United States Patent 11,001,841 (CCCTC-BINDING FACTOR (CTCF) RNA INTERACTOME) - sequence listing, part 12

SEQ ID NO: 29188 - DNA, 1032 bp, Homo sapiens
agtcactgtcccaacttgttggggctctggagagctgtgtctgatacctgaattcatgcagtccccctgccatcagcctccttgtcacctgagcctgcagaggaacttccagtacctgagcctttccatggcactgatttgggcctctgcttgcttctctctgcagacacccagtttcatctttggcagagtatcctgcatgcagtacctggcactgaataggcactctgtaaaggtgtgtctaatgagggaaggaaagcacctcaagttcagtctgggtgttcacaccattgggaaagttggagtggccaactggctgagctaggagtgagtgttggggatggttgtggtcagcacacccctaggaggtggaggtgggagaagagtggaaactgacttcacatttctccagggagggatgctttggaaaaactgctcagtgagatgaagcacagatctgcttttcatcccttttgtacctttttaaagacataaggtatgttttgacactggagtatatatgagggttgctaacgtttgggttgaaagagctgctgttgtccacagcttatttattttccacccatttttgtctcctggtctcatccagttacatttcctgggatatgtttttggaggttgctcagatcacggcactagagtccctttgggtttctcctccctcctctgtctatttggcctcgcccttgacaaacattccccacattcacacccaggcctttggcctaatgttcttgaatgctgcttgcctctcattgaataggcttttatgtagctctcatattcagttcatattttggcattttaaaaaatatatatttttgcttctttctcaactagatcatttcactcctcaaatttgtaattaaaaaaaggaaattctcaagcagttttattcaattagaactttgcaaatatcaaattgtccgtatccttctggattctcgtctgaacattgcttatctgcgtacatatcacagtgttttcacatagggattgctgtatgttgaa

SEQ ID NO: 29189 - DNA, 1048 bp, Homo sapiens
ttgagactagcctgggcaacatacctggacaacatagtgagaccccatttctgtaaaaaaaaaaaaaatacaaaaattagccaggcttggtggcaccagcctgtagtcccaactacttgggaggctgaggtgggaggatcacttgagcctaagaggctgaagatacagtgagtcaagatcacaccactgcacttcagcctcgtcaacagagcgagaccctgtctcaaaaaaaaaaaaatacatacacacacacacacacacacacacacacacacgtatatgtatatatattttttaaattaagaaaaaatgtctgctctatgctggacacttaaagtgacttcccctgggtcctagggtactttctgagccttaatttcctctgtaaggtgggggttgggtaccttagctcacttagttcttgcagcacctatgatgtagctaaggtacaaaaaaggaagaggacaggacctaacctcttttggctctatttaaaaatgaatgaggaactgaatgaacttcagtttgcacattgatgtaggactaggggacctgtttttagaatatgtttggaaatgtttattttttccttttgaaatggcttttgtaggtgtggtagtgggacacagaggagcagtcacagagtgtggtgcaagtgaccacaaaattaagggttaaactttgttgacatgatggaattttttagagtagcagaatcccagagcctgtgccttaaggtaaggctccctggggaactttgtttagaaatgaatcctaaactatcgaagggcttgcaaactagaaaatttctgcatatctcaggccttgagaattgctaatggatatgtatctaaatgtcccttacaagcttgctcctccacgtggccctgtggaacaggtctgttgggttcaggatctagtttggaacagtgatgaaatttcgagctgctgaaccagatatggaactgctttgctaacctggtgtctgcccagcttaagccccctccatcccacagctgtgaaaggaaatcatgcttcttcccaagtg

SEQ ID NO: 29190 - DNA, 1050 bp, Homo sapiens
ttttctgatgtgggattccatattcttcgctgtcctatgaaaatgaggtgggagatgccttgattcaggaagcctgtctgtctaggagccccttctctggtcaaaagttgtttttaaaaaatccttgctgcatttcaacgtgaatgagtatccactgtattcatagcacagtgctagaagctgttagagttgaatgaaatggcctctgctttcagggagctaacatgtaaacatccagtcataatacatgggaaaatacaacagaggctataacagaggaacaactctaaatctttggaggactgaggaagggaattagaaaaatcttcacaaggactttggcatttgggctgaattgtgaagggtgagtaaataggattttagaaggtaaaggagcaggcatggtgtttatttagatagatttagacaaagttgggaataatttggcatgctctaggaatatgtgtgtcagagtactgcataggacagaggttctcaaacttgaatgtgtctatgaactcccagggtatacccccaaagatctgaatgtggaaggtctgggatgttgtccaacaggaacacctaactagtggagggggcaggatcagaggagccttctcagggataagctgaggtcttaaaggggtggaaggagagagcagctgtgttccaggctgagtgaacagccattttgaagggcttgaccagtgctggtgctcgagtgtctgggttttgtgtagaccacactcttgataactgtgctgttcgttatcttccacaaacagggttttggtcaggtgcctccttgcttcagtgtgttctttatcagtcaggattcttggtgataagcagcagaaaccgcttctatctagcttgaacagaaaaggatttgttagaagggtggttcttggagtgactagaaaagctggagagccaatttggaaaatgggccagaaccaaggaggctcctgcttagtactcctccgccttcatgatctgtatattgtctctgctttcctgggtcattccctcaagggtcgcactcctggt

SEQ ID NO: 29191 - DNA, 1050 bp, Homo sapiens
cctgggtgacagagtgagactccgtctcaaaagaaaaaaagaaagtaatgagatggggctgggcgccgtggcttacgcctgtaatcccagcactttgggaggccgaggcaggtggatcacaagggcaggagatcaagaccatcctggctaacatggtgaaaccctgtctctactaaaaataccaaaaattagccaggtgtggtggcgggcacctgtagtcccagctactcaggagggtgaggcaggagaatcacttcagaaccagggaggcggaggctgcagtgagccgagatggtgccactgcactccagcctggcaacagagcgagactccatctcaaaaaaaaaaaaaaagtaatgacatgattacctaagtgcccctccacacagccccaaatctcctttgttgtcactccgagtctgtcttacagcttttccccaagttgtgatgagcataaatgtaaaatccaagaaatgtttattttgtaaggggaaaaaagtgtgggtagaggagagactcagacaaacctaaatatagatataaattcaaatctcagttcagccactttgtagcttatgtagggggctttggcaaattatctaatttctttgaatcttagattcctcacttttttctttctttttgttttttttgagatagcctctgtcccctgggctggagtacagtggagagatcttggctcactgcaacctctgcctccagggttcaagtgattctcctgcctcagcctcccgagtagctcggattacaggtgcccaccaccacgcccagctaatttttgtatttttggtagagatggggtttcaccatgttggccaggctggtcttgaactcctgacctcaagtgatccgcccacctcggcctcccaaagtgctgggattacaggcgtgagccaccaagcccggccagtttcctcacttttaaaacataataatattggtctcagggttgatataacgtactaagtgggtatcagtggtagctacttttatgttgtcctcatggaggacatgaatgaatttaatttc

SEQ ID NO: 29192 - DNA, 1050 bp, Homo sapiens
tgagatcacaccactgcactccagcctgggcgacagagtgagactctgtctcaaaaaataataaaataaaatttatttatttagtgaccttgtctcactttgttgcctaggccgaccttgaattcctaggttcaagcgatcctcccatcttagcctcccgtgtagctggaccaacaggcatgtgcagcattaaaaaaaaaaaaaaaacttactatgtgtaatatagcaaagttttttaaaagttaaaaacatagccttgaactaaaacatcatgagcacatgtcagaaatttattaacattgttaatgaagataacaggatgacaaatggatcaaaggagactgcaagaaactgatatttacatagaaaaaagaatgcaggaataagattgcaaatttaaatacaaaactagggccagattccgtggttcatgcctgtaatctcaggactttgggagactgaggcgagtggatcacttgaggtcaggagctgaagaccagcctagccaacatggttaaattaaacttcgtctactaaaaatacaaaaattagctgggtgtggtggcgggcacctgtagtcccagctacttgggagactgaggcgggagaattgaaactgggaagtggaggttgcagtgagccaagattgtgccactgcactccagcctgggtgacagagcgagactctggctcaaaaaaaacgcaaaactagttaatgtcctacagtgcaatgaaaacaaaagcttaaaggttttcttttctaccagacagaaatgattttaacttaacaattttctgcaggctaacatctaactttacagaatgggagccttaatcggtagtaaatagaaagtcaaacaaggtgatggttccatagagcatcagataacttttaggcaggcagcttagacagtgctgtagtataactttttttttttttttttgagtcaggggtcttgctctgttgttccaggcttgagtacagtggtacagtcgtggctcactgcagccttgaactctggcctcaagtgatcctcccacctcagcctc

SEQ ID NO: 29193 - DNA, 2297 bp, Homo sapiens
ccttaagtgatcctcctgccttagcctcctgagtaactggaattttagtataactttaaagaggcatataacgtttttttttggtcttatttccaagttttagttaatttttctttcctgttttcttgagacatggtcttggtctgtcacccaggttggagtacagtggcacaaactctgctcactgcaaccttcacctcccaggcttaagcaatcctcccacctcagcctgccgagtagctgggcctacaggtgcgtgccaccatgccccctgctaaagtttgtattttttgtagagatggagtctcgctatgttgcccaagctggtctcaaactcctgaacttgagcgatctggccacctcagcctctcaaagtgctgggattacaggcatgtgccaccacacctggccaataattttctttaacaaaataaatcacaattgagttcaagaactaaaagatgactagatcatctgaggtggaaaagagtccctggtaaaagtaattttaaatagttttgaagtagaattgtgaaattcagagtttggagaaaggaagagggtggtcacaagtagaaaagagaagacatggcacttacattcaaagaaagattgccctaccccacccctcaaaggcatgtgcagaagagggagtgagtacttttccagggtggatgatgaactaaagtgggtgggaagtgaaaacctttggaacagaagggagcagttcataggaagcttggaagcttgtgttaaagaatttgatttgattaagggccgggcacggtggcttatgcctataatcccagcactttgggaggctgaggcaggtggatcacctaaggtcaggagttcaagaccagcctggccaacacgaagtctctactaaaaatacaaaaattagctgggcgtggtggcaggcggctgtaatcccggctacatgggaggctgagacaggagagttgcttgaacctgggagacagaagttgcagtgagctgagatcatgccactgcactccagcctgggcaacagagcaagactctgtctcaaaaaaaaaaaaaaaagaatttgatttgatttaaaaggctgttggatgaacaagatactcaaagaagatgttcgtcactgggtaggaggctatggttgaaattaaggcagagtgtggacgggagtgaagaggtaaatccatgatgctaaggaaggagacttgagtgaacttaaggcaggaggaaaaagaaagagcaatggaaagtggagctgcagatccctctcctgttcaaactatgagagctggctcaggtcccctgctatagtgggccagaaaagcctggacttccactgctttttcctgcagagctgagtccctccagggctgccatgagaggcggggagagagagcactagacagagaagaccagaagaccatttgagaattcctttgggtttccttcatgattcctttttcttctcattctgaattgttttattttattatgtaatattcggtatatgcaaaggaatatatgacacctttgtgtgtattacaaaacaagcatttgagaatccgcacctctccacccaatttttctttgtggtttctttgccagtaaaagagttcactcatctgttgcttaaaatataggatgcttgagtcaccagcttgccatcctgtgtcattcaacacctcctccagactcttcgcaggaaggtgacccagaaaccccttgaaggacatgataccgtccctgtgctctgatgtgccccctggtgtttgagtggagtgatttttagatagcggtttgcctgttaaaaccttccctttgttccctatattattgcttgcattttagggcttctcagttgaaggatgtggttgaaagagcccagttcctcagctgctcctctgggtgactagagtgtgggtaactgatgttttaggtcctggagaaagcagtgatgatcacaaatagtagaatggagaaatggttatctcatattgatcttcaggtttgttactagtctacatttggttttttaaataattattagaaaaaaacattgtgggtggggagataggatcattatgatgaaacagttctgtacattcaatcaggatacttgttgggaattagattttgcatttacctccctcactggtgtggtccatctcattttcagtggcctacacacatcacacaccattattatttccatgttcttgtacttgttgggcagctctaatatgaaagataaaatgaacgaaaagtacaaatgaagaaagtttaggtgactattc

SEQ ID NO: 29194 - DNA, 1026 bp, Homo sapiens
tcatttatatgctttctaaatttttctttagtgaatatattacttttatgattttaacaaattattaaaaacagggccaggcgcagtggctcacacctgtaatcctagcactttgagaggccgaggtaggcggatcatctgaggtcaggagttcgagaccagcctggccaacatggtgaaaccctgtctctactaaaaatacaaaaattagcagggcgtggtggtgtgtgcctgtagccccagctacttgggaggctgaggcagaagaatcacttgaacccaggaggtggaggttgcagtgagccgagattgcaccactgcacgcctgggcaacagagcgagactttgtctcaaaaaaaaaaaaaattattaaaaacattgtctaacacaaggtgcataataaatacaaaatataagaataaatgacctttgtaaactaggtttcccagcccctaatagggctgggtaacaaatacctgttaaaggattattgactgaatctgtaatttggagaaactgtaaccctatttggaggcttcacattctttattcttgaccagaattaatttaaccagatttcaggttacctcattctcaggtagatgctgaaggctgagctgagcaaagtgatatttatgttacctccaagccacaagctccataaagttcatgtgaactcagggtctctttgtgagtcatggggctgcttgcaatgcacggatgataacaggaacctctaattttggttatttgcttttagagaccagaacccagatacagtttcctggggcctcacctactttgttaagcaacttagctataagtttacaaagcagctaaaaacaggagcaggggagtgagatgagcttgagcgtgccagcctagctcgtgggaggcctgtctctggccctgagctttgtggcctgccgtaggaactggagcttcattttcaaagctccataaaactcgccttctcccgggcctcccttttctgagtttcatggctctctgtggaaatgacagcct

SEQ ID NO: 29195 - DNA, 1083 bp, Homo sapiens
aacccccgcctaccaggttcaagcgattctcctgcctcagcctcccaagtagctgggattacaagcacctgccactgcacctggctagttttttgtatttttagtagagatggggtttctccaggttggccaggctggttttgaactcctggcctcaaacagtgcatcgatctcggcctcccaaagtgctgagactacaggtgggagccactgtgcccagctgggggacgtgtattatttttataatcacaaaaaacgtctttatgttatatatcatcgtggactatatcctcttttttctttttttttttttgagagtcttgctctgtcgcccaggctggagtgcagtggcacgatctcggctcactgtgcaacctcagcctcctgggttcaagcaattctcctgcctcggcctcccgagtagctgggattccaggcacgcgccatcacgcccagctaatttttgtatttttagtagagacagggtttcaccatgttggttaggctggtctcaaactcctgacctcatgatccacctgccttggtctcccaaagtgctgggattacaagcatgagccaccacatctggcctatattttcttactaacaatttatcttaaaaaaatcaggtttattatttttgcttctcagccatgtgtctggctttcctgagtcttttctctcctctctgccatccaccctacccatctctgctctgctcctgctgggccactggcaccaccctcttgaaagtctttcaacctaaaaacccatgacctggctgagcaccatggctcacgcctgtaatctcagcactttgggaggctgaggcaggtggatttcttgaacccaaaagttcaggaccagcctgggcaacatggtgaaaccctgtctctacaaaaaaatacaaacaattagccaggcatggtggcacacacctgtagtcccagctactcaggaggctgaggcagcaggatcacttgagcccgggaggtcaaggctgcagtgagctgagattgcaccactgcactccagcctgggcaacagagagcaaccctgtctcagcaaaaaaaaaaaaaaaaa

SEQ ID NO: 29196 - DNA, 1062 bp, Homo sapiens
gcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaaggtgggtgccaagcaaaattgtgttttatgttccaccatctcccctctacctgtttttgcctcaggagcctagagaagtcccaggctcaaggtaagtgaatacaagaccgagttagaggtgcttttttattaaagcatcttggtgtcatgtcaagattataaaatattaaaaaacataagggactggtgagggttgataaggcagtgacccgctgagacctttgactcctttggctatgctctgcagtgatggggactccactgtcagaggcagagaaagatgcctgccactcagtagttccagatacaggactgtgtgtaccttggagtcagctgatggcatagttttagctgtgtttaggggttaccttttaaggaaaagaaagaaaaaagaggttgagtctttgaccagcaacacatagaggaaactgatgttccaaatgtttctggtgtttcagtgtatgtgtcttctagaaagtaggagattttatttttaaaacctatctatgtttaaaccctattttgaaagaaaatttcattttccttgcctacaaatctgaaagctgtacatcctaagtaaaaatctatgccttaagataactgtccaggctaggcactgtggcttacgcctgtaatcccagcactttgggaggctgaggcgggtggatcacgaggccaggagttcaagaccagcctggccaacatggtgaaaccccgtctctactaaaaatacaaaaaattagccgggcgtgctggcaggtgcctgtaatcccagctacttggaaggctgaggcaggagaattgtttgaacctgggaggcagaggttgcagtgatctgagatcgcgccattgca

SEQ ID NO: 29197 - DNA, 1015 bp, Homo sapiens
atttgccttgtcctcagggagcatagttggcaaggaatctagacagcagcccttcttgagcttgacattgatcttctcatgaggaggactgggctccaggtggggaaagaaccccatcctcacttgtgggctagacgacctgggagtccacagacactgaagacacatcattcttcctattcatttcaaccttccctcgacagatcttcctgggaccaggtcttcaggacagtgtgagctagggtgagctcctgagctggtcttgggggaagtcagggtgggctttctggggaaggtgaatctaggctgacagcaggaggcattgatgagatctctctccttttcagtttattgaagtgctctgggctgatgtcattacatttgtaacttccatgccccccaaaaatgttttgaagacattcattttatcaaaatacaacatacatgcagaaaaatgcccacattttaacttacggcttgaagtgaagttacccatgcaacacccacccacatcaagaagtagaacattcccagcacccccagaagccttcttgaggccctccctgctcttcctgccccaaccaaggtaaccactcttctgaattctgtcactggagtttaatctgtctattgttcatcatttcagtaaacttatcaaagtacatgcttagaagtctggctgggagggccgggcacggtggcttacccctgtaatcccggcactttgggaggccaaggcgagcagatcacctgaggtcaggagttcaagaccagcctgaccaatatgatgaaaccctgtctctactaaaaatacaaaaattagccaggcgtggtggcatgtgcctataatctcagctacttgggaggctgagacaggagaatcacttgaacccaggaggtggagggtgcattgagcggagatcacgccattgcactccagcctgggcaacagagcaagactccatctcaaaataaatacatacgtacatacaaacaaaaattagctggatgtggt

SEQ ID NO: 29198 - DNA, 1044 bp, Homo sapiens
ccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattct

SEQ ID NO: 29199 - DNA, 1152 bp, Homo sapiens
tcgagctccactaggccgaggaccctaaaccccgaagaaaggaaaggcctctcaccgtcctttcgccgccgccccgcgcttcctgatgagttcgtccagggagatgtccgccatcttgctccgccgagcaagccgaaagcagtcgagaccccgcgagcccgccccttcggccgctagggagcgacgaactacttccggcgtccgcggaccaactctcgcgacagccagctcaaagcaggcaagaaccggaaggggcggggacgttccccgtgagccttcgcggtgctggctgctcatctgcatacggaagttcggcacattatgaattatttattttcctcgagggaaaaaattaaatgaaaagcaacaaaatacattattaacaagtgagacaaacttcaatggaactggatcatgacctcaacagtcaactacgatagtcatcatacgcctaatgagaatagaattcattacctaggaaataaactaaaaacgtccttatgccttaaacttatgagtaaggaaaataacgattcggggtgacgcccgaatcctcactgctaatgtgagacgaatttttgagcgggtaaaggtcgccctcaaggtgacccgcctactttgcgggatgcctgggagttgcgatctgcccgaccttattcacgcctaaaaagtagactgactgtggggtggtcgtgttttttgtttcttgttggtaggtggtgaatgcgtttttttcgttgttttctccgttactcaggctgccagttgcttggcagtcttgtcgctggctgtggacgctctgcacttcatcaccgtccccagctgcgctttgagccggtctaaggttgcccacagtattgacgttgggacccacgaaactggcaatttccatgtgtgcggccttacccagttctcccaaacttctgcgtataaccgcttctctgtgcttcagaaagataagtccggccccggcctcacacagcagctcagttcgtgacagcgtttaatatgtaaaatggagcaaataatttatagggcgttgggagagttaaagagactaattcatttacgtgttaaatacagggaatggcttttgcattgatataaccccagcctccagcatgcgccagacctgacgtaggtgttcggcac

SEQ ID NO: 29200 - DNA, 1047 bp, Homo sapiens
atggaggttctgaagggtggggactgtctctcacacacagcctggccttccaggtgcccatgatgggtggaaagtgtgaacttacaacttgtaaaggggtcttccttttacaaaaggttctttccctcaggcctcgcccctttgctgcctggaagtgtttgcagatgtcaggaccctcactcaaggaggaatgggcttcagactgagggaggaggagcatttgcatgggggtgagagcatgaatcgaagcccatttgctgctggtattttgggaactcacccactgcacaaagcgagacaccttggttggccggtgggccaggtccccagagtttggtgatcatggctgagagatggactgtgcacctatttggtgcgtttggacagggtcgttttttctatgaagctcaggtttactgagcatttagtatgtgctgggtgctgttctatacccttcgcatgtattagtaactcatttaatcctcctgacaatgaggcaggaactattatcattcccattttacagaggagaaaaccaagtcccagagaagtgaagccacttacccaaagtcacacagcttgtaaatggcagaactgggcagtgggaccccagtgctgaactcttggtatagctctgtgttgcctctccttcttgaggtgaagcctccctaattggaagtaagggtgtggacgatgctgattggaagtaagggtgtaggcgatgcatttggagtctggatctgcttcctgcctgggtgaccacagcagccacgtggcccctctgggcctcattttaaaagggggcggttaggctcccctgcctcgcatccctccaaatgttgttttgaggctctgttggaatggaggaaagaatcaccttgcaaaatgtaaagtgctgtgtacctgttatgattgcccccatgaactggcgtctaccagatctgggctcccctgggtaggggtggggtgttgggaggaagacactggacctgaaccttgaggttgagttggcagggaaggcagtggaacaacacatgtgttacagca

SEQ ID NO: 29201 - DNA, 1024 bp, Homo sapiens
ccggccttggccttctaaagtgctgggattacagatgtgagccactgcgcctggcccctacgtattatttttaaacccatttctctcatcacctcccataaaaatgtaacagtatatttttatgcgagtaaatgccatttttaacaggtacatatttcatattattgacatcctatattttagttaataggcttaatttgttagagcagttttaggtttacagaaaagttgggcaaaaagtacagtgttcccgtataacccccatagcttccttattattagcaccttgtgttaggatgcttcattggttaggattggtgaagcaatatgataaccttattaactcaaggccatagtttacatgagggttcactcttagtgttgtaccttctgtgggctttgacaaatgcatgatgtcctgcattcaccattccaggatcacacaaagtggcttcactgcgctaaaaatgctgggctcccttcatccctcccaccagaccactggaaacgacaggtctttgaactatccatggagttttgccttttccagacagtttgggagttgggatcatacagtttgtagccttttcaagttgtcttcttttccgtagtaatatgcacttaaggtccctccatgtctttctgggacccaataacttgtttcttcttattgctgaataatattcctttgtctggaagtaccacagtttgtttgtccattcagctgccgaaggacagcttggttgcttctagtgtttggcagtgatgagtaaagcttctatcaacattcacgcgcaggttgttgtggacagcttctgggacataagttgtcacatctgctgagtcagtgccggggagcgcagttgtttggtcacgtgttaagagcacgcctcccctttgtaaggagctgccaggcgagcttccggggtggccgcgtccttttgcatttccccagtgaggaatgagagagagaaagtttatcatcttaatggctgcgtgttttgtcttatgacacactattatc

SEQ ID NO: 29202 - DNA, 1002 bp, Homo sapiens
cagggcaccccttctggtccctgtctgcatgctcctgctcctagcggtgctccctgccagggccccctaggacaacagatctgtgcagggtcggggacaggcgtgtcattctgcagggcctggccgtgtactcctcattatgagtccaagacacacccccttttatctgtgtgactgtattagcttcccagagctgctgtaacaaagaccacaaactcggtggcctaaaacagcagaaatttgttccctcacagttctggagccagaagcttgaagtccaggtgtcgctcccaccagaggctctaggggaggagcttcttgaagcttctggtggctctttggcttgtggctgcatcactccaatatgtacctccccatggctttcatttccacgtccaaatctccctctcctttctctctctctattttttttcctttcttgagacggagtttcactcttgtccaggctggagtgcaatggtgtgatctcagctcactgcagcttctgcctcctgggttcaagcaattctccttcctcagcctctggagtagctgggattacaggcgcccaccaccacgcccggctaattttttgtacttttagtagagacggggttttgccatgttggtcaggctagtctctaactcctgacctcaggtgatctgcccacctcggcctcccaaagtgctgggattacaggtgtgagccaccgtgcccagcctcttttttgttttcttttgagacggaatcttgctctgtcacccaggctggagtgcactggtgcaatctcagctcactgcaacctccacctcccgggttcaagtgattctcctgtcgcagcctccctaatagctgggattacaggcgtgcaccaccatgcccagctaatttttgtttttgtttttgaggtggagtctcactctgtcacccaggctggagtgcagtggtgcaatctcagctcattgcattctccgcccccacaggttcaagcaattctcctg

SEQ ID NO: 29203 - DNA, 1002 bp, Homo sapiens; identical to SEQ ID NO: 29202

SEQ ID NO: 29204 - DNA, 1002 bp, Homo sapiens; identical to SEQ ID NO: 29202

SEQ ID NO: 29205 - DNA, 1002 bp, Homo sapiens; identical to SEQ ID NO: 29202

SEQ ID NO: 29206 - DNA, 1034 bp, Homo sapiens
tactcttgctgcacagatgctccccacacacagagatgccccagttacgctggaccaaacccaactgccaccagcgccaatacccattgtgttccaggcacttcactttgtagccactgtgtcctccctcaccacccaagctgggcatcgctgggtgatgaattctagggcagcctcctctctcagggtggacatcacaatggtgcagtctgtcactgtctggtccctggtggcaaagggaccgggtaaacccgttgtcaggccaccttggggctgtgagatgtctgtaaggtcggtagtgccagtatggtaaaggcatttgaggggtgggcaggtcggtgcacaagatcagcgtccaccctgctgtcaaccagggcagcaggagcatggccacctcagctgcaaatcaggagggtttccattattggacccaaagatcgcagaaaacccagtggaggcagtttgcaggcggtactaaccacacaatgcatttgctctgacacaggaccagggcacgtagtagacgggcaggggtcagggaacctgcctggggttctgggccaggctacatagggataaagcaagccccttaaccgactggatcccaggatcctggcccataaagggagagggttggaagaagatcttccacatcccttttgccctaacctggcagtcatacacccaaactggggggtagtgttggctttgtggttttaataaggttaaaagcaggccaagtcttagctcaagaagctggcaggctgagttaattccggagaaaacaaacgggaagcccaagaccttggacatagatcttttattccctcctccttgaaattctccatccccaagcgcttattaatgtggaatttgctgcttgggggagaaccaactctccgacttcagaaacatttgtaagagcaaatttaataaagctaagaataataccattcagatgtaattcctttattttgcatgattattccttcttttctatcgcaaggcatttgaaatgcaaggagttattgaga

SEQ ID NO: 29207 - DNA, 1113 bp, Homo sapiens
gaaagtatgaaggcagagtggcaaaaaaatctagatgatttaatcaaattaggctaaataaatggttcaattattaactttctataggttctcttgctgcaaatggccctaccaccttggttgataaagtttcaaatcccaaaactaatggggacagtcagcagccctcctcctctggccttgcttccagtaaagcttgtgtcggaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacgggaacagtggcaggaattctgaaagtgaatctaacaaagtggcagctgaaacacagtctccttccctttttggctcaacaaaattacagcaagagtcaacgtttttgtttcatggcaacaaaactgaagatacacctgacaagaagatggaggtggcatctgaaaagaaaacggacccatcatcactaggagcgacaagtgcctcatttaatttcggcaagaaagttgatagctctgttttgggctcattaagctctgtccccctgactggattttctttctcccctggaaactccagtttatttggcaaagatactacccagagtaaaccagtctcttcaccatttcccactaaaccattggagggccaagcagaaggtgacagtggtgaatgcaaaggtaagtaccagctttgtcgttgagtcgaggtttgcataagattcttgtttcttgggaaacccagagactttgattccaaatatgagtctggattcacattgagacgttgttctctccatgtgtgatctcagacagagctaatcagcttctctgagtttcagattcctgctttataaaagagtaagacttttgtagggttgtttataaggattaaaaataaaatgaatttgaaaacacctgactttgaaaagtctcaaacacacatggtttagcatataaaaaacaagtgaattaaagacgttttttgaaaattgtgtttttggaaaagttcatcaagttcatcatgaatgtcccctgaattga

SEQ ID NO: 29208 - DNA, 1058 bp, Homo sapiens
tccagagcgtggcagtggtgtctaagtgatgtttcctgtgtgtatcgtcagtgccccagacaaggcacaaggtctgggccctccagacctctgttgttagcttaaaaagtggggtgatgtcatgatgctgcttcctcacatggtggttgtgaacaggtgatgtctgtgaagacacctacttctaagcagttgaaagtgaggccaggtgaggtggcccacacctgtaatcccagcacttcgggaggccaaagtggaaggctcacctgaggccaggagtttgagaccagcctgggcaacatagcaagaccccatctctacaaaaatttttaaaaattagccaggccaggtggtgggcgcctgtagtcacagctactctagaggctgaggtgggagtatctcgagctcagaagttcaaggttgccatgagccgtggttgcatcactgcactccagcctgggcagcacagaccttgcctcaacaaaagaaaaagtgtacttctcagacatatggacatactgatccttgaggaagaaaactgcatttgccaatttgcctctgaaatattacggttttctatcaggagtctagacttccattactgttttgccttgccctgctttcaagtatatcctcaggcacgggccctctgggcacagggtgaaataagggtctccccttttctttcttctctgcctcccataaataaaacaaatggggagtctttcctgaggcaggcactggggatttgaatcgagtcccagtggaggcaggatgcccctcagtgagcgcctgttccttgtcccttggttatcacagtttaagcatcagaagactcgggagattggagggataagacggacagtcgtgtgacctaatcatctgagcatcacagttgtttttcttagaattgctttttggtgagtttttatgcaactgccgttctctttaagaggatccttttatatatgtggggttttttatttttttgagacagggtctcgttctgtcacccaggctagtagtgcagtgacgcaatcatagctcactacagcctctac

SEQ ID NO: 29209 - DNA, 1050 bp, Homo sapiens
tttgttttactacctgtaaataacaagttcgattttggtagcttgtattttgcattgaactccgtttgatgaacgtttacgtagtgctggatgccagggtttgaagaataagacagtctctagctactctatgctagtttataaaatgctagtgatcttaagttctaagcagacagcatcctggtaagagtttggctttggattaaaaaagacaggaactgcttataagaatctctgctggggccagattttgctttcagaaatgctgataggtccttgaaaaaaaagaagggttgctatgatgacttggctctgggcccacacaccgtggtgacgacatagtcactaaggaaaccgagagatgcagcgtctgaaaggcctccgaagggttttgttactgttttctgggatctgattggcttagacggtgtttggatgggagcagaacgctggagcttgctgtcctgctgaaacttctaggacctggtgccgagtgcttttgagatcaccttacttggattttggtttaaaaacaagggggagatttagggtaatttctagattattgtgagatttgactctgatgtttaggctgctgtaaaacaggaaatgaggtaatgtctttaaacatgtagtgtgataatgaactgtaaatgtctaaatatgggcaactgtgcagttcaagttgcagagttgctgtgttgagtttttatataattgggtactttccgtgttggctcctttgatccttaaaagtatgcatcagtattaaagtctagaggcccatctgcctattgaggttggactccgtgtggttgtgtttgaaatactgtctgaggagccagcaccagacctgcagttcaggctgagaaagaggttttgagcacttaagcgagccacagaccacccaggagtgcgagctgtggcctgttacgtaagtgttaggaatagtgtgatacctcgttcttttgagaaactttgaaatcacttaatttcggagttaaatatagcctgcaaaagtttaatttgttcatactgtttttgaagatg

SEQ ID NO: 29210 - DNA, 1066 bp, Homo sapiens
cccatggagtccctggacttgaaggacaagaccaaggtatgggctgggggtgcgggaggcctttggccggcggcagaacaagcccatggagtccctggacttgaaggacaagaccaaggtatgggctgggggtgcgggaggtctttggccggcggcagaacaagcccatggagtccctggacttgaaggacaagaccaaggtatgggctgggggtgcgggaggtctttggccggcggcagaacaagcccatggagtccctggacttgaaggacaagaccaaggtatgggctgggggtgcgggaggcctttggccggcggcagaacaagcccatggagtccctggacttgaaggacaagaccaaggtgtgggctggggctgcgggcagcctgcaggtgtggggagttctgtgccctgggagctgctctcactttgtagcagtgaattactaataaagtagccaggcatggtggcgcctgcctgcagtccccgctactggggaggccgaggtgggaggattgcttgagcccaggagttccagactgaaatgagctatgatcatgccacttattccagcctgggtgacagagtaagaccctttctcttaaaaaaaaaaaagtaataatggaaagtggcacactggcaacttgggaggctgaggcaggagaatagctggaactgggagggagatggttgcagtgagctgagatcactgtactccagcctgggcaagagagtgagaccctgtctcaaaaaacaaaagaaaaaaaaaaagaaatacctgagactgggtaatatataaagaaaagagctgtaattggctcacggttccacagctgtctaggaagcatagcagcatctgcttccggggaggcctcaggaagtttccaatagtggcagaaggcagagtgggagcaggcatgccacatggcaacagagagagtggctggggggtggtgccacatgcttttaaatgaccagatttctcaagaagtcactgtcacgaagatggcacgaagccatgagggatgatcctgccccgtgatccaagcacctcccaccaggcc

SEQ ID NO: 29211 - DNA, 1045 bp, Homo sapiens
tagggcaacagcttcttattaagggcagaagaaaagagctcctgcttgccatgtgtcaccctctgctcggagttccatattctcacctgacttggtttttcatggcagcatgcagtgctagtaagtagatgatttcatagacgagatgagctgagctggcacaggcacataacgtgcccagacattttgaagctgggattgggatcctggcctgactgcagagcaaaatacaccatttggtgcatcctggcaccggcccacatgtgtggctctgcagagaggcagcgggcttttctcatctctgcccccgtccgccgcttctcattccacccccacactccctggaagaacaggacccagagtaaccctgcatgtgctcgggctcctagagtggggctgagcagctttctgtcccactgagcctccctttccaggttggggcaggcaagtggattcgacaggctgccagaagactgcaaggtcattgggagttttaatctgtgactgtgtcatgaaggacatttgtactcgaattcatggagtgccactcctgatgggagaggaggcccatgacagtgacagtcatgctagtgatcgcggacaccacaccatgctgcctttgccagctggctccttcagcgagtcctcgcaccaagcctgggaggtagaggtgagggcagcgagcagcgcaggagtccgcagcccgcgcgggctgacctgcccagaagcctgttcccagtccctgccgttcccagtcactgcctcagggtggccgaggaggacgagctcttggtgtctcggctccactgactgcttttctttctccttcagatgctgatcgcgtggacagcaccacattattgggtaaagcagatctttcttcttgccagcctgttttttgcctacacattccattgtcttctgtcactaactgtaaaatcataaacgtttgtttttcaccttaaataattagcttgtattaaaacagccccactgaagatgataaatagccatgccttagcatggtccctgccacaccaagaga

SEQ ID NO: 29212 - DNA, 1008 bp, Homo sapiens
taaatttaatgagactcggtggccatgagcgtcctcctgtgtgtgcgctgggcaccaggtgcctccccttgccgaatcatttgggtaaaagggactctggtgagtggcgcggaggcctctgtgcgcagccctgttttccctggctgtttggcccagcgcgttcacagatgggaaaacgcgcatcgatgtgggagctgctcgcctcacatccatgttagtggtgcaggaagtatgaaaccgccgcagtcggctccccgttgccacctattcccatgcgaaaggacatcttcattacacttgctttctcactgaaatgcgactcctggaagcatggctctctttggagagaagccgtagcgtggttgatgtcatctctagtggatggcagggtctgcttggccagtgcttcagtaaggtcacattatgaactgtgccttggcgagtggattctgaataaacaagcttcttaataaattcttctcttttaggtaatgcatgccaggactgtgcaaagaggaagttagaagagaatggaattgaagtttcaaaaaaacgcacacaatcagatactggtattgtgtctgttctttttgtggggagctgcctcgggtctctcttgttggcaggcatcttcagggaccgtgctgcgctttaatgccccgcgccctatggtgggaggacggtgcatacgttctgtcagggccagagagcacaggaggcttacttagcagagaccctgacctctcaccccaacccgattccaactgcccagagctactggtacctctttagaaaaatgttacggagaaaacatacactaagaaggtgcagcgggcagaaggtgctctctccaaaaagaaaagttaaaaagatgaataaaaagtgcacaagttacataaggtcagctccgcatttttgcgaagtgaacgctcccatctaatcacacgcagttgaggaagcagcattgccaggacaccccttgtcactgtccagcctcctccagccccc

SEQ ID NO: 29213 - DNA, 1123 bp, Homo sapiens
cgacaggcttattcttctccatacctccaacaggctctcactgtatgtttgttgaaattgccccatcctcagtccactaagaaataaaagagcatccatgttcatggattgagattcccacagatcgttgcaaatgtaatgtcatcatttgcttgatcccctgatagtactgataattacacaaggtcatttccagacagtggctactgtttccattgtggaggggttttcaaagtcttccgtacataagaacaattgtaaagcagtttctgaaatagaaatctattgcaaataacttcttttagctggactttaacccttgggcatttcattcttttatttaaacagatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagacactttttttttttgagtcagagtctcactctgtcacccaggacagagtgcagtggtacgatctcaagctcactgcagccaccaccgcctgggctcaagtgattctcctgcctcagcctcccgagtagctgggattacaggcgtccaccaccatgcccagctaatttttttatttttagtagagttggagtttcaccatgttggccaggatggtctcgaactcttgacctcaggtgatccacccgccttggcctcccaaagtgctaggattacaggcatgagccactgcgcccagcaaaataaacacattttataatttgtatgtggaaacatgttactatagaaagcattttaa

SEQ ID NO: 29214 - DNA, 1033 bp, Homo sapiens
agtctctcctctggaaagagtcatgtcggctgttccctgacctgctgggctgggctggccggcagcatggccgtgcctctgtcatcaggggctgtctttcttgcctactggactgtgaaggcagggaccctgtctggacagggaccgcatcagcatctccagcatgtggctggagcagggatccatgtgtgcttggatctcaggggctgagccgcagccctgtccaagctggattcagatgggggaggattcaggtctttcttctaggaaggagtggggtgtggactcgcagctggggtctggtggggttttcagtactggtttgcagagtgactaagggatgtgcccccagcctgatgctgtcgtcaagacagaaggacgtgcgtgtcctggtggtgcatctgggagggccctccacccgctgagtggtgagccacctctcagcttgttctcttccctgcacagtggacgcggatgtcctcctggaggcctgctgtgcggacggacaccggatggccactcatcagaaggactgctcgctgccatatgctacggaatccaaagaatgcaggtacgtttgccagtggccactgtttcactggaacaatgttcctttagagaaaagtgggggaggaagggacagtgtgtgccagacctctcgggagaggctggacacccaggcccggatccatccaggctgcgggtgctgcagtgggtgactcctgcctccctcctggcaccggcctggcaccgggccttggctcacccttcctgtgccactctgtgattgtcggggtatgtgtctctttcactgggctgggagcaagaagatctgggcttgcagctgtgggcaagtcagttttctcttttaaaaaaggggggacagttgtgggggagcaaaggagatgatgtgactaaagagctttgcgagtggaaacacggaccacctacagaccccaaaaatgccaatgagccggcgcagagtgaagcgttccaccagccggtttttcagcttctgcagcagccaacatct

SEQ ID NO: 29215 - DNA, 1063 bp, Homo sapiens
caagtcactttgcattccttgtctgagaaatgaggctggaggccaggcgcgatggctcatgcctgtaatcccagcactttgggaggctaaggcaggtgaatcacttgaggtcaggagtttgagaccagcctggccaacatgacgaaacctcatctctacaaaaaatacaaaaattagccgggcgtggtggcacatgcctgtaatccctgttacttgggaggctgaggcaggagaatcacttgaactgggaggcggaggttgcagtgagctgagatcatgccactgcaatccagcctaggagacagagcgagactccatctcaaagatgaaggaaaaaaaagaaatgaggctggaggaggtggaggacaaaggacatgagctggccttactaggagggtggagtgtggtgccactgtgttggacattgccctgagtcagcccacccctcactttcagatgtcaacgagtgccagcgctaccccgggcgcctgtgtggccacaagtgcgagaacacgctgggctcctacctctgcagctgttccgtgggcttccggctctctgtggatggcaggtcatgtgaaggtgaggctggggccccgtccactcacctcccccaggtcaccttcctcctggggaagccacccttctgcagaccggtttgcagcagatccgcgatggtttccctgttaaatgacatgttagcaggggaagtgcctgtaaaatattgttcatcagagaggactgcccgcctgcccacccgatttctcctgatgacatccaccctccgaggccgtgtcggggttcataggctgcggcagaggccatgcgggatgtggctaggattatggggcttggagcatgacacccacgagtcacagggccttggttatgcccgacctctccctgcctccgtgtcctccccggggagaggggttgatgtgtgaaacagcagcgaaaactggacacttgttttgcacaaagacagtgtgtgggttttaatcagatgctgcctaggggagacaggcctctgtgtccattgatctcaagtcacccaaacaaaagg

SEQ ID NO: 29216 - DNA, 1035 bp, Homo sapiens
tctggggcaggccaccgccagcagcacccgtgcccaccttctttcctgcctctgttttgggcccctcccaggcaggactcccccgttcagtgcccctgactcccaggccagtcctttctaagagcttggaatgatcactagccaagtaaatgcaaggcctcctgtcagtcctgacaaacctggaaagaggaggtaaaaggagaccccagtctcgataaatgcctcaagcaagtccaagtaacccagcacgagacatggaaacttaaaaagccaaaagggagatgtgatagaaggccaggacgagaggatgctcctgacctcagaatccagacacagcccagatggcagggcttcctggagcacctgggccaggtcctctggggctccgcacctgggccctgcttcctcaggcagccaccttcagagtatgatgggccaggagttcagtacacaggagacgacccctgtcccatcttgtgacaagaaattagaacttgttactatcctgtagcggaagataataccgatctccatcctgtcacaggaggttagaatctgtaacaggaagttggaatctgtgctcatcctatacaggaagttaggacccgtccccgtctccaccacaggaagttaggacccgtccccgtctccaccgcaggaggttaggacccgtccccgtctccaccgcaggaggttaggacccgtccccgtctccaccgcaggaggttgggacccgtccccgtctccaccccaggaggttgggacccgtccgtgtctccaccgcaggaggttgggacccgtctctgtctccaccacaagaagtttggacctgtattagggttctctagagggacagaactaatggaatatacatatatatatatatataaaatggaatatatatatatatatataaaatggaatatatatatggaatatatatataaagtggagtttattaaggattaactcacatgatcacaaggccccacaataggccatctccaggctgaggaacaaggagagcagtctgag

SEQ ID NO: 29217 - DNA, 1027 bp, Homo sapiens
atggtgttggaagaggctagtgcctgaatcagcagcctggaggtccacggcgcctcccgcaggtgagtgaggtgtgcccttcgtgttggctgaatcggccagaggggcggcgggaggccccgcctgccagccccgcatccccgcgctctgccgtttctccgcttgctggaccggccctaaccctcttcttgtctctctgcccacttttcttgcagccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtgagcctcgcgtgccttggttttatttggcatggttgggagtctgtgccgcttgttacccgggggtgagctgggcactggccaccgcctggtacccccgagggctgactgaggagcgctccccactagagggtgtgtgctcgggggtccctgttcacagagcccactgtctgtgccgacagggaggccaggccgggtacatcatttcacatgtgttaacttgtcttcatttgtgttgaacccaaagaataaaggtggtggtggagaagggccctcagattgctgagcacagtcccctctcgttttacagatgtggaaactgaggcccagagagaaggggaagggttggccagggtcgtctggcc

SEQ ID NO: 29218 - DNA, 1030 bp, Homo sapiens
ccattgtgggaattttaaatatgtccacaaattctttgatactctgaccttctcaagaggaggaggttaattcttttctccttgagtgtgggctgaacttagtgacttgctcctgaagagtagaatatggtagaagtgacagtgtgcgacttctcagactaggtcataaaaagcatcgtagtttcctctttgctagctctttcttgaatcacccactctgacaaagccagctgccatgtcatgaggacactcaagcatccatatgcagagagctgtgtggtgaggagctgaggcctcctttgaacagccatgtgatgaactaccttggaagcaggtcctctgagctccagtcacatcctcagccacgtgtgcaacctcatgagacaccctaagcctctcagatctgtgtgagatcataaatgttattgttttaaaatgctaaattttgggctaatttgctatgtagcaatacatcattaatacaccagtcttaattctccatgctgtgtattaaatgcattctgtaacccacttcttaaacagtgtcttggtcactaaaataatttaaacatattgcttatggtcatataatatcagtattgagatattcctcagctgtttcttctctgtgtaagataattcttttttctcacatttgttttatactttttgtttaatgtagatatcaccgtatttcacatttgtttaacaagtgatttatcttgctgtgagtctttgcaagtcatgttaaattctttctgaacaagtaagacaaacatttaaaattctattttagttgctcctttaattatttttcttttttttttccgagacagggcctcactttgtcatccaggttggagtgcattttttctagagaagggggtctcactatgttgcccaggctggtctcgaactcctggcctcaagtgatcctcctgcctcggcctcccaaagtgttgggattacaggcatgagccaccgtacctggctagttgcctttatgatgcatccatgaggcatctccaga

SEQ ID NO: 29219 - DNA, 1042 bp, Homo sapiens
ttcctatttactaccccttttgtttttcattccccttcttaatgttcacattcccatcttgatctggcttagatccatggatgagtaataagagcattttttaatgtacatcctcaactccactgcctcctctctaaactttgttatgtttgcctggtaaaactccagctctggtcaaatccaacttgttacctttgcgacagtacccaaatagctgaacaaggctagagaaaaacatacagccgtgcagactgctctcactttaacttgctgatcactaactaacgtggcccttaatgctacctgtcagtcccgctgtttgccctggtcccttgactctcctgctccccgagtcaggtatttcatgctccaccctcttcaaacctccatcccatctccctcatcctcactctcagctctctgaaaataggagcaactagaagataatttccaggaactctcatcaccctctctgcccacctacttgtatctgtgcccgtagcctgcctttgcttctggtctgtggattagcgatcttgctctgaatatgagctccccttaagtttgcactaaattccattgccttttgcacacattgctccagcagtcttcttctctccccccttaaaaatcatcagttttaccctttctattggattgcactcatcagtttatagatctgctgtaatttttccatactaagaaaaatctctccctccatttccctgagtgataatccttcccggatctcagaactcagtcctcagacctcttctcttttctgcctatatttactttcagagtattctcactcaatcttgtggctttaataacttccgtttgctggtgactaacatttttctttagctggacttctttgtttttttttttgagacagggtctcgctctgtcacccaggctggagtgcaggggcacgatctgcagccctgacctcccaggcataagcagttcttccaccccagcctcccttgtagctgagactacaggcatccaccaccacacccggctattttttaaattt

SEQ ID NO: 29220 - DNA, 1103 bp, Homo sapiens
cacagcatctttcttctttgattttgtggaacctgctttttattaaaaatttttacttgaagtcagaagccacaaacaggatgctcactttccttcctggacttggatgtagacagagcctccaggcttccctgtcaccactgtgacgggtaagcttgggctggtccagaagccacttgagggactcccttcggttagacacatatacccgaggctttgatatgattaatgagatttttaagatcaaaggagagagggtaaaaagtgagtcgtgtaacttcaatactaaaccaaacctgccatccatttgaggataaatggatagaaacaacaataatcttgataataatagtctacattctaaaacataactagttatatgctagaagcatctggccagaaggctagtttcttttgtccttttccagtcacaaggtgctctagtgtgatggggaaggaaaggagagccgtagaactaacttttgactgtggctggcagatacacctttgtgcttggctaatcttggtggggaagggagtgagcattcgttgagcctgccttcggcattgggctttgtcccaagggttttgcttgtagtatcttctttaattcttagaacaaactcaagaaattttttcatttttacaaaagatgaaactgtaacttggagaggttaaataacttgtctgagagtcacttgttaagtgagagaggctgggaacattctctccatatccagacatctgactctaaagcttaagcttaacaagcagtctgcccttactgttctgagcttaagctcaaaagcagtctgggccaggcgcggtggctcacgcctgtaatcccaacactttgggaggccgaggcgggtgaatcatgaggtcaggagttcgagaccagcctggccagcatggtgaaaccctgtctctactaaaaataaaaaattagctgggtgtggtggcacacacctgtagtcccagctactctggaggctgaggcaggagaatcacttgaacggggaaagcggaggttgcagtgagccaagattgggctactgcacttcagcctgggcaacagagtgagactccgtctcaaaaaaaaa

SEQ ID NO: 29221 - DNA, 1048 bp, Homo sapiens
aggctgggtgcagtggctcaagcctgtaatcccagcactttgggaggctgaggcgggcggatcatttgaggtcaggagttcaagaccagcctggccaacatggtgaaaccccctctctactaaaaatacaaaaattagctgggtgtgatggcgcatgcttgtgatcccagctactcaggaggctgaggcaggagagttgattgaacctaggagatggaggttgtagtgagccgagatcgtgccattgcactccagcctgggtgacaagagtgaaattctgtctcgaaaaaaaaaagaaccgggcatggtggcacacgcctgtagtcgcagctacttggaggctgaggtaggaagattgcttgagcctgggaggtggaagttgcagtgagctgagatcacgccgctgcactccagcctgggtgacagagcaagactctgtctcaaaaaaaaaaaaaaaaaaaaaaaaaacaaaaccccagaaaattttaatgtaaatttccaggtggataagttagatgtactaaattataggttaaattttgttgttgttggctgggcgcagtggctcacgcctgtaatcccagcactttgggaggctgaagtgggcggatcacgaggtcaggagatctacctggctaacacggtgaaaccccgtctctagtaaaaatacaaaaaattagccgggcatggtggtgggcacctgtagtcccagctactggggaggctgaggcaggagaatggcatgcacccaggaggcagagcttgcagtgagccgagattgccgccactgaactccagcctgggcgacagagcgagactccacctcaaaaaaaaaaaaaaaaattgtcattgtaataacgtctttaccttataattcaatgaatataacctttaaatgagaagtctccagttgcatttaaaatattatttgacttacaaattgttttatatacagttttaatgcctgtactttgcatataacatgaggcatatttctttttttttttttgagatggagtcttactctgtcgcccaggctggagtgcag

SEQ ID NO: 29222 - DNA, 1049 bp, Homo sapiens
taaatgatcacgtacttattggccgtttgtaaatcttctttggagaaatgtctatttgagtcctttgtccagttttcaattgggctgtttgtgtctatttcttgtagagttgtaaaggttttctatacattgtagatacttgggataatattgaatctatagatcaattggggaagaattgccatcttaacactattgagttttcaagttcatgaatatggaacatctctctatttattcaggacttatttaatttttcagttgtgttcctatttagtagatagcttgtgtttcgccacagatgttattggaaggatattattgaggcaggaaggaaaatggaaaggaagtaatatttctcatcaccttgaaaacggcagctagtgaaatgaccgaattttagttggaattcagcaatgaaatttggattcaacagtgaaacttagaaaaaattttatggtgtgttagttcaaacctaatacaaataatcttttaaaaagtattctggttcctaacaaagcgcctgtacttttttgactctttctctgtgagaactttattctaggtagattttttagcagggtatgtgtgccagttttttgttaccacacttgaggtaagaactgtaattacattgtcaaaataatatttagagtattattttcagggaataattgcagtggtatgacgaatatattatgcccatcaaattttatgtaaacacaagcatgagttattttaattgagttattggtgttgtttttggcctttattctttcttactctgtaaaaataatgttgggatttttgagggtcttcataacatttgcagtatttacataaagatcagttgataagctgtttggtaaagtaaactgtcatttgtacctgtctggagttttcttttcttgtgtctgggacatctttaagccttttccttttcagaattgtgttctgatcctgagcattaatcttatgtgcctgatgagttgttggatcagttggttttcagatcaacctatactgttggctttttgcatgttcagttt

SEQ ID NO: 29223 - DNA, 1034 bp, Homo sapiens
gctgtatgtacacttaagatttatgcccttgattgtatatcagtttacttttacaaaaataaagtcatggataaagtaagtaatattgttaaggacactgaaatttataagaaacacaattaaaatagagcatcaaagtatgggcaatgaattaaaattgtttatgtattgaatactgatatgctgagcacaatgctgtatgttttggaagataagaagaagatgtggataaacaatcagtttatccatgtaagaagtgagtaaccagtccatttatcagtgtaagatgtgggtaaccattccatttgtctcgattggatcctggtactttttctggtgattctacttcttaaaaaccagctctgttcataagaaattgagcattgaggtaaaaggtgagcagggaatagagtcagtatacctagtaggaaaggcacagtctgggagtgggagacctggctttgaatctaggctttggtgccaatgaatggggtgactttgatggttgcaacagtataagcagcacagcagggtagcagctgttgtgtacataccctgaactgggcattatccgtatattttttctgttctcacaatagcctgcagagtaagtgttactgtctccccatttggacagatgagagacctgaagctcatcactggtaaatggcagaggtagagtgtaaacccattgctgccatctggatctaaagcctatctatgctcattgtaaatactgtgctgcttaaattccgtaatgcccttccttgttgtacagctttcctgggctcctctgtgaagtatagcgttaagatgggataaactctaattcacctgtagctcatggaatttctcaaattcctgcaaataattaagagttgaaggtgtatatatattaatgttacatatattaatgatatttgagcttaggtggaagaagagaattacgaaattcaagctacagaaataggcattgcttatttttgagaattcattcccttaaaacgttttggatacctaatatctgccaggtt

SEQ ID NO: 29224 - DNA, 1049 bp, Homo sapiens
cacccactgcctcccttagaggacgacattaaaggaagggtggctgggatgtgcgtgtgtgtaatacgtttcccccagtgcctggcacatgtagattcaggaaatctatttatatatttttcagattataactcattttcttctagtagaggaagcatcgccattgaatcagtggactgttatttttctagtttaatgctactcacgtttaacccgttggaaatgttatttaactcttttaacaggagaagggaggttattttctagaccagctttgtaagctttgtccaaattgctgtgttaagcaactgtgggttagatttcccagatctcacaacaaaggagagtggcatttattttccatagcacatttaaatcaaaatttgtttatgaggtataaaaacattttctaggtttttgaactgattgaaatctattttactcatgttgtgagtatagcatcgccattgtatgcatgtatggatatggataatagatgaccttcattaaaaaaaaaatttccctgaaaccccccgtctttaggactgtctctgtttactggtgaggagttcgcctttcgctgtctgttggcatgtgctcctcgatgcccacacaggtgacctttactaccttctattttgtatatcagtattgtaatgcagatgctgattcatctgcctgcaactgttcacgtactttaaaatcaatcataaatgagaaagattgagagaaggaaaaagatgagaagagagaccttcatgcattttgttttttggcaagtgtggaaaatgatgtaaagtgtagttagtgctttggcatcaacaatgtgatttgtgaatgttagcttttctgtgatgacatttaaatgatgaatttcaagattaaactgaggagttccttaggcgaacttacagagttctcctatatgaccgttcctcgtccttaaagcctgaggagccaggttcatctgaatggtacttccaccaagatgcagaaatactgtcactctttagcagaatggttattaagtagaacgaagtgtgagctta

SEQ ID NO: 29225 - DNA, 1023 bp, Homo sapiens
gtgaaccttttaagacatttaagattacagcaaatcaaaaattcactgaaaagaaatgcttttgtgtgtaagtggtgcctataaagtagataagggcatgtctcttttactatgtttcaagtaaccaaactttcctcctcttttttccctaggttcttgattattacagacctctttctgaaaagcccggaattggtacaagccatgtttcccaaactgaacaatcaagaaaggtaaccccccaaccagcgtggtctggagtatttagcattccatatagggtattcgatgcacgtgactgaaaagctgtgtggtttctgagttggcacagaatctctaaatacatgtttctgtgttggtaatggttttaaattggttggttaacattacagcttagccacagtaggcagtgatttatggagggtagcaggatccaggttggtgccattattcagtaaatgcatattaagaaaaacattaagaacaaaatattatgcatatgcctggattttagaatagtaatttatgtaactgtgtattacagttgaatatttgaggtgtactcatttgtttaggtcatgggtgttattatttgtgatacactctgctaggtttgtaggtttctaatggataatttggactaaaataaaattgacgcccgtccacaatgtcacagttactgtagtaggaaaaacagtgacctaggagttctaagacactggccctgtgctttgctgtgattatagttctttatgtgaccttgttgggattcaggttcgtgtgtgtgtgtattttttttttttttcctaaacctctatggtaaggtacaagggattcagtttcttgacctgtaaattaaggagattgaataaataatttgcagtacacttcatttcaatagaatatatttttcctaaccttattagaaatgttgccttaggaaaataacaaaatatattcagaaactacagatctagtgatgaaaatctcttaaagttgttaatcttttgattgtagtcacga

SEQ ID NO: 29226 - DNA, 1040 bp, Homo sapiens
tgggaatgtaaatggtgcatctactgtcttaatctgttttctgctgccataacagagtcctggagagtgggtaatttataaagaaaagaaatttatttctaacagtctgaggctgggaagtccaagaacatggcactggcatttggtgagggctctcttgctgtgttatcccatggtgggaggtgagagggcaagtgagtgcatgtgagcattacagagacacagtccctgcccttactgtgagggtaataaccatgtgttgttatgtacaagaatgacagtgctgtgtaaattcttaagcttttttcttgtgctagttcttttcattgttgtcaaaattagttgacttcttcacccagaggctggtagtctattcatgcagattactcggtggggaaattttggatatagactcatcatcaattcacgtggcatgattcagcaaaaatgagagcctacatttacatacttgtctggtctcctttccaggtgaattggagtgaatattaacaaattggactagctgctcgtggtaaacagcttgtgtagttttcaggtttatgatctctgtgtacggcatagtagttaaggacagatgctagtgctgccgcttactactttggataggttaatgagaataatagtagctaccccatgaaattgttatgataactgattgaaatgtgtataaaactctcagtgcctggcatgtaatggtcacccccgtaaacgtgttgcagggaagaagataattgactttggcatcagaaagagttcaaataccacctcagtacctctgtaacccagggcaaataccttaatctataacctgagctattgctatttctgcttccatgctcttactactattactgcaactacaagtctaacaactactgctactatgctgatgaccttgccgttttctccaggtagcatcaccgttatgtatagaaggcaccatgtagcccttgtcatttaatcctcacagactctgtgaaataggtattattcttgacattttccaaattggagttctg

SEQ ID NO: 29227 - DNA, 1164 bp, Homo sapiens
gccaatgggtttaagtctcatctcattcgtctgattggaaatctgtgttacaagaataaagataaccaagacaaggtaagaggatttcttagtatgtattatacatgtatggcttcatttagaatatagtccttggaagacattcactcttttggagtgaaagcttgaggtgcttagaaagtagcttggatagagagatatatattttatatgaatacacacacacacacacacacacacacacacacacacacacatatatatacacacacacacgtgtgtgtgtgtgtgtatatatatatatgtatatgttaatatataggctctttggagcctagacaaatttctaacacacagtagatatttaataaacactagttattattgcctattatcttaaaaaacaaagcttagatctatatcctatgtttatggacgatagcatcataagccttttcttctagatgttttaaaatggatataaaaggaatataatatttaagtatgaagtctttgaggacctagtaggctgcttttagaaacctcttatgtgcagaagagcttaaaggtagttatattgagaatgtgagagaatggtaagaaagatctcagggcagttggaccacatgcttcagattgatctcgcctttctgtatttttctggagttttacttcgggtggcatttgatttgcttagttaaatattaattaaatttctgccagattatatttttctaagatggtggcagaatgtcttgcattgtacatgtgtgtctgcagtatgactttgccactcccctgtcgagggttggcatctatttctccatccacttgaatctgggcaggccctgtggctgctgtgagcaatcaaatatgtgatcctataccatttgtagcatagcccttaactggtctagctgattctatttctggcttcttagaagcccgtcactatgtaagaagtatagattcccagagatcaccttgctgcgagttgctgaatacacatggaaaagccctggaagataagatacaatgaggagagaggaaaggtctggtgaaggaacatcaaggcatgagatgtgtgcgagaaaccatcttgggagtagatccatcctcagtttcttacttgcccagctgatgccacatagatcagggcccccc

SEQ ID NO: 29228 - DNA, 1051 bp, Homo sapiens
cacatcatatttggcttaacacctgccgtaacactgggtacatagtgtagtgaaattaatggacgctggatgactttgcttgctttactggtgagtcaagcgtagagtagttacttgcttggagcgatagcaggccaaattctgactccagagcccatacttttcctgttaccatccactgcttccaccgtcaccacaaaagaagatgtttgagactggtcctttgaaatctatgaccaaatttgtgtgactctttgaggtggcaggacattgtattacagctttttccacaattcttactgaacttttttcattatcatctaatgtctagtgttttagtaaatgtagtttcttttttctttccctttctttttttcttttttaagaggtggggtcttgctctgttgctcaggctggagtgcagtggtgtgattatagctcattttagccttgagctcatgggctcaggcagttctcctacctcagcctcccacataactgggactgcaggcatgtgccaccatgcccgactactaaaaatttttttttggtagaaaaacagggtcttactgtgttgcccaggctggtctcaaactcctggcctcaggcagtcctccttccttgacctcccaaagtgctcggattacaggtttgagtcaccttacctggcctgaatatggtttctttaaggttcatgttgagggctacatttcaggcacatgcgtatttccgagaagcataatttaccccatactgtagacacagaaagggagacattggggaagtaatgtgctgcccatgatgattccgcagtttgtaaaagtcatgaatccagttttcctaactgctactcagttttctttacttacgccatatgatcaatttttagataacagacgttttaatttaatttaattttatttttgagacagggtcttgcttttgtcacccaggctggagtgcagtggtgtgatcacagctcaccgcagttctgtgctcaagtgatcctcccgcctcagccacccaagtagctggtactagaggtatgtca

SEQ ID NO: 29229 - DNA, 2878 bp, Homo sapiens
ctctttgttcttcttttatactttgtacacctcttaacccttctttggccaagatctgggggctttagcaatgacaatttcaattatactttcagttgaaagatttttaaaagtaaaacgttagcattggatctggagaattttgctaactgagataattaatagctgggctggtggtgatagggtttgtgtgtttttgagagagagagagagagagagaggaagagacagacagagatggaaatataaagatcattcttccactgttatatgtgttttttcccctttaaaggaataggcatttgaatttcctctctgttgtcaggtgttctgacttgggtacatcagctcttactgagtgcttgaatgttcaggatttctatgacatatctcaatctaatgaaaatctgactgtgaaatgtctatatatctccccaggcttcgttttcttggttaaatgagaaaagtgctcttatttcaaatgttggaaagtagctctacctttttctggaaaaaaaaaaaaaataaaaaaaaaataataataataataataataataagatgggaaatgtctgtcccacatctaaagcagttttgatctttagcatatttagtttttttttttttttttttcctggcagcagctgaaaattaagaggatcaaagttatgttcctataaaagacttttttcctgtcagtgcttgaaggcattgtctgactccccccacccccacgttttaaaagctgattgcttatcttattcaggtagaatttaatttcatgcccatcatattctaatagaacaaaaatgatacttagtttcagactgtggattttagtttgaattcaaacctactgctatattgcagttaaagttgggaatattttttactccaaatagaaatgaacgtgctattttggcatagtggtaagagcttgtagttcaattcaacaagtatgtgtttgccatatgctgtgtaccagccagtattctagacactgggaatgcagaaatggatttggcctactgttctctcgaggaattcacagtgtaaagaaggagacagatgtagaaactatcatctcagtatcatagaataagtggtgtgtgacaggattgagagccagtagaaaagtacctaagtgcttggtataaatggctctacttggaacttcaggaagaacctcctggatccaggccttgaaggatgaatgagaaagagttaggcagttagaggagtaggtcagccttgcaggcagtgggtgagcaggtgtgtgggacagtgcaggacccagtggcacctgaggggttggggttggggttggggttggggttggggctggggctggggctggggctggggctgtgccagagagctggccccttggctgcacgatgggctctgcactcactgtgggaactaagggttaggccattttcagcgttagtagattccttattgtagctctcatttctgaggattattttgtggttctttttcagatccacttcttttttttttttgagacggagttttgctcttgttgccaaggctggagtgcaatggtgcgatctcgacgcaacctccgcctcccaggttcaagtgattctcctgcgtcagcctcccgagtagctgggattacaggcatgcgccaccatgcccagctaatttttgtatttttagtagaggtggggttttcccatgttggtcagggtggtcttgaactcccgacctcaggtaatctgcccacctcggcctcccaaagtgctgggattacaggcgtaagctaccgtgcccggctgatcaacttattttttattgtgttgtccatcttcgtcttgagtcatttaagacacttattttctcttggagattgtttttatttctagtttttagggtatggtttttctcatttgttctctctcatttccctcttcccttaacccctcccctcctcctctccacccgcggtttcttttcccagtgattttttttttctgtcttttaacttgatctcatcttcttaggagaaacctttttcggcagaagtcccataggtcctggctgtggacttgtattcacagagcgatttgcttttgttttcatctcctcgggtcctagagggtccactcacctcttaccagcttttttttttttttttttttttttttttttttttttttttttttttttgagacagagtctcgctcttgcccaggctggagtgctatggtgtgatctgagctcactgcaacctccgcctcccgggattaagcgattctcttgcctccgccttcctagtagctgggattacaggtgtgcaccaccatgcccagctaattctttgtatttttagtagagatgcggtttcactatgttggccaggctggtctcgaactcctgacttcaggcaatccacccgccccagcctcccaaagtgctgggattacaggtgtgagccactgcgcccatctcagtttttatattaatataatttcttgacttgggattctagtaccacactgacaatgtgactctggatgcagtagctgcctgtgataatggtcttccctggtcccccactgagatgtcgaagcaacccaaaacctttttaactgctacacagagattttgatgatgtggcagcctgtgatggggtcccatcctagactagagtttttcattctttgtctctgccctttgtaagccaaaagccacctacttgtttgcagtcctgaaaactctagcctccaggaaccttgtcctagttggatcctgcatgcctccactcttgtctgcctctctgggttttatttctggcctctgagaatgatgctcacactgcccagtggcaggacgcaacctgggttcctga

SEQ ID NO: 29230 - DNA, 1011 bp, Homo sapiens
aacgtggacttgatagagcagtatgcgatgtttttgtcttcagggcaagctcttgatgcatagcttcatgtgacatctcgtttataacagcctgaggcatcagtaatctttatagcaagaattctagtgctgtgttatgcataccaagcttaccgtttattctgcccagtaaatacatggcttttatggagtcataaatcatgacagtaggagtcatacctctccaaaaaagaagagatttaaatctttagagttaacaagatttaatgtaatttagacattattcttacttagaagtaccattcttatttaaaggcagtatatctcatatctttaaagataactttagaaacttactgccagagaaacaaatattgattaagagcacactgtgtgccaagcattatgcgaggtgctggagagaaggaaggggaagaaaaggtcctcaccctcaagtaacttgaagcttagagggacaatgataaatagtaaaagattctagagtccgggcatggtggttcacacctgtaatcccaacactttgggaggctgaggtgggcggatcacctgaggtcaggagttcaagaccagcctggctaacatggtgaaaccctgtctctactaaaaatacaaaaagtagccgggcgtggtggcgcatgcctgtaatcccagctactcgggaggctgaggcgggagaatcacctgaactcgggaggcagaggttgcagtgagccgagatagcatcactgcactccagcctgggcagagcaagactccgtgtcaaacaaacaaacaaaaaagattctagagcagtctgatcagggtgagggttccgtactcttcttgtgccatgaagcaggaggaaaggcctcctgagggagctgaggctgcacgaggatgagcaaggtttcataatgtcctccagaggccagtttaccaagctgcatcagctcctccctcccagccaccctgcccttcataaagctctagttttgtaggggatggggtggg

SEQ ID NO: 29231 - DNA, 1026 bp, Homo sapiens
gtttttgcttagtccttgttagcagttacattaaaatctgttttaagttccacctcagggaatatcaaaagttggttacttttctaaatgggcctttaattaaaattttaaaaaattagaccattgtgttagattttttaaaatgttggctaaaacagaaaaggttgatttcagtgcagttgggctgaaactatacttaaatagattaaagtataatctggcttttaaaaaaaacacatctgactgggatgaagtagttgtggtcttaactgaagcaggtgaatggaccatattcgcctttaagagccttctgactcccaggttttctgatttttaaaaacttcctatttagtcatatgtttttacttcactttatggtttaagtgagccaaccaacaaaagttactcataaaagatagtattttacttgtaacaattgcagaaaaagtgaaaagcttgacattacaggtagaaaggaagtcagtctctgtcccctgtgcgtttccgagactgtgtttctatttatttgccctttgtctgtttcccctgaccagcgtgcgtttctttctggaggcgcagggacctcggcttatttttctctgtctttgcattgcttgacagagggcctgacccagggtaggcactcccgcttcatgactacatctcattttttatttatctttgttatgatagatagcagataaagcagttgatttcagtcagaagcagaccacagcagcaggattctttccacggtgcatgttctggctgagtgttggtgggctccaccctagccgaacctgtgtctgcacacctgttgtgtcttcctgggaggctcccaggcatgctcctgtctggccagggtgcttcctcctcgctctccagctggctgaagggaagctgggcaagagtgtatgtgtttaggccacagggagagcacagactcccagagcatgaaccaaggggcttccaggcctcagggactgcctcctggtcccccagaggccacctcactcttactcctgt

SEQ ID NO: 29232 - DNA, 1049 bp, Homo sapiens
gtagtcaccaaatccagagggcattaaaaagaatttacaagacaaacagccagcttgctcagtgacagatggcttgaaaggagtggggaggaacatacctttacagattaaaactatttaggaggcacagcaagcagatgctctgtgttgactttgttggagtgctgatttgaacaaaccagttgtaaaggacatttttgagatgttcatggagagatgtccatggatatttgaacgtggactggctcttaggtaatattaagaaattgtaattaatctttctaggcaaaacaatggcaatctggttatttttgttaaggtgctgtctgttagaaataccaaggtattagctggtgaaatgagttgctgagatttattttaaatactcttggtgggaaaaagtgtgggaagaagacagatgaaacaagttgacaacatggtggtttctgaagccgaatgttgggtgtgtgagtatgtattatacctccctctctctgtactttgtggtgtgtttggaaattttcatttaaaaaaatggttaaaaatttttaaagagttgttattgttgttgacccgaggttgagagctcttggtgggtaggggactcatcatggaatctgaaaggcagctttatcaaaagagtaacgtgtgcagatgggcgccgttcatcccctctcccccatacagacacatttttgttgttatattcatagacacaacagacatttctacaggatctgcttggtacagggcactgtgctaggtagatgggagaatcaagcatgaaatgggtagaatcctgcccgatgagggcacagaaggcccccaatgccacagtatagggggaatggagatggcttggaaaagaggtcaccgtggagttgggccttgaggaatggtgggtagcagttatgtggcgatgaagagactatttcaaaggaatgaattacaccagcagaggtacagaggaagaaaggtaaagggtcagtataggtttggctgaagctagagagaatctcaaatagacttggtcaagaaaagaagaccaa

SEQ ID NO: 29233 - DNA, 1045 bp, Homo sapiens
gctattttgttcgtcgatatttgtgcctgtctcttcaccattacaacattgtctttattactgtcaatttacagtaaatcttaaaattgggtagtgtgattcatccaactttattttagtgatttaatcttctttacccttccatgtaaattttagaatagctttttcataactctacaaaactctgctgtgattgtgattggaattgcgttaaatatacagctctctttggggggaatcaatgtcttactgtgttgagtcttccaatccgtgaaccaggaatgtctttctatttagatcttctctgatgtctttcatcagtgttttctcattttcagcatgtagatcctgtgtatgctttgttagatttatttttagcacagtggttgcttggtacccatggggtattcattccaggacccctgtggctaccaaaaatagatgttgaagtccctgatacaaaatggtatggtatttgcatatcacctatgtacatcctcccgtatacttcaaaccatctgtagacttcttataatacctaatacatgtaaatgctgtgtgcatagttgctatactgtatttttaaagtctttttcccccaagatatttttgatctgcagttgaattagtctgacgctgtggaacccagagacacaagggctgactgtgtataacatgtggtgggggagctactgtacatgttactttttaaaaatagccagttcctggttgttcgtctcgcatgtggaaatatggttaacttttgcattgaccttgtgtcgtatgggcttgctcaactcattcattctaggagatttgaaaaatagattctctgggattctctacataaacaatcatatcctgtgaataaggatgaagttttatttcttcttttccaatttgtatgccttttattgccattttatgtctcattgagtcacaagccttatttgatcatgctgtgatgtccctgcctgccttcttctctgtgggggttaaatgggaacagaacctactttttactgaatgaagaattatttattta

SEQ ID NO: 29234 - DNA, 1116 bp, Homo sapiens
caccagtctctgtaaattctttctgttgctttcaggacaaagttaaaactggtaagcttggccttcagggctgcccctgattggacctgcctggccggctcaggtgtcctcttctgtattcctgcagcccttcgtgtttccctccagtgctggatgtgaatggtgctttttgcttgtctgtggggccttctctctcccttatccccacccacatcctgacattggtaagagcagtacctgtttctgatttaccttttagtccccaatacaaggtctatcacaaagtagctttcttttaaatgtttatcaaataaataaatagaagattaaaagaggtgccaggtgttagcacacagagaaataggtcttggaaaaaggacctgaaagtgctgttgtcatgtttgtgtcatgctgatggcacgattcccgagggcaccgaggaaatggtcagacttctttcctgtaggtcaaggctggtgagagtttggcacttgagatgtcttcctaggtctgctgaggctggcggcccactacccgcatttgtccctgactgctttgcaggccgtcccctgtcctacagcaggccaggtctgtgtcactggccctccctctccccttcttaatcctcatcactcttcatttgcacactttgaggttttccagcacatttaatattatttcagccattctctcttttctgaaaaccagaaatagttacctgcaatttgtgtggtacaatttttaaaaaaaaatgtacatttttaaattaggcagatctgggctttgccactcattaagctccatgactgtgaacaaattaacccttacagatttcattttctttatctgtcatcttggaacattattttctaccttgcaaaaccattaggaataccaaatatttgcatggaagagatttgtaatatagtaggatacttggcacgtttcctttccctcgcctatttcccattttcaagcagagctaacacagcttctaagacatatgatcttgattcgtaagacatagtcccctaattgtaatctgcaccccgagtgtcacattgcacagtctgcctcaggtaacagtggggcttccacatgtcttgccttggaggt

SEQ ID NO: 29235 - DNA, 1024 bp, Homo sapiens
gttaagatgtttatcaatgacagtgtgtgcccagcaggacatggaccttcatcagtaattctagtttcgccctggccttgtgatctcactctgcctctctgcccttgtgatatttcattgcctttgaagcatgtgatctctgtgacccacaccctgtttgtacacccctccccttttgaaacccctaataaaaagttactgcttttgtggctcaaggggcatcacggaacctgccaacatgtgatatcgctcccagagacccagctgtaaaatttctctcctttgtactctttctctttatttctcagaccggccgacacttaaggaaaatagaaaagaacctacgttgaaatattgggggctggttcccccgatagatggggtttcaccgtgttggtcagactggtctcgaactcctgacctcaaattatcctcccaccttccgcctcccaaagcattgagattacaggcgtgagccactgtgcctggcctatactggattttgaaaggcaagactcaattatatgctatgataagaaatatactttgaatataaaggtgaagataccttaagagtgaaagaatgatataccatgtaaacacttataagaaagctggagtggctatattaatattagacaaaatagacctaaggacaaagaatttccctagatgtaaaagagtgatatttcataatgattaaagggtcagttcatcaagaagacataatagcctaaacatacattgctaatagcagaatttcaaataactgaaaccaaaactgacacctgaaagaaaaaatcgatctgcagtcataatcggagatatcagcgttcttatctttataaattacagaacaagctgaaagaaaagcaggaggaatatggaaaactggaataccatcagccaccttgatcaggtgaaatttagtgaacactgcaccaataacagcatgtatgttctttccagtacacatagaacattcaccaagacagaccatatgctggggccataacagtgctca

SEQ ID NO: 29236 - DNA, 1059 bp, Homo sapiens
acctcccccaagtgattctaagttgtagcctaggctgaggagcactggccagactttggctctgagttttctctctagagagtgtctgcaatgcccaagccacttcttttttacttctgcttgagtcacaccatatgttgctgcccaggcattgtggacaaaagcagcagctcaggcctgaaatgcccactgctaagtggcacaaaacaccatggaaacaaatgcaacacaaagatcaatggtactatatttttgtgagacttagaattgctgtgtaaggctaaagccagcaaaagagtatggatggaaattacaaatccagacatacacccagttaatgagacagtcaagaacaacattacactaacttagaataaccccatatctaccaaatttcttatgattgtagaagtagatctttccatattcaaactttgctgaaggacagctagtggttggtgaaggattaccatatccagctcttttcaaatgtggatggtaaaggaaacctttagaatctcagagccaaatgaaaataatattacaaatcattgccatttcctgtggtctcatgatgtgctgggcaccatgctggatgctttcccatacagtcctcactgtacacctgggaggtgggtatggccctcttgtttcatgtaagaaaatttagacttaatgaagttcagaaacctccccaaggtcacacagctaacaggctctgttttctgtcaacctagtaggttttcccaaaggagcttggttattaaagttgggcctgtacccttagcggagtgcctactctggcattattggctaatgtgggaaagaacagttcccaaatctatttgttgtcctctgtttacacttcatttccagaggctaaatgttaatttgtttaagccaggcttattgtctcctggagatgcactaccacgggaaagtgttgactgagcttggctcctcagtgtgaactgtaacttgtgactcattaattacgggcctacaatcaactcccaacatgttagtaaagaaacaaacaactttcttgtttaatgaagt

SEQ ID NO: 29237 - DNA, 1062 bp, Homo sapiens
ggagcactctggctccctagcaagaggaaggagcatctcagtggtgctgaattctcatcttcggagggtttgtcctgcagccctctgcggcagaagctgagagcactggctcttgccctggcttgggttggccacccttgctggagggtgttctgcagggaccctgcttttttcctaccagttcaactagttgtactatacaaaactgtacagtggtgactaaccagggaccggatacagcttgtttagatttgagataaaacctactgtttaatttcacgaacttccctggtgaaagccaaacttagctgtgtcccttgtcctggtcactgcttggctggtggtggggcaggggtgaataaggctactgcaaggactgggagcgtagcctgcgggaggcagtgaggagcctagcctagcattgaggagactgaggaggggggcattttaaaaataaaactatggcttctgccaagaagagaaaagcagctgatgaaaatcatgtgtttcaaagtaagtagactgagcgatgcttattatttgtgctgaagatactgtcatttgtctgattagcaatagaaaacaatcttattttaaagagcacagtagcttgtaagttcagtcaggaaaagacaaatacacagcctcagaagactcctctgcagggtaaagcaaatttggtttagtgcgtggcattatcatgagtccctgaaggctgtgctcattaaagagtgttgacatttttttagccccccaaaaaggaaagaaaaaagaagaaagcttctagtcatgggaaagcagtacgagaatgttcaggtacaattgcagatgttgcatttcccaatgaaaacgatgatttattatgaaaaaagaaattcactcacagtttacttttacattccctgaattgaccttccagtgaagcagggtgttcattgcgtctttggcttttagcaaagaccagaaaataaaaagactgttgtacacgagcacattgtaggcctacagatgctcgcagcaccttccaccttggtgtcctccttgccagatggccatccgttc

SEQ ID NO: 29238 - DNA, 1027 bp, Homo sapiens
agtccttttattctcaacctttctgtctgagatgtgtttcttgtataaagtatatacagtcatgtgctacatagtaatgttttggtcaacacagacccatattcaaccttggtcccataaggctgtaatactgtatttttactgtacctcttctatgtttagatacacagatacttatcattgtattataggcacctacagtattaagtacagttacatgctatacagttctatagtctagaagcagtagggtataccataccgcctgggtgtgtagtaggttactaggtaatatagcctagaatgtgagtacattctgtgatgttcacacaatgatgatattgtctctatccccagtgccaccatccagtccacacttgcatcattgctggccctgaacttcggcagtgacttcctaactcatctttcagtttctgctcctgctgggtccaggtgatttttgattccccattcattcagtgtcatgatctttgaaaaccaaaactggatcattcctctctgattctcccactccccacaccaccttgcataagcatgcccctgttcacagagcctcctagacggcccatcatcctcagaataagcctagtctatcacattctaaaaggtcctcttcatttgtatccagtgctgttctccccttcttcagcattccccaggcacacctacgtttttgtttccgagaaggatctcagttcctgcgtgaaggcagttgtccaagcacatctctgcttgtgctcctcctgggcttggtcatcctcatgcttcacacccagcgttctgtgtcttttctctcaagtcccagctgagataggccacccgctccgatccctgccaaaacttgttctgttccttcagctcatcacaggttattgttaaatatgtgtgcatttatgtctggattacccgctggattgcttcctaagggcagggatcaagttttctgtgtttcacctcaatataaatataccattgtcttgcatgtagtagataaccaaaaaatatt

SEQ ID NO: 29239 - DNA, 1028 bp, Homo sapiens
taagaaaggtaaattttcgtctgtgattgcactgtgggtcagtggtgaaactcaaataatatcaccgaacagaatagaatccagaaacagattcacccacagtcaacaaaggcctcactgaagttcactgagaaaaggatggtttttctcataaatggtgctggaccaatttaatgtccatagtggggaaaacatgacctgggaatcctaactcacaccattcagaaatgtcaattctagttgaatttatagacctcagtgtgaatggtaaaacaaaagagcttctagaagaatcacagatgactttggttattatcttggattgggcaagcgtttcttaaggcacacaaaggctaacttaaaaacactaactgtaagagaaagactttgaaacgatgtttgcgttacatatatctgacagaggataaggacttctacaaaacaacaaggaaaagaaacaattcagtttttaaaaatgactcaagacttgcatgccacttcacaagagaagaaatccaaatggttagtaagcatatggaatgaattcagcatcagtagtcatcagggaaatgcaaatttaatccacaacaagtaaccactagaccccaccagaatggctaatttaaaagccccaacaatactcagtgatggcaaggatatgaagcagcctgaactaatacatgatggtgggatgtaaataggaagaattgctttggaaagctttttggttgggaatgtctgctaacattaaacatacagctatcctgtgaatcagcagttccactctagtatatccccaaagagaaatgcagatacatgtttattagaagaggagtcctcatcccctcagccgcagacctggtactgggcagcacagctggaggtgagcaagcatcaatcaccacctgagctccgtctccggtgagatcagcaggaggtgagtgagcatcagtcaccacctgagctccgtctcccgtcagatcagtggcggcattagattctcataggagcgtgaaccctattgtgag

SEQ ID NO: 29240 - DNA, 1033 bp, Homo sapiens
aaaaccccatctctacaaaaattagccccaggcgtggtggtgtgcacctgtagtcccagctacttgggaggctgaggtgggaggatgtcttgagcccaggaggtggaggttgcaatgagctgagattgtgccactgtgctgtagcctggggaacagagccaggccctgtctctaaatcaaaacaaaacaaaaagcccaatatggacaaaatgaaatgtcagcaaagagatagaagacctgaagataaatcaaagagaaattctggagctgaaagtacaatacctgaaataaatttactagaaggattcgaagacagatttgagcagggagaaggaagctaggacaatggaaaatattaagtccaacaagcagaaagaaaaaaggttgtagaaaagtgaacagagcctaagggatatgtggaacaccatcaagccaaccaacatacgcattgtgggaaacaaggaaaaagagaaaagggcagagagaatatctgaagaaataaggactgaaaattttccacatttgatggaagtcacgaatatatacaaccaggaaactcggtgagctccaagttaagatgaactcaaggagacatattatagtcagagttttgaaagacagagataaagagaatcttaaaagcagcaaggaagaagcagcccatcacatgcaagagataatccataggattaccagcagttttcttattagaaactttggaggccagaaggcagtgggccaaaatgttcaaagtgcaaaaagaaaaaactgtcaactaagaatcgtttgtctgtccaaactgtccttcaaacatgagggataaattaaggcattcacagacgaacaaaagctgatggagtttgttaccactagacctgccttgtaagaaatgctcaaggtaatcctgcaggatgaaatgagaagacaacagacagtaacttgatgctatatgaagaaataaagatctcaatagagataaattcatgagcaatatacaagctagtttataacttcacattttgttttctacata

SEQ ID NO: 29241 - DNA, 1034 bp, Homo sapiens
tcgctcgggcccacggggtgcagtggaggaagtgtgagccttgtacagagagaggtttcaggcttcagagaggaggcctgtgaagtcaggaacatctcccctctccctttgcaatttatggaaagtacattgtgccaagcaaggacagtgaatgggccttcgtttcagcatctttaataaagtactgatttgggttatgcacagatataaaatctctagtggacagaggtgtgaaatgtagttctgtcaaactcagcagtgttttatggggcctatgtaccacttcccttacggcctagaagccgattagcagcctcagctttcagtgcaggggtgttgctgagatggctttttccctccggaaagactgaaactgctctttcttatagtgtgtattaaatgcaaatcttactctatattcttcagattgtaacctataatttccaaatctgacaattatttctctgccttcttttagtattttttttaacactttcagtattagcaattagccattaattggtaaattggagggtatacatactcatgattttagcttttatttttaaatgctattaaggcataacaggctacgaaacatagaacagtacatacagcattgcatggaaacctttgaagcacagatgttctgtcgtattaaaatataaaaactcagagggaaattagataccagatagaccaacaatttagggaaggaagagggagccaaaatgggtggtttgtggtgggtattgaacacatagtttccagcgtcatgcagggagaccctgtgtagaatctgcaccataaattagacttgtactttaattttctgaatgagaagagtatgcagtgggaccactgacataaatgagagttgagaacaaaagatcatcatagcagatgaaggtggaagtaaagtgaactttagaaagcaatgaaaatatctcttgacattcgagtttattctgaaaaacttgtgaccccttgcaaaagtaaggggatcttcagatgtcctgtcccaggacctccat

SEQ ID NO: 29242 - DNA, 1065 bp, Homo sapiens
caatagccttaagaagggtggaaaaaggcccgtcttcttcttggatccttggttgggtgacaaccctccggtggtgagacatggtgcctgattttcagttggggctttctgcttcccctgtttggttttctagggacaatttaaaagattctgcaagttaattactggagaagtccgtagatcctggattcatagtatcagattaattgtggtctttgagtgggaatcctagtggtttatttagactcatcagttgtcttattcttttttttaaaaagaaagaaaacatttattttcgtaagcttgtattgcccttaaaatatttctctgcactcttaggtcacctgcctattcacgccaggagcgcatcgcttgcgttaagagactagaagtttctttcttaaccataatgtgccaggattttgttatacggaaaaatctgtccgtgtttccaactaatatttcctagccttcaggcaagtgcgacttgcttcactgtaaaatggattcccaggacctgccgtatcgggacgggcagaattctttaaaatgcagtgccccgggcaaccccatcacttcccggctggctccgggcggtcccgggctgcccgccggccgcagagccccctctcccgggcccgcccggccggagcctcagtttccccggcagagcggggcggaggcgaggctggggacgctcgggcggcggggaaggggccgactcggccaggcgcgcccggctgggaggtcccgcgggccctggagcctcccgcagcccgcctgggcctccggggcgcgaccccctaatccgctttagtcaatatcttatgagctccgcttgggcaaagtaaacaggcgccgaacaaagcggcggccgcagcccgcgactcctgaccccggggtcgcgccctttgttcgccctcaatggggcagccccgccgcccggcctgcggctaattggggcgcgtgccgccgcctctgcccggaccgcaccctggactctgcctgggacgcgccctcggacgcaggccccggacccgcccgccaactccgacccgaccccgg

SEQ ID NO: 29243 - DNA, 1031 bp, Homo sapiens
tccggattccaatgaaaagattaattggaaaacatttctactccattttctaaaactgagttttcccatagaaaaaaaaataataaagctatccctaaagttctttcagcttctaaaaagaagatgctgtagtaagattccagtccccaccgccccaactcccaggaaagcaattgggaaggtttcttaacataccctgagttcttccttccctccccccaaattccgtgtgtcatggggtggaggcagtggtgtgtttatcagggtggctggcacaattcacagccacaatcatgggggtctagcgagctgtggaaggcagctcagtgggcagcgaggccctggcagagttgcccggctgccccagcccagcgttgccctcctgggcagtctaatccaatgtgaaatgaagtttcctgggaagcagggcacacgaggaacttttgaatttaccaatggcataaaaagtatatatatttttatgacaacgggcaagtttcaattggttggcagaaatggcgagatgtgacgtcaagggacactggttagaatgccaaggccggcggcggggggttggggggagacaggcacagacagacattgggttgggacccgggaggccttgtttctctcgggccctggccgccaaagggccgtcgcaggcgtctggggacatcagctccatgcggctctgggccagggcatgctcgggcagggggacggggtctgcgaatagtgactctgtgtccgcgtgcgtccccgagagccggaggcccaggccggcccctctgcggtttgggaaccactcaggcgcctctgtggagcgggcgggaaaagacgccgcggcctccttggcattctaacccgtgtccggaccctagaggccggccggtctcaaccaccgggagggcctgggagggaaccgtgtggcccggggccagcagtgtcgccatcgggctccgagagagcaaagctgtggccttgaacttctccccgaagctcctgtgccctgagtcggggaagcaggaagt

SEQ ID NO: 29244 - DNA, 1064 bp, Homo sapiens
cggcgcggggccggggaagtggggcctgggccgtgcgcttcgcccgcggcagtccagagccgtcccaccctgcgaagagttgcgggaactggcaccgctctgccgtccgccgcttcgacgcgggaagagggtgagcgtttggaacccaggactcagaccgctagctgagggcctgtgcagctctgggcacgcgagcgcggcgccggcggcggccaggcacggtcctcccgcaagggcagggctgtcgacctgtgcgccccaggtcacgatcgggttcacggcgactcctgaggacggtaagtgcatttctcactttcgctgcttagtgagtatttaaatattaatgaagggatctctaagagggacccttccgtagggcaggccttccacagaccagggaacgcaccgaggaggttgctcttgaacctgaagccgcaccagcttgcaagaactccactcggcattaatctggatcttggaatttgtgaagcacagcttctaatctcaggtgtgcaggctatttgccagagagaatcttgttgaacacataaaataagcgttagcagacatcttaaacacaatgggaagaaaagaaaaaacatctgtttttagatttttttttttttttttttttttggtgagatgtgtttggaaaggttattgggaagctacaactctttcttggaagattgaaatatttcatttacttcctaaacccacgctgctgattttttccccctggtcggacacttggggacagctgatttgaggggggatcctcggttcggcgttggcggcatttgggccggttcagtgaaaggcccttgtgtgaaagctgctgtttacggtggtgtaaaacgaaaaacaattcgtaactttttgtggtaaaatgcccctttataggtgcctcacacaggcccagccagtggtcctggggagtttgtgaggagcaagaaaggggtgaaggaatgcttgcgtgcaatgattatagggtttcaaggtaacgtggagattaatttttttcaaaggtgggtttcaaaagccgaggcagcctgcaggccagc

SEQ ID NO: 29245 - DNA, 1048 bp, Homo sapiens
gagagtctggcctgacttggtgaagccacacacaagcaaacacccttccaggctggagagggtgtttttgtaactctgacaaatgtggcccagagttatggctccgtgaatattttctgaatcgacagaatgaagaggcctacacatgagccatcccctggtcccttctctgaggtgctggaggagctgccccggagaagccaggccagagtccaggctcccgttagcagatgtgggaggagcgggccgtgctggggccgtagtgaagcgatctgtggtgctcggggagcgttgggaaggctgaggtggcccatcagctggggacacccggcacattacggggacctgtctggacaccccagcgatgccttgaaggaggacagatgagggagtggccctgatcaggtgggggaccagggtcacccaagcagctttcttggccagttatatctggcttcagaaatgaggttttattttttcgtcaatcggctgtcacgttttatttttctttcaatgccagagcttctcagcttggcccctgtagccctgtacgttagcccactcagaagagagctctctttcagggtgtccaggagcctctgacactataggtagaattggtataatggaaatcatgaaaaagaatgaaattttgtgacaatgggcagaaaaaccccaaaaccaggtttctagtcacttttttgtgcgtggtgggaggcagtttgaaagtaaaacggaaatcagggatgggaagcttcttggtggggtctggactggggagtctcatctttctgaccacccaggaacctgtgtggagagagtggctgggccactgtccagccagcgccgagagggtttccgagtagagatgttaccgcagggtcaccggttagtgttgtaaaataagactggtggttgtggatactaaacgtgtgcatgagatctacacggtaaaaaggccaaacaattttttaagcagtgatagaattttccctccagatttagaaggaatcgtccctgatgcttctggctttctaaaaccagggcg

SEQ ID NO: 29246 - DNA, 1062 bp, Homo sapiens
gttgcctgctggcagggcaggccccgtgccatggagcatgagggacccttcccctcccagggccaggcttttggcagccaggccaagccgctgctggaatggaattcccggcgttcctggtggggcgcatggcatcggaatcctacctgctttgtctctggcatcagctggtgagccagtcacgtggccgtgtgcgtgagaccagagcccaggactgagggctcctcccgggcgcttcctcctcgctcactcacccccaccccctttttttggctttcagcaggactggctctgagcaggcgtaaaacagtgttaaaactgaatccgggcagcagggagctcctgtccacggcggcaggctctcacagtccaccgggctctcgcggtccacccagaccaccctttacctcgagtccttatgcacagaaaggccctgatatgtcccatacactcaggagttaggcccagagctgggcagtggtcactccacgccattccctctggtgtagagctggccctgcctgcccccagacggccgtggggtgggtggcaccgcttcctggggaaccccttcccacacttctggccttgtttctcacccacacaaggacaccccagtggtcactgctgcagctcgcggtcacatagagggtgagaggggagagctggacaaacaggtgacccagcagacccagcctgatgcccgcaggagagagcaacggggtctgatattttgtctccaaatgaaagagccacagtgaaaccccaggcctgccaaccccagttgtagggccagagaacagggatgtttccctgaggcggtggcaaggtttggtttggtgaaaacgaaggatatgtgagggtctgagaggggagggtgactggcctagactccacccctggcgccctgtccaccgtggctggctggccactctcggacccctcggcgtcaagcgctgactgggtgcctgcctggggcttggggctctgtacgtgttaattctgccactccagcagccctgagtgggaggagccattatcccccttctttctgtagatggg

SEQ ID NO: 29247 - DNA, 1086 bp, Homo sapiens
aagttagccggagcatcctaggatgccaggaagccttccagaggtggcagccccgcagcccccgctccttcccacagctgacctccagggctgcagctgcagggcccctgcgtccagccctcggacctgccacgtcccagggccccactgccaggcaccgccccgtgccggccctgtacaggccacatctgctgcagcagccatgccagagctccgcctcccgggctccgtccccatggaaaccacggtggggggggctcctcctgcatttggcccgctgactggtttccattagagccggcctgctttccctgagctctgcccctgcagttcaaggcttcccctgggggtttcttcccacatttaccgagcaccagccgttccgtgccagggaacccagcggtctgggccccgcccgccctggccagcacccaccggtggtgcctgatgcccggcaccgtggctgctcccctgtcctttcttatcgaaggccagctgctgctgggtcctggtgtcgtggactcagccctggatctgagtcagggcactgggctcccatcctggctgggccgtagaatcactggtgggcacttgaataagccccttcctctctccgggtctcagtttacccatctgtaaaatgaaaagctccatctatttcttgagttccttgcaatgccgagaaagaaagacaaagagaaaatgaagccacagtacactgttgctgccgggttctcagaactgggatttttgtttgctttcaaagagggttttttttttctagggaaagagtcatggaatttgaccagagatgattgtttgaggggccaagagccagccagagcccacggacatgcagcatggaaggtgtagccagaagcctgggcagcgatacccgccggtccgccttggcatctgcttggcacccagtgacctggctgtgaacacagtgagcggaggcaggaagtgtgcctgcgccggaatccgaagggctctggaaaactccccaagaggtttccggaggtcagaaatgtgggcagaaaatgagatccagcttttaaaaacctggccgactcatcccccggg

SEQ ID NO: 29248 - DNA, 1063 bp, Homo sapiens
gaagccctcacgctgctgggccttctctccggccacctcatggcagctgggtccttggcccatctggtccctccggaaggaaccgtcgaagctaccatggcctcgtctttccacgttccaccttctcgggtgcaatgaacaagtgtgtagatgccacacatcctcctggggcctggcatctttgtccagagggcccgaggcagctcggggaaggcctttcaagtgcgtcttgggaagctcacggctgaccagtgagcagggcctgggtcccactcggccgtgtgatcttgggccagcccctccccggctctgagcctcagcttcccacagtctctctgacccccacttctgacatgtagtggatctctagagggttctgagggttcaggtgtggaattggctgcctcaggcataaaaacattcctgggcttcaacctgggatcccacctggaggacagaggagagatttattgcagagatgttcatgcagtgcctctttaaatgtggaaagctcgacgcaccagccgtgctcctggggttgggcgtttgaattgaggagttgtgataacatgacctgccggactctcgtgtggccgttcacaatgggagaagcctctgtgggcaggtggaggcggcccacgtccacacgcacacgggagcccctgcgagccaggcctggcacagggttgtcagtatttgctgccacgttctctctctctcaattttccagaactttgttgaatgagcacccattccttgtgcaatgggcagaaaatgtttaagttacaaaacttatcatctggccagagtgaccctagcctggctaaattatcgcaacatgttctcccccaaaagagagacatttgcaaaatgctcaggaggtcatggggcggccatctgccaggcacattttatttcctccatttaaaaggagcagagccgattgaaggggaaggaaggggtgttctggagattggggtgcacaggggtgctacaaggccagcttcccccacatctggcgtggctgatgagagcaactttgctgctgcttttggggcagaat

SEQ ID NO: 29249 - DNA, 1101 bp, Homo sapiens
gcctcacaccaggctaatttttgtatttctagtagagacggagtttcaccatgttggccaggctggtcttgagctcctgacctcagctggtctgcccgccttggcctaaagtgctgggattacaggtgtgagccactgcgcccagcctgatgcctttttatacccagacagaagcaagcaagcccttacaatggccctgcatttgatctttcagtcctgctgaaaatgcagatgcttcctgacttgcagtggggtttgtcctgagaaacccactgtaaattgaaaatattgtaagtcaaaaaagcatttaatacacctaactaccaaacatcatatctcagctcagcctccctgaaacgtgctcagaacacttatgttagcctctagttgggcaaaatcatctaacacaaagcctattcatgataaagtgttgaagatctcctgttatttattcaacactgtactgaagtgtggttggtttctactgaattcatatccctttgggttgagaaatcttaagttggatcctggtaagtcggggctgtctttatggacaaaatgcagagtgatggccctcacgcggcacctccctgttggctttgagcagcactctctgtctgggagaaactttagtgagcatgaagttgagccctcaccgtgatgagggatgggacagggtgcaaggacagccacctgctgttgcaggtttcacctgggtgaaacaccttcttgattcggttcagatttgttaggagttcctgtgggccaagccctgagccagtcacatggagtcatccctcttcctgatggccctgctgagtgcccctcccctgaggctcccagagcccacggggcttgccctggccaccaggctggcatacagcagagcagggccctggccccaagctgccccgcagtagaaacacctctgggttccatgaacgttgtctcgccaaggtgtggggccaccagatccctcaggggcggggaaggtctggggtctgggccgagccttccgaagtctggctgtgcagtgggttcaggccctgccactcagacccttgccgggatggtgccggggtgggccaggcccccagcccc

SEQ ID NO: 29250 - DNA, 1040 bp, Homo sapiens
ccctgcccgtggctctggatcggcggtccccatcagaggcctgggctgagtcctcaggtgtgtgagtaccatcttcccctgacccggcggccccacaaacacccctctgccagccacagctcggccgccctgggccttggcctcccagtctgtgcagtggggttggtgacgatcacaggcttctgctctgtgcaggtcgggagggagtgccatgtggctgcacccccagcccaagagcagcctcgctgctggacctttgggttcccaataagatctggtgaagacacatggagaccactgctgggcgggggcaggaaggcgtccctgtggcaccctggggccgcccatctgttggatctggaggtgctgcctgccaggctctactctgcatccagcgagtgtttgttgggggcaatggggcccgtgccttttgtccagaggaggccggagaaggggacacaagaggggagtggacagacggtcaccaggcagataagcaggacggggctcggggcttgtttgggaagtggctggtgctgagcttggctggggcagggctccaggaggggccgagtgggccccacccccgacccttgtcggcagggccccgaaagttccacgctgttgggggggtgccgtggaaggtggagcggggagcagcctccgatccctggagcaggttccccagcgttcccgtggcagccacttcatggcacagtggtccccggagttcaggccaggccctcgagccgcctgtctggggaccactccaacctcaggcaaatgaggggcggccctccccgggtctgggggcaaaagaaggttttgaatccggaagcccaggctcagtaggcccttgccacctcccccagaggtcatgcctcaggctaggccacctgggctgcaacatgggagggcatcagtgccccaggcagcccccagtcccccggggccactgcaagacccttagacgggacgacaaggcctctagaagccccggctgctgggagcctaggcagaagaagggcccacctgcctgt

SEQ ID NO: 29251 - DNA, 1023 bp, Homo sapiens
cactctggccaggatttccctgtgttggggccagccaaagtctctgacacacaggagtggaggacctgttccctcctgggcccctccacagcccccactctcctgcaggccccatccccgcaacctcagccattccagacagcatctccctccccaccagagcccctcggcctctcctgagcctctgagcttgcttcctgccccgtcacaggcccatgcacctgcccttccagtagccagaggatcccaagtggcacatttccgaagggacggtctccaggaacccccaggggccagggtggctgcagagcagcatcagggagatgctgggtgttggccgtggaggacaattgtgcccctggccaggcggggagggggcaggtggaccctgtgggagccctgtgggagccctgtggggttggccacacatcggttcctgctatccttgcaacaagatcccctggagggcagtgtgcctcctagaagaaggcaggagaaatcaccacgtgaagcagagaatggcgtttgatgagtgtgtgctttttctaggggtcgacgcaggtcctctgggcagcatggggtggtgccgggtggaccccacggtggcctgtgttcgccacgtggccgtgggtcagttcctcgctggaggagacccttccccagacacctgccgggcacccagccaaacccttgaggcctgggaaggtctctggatgccaccctacaccccgcccagactcctctccctgtggttcctggacagaacattccgtcaccacgaaacgaagtttgcccaggccctgccttcaccctgggaaaacccagccgggcatgggaaggaggaatgctgcccgcctgcccgcccagaccagagtcgccccacatgccaggccaggcccgcatcctcctggggcacacgggagccccaggcttcccggcaggaaaagccccccaccgcagaagggctggtctctggtggggagttgctgctgggtggggtgaccacagggcggggttcaggct

SEQ ID NO: 29252 - DNA, 1044 bp, Homo sapiens
acagtggctcctctgtacctggggaaactgaggcccagagagccagggacttcccaagaccagccagcagcagctgccccttcctggggtgccatctcccctgtccctcctgccctgcgcctgcccagccctcctgctctggtgactgaggaccgccaggcaggggctggtgctgggcggggggcggcgggccctcccgcagtgcaaggccgggcctggcggggtgaggtagtaggttgtgtggtttcagggcagtgatgttgcccctcggaagataactatacaacctactgccttccctgaggagcccagtgacacgaccccatgggagggccgccccctacctcagtgacacgaccccacgggagggctgccccccacctcagtgacctgcagggggcctgagccgaagctgggtgggcatctgggagctagattcaataaagctgttctgaccatgaacttggaactggcccctttcattctggaagcccagggactgggctctggggcgcgtctgctgcgggacagtgtggaggcccctggccacgagctgttccaggtcatgagacttgtctgctcacgcctcccggtgcctccagagtcctcagttggctccgtgctgtaccctgggctcaggatcccaggcccagcccgttctctgccctctcgtgctgcctttgagccaggcgggctgaacaccgggacccaggcccggtggagaggtccccacggggcagccaccaaggccccaggtcagcagctcagagcactgccaagtcctggctcctgaggccacctccgtgccttaagtgccttgaccaaagtctggacgtgcctgtccttccgtcctccctcaggacagtttccagggcacccgtaattcctctgacagactgccatcccaaaagtgcacccattctcctgggaggcctcaggccctcgtctagcagctgccgtaggctgggcccagtgatcccgccctgggcatgtggggtgggcttgttcatgcctggcccagcaccgagagcccctggtggggag

SEQ ID NO: 29253 - DNA, 1045 bp, Homo sapiens
ggtgacagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgttaagtctcctttgtatgtaaggtagttttttcaacatctaaaatttttgttttagccttcaaaaccaacttaccaacctcagtccagctgggaaggcagcgttgattatggtagtttgtcaagaatatatggacctggaaacactttctctctctgtccacctggtagataaattgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccagcattatgaaaatgcgagagtgggaaggacacagtgtgagacttccactagaaaaaagtgaaagttagggttaggacatccttttttaaaaattacaaatttagtccgttttggtttttgtaatcaggctaggcacagtggctcacacatggaatcccagcactttgggaggccgaggtgggaggatcacttgagcccaggagttcgagaccagcctaggcaacatagcaagaccctgtctgtacacaaaatttaaaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaaaaaaaaaaaaaaaagatgcaatcaaaggggctgttggccagcaatggcagcagcagcggcgggcagtctgcccaagtgtcttaggaaccaaaa

SEQ ID NO: 29254 - DNA, 1048 bp, Homo sapiens
ctgccaaaccttcggggcactggtagcacctggccacctgtctcgatgccacctcctttcctaaaacatgagagagtttctcaactccctgggattgtagacaggtttctcaaccttgtcatgctctgcaggtagcctggagggaccaaccacagctctgggggctcttgagggctctagccaaccactggggtgccagatggttctccccttgtctcaggctcagcagagtcaccctggaaccacagaggcctgggctaggccctgggtcagcagtacgatgagggctgagcaattcagggacctgagggagggcatggcaggctgtttctagagattcagaaggcttcctagtggaggtgaaatgtgagctactgaagcatatgtggggcttgctgggcagagacaagggaaagagttactctcagagaaagcagaccatccaaagctaccgggacatagaagccagcagcctgctgcgggacaaggggctggagggcaggcttgatgtggtcagatgggccaacagcaggctgaggggcacaggagccagggagcccacctgtgggaagggcaggctgaggctggagacccagagaaaagtggggagcctgggggatccttggggaggtcgggggatccattgggaagccaagggttgtgtgggaaggccgggggatccaagaggcctagggtttgtcaaagcggccagaggctttgtttaataacctttgacactttttaaaatgtgcttcctacttacgcgtctatggcctctataattagacagtcctgatagaggcctaagcacaaggccagacgctgcccgtggccctgcccacctccccggcctctcacctgggacagggtcatcaaggcctccaagggaagcgccgtgagggaggcccttgcacgggacatgccccagagcctcactccaggccctgggtctcctccccatgtcctcaggagtgtctgtgggccagcggtggcaggatgtcctgcctgtggcccggaagcacagccgagaccacatcctgctgttcaa

SEQ ID NO: 29255 - DNA, 1075 bp, Homo sapiens
aaaaaaaaaactggccaggcatggtggctcacgcctgtaaccccaacactttgggaggccacgccaggaggatcacttgaggccaggagttcgagaccagcctggtcaacatagcgagacttcgtcactagaaaaaatttaaaaaattttttaaaaaggaaaaaatataacttagagccccctatgaaaaactaaattagcatcatgacaggatacactttggggagtgaaatttcacagtacctttatttaattccaagccatagagcctggtaatatttttctctttatcagctgtggcactaaaataacagtggattttttccctctagacattcttcttttggccgatgaaaaatttgacttcgatctttcattgtcttcttcgaggtaaacaaatgagttttcttcccttgccttgggcataaccacattcagtaaagtctttcctttaaatgccagtgttatgagttattaatcattctttttttaaacaaatagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctg

SEQ ID NO: 29256 - DNA, 1026 bp, Homo sapiens
ttgtgatcctccggcctcagcctcccaaagtgctgggattacaggcgtgagccaccgtgcccagccaaaaaccccttacttttgcagacacaagtaataggtaaataacgagatctttgctgattctgttttttcacattttgccccagttggggctgaagaagaccctgttaaaagcacccggctctaccagcaatctcgcaaggaagtcctcctcggggcctgtttggagcggggcatccagtgcgtgcacatccccagcagtgggcaaaggtgaggcagccggcatcatgcttggacccacatctggccaggtgaggcctggagtgctgctcaggccttggagactgtttctgcagaaccacttaggcttggcaggacgtcccggagggcgtgctgtgtgcggtggaccaggctgtggactgagttgctgtacctgccctcagtgcctctgtcccatgaggagggcacactcagatgggtggcttcagtctacggggtacacatggccagaaagcatgtatgataccccgtgcctgagaacatggacactggaatcaccctcatgtccatgtcatgagacaccagttttaaaataggactattccagataatgtagggcatatggccccataactcctgggtgcctgtttaaatccatgctcccacacctgtttgaggtcaagccacatttcaaccttgccaagccacagctgccatctagtggtaagggaaagccttcgcctttctgctcttcagagcgaaatcctcttcgaggtgcattggccatgtggcgtctcggggtcgttcagggcagcatggtgtggattgtgttcacaaaatgtaaaaagtgggccgggcgcaggggctcacgcctgtgatcccagcactttggcaggccaagatgggtggatcgcttgacccctggagtttgagaccagcctggccaacatggtgaaaccctgtctctactaaaaacacaaaaactagccgggcatggtggcgggtgcctgtagtcccagctac

SEQ ID NO: 29257 - DNA, 1080 bp, Homo sapiens
gcagccagtcctctgtgcagggaggggaagggaggccctagccggatccacgctcacctcctccactctgctctcttccagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcct

SEQ ID NO: 29258 - DNA, 1020 bp, Homo sapiens
tatctggaaatatgtcctccctgaactgttgaaattactttgggtcgtagtggcagtggtcaagcgtgtgagttaggatgacattctttgtgtgacaccagcagacagttaggactggcaggagaaagagttccctgaggtggaggcgcaggcagctgttcaggaagggaaggcttgcctttggagagcattaagctgtcacgaaagctttttagggagcccctaggtggctggctgtcaggcacgctgtggaaggaacttctgcagtgaatgtttccacacctggaagaaaggcatgaaccgtgcagcacaggatgagaggacatgacgcccagacttctgaactcaccgcgcttctcagaggcatcctgcgctttttctagtataagtgctgttctttgaggacacagatgtaaagtggattgttttctctaggagaacctcagtcaagatgagattatgtgtctctaaagtgcctttttcaggtcgttaatatgcagcagctaattcttgctgtgtcttctgtttacatggagctagtgtggctggtccaggatggctgtgtcttctgtttacactgagctagtgtggttggtccaggatggaatccattttgctgcacctttcataaaagtctcttgcaatactaaatatctgtaattttttctttttttgagatggagtctcactctgtctcccaggctggagtgcagtggtgtgatctcggctcactgcaacctccacctcctgagttcaagcaattctcctgcctcagcctcccaagtagctgggattacaggtgcccaccaacatgtctagctaatttttgtactttttttgtagagacggggtttcatcatgttggccaggctggtctcaaactcctgacctcaagtgatccacccacatcggcctcctaaaagtgctgggatgacaggcgtgagccgctgcgcctggcccaaatatctggaatttttacacaatgaaaaggttctggattcatatgcaccttgttaggct

SEQ ID NO: 29259 - DNA, 1269 bp, Homo sapiens
gctagggcagatgtgcttgaggaaggcgcctctctcctctgactcccctggagccctcccctaaggccttagcttcaggcctggctttcctgctacctgccccttctctggtccctgtctctcccccactcctcgcaggacagtggcctgaaggacctgaccgggttctgctttcttccccggggcagctggtgtgagggtctcccgcgcagggtcagaccccgcgggccgagacaatgaggcgttctctaaggctctggcatcgtgtgcgccggctgtgactggcggccgagggtgccggtgggcagccgggcccctaccctggaagcaaagtgtggggtgaggccgggaggccccagggcccgctcaggacgtctgggtacagcttgggccaccgccacttctgctcctctcacggctgccgtcttctcatttcagagcatgggcatgtgtttcatcgggaagaggaattttgaacatttccttcttcaggtgcgtgctgctctttgacacaaagagatggggctgcgtgtctgccctgggcctagatctccgtcggtaatgacatgtttgttttccagtatctgcagcctcgacctggtcactttatttccatagaagacaataaggttctgggaacacataaaggtgaggtgcagactctgccacttgtcatctgaaatgcctagagctgtggcgtttcagctctgggagactagaccagagttcctgtcgtcccttccacttggctggagaattgtagaaggctctgtggggcggccgggggcgggcacggcctagggtggaacagttgccttgatggtggctgggtgcacttccagatgtggcctcagctgagatgctggagttcatgaaaagcgcgcctctgacttggaaggactatactctgtgagttacgtatcaagtccctgtaaaaagaatgatttccttcctgtgtaaggaaaatgttaaactacacaaaactccactctgattcagggagtaaggtggacgtcccggcatggtgtgaatgattaaggaccacatgcagcgatgggatcaggcgtccgcgctggccagagtgctgctcgctcatgtgcagacccttactgcggtgaggcctgcgtgagcctgtgctgtgcctggtgtcaggggacaggctccgagtcagtcacagtgtgcagtcctgctgtggggacagagtgcagccattgttgggttagtacagtggcggggatgtgcctgccggcgtgatgatcaggcaggtct

SEQ ID NO: 29260 - DNA, 1046 bp, Homo sapiens
gagggacaagagactctgcttgggactctgtgccaccaaactcccgagaagctgcagtgggagaagctgaatgctgggcagcgggcggttaggaggctccaggaaacggctcagcctctcttggtgggttcccctgccggccgttcctgggacctctctgctccacgtcccccctccagggaggcctcccatgagtgccccagctgtgcctctgctgtcactgctctcctcttcctgaggttcttgtttgtctactgtttaccacgcttcccttctagaaggtgggctcctgaagttaggggtctctgctcatgtccagcgacctggagcggcacctcattatgcctggtatcctgggaccctggctcgggtctgagctgggctgtggagttgggtagggccaggagccaggctgggagtgaatttgtttgttcctcactcttggtgttgaccttggccacctggctgaggtgtgtttgtcagcgtctttattgaggtgtaattcacacatcatacaacacactcattgaaagtgcacagttcacggacttctagtacattcaccaagttgtgcagccatcaccacaatcgaaacccaaacaggaacctgggccttctagacactttaggcactccctggacccttcctccctgcctgtggtgaccacctttctctctcttttgtcttttgagatggagtttcgctcttgttgcccaggctggagtgcaatggtgcgatctcagctcaccacaacctccgcctcccgggttcaagcgattctcctacctcagcctcccaagtagctggggtgacagacatgcaccaccatgcctggctaattttgtatttttagtagagatggagtttcaccatgttggtcaggctggtctcgaattcctgaccttaggtgatccattcgcttcggtctctcaaagtgctgggattacaggtgtgagccaccacacccagccaactctatttttaaaaaactgttttagatttatagagaaattgcagagataatacagagtttcccaattatccc

SEQ ID NO: 29261 - DNA, 1034 bp, Homo sapiens
attgtggatgtttggccctgggatacttcattgcccaggacagatctttgagtacaggggtgagctgaccctaccacaccgagttcctggcctgtcctgtccctggagctcacacctcaaaggagaaacccctgatcctgccagtggggggcctcctccctgctgcccccaggggctgggatgaagtcagagagggagcctgaacacacctgcctgtgtgttttgcaacggctgcaggtcctgggtccagcattgtcgtctgacaggtgttttggatgatgcctgtgttgaattccatgggaagtgttaagtcgggaaccactgcccacctctgtgacctctctagtcactgcgtcccgccctgctgaacacatcccagctccctggcctcacagccaaggtcctgcatgcagtgggtgagacattccccaggccagcaagccttcccgtcctctgcacctcatctgtagatgaggctacatggcagagatgggctctctcgtggcacatggagagtactgatgcagcagttggcatgtcctgatgtcccagctctgtaaggagacccttatttgtcatattcatctaccaactggagtcatatgggagggagtaaaggtagctgctgccttatctgtgatttccaagggcctgggcccagagcctggcagctactggatgctcagcgcacaactttatgtgtgtctatatggatggatggatggctgtgggtaagtggataggtagatgggtggacgggtgggtggatgggtagatggatgcattgctggaaagatggatgggtggatggataaatggatggatgagtggacatgtagatggatggatgggtgggtggatggatggatggatcagtgagtaggcaaacgaataggtagattaggtaaatggatgggtaaatgttgggtggatggatgggttgatgaacagacaagtgagtggatggatggatggatggatggatggatggatggatggatgaatgggtgagtggatggatagatgggtgggtg

SEQ ID NO: 29262 - DNA, 1050 bp, Homo sapiens
gctctgcagtgtaacttgcagcctggtgattcgatggagggagtgcctgtcttctagaaagttcctgtggtgatggcaggagggctgaattgggctgggagagttcaggtgagagtccgggggaggtggccaggtggggcctctgggtgtgcgggcctccggggatgcgggactccgccaggccaggagcagctttttgggtggattctgagttcgcgcccctggcctggtgggaaggagttttatttaaagattatcacttgatttttatttttgggtgaggctgggcctgttgaatcagtcgtgtgccaagaggactcctgcctgagagatctacttttacaggtttaaaaatagccgcagaactgctttccttcctcccagtaacttccctgtgcgctgagtgtcgaggctgggtggagggctgcgtgtcgaggctgggtggagggctgcgtgtcgaggctgggtggagggctgggcgtcgaggctgggaggagggctgagcattgaggctgggtggagggctgagcattgaggctgggtggacggctgggcctcagccccacagtctgggcctgtgtaggcctgagccgatgcatctcctttgcctcccctcaaatcagcgtggccgttcactcatcagagaacgttctgggggttgccccggagtgaccagtgaggtggttgtccctgcccttctcctcgcagatgctggggaggcgtgaaggctggagcaggtgggtgcacaaccagcctggctgtcccagggcttcctttagcctctgtgggggcgatttctatgtgccatgtgtcgccacgccaggctcttgtcctgtcccgggggctcctagtctgtggctgattctgcttcattccttggagagtggtggctggtgctgactggaagtgggtggggctgcctgcaggaccagagtcactcttccttgtgagcgtccctaaaccttgcgctagagcttgacccctgactgcaagacgcctgtgggtctgagggtccctctgggcacgcagagtgtcccctgggcttccttc

SEQ ID NO: 29263 - DNA, 1100 bp, Homo sapiens
gtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaatttctgtgactaatcactgaactagacgaatgttaaattttttatgtctgaagcctgagtctattttggatctgtaaataatcattgccagtgtgacttttgttcaacaaaaggattgtactgtattaagaaccgatgaaaaaaattctcctgtaacatttttttaagaaaactttgtttgtttaaagaaaaagtattgtataaattataatttttatttaaataaacctaaaatgctttgtgctaaggctcagggctgtctgcctccttggcagggccacacgcattgtaggcggcctgagccagctgggccaccaaccccaggccctcagtgccgctgccagcccgccactccctggggccccacggctgccggcggcggggcgtttgggtactgatgcggcctgagtgacggctgtggggtgaggtggggctgagaagcagagtcctgttggacgtgggcattggaggctgggagcagggggcagggcctgagttccagaagacaggaggccaggtggcgagggacgcggcctgcagggagggtacccagggctggcacagggcgaagtgggggaggttgaggcagaggcagtgccttggggtcagggggcatgcaggctttggcccctctccactttggtgtcctggctgcctgggggttctggacacaggggtt

SEQ ID NO: 29264 - DNA, 1020 bp, Homo sapiens
aaatctaaaaatttaaagactttcatggaaaaaattataaaataattaaaagacatgaatgaggatctttcatggaccagaaaagtcagtttcacaatgcaaatgtcctttcgaagttcctcaaatacaaatgcaaatgccctctcaaacatgtggagtgggccgggcgcagtggctcacgcctgtaatcccagcactttgggaggtcgaggctggtggatcacgaggccaggagctcgagaccatcctggctaacacagtgaaaccccgtctctactaaatatacaaaaaattagctgggcgtggtggcgggcacctgtagtaccagctactccggaggctgaggcaggagaatggcgtgaacccaggaggcgagcttgcagtgagccaagattgtagtgagccgagattgcgccactgcactccagcctgggtgacagagcgaaactccgtctcaaaataaataaataaataaaaatagacatgtggagtgaaagaagcaagttacagaaaacaacacgtttcctttggataaggagcaaaacctgcaaaactaaactcgctgttgcagatacagccatggacagaggcaggaagggatgcgcttggcgtgacctcgtagcgccctcccagggggagcggggggactccagagcagggcacagaaggcttcggggcggcgttcagttgcctggcataggtggtggtgacaccttgcttcattttattcttgttctttaaattgtgtgtgttttcatgaaaaatattctgctttgaaaataacaggtatgtgtaaaggaaagaaagcaagccaagtctgcccaagtaactttattcgtgtcttctcaaacatttcagatcaaataatgccattttctaatcttgaaaccagcaagattagaaagagaatgaggccatcctttcactcagactttcccagttactcaagattgtattcaggaacgaagtcaaactcggcctcacttcttaattagaataaactagaatcaggtccattgc

SEQ ID NO: 29265 - DNA, 1049 bp, Homo sapiens
cactttaaaaatgccaagacaaaatcacagcacactgggcttgagaacacaggcagtctttcagtgtgggtctgatgtttgctattttagctcagctccgcctggcagggtgtggtctgctgacagagggtatgcaggcagctggggtatgtggagtatgacgtttgaaagtggcatggtggtggctgggcgctctggctcatgcctgtcatctcagcactttggggggcccaggcgggtggatcacctgaggtcagcagttcgagaccagcctgaccaacatggtgaaaccccgtctctactaaaaatacaaaaaatagctggacattgtggcaggcatctataatcccagctactcaggaggctgaagcaggagaatcatttgaatctgggaggtggaggttgcagtgagctgagatcgcgtcactgcactctagcctgggcgacagggcaagactctgtctcaaaaaaaaaaaaaaaaaaaaaaagaaagtgttatggtagcaagaaaggcccaaattgagcatggcaaggatgtgagtgctgggataaagctggagcacaagagggttcttagtgatgtggctctgacagccttcagcttacattgccagagccacgagatgtctgtgagcaaatcagacggtcggctgaataggccacagtccgtcctcagccgaaggagaggcactgttggggataatgaattcatttggaaaacgtttacgagctcctctcctgtgccaggtgctgtggtgcgtgctgagcaagccatgtggctcttcacggctggacgcctgccctgtgaacacatgcgcacagactgcagtgctgggcaggtggcagtcccgggaccctggcagagtagcaaggccctcactgggtggaatgctcatgtcctccttacacaggtcccgcttccgccgagacctggctgtacagcaggaaccgatctggctgctgaggtcaggggagggtgtataggagtggggagcgcttgactggggaggaggggcatggagggtggtgagcaggcactggagctgctt

SEQ ID NO: 29266 - DNA, 1041 bp, Homo sapiens
tctttttaaaattttttattttttactttttcagctttttgttaaaaactaagacacagacacacacattagcctaggccgacacagggtcgggaccgtcagtgccactggcttccacctccacatcttgccccagtggaaggtcttcgggggcaataacatgcatggaatcatcatcttccatgataacattgccttcttctggaatgcctcctgaaggactagggacttgcctgaggctgttttacagcttttattgtattttgttttttaaacaagcagaaggaacataactctaaaataatgataaaaagtatagtacaataggccaggcacagtgtaatcctgtaatcccagcactctgggaggccaaggcaggtagatcacctgaggtcaggagttcgaaagcagcctggccaacatggtgaaaccccgtctctactaaaagtacaaaaattagccgggcgtggtggtgggcacctgtaatcccagatacccaggagtctgaggcaggagaatcgcttgtaccctggaggcagaggctgcagtgagtcgagatcacaccattgcactccagcctgaatgacaagagcaaaactctgtctcaaataaaaaaacaagtataatacaattagtacaatgaatacatccataaagcagtagcatagttgttcattatgatcaagtattacgtacagtacataatgtatgtgctatactgttataggactggcagtgcagtagatttgcttacatcagcatcaccgcaaacacaggagtatgctttgtgatgtgatgtaactttggctgtgacatcactaggtgacaggaatttttcaactgcattatagtcttacaggaccatggtcctatatgtggtctgttgttgactaaaatgtcgttatgtggtgcgtggcttgacttctctgtgttggacaatttctttctttcttttttttaaaggtgcccaccaccacacctggctaatgtttgtatttttagtagagacggggtttcaccatgttggccaggctggtctcg

SEQ ID NO: 29267 - DNA, 1028 bp, Homo sapiens
tgtaagacttttatagtaaaactgttaagtctttttctttttgagatggagtcttgctctgtcacccaggctgcagtgcagtggcacgatctcggctgactgcaacctccgcctccagggttcaagccattcttctgcctcagccttcccggtagctaggattacaggcatgtaccaccatgcccagctaatttttgtatttttagtagagacagggtttcaccatgtttgccaggctggtctccaactcctgacttcaggtgatccgcccgccttggcctcccaaagtgctgggattacaggcgtgagctaccgtgccaagcctgttcaatcttttaaaaaattatatttatcttttgcaattctgcattcaatttcagacaaaatgatggcaggtgagaattcccaggtgggcgtttcttcgagtttttagtctgtgggcagaggcctcagttccttcattgcactcccagacaccctcatcaccgtgtagatgcccgagggtctgtggtggtgcttgtcgggctgaggtccattctcagggatgggctgaatgccctgcttgtgtggggtgtggggtgtgggcttgtatggtgccactcatcccttctgaactgggccctcaggaccccgggtggctgcaggggggcctgcgacagcccatgaggagctgcttccttcagtcctgtgggttcctgggagcccacctttcggctgagctggtggagggctcttgggaaggcaggagagaggctcactggttttccttttcttttccatcagcatccagcacgtgtatggtgcccagcaccccccctttgatccactgttacatggcacgtaagtgacgttccaacctcacttggcgtctcggctctgatatgggagggctgtggcaaccccggtcttcctgcttccttcctgctcccaggcattcctcagggaggagactggtttctcattcagccacactgatcaagcagtcgctttgtgtgagatactgtgcaccccgtgctgcgcatcccggt

SEQ ID NO: 29268 - DNA, 1047 bp, Homo sapiens
actttagcagagcacgggccagtgattttgtgggatgtcccttggtttgtgcttgtctgatgtttgcccacaatgagattctgattgataatttttggcaggaacatcactgaagggattcgtgttctccttggtcatcacagcgggggcacgtggtgctggtgggtcctcacgttgaagatgtggactccgatcacttggttgaggtggcgtctgccagctctttccactgaagagctcccctttttcctttggtgatgaagtgctctgtagagagatgctctggggtctgtgcatttctacagtgtatttctttgtccccttgcacggcaaggcagttgtgcacctcactttttaagggaatgatacattttcccatggcgtacgtggagaaccgccttagtctttagagtgccctgtaacatgccatcctatggatttcccccgacttgactgcaccagcccctgcggttgggcagcgggttattcctaacttgctattattacaaacaacttgagaacgtttcttcaggcgcctgaacctccttctgtgatggtgacacagagcatccctagccatgggtgaggcgagaaggcagtgtgggggatgggtctgtgagttcgcctagagcaccaggtgtggaggtgtcacccaccaagacaggagataaaggtagatcgtgcttacgggagtctagtcttgtagttgacgtacccatcttggccacttcctcttctagcatgccagtgccccttctctgctggctctcctgcctccagggtggtgtggagattcagaaccacgttgcacctgggagagtgggtcctggagccgggctgcctgtgtggagagctggctccactggttactcgccacgtgaccttgagccagcttggtgatgatcctgctctcagagttcttgtttgcgtgatagacatgatgaaagcggtgctcattttgcagtttaaatgagatagtacatatgacatgcttaacagagtgcctagcacatactaaacactcaaaaatgttagttatttttatgg

SEQ ID NO: 29269 - DNA, 1056 bp, Homo sapiens
ttcacccacaggctggcgtggcaggagcaccagccttaccttcttagagaatatttacttacattcatctttgctattcttaaatattatttaaaattacagatggtcagtgtttgaaatttagaaactactgagagtaataataagaaaaataatagaatctaatgctatgtgccaggtgtggggtgtggagtccttgatgtatattttcttgatcatttctcacagtagtcctgtgaagtggatgctatttttattcctgtttgacagatgaggaaactgaggcttgaaggggttaagaaacatgcctgacattccaagattttgacgtcacagagccagggctcaaacttaggaatgtctgagtccactgggcacaggctctcctgcctgctgtgcaacctgccaagaccagtctcaggaagaaagataaaaacccatgtaaactaccaccctggattccccaggacgttaaaaaagctgatcttctttgtctttttgtgagggctgtgtgtgtgtgttttccttttcacgtagacttgagattaagcagtgtatctaattatatatcttcttatatttattttatttttaattttttttttgagatggagtctcactctgttgcccaggctggagtgcaatgacaaggtcccggctcactgcaacctccgcctcacaggttcaagcaattctcctgcatcagctcccgagtagctggggttacaggccgctgccaccacactggctatttttttttttttttgtatttttagtagagacagggtttcaccatgttggtcatgctggtctcgaacccctgacctcaggtgatccacccacctcaccctcccaagtggtgggattacaggtgtgagccaccatgcccggcctatttttacttattttaaataatgtcttttcccatgacactaactttctttgaaaacatgattgttcatggctttataatagttatcaaaatacattcatttcttccatttgcttgtaggtgaaacatttctgaagacattctattatttgggtgtttaagtt

SEQ ID NO: 29270 - DNA, 1023 bp, Homo sapiens
gttctactcaaccgtaccgtggaaggatgggcgcaggaaatcttgaacatttgaaaaaaatgtcctttacgtgagggtaggccccacgcctggctctgtgcccacgtggctggccttgactctttcgggggcttcctccagcctccaatagaggatcagcgtgagggagtgagggcttcacgtcagctgctgtgagggatgacgtgagatacgggtgttcttaaagtgctgtttcccttaaaatctggtttttacttacttcgctgaaactggtcaccaaagacaccacatttgcctcattgtacttgagagcggaacaggaacggagaaattaattaattcagttttatagatgaagaaggggagcctgaagaggttcattgttcaacagatacttactgagcactcactcgaggcagggcctcgtcctctgggccctggagactcagcagtgagcacgtggctggtcggagtgatgggcacagagctgggcgcaggcagttttggaaagcacatgagactcttttctgcctcagggatcactttctcagccatgccgcatgacctcagaggcattttgcaccaatggacacttcgtgaaaaattttttcccagggttctgtgacattttgccccgatttcccccgctgtctccgagtgtcccctgtgagtggactctttctccttcacacccatgtgcgtttctggacttcttgttttaaacacgctcttccttggttgggactctgcctgtctttccgcacctctgagcctcattgcccagtgtccgtgtcttccggaggtgcctactgcactgtcttgggattttgccctgtcagaaatgtgtcacgtgtgataggaaaatcatggacgtggttgagagtcaggcccctgagtttcctttcctcatttgtaaaatggggatgggaactgctctccaggatgacaaattgtcacgtggaaaccagtgcacggcgcagacactgctccacagtgtcgacatcccttctctccctccccttc

SEQ ID NO: 29271 - DNA, 1083 bp, Homo sapiens
ctctggggcaccagatccaggctcccgcaagataaagcaggcctgaccgtgccgtgtgggttgtgagccagccgggggggttgatggtcagttcttgactgtcacagggtctttcgttgccatccgagcctttcttctatgcttctgtgcgttttatttgaaattatatgtaggggactgtgggattatgttgctttgccttcgtaattacattgcatacttatctaaaattaattgagcttatcatggacaagactctctctagcctttctgtgtatccagcttcctgtctggtggatttctcagtcatgtgtgacatctaggcgtgtgctcgctggcctccggagccacagaaggaaagtggacagagggagtccctcggcagtgctgagaggctgcccctttcctctgcatgtcccctgaggtttgttccgggggcttctaaagggtgacaggtgtgggaatgatgagcctggggtacagcacgtgccagagaggtcttgtgatgccagggccctacccgaagtgtggatgtggtgaaaagctgtcttaggagcctctgcgtggctgccccattaatatttacgtagcgtagcatcagaacgattatgcttgctgaagccaatcttgttattgactctacctgttaagaaatggagtaacctgctgccaggtactgttaccagcaaaggctgctaacctcagaaggggtttgagctgagtcctgctgtatatgttttaatgctgaaagtataagaggctgactgagtccaactggaaagtaaaaatgtgaacttcaagcttctaatttgttgaaaggatttagatttttaacatgaaatagcagtagcctttcctttaattaaatgccatgcaacattggctgcgggatcaatgatattgaaggaaaaaaacagtgtaattagaccttgtgaagtgactaacaaatgattagggctctctttcaagagtgggggtgggggctggtaccagacgtgcagattagttgcagtttgcctttccttgctatagactttgaaaggccaaagttttcccttaaacattttgggtctgtttcttgat

SEQ ID NO: 29272 - DNA, 1125 bp, Homo sapiens
ttataaacttaatttttagaattgtgttttatctcacgtaaaatgacttaacagttaattgtaggacagtttctagaataaaatgtgtctctattttaatttttcattccttttaaaacattcatcttttcaggttttcaaaatctaacaatgtggccagcgtctagcccaggtggcctctctgtgtgttttaccagtggcttgcaggtttctgtcctctgtgagcagctcaggtggccggagaccccagggggccctcccctttattcagaacttgcaggattgtgggagtagatggcctggcttctcttgtggttcttgaatttgtctctgaggacattgcatcctcagattctgtctctcactggggtggccacctgggccagcggtgcccatgttctactggccagaattgcgcacctcccaggagggggaggagggcggctgttgccctcactcatgtccccccgctcagaacccatgggcaaactcagaattgtgtatcccggccgcactggggctctgagcagtcgtcttggccatggctgacagtggggcaggaggtgggcttcctcagcccactctgcttctctctggctatgatcggtgttgacccagtttgactctgacttttcaccttgtcctaaggatcccatgagaacatgtctgtagaaggcacagagcacagtccctggccctgtttctcccttcctgtgcttccaggagggactgggcatgtggtgtcaggacagtgtactggggcctctgtatggcctccctggccttgtggcttcaggagggactggacatgtggtgtcaggacagcgtagtggggcctctgtatggcctccctggccttgtggcttcagacaagtgactgagctctcctgggcctcagtgatgacattcaggtgttaatgagtgagtgtgaagattgggtggaacgcggtatggaacctggcgcacagtaggtgctcagtgaatgtcagcttttgttccccagctccatgaggtcttctcgctcttagcaccccccaggtgactggccctcacgaagtgggtcctctgtagatctcgggtatgtgaagtcaacagtggcccaaggaggctgtgggcaggagaggc

SEQ ID NO: 29273 - DNA, 1133 bp, Homo sapiens
gacaaaattgtaagccatcaaaattatcaaagagactatgttttgacaatgaaaatatgggagaaatgactagaagtaacgaggagctaaaaccgattagagatgcatttgacatttagaatcaccgttgcgtttcaacaacatcagtgcaagaagaacccaaagcagtgacaagaggggacctatgagagaggaattggaaagctggcatcactgcttacagatgtgacccaggctcagtcatgacagttgatgagcagtcgtttgcattcaagggatattgcccattttagatccactatacaggcatactttggaaatattccagatttggttccagacaactgcaagaaagggagtactgcgagaaagtcacacaaattttttggtttcccagtccatataaaagttatgttttgtactatactgtcatctattaagtgtgcaatatatgtttcaaacagcagcatacataccataatttaaaatgcttccttgctaaaaaatgctgacacaaagacacaaagcatgtacatgctgttgggaaaatggcactgatggacttgctcgacggagggtcactacagaccttcagtttgtaaaaaatgcaggatctgtgaagcacaatagagcaaagcacaatacaacaacgtgcatgagtatatatatatacacacagtccacccttgaacagcatggaggttggggcaccagcacacatatatatgtatatacacagtccacccttgaacagcatggggactggggcactagaatatatatatatatatgtatgtatgtatatatatacacacacacagtctacccttgaacagcatggggactggggcactagaatatatatatatgtatgtgtatgtatacacacacacacacatgcacacacacagtccacccttgaacagcatggaggctagggcactagcacacatatatatgtatatacacagtccacccttgaacagcatggggaccggggcactagaatatatatatatatgtgtgtatgtatatacacacacacacagtccacccttgaacagcatggaggctggggcactagcacacatatatatgtacatatacagtccacccttgaacagcatggggac

SEQ ID NO: 29274 - DNA, 1049 bp, Homo sapiens
tgcattcctcttttttttgagacggagtcttgctccgtctcccaggctggagtgcagtggcgcaatcttggctcactgcaatctccgcctcccaggttcacgccattctcctgcctcagcctcccaagtagctgggactacaggcgcccgccaccatgcccggctaatttcttgtatttttagtagagatggggtttcaccgtgttagccaggatggtcttgatctcatgaccttgtaatctgcccaccttggcctcccaaagtgctgggattataggcgtgagccaccgtgcccagcctgtactccattttttaaaaaataaaacttttcattccatgctctttgatctattataacttgagtggaattggtctcacattttatacaatgaagatacttttattttatcgtgattactcttttgccttttttgttggttagaggaaaaaagaatccttaaagatgagtgtgaaaatttgatttattttttaattcacaaaagctgaaagttgaacatgtagatgatttttcttttaagatagataattaaatatgtatagattatctcaatttctgtcatcttgtgcctgagagattgaaggaaaatctggaaataagaggcaaccacttcaaactttgcaacttcatgcatttagcaactgagccacttccaaatctgtagtttggtcatgaccttagttcttaaaagtcagagtggaatcctcatcttctggtctccttggattttcagttcagtaccacaaacttttgaaaaactactggtgggtttttgaaatgccagattgtgtgccatgatctttgctcttaggcagtttaaatttcgggagggatacatggcaatttattgtattcattcactcattcattcagcgcttattgctgggggctgtagaaacagaggtgatgaaaattagaaggcctgtttgaccgttgtggtggaggcggcagctgacgtttatttagcacgttgtttctgaagcttttaaagaactttccttgttattatgtcttactaattcatgaagat

SEQ ID NO: 29275 - DNA, 1047 bp, Homo sapiens
gctctaatggtatttatatttaaatcattattattacaataataatacactggtttgccaataaaacacaaaccacttcagaagaacgttctaaaatggtagcattttctgaggccgggcagcagtgtctaattttgggccttcacagtcagtttcgcgattcatgtgttatgcattttcaaagaataatcaagagcatgcaggattgcccggggcagtgagtactgaaaatgtacagttgggccagttgtgctaagagagtgatgggacatctgcacggacatggctgtatttcacgccagttaggggctgtcactgcagccggcgccatcttggagccctcggagcttgacttggtgataatgcgtcatcagagctgagcaccttgtgtcagctgtccagttacagcgaggtgtaaagtggacgagtgtctcagtgatgactgatgggttttttctttcagatccatgcaaaattcataaacctgatttataaccagtggaatttgtgctgccggaagcagaaggctcaaatgcggagctttgttttgtaggaaatgtctttctttaaggtgtcctgatgctttcatccctgagcacatccaggtgatgacaccagaggctctgcatgaggggagacgaggaagcaggtgtacctggtctcctttcatcttgcaggaaatcccatttagcttattggagttggaccaatgatcacattaagagcagaagtcacagagcaggctgtttgttacgagttttgtaaataagatgtatcctgctgagccccacagcacagggcacgtggatgtccacagggggacagattgtggccaggcacccttggcaagcaagttcttactgaggtcagaagtgactggcctgccctgtgggtggttgacactttgcagccatcatatccctcacagcatgtccacatctttgaaagcattttcctcccaggctccgggacagcaagccttcctggccttggcattcctgtggaccctgtccctcctcaccatcattttcggcttctgtgtgtgcc

SEQ ID NO: 29276 - DNA, 1029 bp, Homo sapiens
atctgcattgcctagcagggcttggcttttcctgagccattgcggtaaaggttgttcctgataccactaagtgaagaggtctcagctcatctacttgattcagaatcatcagaatatggcttttatagcctgtggtctaaggtttagactccaagtttaatttgaatatattagctaaaaggttccgttgaggaaagacgtgtggtttttgctgttacttttcatgatgtaggaatgaaaaaggagaaagtagaagcctgttgtgcggttggagaatggaaacctcgtatctattggctggtccagactcctcgtgacttactttgttccttgcaaagaaaaatgtgcccactagagatatattttggcccaagcaccaatttgtcatttcccctcctttactaatattttcatacattttattctttctgctagatctttcggctttttgcccccttagaaaaaggattgaatcataatgtaaaactttataaatttcaaatgtcgcttctctgatggtgagtgatgggacttgtgccatttaaatacaagattatctgccctctatttgtaaataaaatctgctgtacaatgaaatcgatgctggctttttcatttttcacctgagatttgtggtctgatgcaatggtttattggcagggccgatgagtgtgagggatcatgctttcctggcgcgtgtgtttatagcacatcaccgtcccgtggcagccgttgatcttctctcacgtgccacgatggattccacatgatcctcccaggagcaagagttgagggatgtcagttcccaccatccaggggacttggcagctcagctgtgattcctgtagataaggccgtccgagcagagctcctctagcgactagtgtttacaagcactgccgctgttttaagttcagagaagtatgaggctatgtactcacttaaaaccacggcaacacgcagaccggcgtgtcagctcccggacgacctggccgcttctgcctcttagctccttttcctactcttggt

SEQ ID NO: 29277 - DNA, 1039 bp, Homo sapiens
atggatgtgtccttttaatgctatttggtattagtagctatgtttcggggatgatttttagtgtagatcacagaaacacacctgggccgattccagctgagggaacacttctttaagaaggattgctttaacacagcatgttggcttcggggcctgaagataactggctttgagtgtgtgctttctgggcagtggaagctgctgacctagtgctatttcagcccctccctctctctgggggtttaaacttggtatccagtgagaagttccaggctgggctgggcacggtggctcatgcctgtaatcccagcactttgggaggccgaagtgggtggatcacctgaggtcaggagttcaagaccagcctggccaacatggtaaaaccctgtctctattaaaaatacaaaaattagccgggcatggtggcgcgcgcctgtaatcccatctacttgggaggctgaggcaggagaattgcttgaacctgggagacagaggttgcagtgagccgagatcgagccactgccctccagccggggcgacagaaccagactccatctcaaaaaaaaaaaaaaaaaaaaaaaaaaaaaaaaaaaaaaaagagaagttccaggctggatgaggccctctcaggcttttaggggattattcttgcacttttgccagtcttttcatttcactaacagcactcatgccaaggttgtcggttcgctattacttcttgaattacagcttccatatttgcctaccctgaagtcatactgctactcttaggttcactactgaacaggacaatttctttgagtagaaaagaaccattgccttttataattagtcatttacatttcctttccttggggaagaattattgaattccaagaactgtttggtggcatggaggtaataggaatattggggaaagtgactaaattatctcagaacttgtcagagaaaaggccagaaacgcagtggcgtcatgactcctttagagaaaggtcaggaaacggccaggcccatgactcggggtggagtggactctgcc

SEQ ID NO: 29278 - DNA, 1047 bp, Homo sapiens
tgcgcgcttggcaaattatttcacagaatgtggagacaaattgcactttgttggaaacttagccctggccacgtgccttgcagggccctgcccgctgagcgttgccggtcactgtgccttttcccctccctgcgcctttagcacagaaggccgtaacagcagtcttcacgggaagggcgctcggtttgggaaactgctgagtgatattctaaaatggactcctacaaattacaaactccattttgttccttgattgaatctgatttttaactctgtgtctcatggtgattacctaatttccatattatgaagttgtctgcagttcttctgataatactttcagtgttacgtttagctgcttttcaacccatcatctgttaaaaataccgtttttgcctccgtcagtgcgttcatgtgcgctcaccgcacgctccaccgcgcggtcttgtttgggtgcggctgggttcttttccctgccagcactttcacaagcattccccagcctcactgagttctctgaagtatgatttgcagtagatgtgaattacacgttcctctgaagtatgatttgcagtagatgtgaattacacgttctgagcaggttcctccttttccgcttgtgtcccttggaaggcgtatttcgtgttttcgtggaggttagaaagttgtggttagtgctcgtttgttccggtgctgcagtttgggaaatacttgaattgattttctctggtgctgtggttcagaaagaagcacattgcggattcgctggatgattgtttaagagagcagcagcgataaccaaaggaaccccaacgaaatctgtactttttagtaaatcatatttttattttcagcgcagtctctgagtaggccattttcatatggcaattttttgtttaaaggatcagtgcttcacaacagagaaagatgtgtgttgccgttgagaggttaaactgtctaacttgttcctgttcttctaatgaaaccttaaggaatttctatcatggcctcataataagaatacccaggctgctaaagcagtaaata

SEQ ID NO: 29279 - DNA, 1048 bp, Homo sapiens
gaagccgcgtggaaaggaggatgggcggcagccttcgagggtgtgtgctgggcagggagtaaagcgacaggcaagcccgcagatggggaactccctgggaagccccctgtatccttcgggacagacattgtatgagttcccacagaatcagagagggtgactggagccactgaatttggagtgaaagaaaaaggtgagagtaggaggaacgtgcgttttcagtcgtggcaggctagataatttcaaccacatttcccactggataagacctttttgtttttttaaattaagccaacaaagcaaaaagaaaaaaaaaaaaggaaagaaaaataaatgtcttaaaagcattgaattgctatctacaaaataaggacttcctgggccagagtgaagctaggacctggctaggtatgcccagctctaaagccaccagtgttctgggtgtgtgtttcctgatgcagaagaaaaatcatcccaaagctggttgtggtttgggcgcctcatgtagtgcctgcatccaacccgattagtcaggatagggatctgagaaatgcccatacagtttgtgagacccagaatagtgacacgtgagggcaaagtggacgtgatactccctcataaaatctaggttccaacctgagaggatcagggttgtttgaacctcagttatgatgattctatactggagttccccagaatgctagtgagaagcaaaacaaaatcttgtctggaggaagttacaactgaaattgtatttttttctttctttctttttttttttttttttttaataactccaaacacctttttcaaataaagtgacccacacacatgaacccgggaggcggaggttgcagtgagccgagatcgcgccattgtactcccgcccgggcaacaagagtgaaactctatctcaaaaaagaaaaaaaaaaaaaaaaaaagttgggtgatgtttttgtgaccagaaatatgccattgaaacttacctcttgtttctgtcaatcaccctgtggtaaaattggtttcattatatgtcgttttgcttcag

SEQ ID NO: 29280 - DNA, 1045 bp, Homo sapiens
ccaactgatagaatttcagcgtataaagcacacgatgagatttccactccgtattacatcgagaacgcttacacctacttgaaattccacatttttgcagtgaatcctaatgacgtcccctgtacattttgtttttacatctgtcacgtctgatgttaacctctgaaatcacatgatccctgtttgtccccaagatagaatggccagaggagtgggcttcagccctagcctttccaaaggctggagtcagagcccctctgtgtgaattctggggccagccccacctggtactcagtgtcatgcatcttttgtgacatagatgacgtctgtataaatgagatatttgctacattttttgattaaaaaaaccatagagaacttttttcagtattttaaaagaatatttgaaacctcagcagatgtgtccatttgattatgtccattcttgattttttcagatttaagagtagatcataaacaactgcatttcagatcagagaattgtcccattgggggtgacactggcactaaaagggaggctcttggattgtttctggtgccacagtggtggtgccagggcaccgttggatgaggggagtgggaagagctgttccctggggccccggttctggtgggctccaccctcacgttgttctgaggggacttaaggctgggaggccctcatgggtcaggaggagctgctggcaaaacctgatagttgctaagctgatctgaacttagcttgcaaggagcagcagcccagaggccttcccagcaacagcatcgaagctgtcgccagggccgcctaggggatgtaggatgggccacagccatgtgccttctgagttttctcctgcaaactgtgcctttgcctctctttagtaaaaaatggaaacaactgcatctctctaccttctaaccccacggaacctccaagggctaggggcgccaaactgagcaaataaaaatagagaacgtctagttaaacttcaatttcatataaacagtgaacaattttttaatataagtatgccctgagcagtgt

SEQ ID NO: 29281 - DNA, 1035 bp, Homo sapiens
cctcggtgccctcaccacggtcctggaaacgttaagccacgctgtcttcctcggtgccctcaccaccgttctctgtaaaggtgctcagatgctttccttggggcagatacggggcctggcttgctctcccagagatgcccaggtgtgcagggcctcttcctcctcccctcactctctcctctgccttggtcgtggtccctgcttggttccctggttctggtagtccctcgagaggggatgtcctttcctgctcgtcctcagccaccagcacttggcagagcccttgctacacgagcagctctcacagaagcttcgagcgcagatccaagggtggcttccgatccctcaccgcagcttccccacacagtcctaaacatatttgcagcgttttgttttgtctcttctgtagccttagacaagctgggctccagcatatgccccttttcacctgactccttccactctccatagtcatctagagatttagccaggattttgcattgtcggtggtttgtgtctttgtgtagtggagtggtttgtcatcgtaaaggattctttccttaaaagtgttcatctatttcctcccagtcttgaggttagaaagtgtgacaagggtgtggtggctcatgcctgtaatcccggcactttgggaggctgaggccagcggatcacttgaggtccagagttcgagaccagcctggccaacatggcaaaaccccgtttctactaaaaatacaaacgttagccaggcgtggtggtgcatgccagtgatcccagctactccggaggctgaggcaggaggattgcttgaacctgggaggcagaggttgcagtgagcccagatcgctctgctgcactccagcctgggcgacagagcaagactccatctcaaaaaaaaaaaaaaaaaaaaagacaatgtgacaatgtcagtcctccgccccctttgttgctgtcagtcagaacgcggattgttttcccagggttccggcagtgtggaccctggaccagcagcctcagcatcacctggaaacttgc

SEQ ID NO: 29282 - DNA, 1046 bp, Homo sapiens
ctgtggctggacactcctggacctgcttctgttggggggcaggcctggctccctgcccctcccctgcctgcccttgggggagagttaagaaacaagtattagtgaagatttcattgtgtttttgctgtgggtctccacgaggacttagcaggcctcggagttgggactgggttggattgagggagacctgcgtgagtcacatcctcagtttccccatctgacttgaggaagctgcaaagttctaaggtctagaagcagctggtttttagtgttgtgttttgtttcaagtgagtgacttcaggtgaggagatgcgggttccttggccacgtcgtgaatcctgctctgagttcctcagttccccctgtgtccagctgtgcgtggggtgggaaggaaggaggatcgggagaaatgcagtgtccccctgggaatacactgagtgagtggaccttgggcacactggacccatgcctagcagacaactggacatgtagatccaggaaaagagccctcctctgagtcacgccaccctgtgcgtcatgggagataaagacttgtattaaacaagctggtggaaagaaacacatttatcgaggatcgttagggaaggtgattgatgtcatcaaaacactttgcattgcaacatgccaacagcattttgggaactaagctgctggggactagataaaccaaggcatatgggtacagctcacaggcgtttcttaaaaagctggttttgttgaaaaggaaatgcatcttaaaattcacacaaacaatggcaaagccacctggtgctcacgcaggaggatgtggtgctgcctgaatcctgaagtgggtggcacccacgaggggggttcctcggaatgctggtggcgtgtgccgggacgtacgtgcgggactagagggcacatgaggggatgctcgagtcaggggaggtcgggagggagggagggccaagctttggctgcccaagggtgcacagtatatcatggctcagccccgcgaagagacgctcctcttgagggcacctgtccctctgtttgcatcc

SEQ ID NO: 29283 - DNA, 1056 bp, Homo sapiens
aggcaggagaattgcttgaacctgggaggcgaaggttgcggtgagccgaaattgtgccattgcactccagcctgggcaacaagagcgaaactccgtctcaaaaaaaaaaaaaaaaaaaaaatgacagtacacactgagtagcatttgttctaggcttgcaaggttgctttacccttccaaaatctacccatgtgactgaccacgttaacagaataaaggggaaaaccatatgaccatgtcaatagatgcagaaatagcatttgacaaaattcagcacccgccgtggtagaaacgctccataaactaggagtagaagggcacttccgtgttgaaagacactcatagagtctcacatcttacctcataattagtggtgaagttatcaaatgcttttccccctaaggtgagaaccaggcaagaattctgctctcactacttctattcagtattgctctggggagtttagccggggcctccagtcacgaaagtgaaataaaagacatgaggattgacaaggaaaaagctcaattgtcctttggattatatagatagaaaaaatttaagaatctaccagaaaaagtggatgcaggatacaaggttaatacagaaaaatcaaatgtatttctgtatattagcaataaacaattagaaaataaaatttagaagttgatatcattttataacaacattaaaaatcctaaaaatacttagggataaatttaaaactactcaagatctttacactaaaaactgcaagacagtgctgagagaaatagaaaaagatctaaacatatggtgagatataccatgttttatgagtacaaagacttaacactgttaaaatattaattgacggccaggcatggtcgctcatgcttgtaatcccagcactttgggaggccgaggcgggtggatcacctgaggtcaggagttcaagaccagcctggccaaggtggtgaaaccccgtctctactaaaaatacaaaaattagccaggcgtggtgacgcatgcctgtagtcccagctgcttgggaggctgaggcagaagaatcgcttg

SEQ ID NO: 29284 - DNA, 1042 bp, Homo sapiens
gagtgcgcgggcgccgccgccccgccgcctgccgcgagccccgtcccccgcggaccgcgccggggccgggccgggccgcgccattgtctgcgccgcgccggggccagggccggggccaggcgggcgggggcgcggttccgtggcctcggggtccccgcccggcgccgccccggacccgcccccgcgcggaccccggccctgacagctggcgcgggggcggcgccgactgagcggccgagtgccgggggtcggcgcccggcctggcccacgtgcccgcgccgttgcttccgggcggacgggacggggctcgggctcggggcgccgcccgggtccgccgggagcgcgctgtcccggccacgtcgagttaaccccgcgagccccgtccctgggacttctctggacgtgtcattcccgtcccacctccaggaagggccacctgggccctgcttcatgtctcagcccagacgggtccttgcgacgcgccccgaggcaggttattgtacgtggttctggggatgaccgttcacatttaatgaataaaaatgtaacttgccttgcgaaccataatttcaaatgtttttcgactgcagtggttttcctacacccaaatgagctcgcagtcagttttgtttcttcttttgtcccgttgtgtggcccacaccgccttcgttgctaagagaatcgcagcccctcgggctcccttctgcgcctttctattccgggtggccctggtagacccgggcacctctgtggaaacacgtcccggccaagctgagccgtcagaagcttctgttggtgttctcgtgttggtcgaaagggaagttatttattttgaagttaactctgatcagattacgtttttagaaatccattcagacctcatagtgaggccagtttggtaaagcaagggcatcctgcgactttttacacagaaatgttttttattttttctgtgtatgtcattcatagtgacaaaattgaggctaggaaggatttggttgggatttttttttaagtgctatgaataagccacattttgatt

SEQ ID NO: 29285 - DNA, 1047 bp, Homo sapiens
gctgcagggagcagggtcgggagcatgtgcatttcggagagctctggttgctccgtcatagaagccatgctccacatcctgtaagtgagagactccccagcagcgttcagccatagctgcgatgtcaggcctgtcactagtgggactgcccggacccccaaggtatgggtacacggcgagggtgctggtgttaaatacaggggacccacaaaaccacctagcagaacaatccacatgaccctgtcgtgtgacccagaacatttcagggatggaacacggaccagctgaccttagcgtggtcgctggcttgctctggaaggtgccgtttccaagacgcccttacctgggttcctgagcacgtctgacagagcagctctgactccgggtttctggagtcagaccccttgccactgtctttgacctttagctttgggttccccttctcagtttgtttgtttgtttgtttattctcactctgtcactcaggctggagtgcagtgttacaatctcggctcactgcaacctctgtctcctggattcaagtgattctgctgccttagctccctgagtagctggaattacaggcacccgccaccgcactcagctaatttttgtttgttttttgagatggaatcttgctctgtcacccaggctggagtgcaatggcacaatctcagctccctgcaacctctacctcccaggttaaagcgattctccttcctcagtctcctgagtagctgggattacaataggcgtgcgccaccgtgcccggttaatttttttttgcatttttagtagagacggggtttcaccatgttggccagggtggtctcgatctcctgatctcgtgatccgtccaccttggcctcccaaagtgccaggacaggactacaggcgtgagccaccgcgcccagccagtttttgtatttttagtagagatgggctgtcaccatgttggccaggctggtctcaaactcctgaccttaggtgatccacccgcctttgcctcccaaagggctgggattacaggcgtgagccaccgtgccc

SEQ ID NO: 29286 - DNA, 1106 bp, Homo sapiens
acctgggaggcagagcttgcagctagctgagattgtgccactgcactccagcctgggcgacagagcgagactccatctcaaaaaaaaaaaaaaaatgttctttggccctccagaaagtcaacaagcaaaatgcattgagcatcccaagaaactgttgccatgaccttactttgacttgtccacatttgccttgactaggccacttctacctcttggtagccattgctttgattgtggtttgtcttcaggatggtactggtaaagtcctgttccatctcctgttataattcaaggaaatgcttcagggtcttgatgccacttgtttaaaatttccattgaaagctctgctcttgtctgcagctgatctgggcacaacggttttggcacccatcgagtggaaagcttgctcaacttcaattttgaaccagttgagatgtctgtggtcttggctattgttctgttaatcgtcagtcctctttaatcagagcatgaacaagatcaatattttccttgcaaattgatgtggatggtctgccactgtggtcttcatctccaatgttgtcttgatccttcttaaaacgaggtatctatgtgtatactgctgacttctttagggcactgtcctcatacactttttgtaaagcatcatgattttcaccattcttccacccaaggttcactatagatttgatgcttgtttttgcttcagtttttgcagaattcatgttctgctaggagcccttttcaaactgattcttactgcctcaaactagatctattcaggcatgttctaacaagttagtatgagtttattttggagcaaaagaattttgaaatgcatgcatagttttgtcataatatgcattttccatgaactttttgaagaccactcctgcaataataaaacattgaacttcatttaaagctaaaattcccttctcttccacttctgactatgaggcagcaactgctatcagaccaaacctttcccaagaactatcaaggccatataaaatatatttttaaaaagagctttttgcatcctggctaaaacagtgaaaccccgtctctactaaaaatacaaaaaattagctgggtgtggtggt

SEQ ID NO: 29287 - DNA, 1548 bp, Homo sapiens
tggagggaattctccaggtggacacttgatgtgggaaggaacaaggaatactcctgaaaggagcagaaacgggaaagctaaataaataatagactgcctaaaactatctcttagagttcaaaatacaggtagacttaagatacatggacagtaaggacaaaaggtgggagggaaataaaggattgcaccatcctgcaaggggtgaaagtatggatttcaagtagattctgggccaggtgcagtggctcacacctgtaatcccagcactttgggaggccaaggcaggcggatcacctgaggtcaggaatttgagaccagcctggccaacatgatgaaaccccgtctttactgaaaaaacaaaaaattaactgggcctggtgacgcatgcctgtaatcccagctactcgggaggttgaggcacgagaattgcttgaacccaggaggcggaggttgcagtgagccgagatggcaccactgcattctagcctgggcgacagagcaagacttcatctcaaaaaaaataataaagtagattctgacatcagacgtgatctctagggtaaccgctaaaagcaataaacatgttgatgaaactggactaatacctactttcactaatcccaaagaaggtaagaaaggaaaaataaccagatgggacacataggaaacagaggcaaatggtagctttaaaccaaatgtgtcagcaagcatattaaatgtaagtggaatgcaaactccaattaagtgtgttagattggatagacaaaacccagctatgttcattcacaggcttcacatatcgagtccaaggatgcagagtgaatgcgagaggccagaagccagggcaccacccacacatctgctacagctgttcacatctgacagcacggcctcaggcaggaggactcattagagatggagggacagctcagtgaccaagtggtgaggttaatgggatgacacaacaatgctaaacataaaagcaccaaagaacacaactccaaaatgtgactggaacagaaagaactaagaggagaaatagacaatcacagtgagagatctgaacacttgcctcagcagcaaataaagtgagtgttgttccagaatgtgtcctgactgaccactccctctggccccagtgaccatcctgccggacggccgtctcctccctggttgagcagccttgagcaagggtagcagtgggcagtgtgtggaggccagaggcctctcacgtccacccaccccaaaggcactgccctgggggacagctgagtgaggagagagggagacacccttgaagcagggaggggagagttggagggagtcacatgtgggagtgaagcccaggaggaggaggaggggcaggagcattgccgctgggggcagacaggctgatggagggagaggggaggctctgagccccaggtgacaccatgctgtacacattgctttacagcccatctttctatgttagtaaacccacttcattattttatagggctctgtggctgtattcagtattttatcaccataaaaattctcattgga

SEQ ID NO: 29288 - DNA, 1025 bp, Homo sapiens
gaggcagtggttgcagtgagctgaggtcgcaccattgcactccagcctggacaacagagcgagactccatctcaaaaataaaaaaaaaaaaaaagtggtgctgtaaggagagtttgtatccttgagggaagaccatttatgtttacttacggctttacaattaacatttagtttattgaggttactaattaaaatactaggttttctttaaacaattaaagaattgccttctacttataaatgtagtggattttaattgagtaggaccagtcactctaaaggagtcttaatatttgatcagctgcagttaaatgagattagattcactcagccatcagtccacttggcagtcttggttgagttctgggaagggcaaatgctgggtctcctgtgagcagcccctctgctcagcactgtgccccagggaagggcccgtgtccctgctgggtctccgcccaccatctcttcccagtgagctggtcctgatgtccatgtcagcctttcagtgactgttgctgcaccttcctgcacagtctgttaacagaccagaggaaacccactggtgtggctcaataaaataattctaaatatgcacgtgtctcttgcatgagacttctggggtgctgacaacagggccctgggcctcagttttcacctaggcgtcatcctcatgctcaggaacgtctgtggctaaatctctccccgtgagatgctctttttcttcaggaaataaaggtttttccagaagcatcccagcagaccttgttcggctggagtgggtcctgggggacctctctagtatcctcctattgaggtgggtgagggaggagaggccacatggccacctgcccccagcctctgccatgtccatggtcccaaggccatgtgagcccttatgcaggcccaggtcctggtcccctgctcctctctggcgtggtccagcccattgtctctctgccacagcaccctcagtctcacagcatcagtgaagtcttaatatcttttctcttttcctgtcaacattt

SEQ ID NO: 29289 - DNA, 1030 bp, Homo sapiens
ccgccacccgcgcgggcactgcgcctgcgcggagtgagagcgtgagcgcggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccaggtacgcgcggggccggcggggccggggccggggccagggcggggaccgggggcgccccgggccgcaccaaccccgcccgcgcctccctgcagccaaggcggacaaggagagcttcgagaaggcgtaccaggtgggcgccgtgctgggtagcggcggcttcggcacggtctacgcgggtagccgcatcgccgacgggctcccggtgagtcggaccgccgggcgggcccgggtttctcgcgcgccttgcgcctcgcttggcccggcctgacccccgcgtctccgcaggtggctgtgaagcacgtggtgaaggagcgggtgaccgagtggggcagcctggtaagttggggcacgggcggcggcggcggcggggggcgggcgcggggcttttgctgaccgccgtgtcccccagggcggcgcgaccgtgcccctggaggtggtgctgctgcgcaaggtgggc

SEQ ID NO: 29290 - DNA, 1026 bp, Homo sapiens
gaatgcggtgtgtgcaggcatcgcagatgggggttctttcagttcaaaagtgagatgtctggagatcatatttttttatacaggtatttcaattaaaatgtttttgtacatagtggataatcctgtatttatggggctgggcatcctgggggaagagaggggctctgaggaagggctttggctgctgggtgacctgacaagtttcccgtggggctggtagttttgcccacgggggaaacgggggaggcccagctgggtgccagcctccccagtgccacaggctacttcatgtggcttgtggcccaccgcactaccccgtgctgcacccagggagaagagcagctgcctcctggggtgcctctgggaggtggaggcagggagccaggccctgaggatgcagcaacccacactagtcaggaggtcattcctcggtggtcccaggaggatctctgcagcccccacccagggaggccttgccagtggaaatggccatacttgcatcctggcttggtggaaacagagacgtgcgggggggtgggggagggagtccatgctgcctcagagggtggctgggggttttgaaggacagggaggagtttgccaggcacatggggtgggagtgtgttccgggcagtgccaaggacgtgcagaggacatgagggtggggtttggtggagggtatcggggtgttcagtcagttatagttagaccctggcctggcgggtgtgtggtgagagagtggggtatgaaccaggttcgggtgtgtcaatgggcctggccacaatgttcctggtgggtagaggaggcctgggtggagggtcccagtgagactgctcccccacccccaccccaggggccttctgctcaactgcccaccctgtgctgggctgtggggtgccccatgttggcagtggacctgcacctggggcatcacccagtctgccaagcgcacctactcggctctctggctcctggagccctgtctgccccctgcctcccatctgcccctccgaataagagtccctg

SEQ ID NO: 29291 - DNA, 1064 bp, Homo sapiens
cgggcatcacggagcgcgagaagcgcgagatcatcgagaacgcggagaaggagaagagcccggagcagaacctgttcgagaagtacctggagcgccgcggccgcagcaacttcctggccaagctgtacctggcgcggcacgtgctgatcctgctgctgagcgccgtgcccatctcctacctgtgcacctactacgccacgcagaagcagaacgagttcacctgcgcgctgggcgcgtccccggacggggcggcaggtgcggggcccgcggtgcgcgtgagctgcaagctcccgtccgtgcaactgcagcgcatcatcgcgggcgtggacatcgtgctgctgtgcgtcatgaacctcatcatcctcgtcaacctcatccacctcttcatcttccgcaagagcaacttcatcttcgacaagctgcacaaggtgggcatcaagacgcgccggcagtggcgccgctcgcagttctgcgacatcaacatcctggccatgttctgcaacgagaaccgcgaccacatcaagtcgctcaaccggctggacttcatcaccaacgagagcgacctcatgtacgacaacgtggtccggcagctgctggcggcgctggcgcagtccaaccacgacgccacccccacggtgcgcgactcgggggtgcagaccgtggaccccagcgccaaccccgccgagcccgacggcgccgccgagccgcccgtggtcaagcggccgcgcaagaagatgaagtggatccccaccagcaacccgcttccgcagcccttcaaggagccgctggccatcatgcgcgtggagaacagcaaggcggagaagccgaagcccgcgcgcaggaagacggccacggacacgctgatcgcgccgctgctggaccgctccgcccaccactacaagggcggagggggcgacccgggccccggccccgcccctgcccccgccccgccgcccgcccctgacaagaagcacgcgcgccacttctccctggacgtgcacccctacatcctcggcaccaagaaggccaaggccgaggcggtgcccgccgccctgcccgcctcc

SEQ ID NO: 29292 - DNA, 1071 bp, Homo sapiens
tgtaggtgcctttgcccttcaattggagcagagcggggttcccatatgggcgaagtggacgccagatcgtcccccgctgtgcgcagcccaaacttaaaaggtctttttaactgagctatcatgaagctgccgtgtgtctttgtcaaaactcttacaagaaagatggagtgggagctgtctgggcactagcgtcccagaaacaaccaggaacttgtggaggtgctaagctccctgcggggactcccgcagcctcggtagcctccagatggaagcctcctagctttcaggtccctgaagaggccgtgcaggccgccaggctcactgcgctgtgtgtctctgctccccgcttgctgccgccgcccttgcagtgtgactggtggggatgctggccagcctcgccggaggccctgatgctgtggggtccgaggagggggcctggcagggtgggtgggtggcaggagcctgtggggccccctgcatggtggtcagtgtgggggctctgcattgactgtgaccaggtcctgggaggttgggggctgccaggtgtgctggcaaggaggcctcgggctctggctcaggtgtgtttcccgtctcccagctctgccacacctgcgtgaagcggtcccgccaaagccgggaggggtttcctgtggccaaaggtgccaggcatcagaaacaggaagcaggggaggtcaaagctctgggccacaccctggtccctccaagtttgtcatttctgcaacccccaggtctgaccagtttggaacctgggctttctgagccggtctagtgggttggttgagagatgggggtttttctggtaactgcatttggtgctagccagtttttggtctgcactaggaagctaggctgcagtctgggaggcagtttctagtggggtgaaggggataagatgggtgtcttagctctagctgctgtaacaaagcatcacagaccaggaaactttaaaaaacagcaggctgggctgggtgtggtggttcacgcctgtaatcccagcactttgggaggccgaggcgggcagatcacgaggtcaggagatggagaccttcc

SEQ ID NO: 29293 - DNA, 1045 bp, Homo sapiens
cgcctctgctgagaggctgcaggggccagggctgggggctggcactgcctctggtggcgctgacatcgtcctgctcaaggcttggcagccggcccaggaaagcttctctgccctccctgacaggagacctgtgcacgcccaccccatggcacgactggggtcaggaccagcgcctgctgctgcaccgagaccctgccctgtccatggccacaggcgtaccctaggccggcctcagaggcgggtctggccaggctgggtggagggtgggggctgaccgcagacctggggctgccacacccatgggggaagggctgtggcgacgtgggcgcctcctgttggctgggccgacgcagcctcccgcccggctgcacaggagtttctttaaggagtttccccggtgtgcctcggcagccttgcgctgctctaatggtccggacttccgtgtgtgagtttcccccgtgcgccccggcagtcttgcgctgctcctaagagttctggcttgtgtgtgtagctagacccagggaggcggccgtctcccggaccgggtgcttgtctgggctggctggcctggcggctgctcacaacagcttccggtgggttccggtcgggttgcatcgtggagctttcacctacaaaaggggaaggaggcggcccaagggtccggggcctggtcctgctgtgaccggtgccagctgcacttcctggatgtgccaaccgctaagacgcccaggccagggttgggtccagactcaagcccaggtggcaaggagtgggaccccctgccaaggctgtgaggccccataggggagcctgcctgtggagcgggccccccttgccctctgcagaggctcaaggcccccggggacatgagcctggtgtttatcagctgtctccttagtctcagctgacctcccccgaccatggccccattgcaccacccaccccaagccaggccagttcctctcccagaagtcccggctgtccaagaagagggcagggtgggctgccctcttctcggccagcttcagatggggcctctggttgc

SEQ ID NO: 29294 - DNA, 2064 bp, Homo sapiens
tgagaacattcaggaagagccacatggtgcagcagggcctgtggccagtctcaggacagcctgctggtccctggccccgcctcgaggggctccgcgcaggtctcgccgatgctctgtgggtcttggccggtgcgtgcctctggtgctgcaggcgcctggctgttttcttccttccctcaggctcctgggcccccggcctgagctcctggtttctgagagtctgtggggagctgtgatgcctcggggcagccccctcgtgtggctgccccagcctgtccgggtttctaccgtggttccttccacaccatgtttgtctcttaaagtgggagagaaggtcttaggtccaaacacgttgatttgtgtgctttgtggattcctccgtctgtactgactctgtgccggtgttgttgcccaggctgtagttactgaaaggggaagtggcttttgtacaaaggccctggggtccttgccatgtgtcagcagctgcgttgctgtgtcctgagatcatgtgtggaccccagggctgccttcctatgtgtgcccgccgtgccgcagtgagggttgggcagctctggccctgttctgagtgaggcctgtgcaccagcaacccgccctgggcccgtctgcgtttggtttatgctggggtgtctggggacctgctggcctttccccacccgggcctgacctgaaccgaccctggacctcagcagcctttgatgggcaggaggcatttggggatatgggggaaggagcccccaggcccacccaacagatggttctagactgacagggcactacgcagtgagtcctgagccaggtctggggctccaggtggaaaccccgcctctcatgcctctcctcaggctccccacaggtgcaggaagccgccgcccagccatggacggggaggagcagcagccaccgcacgaggtgaggtggaggctgggctggctgcacagagacaggggcggggggcttccccgctttgtgggctctcggggtcggtccctggctgttgttctgcaaaggtgatcttcacagggttctccagggtcaggcaggaggcacctccgagggagaggggcgctgggctgaggtggcctggtggccctgtctgcccagcttgatggcagccgtgccagtgatggccaagcaggaggggtactgacagtgtggggcctaggctctacggaggccctgcttttcagggtgtgtggtacacagagcggccacgggtccctttcccgggtacgtggtccgtggagcggtcacgggccctcgtttttcagggtgtgtggtccacacagcggccacgggtccctttccagggtacgtggtccgtggagttgccacggagccctggctttctggggtgcatggaccctgacttgaactctcctttccacctgcaggccaacgtggaacctgttgtgccgtcagaggcttcagagccggtgcccagggtgctttctggagacccccagaacctgtgtacgtgtccctcagggtcctggcacgttccccggtgttgggctgttgagtcagggaggagggggaggcagccaaccactgccaggggcttggagcttgtggtgagcaggggccctggccgagacctgaggtaggtgctgctaggcctggtgccacccaacagcagctgctcctgggccctgcctggcagtggagcctcttggaggggctgcaagcagcacaggcaggcccctgggcatggggggctcgtgagcacaagcagtgtgagcggcacgggagtccctccttgctgtggcctcagcctgtccctcctgagtggggtgggggggcccatttcgcctcagagcccctcccctagctgagccccctgcggcacctgcccccactgtcccccacaccgaacctcatccacagcaacccccaaggtcgccctcatggggtgtatggggcacaggactcctgaggccctggcttctcgaagccgtgcagctcacagaggtggtagccggtgttcccatcactgggcaggcaaagcctgtggagtgtgacgctcgtcaggagtcttgtgctctg

SEQ ID NO: 29295 - DNA, 1021 bp, Homo sapiens
tccacctgggtgaccgacccatccccgtcaccttcaagagggccatcgcagcgctctccttctggcagaaggtcaggctggcttggggcctgtgcttcctgtcagaccccatcaggtagggctgcccccgggaccctggccggcctgcagggtggtctgtgggaggctccaggccctcctgtgcaggtccaagcgcagccaatcctcactcaaggccttccctgccctttccttccgccacaaatcccaaacaaacgtgctgtggtccctgcccggtgtccacagtgccagccccacccccccagcccgttgcccatccctgcggggctgcagccatccctctccacagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacggtgacggccgcccgcaggcgtgggaccccctgtgaggctgaggcccgagcaggtactgaccccttgtccttccccacagccgagcccaggaagtgcgtcccctccgtggtcgtgggcgtcgtgggcatgggccacgtgcctggcatcgagaagaactggagcaccgacctcaacatccaggagatcatgacgtgagtgcccgcccctccctgcaagccccaccccacaagcccccaggtggaggctgagcgccctggaggccaaccacatgcggcagtgacccaggcatgggggctggggtatggggagcccacccccagccaggcccagcgccccctccctcccacagcgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagag

SEQ ID NO: 29296 - DNA, 2415 bp, Homo sapiens
gtgggcggatcatttgaggtcaggagtttgagaccagcctggccaacatggtgaaaccccagctctacaaaaaatacaaaaattagccgggcatggtggagcgtgcctgtgatcccagctacctgggaggctgaggcaggagaatcacttgaacccaggaggcggaggttgcagtgagccgagatcacgccactgtccctgggtgacagagtgagaccctgtctcaaaaaaaaaaaaaaatcgtaagttaaaaagtgttgcggctgtggagaaattggaacccttctgcactgttggtgggaatgtaaaatgatagagttgctgtggaaaacagtgtggaagttcctcaaataattaaatcaccacatgattcagcagttctgcttctgggtatatccccaagagcaggatctcaagatttgtataccgatattcatggccaaaaggcagaacaagtgtctatcagcaggtgaatggattaaatgtgatgtgtacatacagtggaatattattcatccttaagaaagaagatgctgatatgctacaacacggatgaacctggaggacgtggtgcagtgaaataagctggtcacagagagacaaatcctgggtgatcccacttacatgaggtacctagagagccacattcatagagacaaagtagaatggtgggtcccaggggctggagggagtagaggaatcgggagccagtgttcgatggggacaaagtttcagtttctgggtcccaggggctggagggagtagaggaatcgggagccagtgttcgatggggacaaagtttcagtttcacaagacagatttctggacatggatgggggtgatggttgtgcaacattatgaacgtatttaatagcactgatctgtacacttataaatggctaagatgggccgggcgcagtggctcatgcctgtaatcctagcacttttgggaggccaaggtgagaggatcgcttgagcccaggagttcaagactagcgtgggcaacataaaccccgtctttacaaaaagtaagacaagaattagcagagcttggcggcattgcctgtagtcccatctgcttggcaggctgaggcgagagggtggtgctgcagtgagccaggtttgtgccactgcactccaggccaagtgacagagtgagaccctgtctttaaaaaacaaaaaaagtggcttaagatggtaaatttattttatgtgtattttaccacagtgaaaataattgaagaaaaagggggcagtcatctggccctcagatctcacatccccttccccatgcctgtccgattccctggcctcggcagttctgcaggacatgaggccgaggccggggacccgaagacctgtggggaagggaatgcgagacctgggggtcagaagtggctgagtggcctgaggccagcgctgtcggagcctcgggcgggttttgcggggcgggcagctggcttctctgccctgcctcctcccactgtgggtgtgggggccccggcaggcacagaggagctcattcctcagctggcccgtaccggggcacccatcctggtgcaaaggctgttgtgtcccatggggcagggctgccccaggccctttgtccccactgtgcagtcacacagtcctggcttctgctgcggaaccctcgttctgggcaggaagacgggctgctgcgtgtgttcaggcccatttttaccagaggctgtgccgacaacctgctgggctgtgaggttgctggaactgggcggtgttggaggctcacaaggcacctgatgtcacctgggacgggcggttttcagggacgtgcaagctgctcacgttacacgcgttccctcctttccatgtgctgcccggaatcctggtgttgggtgacctcctgaccggcccacgtagtgaactctgtgtttggtttcagacaggccgacggtcgcaaggtcctacggtcaagcatccgggagtttctatgcagcgaagccatgttccacctgggagtccccaccacacgggccggcgcctgcgtcacgtccgagtccacggtggtgcgcgacgtgttctatgatggtaatcccaaatatgaacaatgcacggttgtgttgcgtgtagcttccactttcataaggtaatgccgggggcctttcggcctgtctacacgcacttgcttagagtcctaggagatttgggcctgtgctgctaggattctggtagaaacaaacccagatgaccgccttggcctcttctgaaagtccagcctgtccctggcagcctcagaagctgcctgtccgcgaagtagctgcgtcacgcccactgggagggatctgagtgcaaaggcatttggtactcagttaggacacttgtgctgagccctcccacgtgcccggccaggccctcgttgcagccagagatggccct

SEQ ID NO: 29297 - DNA, 1049 bp, Homo sapiens
gcaacctccgcctcccaggctcaagtggttctcctccttcagactcccaagtagctgggactactggcatgctccaccacacctagctaatttttgtactgttaggagagatggggcttcaccatgttggccaggctggtctccaacacctgatcgcaagtgatctgcctcagcctcccaaagtgctgggattctggggatgagccgccgcgcccagccagtgtgttgtgtttttaagtgatttctagcttcattccattgtgactagagatgtcagccttttgaggtttattacaacttgttttgtggcttatcttggagaactttctgtgtgccctggagaagacggtgtgctctcttttgctgggcagagcgtcctgtacccgtgtgccctggagaagacggtgtgctctcttctgctgggtggagggttccgtgtatgtgcctgtttggtcttgttggtttaggctgttgttcaggtcttccatttctcattgatcttctgtctggatggtttttttgttttttgagacggagtcttgctctgtcacccaggctggagtgcagtggcgcgatctcagctcactgcaagctccacctcccaggttcacggcattttcctgcctcagcctcccgagtagctgggactacaggcgcctgccaccacgcccgggtaatttttttgtatttttagtagagacggggtttcaccgtgttagccaggatggtcttgatcgcctgacctcgtgatccacctgcctcggcctcccaaagtgctgggattacaggcatgagccaccgctcccaaccctagatggtctatccattattaagtggtgtgtttaagtctccaactcttactatagatagaactgtttgttgtctgtcccttccattctgccaacgtttacatttttgggctttcttattgggtgcatgtttataatttttacatttttattgatgaattgactcttttatccatatataatgctgtctcttgtaacgactttttgttgagggtggatgtgtctcactttgttgcccag

SEQ ID NO: 29298 - DNA, 1049 bp, Homo sapiens
cccagctattcgggagcctgaggcaggagaatgccttgaacccaggtggtggaggttgcactgagccaagattgtgccactgcactccagcctaggcaacagagcaagactctgtctcaaaaagaaaaaaaaagaaaccattttatttgctcattcattaaaagcagctccttatctgttttatcctgagattgcagcaattcagtcacatcttcaggctctacttctagttctgttacttattttttgagacgaagtttccctcttgttgccctggctggagtgcagtggtgcaatcttggctcactgcaacctctgcctcccgagttcaagcgattctcctgcctcagcctcctgagtagcggggattacaggcgcccaccaccatgcctggctaatttttgcattttctataaagatgggatttcaccatgttggccaggctggtctcgaactcctgacttcaggtgatctgcctgccttggcctcccaaagttgctgggattacaggcatgaaccactgcgaccggcctgaaatgtatttctgaaataataagaaaattaggctgggcgcggtggctcacgcctgtaatcccagcactttgggaggccgagacaggcagatcacgaggtcaggagatcgagaccatcctggctaacacggtgaaaccccgtctctactaaaaattcaaaaaattagccgggtgtggtggtgggcgcctgtagtctcagctacttgggaggctgaggcaagagaatggcatgaacccaggaggcgcaacttgcagtgagccgagattgccccactgcactccagcctgggcgacagagcaagactccgtctcaaaaaaaaaaaaaaaattactccttgatccatgggctgcagtatggagtatgttagcaggcatgacaacattagtctccttgtacatcttaatcagagctcttgggtgactagatgcatggtcaatgagcagtaatattttgaaaggaatcttttttttctgagcagtaggtctcaacagtgtttttttttttttttttttttt

SEQ ID NO: 29299 - DNA, 1020 bp, Homo sapiens
tcgctctgtcacctaggctggagtgcagtggtgcaatcccagctcactgcagcctccgggttcaagcagttctccttcctcagcctccccagtagctgggattacaggtgcccgccaccatgcccagctaatttttgtatttttagtagagatggagtttcaccgtgttggccaggctggtctcgaactcctgacctcaggtgatccaccggcctcggcctcccaaagtgctgggattacaggtgtgagccaccgcacccggcccctctcatctttttgagtgatgctttccctggcttgaataccttccttacacacatgcactgatcagtgcttggctggagactggagtgggaggtgtcctgtgtggatcttcagcatttgctgtgagctctgccctctggtgttctgcctgtgaactcgagctaccttggactgcctgaactcctagttttgatttttcaagtcagagactgccagccagcctccactgcttcttcttccttgggctgtggcctggcttttccagcagaagctggacaactacagggctccctcctgtcttttgtttccttttttcagggacccttcactgcctggcgtccagtgtctagtgtcttgaaaaccattgcttccctatgttttcttttttttttttagttgttgcagatgggaagtaaatctggtctgttccgtcttggccagaaacaaaagcataaaaaatggaggctttttaatgaaagcttaagttagtgtagaaatactcacgggcacctagaagaatgctgacccactttctggttgagatgtgggagcggaggatgcctggacaggggagcagaggatgcctggacaggggagcgggggacgcctggataggagggcagaggtggctttctcccgggtaggcatcaaagcacttggagtatgtagcgaagatgatgggagtagggcttggaagaagtttccctagaaaaatcaagggctacagaatgagatgctgagggaatgataagaaag

SEQ ID NO: 29300 - DNA, 1049 bp, Homo sapiens
cctcttatttttcaggtaaagagattataaatcttccactgaatgaaaaaaattttcttaaagctgcatatactccaagaaaaaaaccacaaatgtttttctgttttgcctgaatacatgatttaaacaagagatttccacagaaggtaagataagtttctttttcaatttgattctgttttattgtgtaatttatgtaaaagttctgtacaggtggaagttcaaagatgggtcacagcgaaaaacgtagtttagaagatatgctggctgggcactgtggctcacacctgtaatctcagcactttgggaggccgaggtgggtggatcatgagatcaggagttcgagaccagcctgaccaacatgatgaaacccgtctctactgaaaatacaaaaattagctgggcatagtggtgtgtacctgtaatcccagctactcaggaggctgaggcaggagaatcgcttgaatccaggagatggaggttgcagtgagccgagatcgtgtcactgtactccagtctgggcgacagagcaagactctgtttcaaaacaaaacaaaacaaaacaaaaaaacagatgtgctcatggtctgttgtcttttggtggtttttgatcctcctgtgtctggttttgagatgctctgcatgtttttgagcaagttgcttggtctttccaagcccaagtttaattcttcttttttttttgagacggagtcttgctctgttgcccaggctggagtgcagtggtgtgatctcggctcactgcaacctccacctcccgggatcaagcgattcttcttcctcagcctcccaagtagctgggactacaggcacgcaccaccacacctggctaatttttgtatttgtagtagagacggggtttcaccatattgaccagggtggtctcgaactcctgaccttgtgatccgcccgcctcggcctcccaaagtgctgggatagcaggcgtgagccaccgcgccctgtccaaagtttaattctgacaaaacaggaacagttttgcacatatttaatgaggtatatgttccgtctca

SEQ ID NO: 29301 - DNA, 1050 bp, Homo sapiens
ggtgggtaatttataaggaaaagaggtttgacacagttctggttctggtaagagtttcaggctgcttccgctcatggcaaaagttcaaggggagccaaagggaagctagcttgtagagaccccgtggtgatagagaggaagagagagaaagagaaggtgccagtctttttcttttttttttttggtatttttagtagagatggggttttaccgtgttagccaggacggtctcgatctcctgacctcgtgatccacccgcctcagcctcccaaagtgctgggttacaggcgtgagccaccacgcctgatgtttttttttttgagatggagtctctctgccacccaggctggagtgcagtggtgcagtctcggctcactgcaacctctacctcccagattcaagtgattctcctgcttcagcctcccgagtagctgggattacaggtgcccgccaccacacgcagctaatttttgtatttttagtagagacggggtttcactacgttggccgggctgatctcgaactcctgacctcgtgatccaaccacttttgcctcccaaagtgctgggattacaggtgtgagccactgtgcctgggtgccaggctttttcaacaaccagttctcttgggaactaagagtgagaactggccgggtgcggtggctcacgcctgtaatcccagcactttgggaggccgaggcgggtggatcacgaggtcaggagatcgagaccatcctggctaacacagtgaaaccccttcactactaaaaatacaaaaaattagccgggcgtggtggcgggcacctatagtcccagctattcgggaggctgaggcaggagaatggcctgaacccaggaggcggagcttgcagtgagccgagattacgccactgcactccagcctgggcgacagcgagactccatctcaaaaaaaaaaaaaaaaaattagctgggcgaggcaggagaatcacttgaacctgggaggtggatgttgcagtgagccaagatcacgccattgcactccagcctgggtgacaggaatgaaactttg

SEQ ID NO: 29302 - DNA, 1031 bp, Homo sapiens
tgaatactcaaggtgtgattgaagaattccaattcattccatgtgtcaaagatcttgttttaagatgttggtgtttttatattggtagggtgcccatcagccctggtttgcccaagtgtcctggtttttcctgtggtcctggtctcattaagaaagtgttttcatttcgagtccttttggaagtcttattctgctgtttgggtaaagaattgactgtattttttagtttttaatttttgtttttagggttgcccgtgttttcccaaatacagaattctaaaccagagaatagcaccttacatagtagagagattgcttctcttttggtaggcggtggccaggaaggaacgccaggtagcattaagccttggcccccaagtatgtcttgttccctgtctctttgctttcagtgggttccttgggccttcttgtttatgatggagaatacataggaattagcctcctcagcttccttctttcttgctgtgcttaagacaagcagccatatggggctgttatctttctgccactgggaaatgagagggtgggtgctaaaaaattaacttaaaaaggaaaaggatgaggccaggcgcagtggctcatgactgtaattgcagcactttgggaggctgaggtgggcggatcacctgaggtcaggagttcaagactagcctggccaacatggtgaaatcctgtttctactaaaatacaaaaattagccaggcatgatggtggatgcctgtaatccaagctacttgggaggctgagacgggagaatcgcttcaacccgggagatggtggttgcggtgagccaagatcacaccactgcactccagcctgggcggctgagcgagactccatctcaaaaaaaaaaaaaaaaaaagaaggatgaacacctttgagctcgtgtgttagtgacatcacatcccttctttcattcatttagtaaattcaagtatgatttgttgggcacttataatatgccaggtgcattacataactcctgtggccttttgaagaaaatattattt

SEQ ID NO: 29303 - DNA, 1020 bp, Homo sapiens
tttcattactcataaagcagtgtcatttataactctgagctgtgggcttcctcattcctgattgcagaattagaactgctcacccagtgggaagcagcagtgggtcacagcgggcccccaggaagcaccccctgccgcagagagacttgctgcactcagggcagaactgaaagaaagacagcgtctccaccaagggaaacactgggaggaagggaactttgccataacagttcctgggccactgaccatccactccacatccattgtccatctcctgtcatggcttcttcctcttcttcggttgacttcctgtggtaaattacactctgttaaaacagcttcctgagatggagttcgtgggtggtgatgtttagggcatcgggcctgcgtgtttgagaccctctgattagaagttcagactgggcattaccccctgggctttgggagcctccgtgttgtcctctagtctcacaagtctgatgtagcaagctcctggctcacgtgtgtcacctgttttctctcctctctgagggcatttaggttcttttctaagccctattgtttctcaatttcccagtaatgtggaattattccatgggtcaggacaggggatccccaaagagcatcattgagccaagagagtttcatagtcagagcttgggcgaatttagtaataggtaagtacaaaatcaagcaaacagaaaaatattgactctaagggaaaagttgtataagtaagcaaagatatcccgagtagacaaatgaggtcaacagtggatatccatttctttcatttgttgttctgggctccctgaacccttttagtctgtacatttgtgacattagctgagggaaatttctcatattgtttctttgatattttccctcttttctctttctgggacttctaatgaggtgttagattactcaaattaatgctttccttatttttgcttttaatgttttgtactttgcctttttggcctacatctgagagacttcttcatcttttaagttctc

SEQ ID NO: 29304 - DNA, 1106 bp, Homo sapiens
tctagcattagacttctgcaaaagcagttagtgaattcatctcagccagctgtaacggggtcttcctggagtccatccttgctcctgccttacatgtgacctgacctgggcttctgcccctccaggctgtggacacacaggtagagaggcgtggtggtccctgtgcctgcaccctgcagtccgccttggccagtcttctttcctgtgtcatgccccacccgcccatccctgatgggagtattttaaaacaaatcccagacaccagattatttctcatgtaaatatttcagtatgtatgtacatttatttatttttgagacagggtctcactacgcccaggctagagtccactggctccaacacagcccactgcagtctcaacctcctcaagctcaggtgatcctcccacctcggcctcctgagtagctgggactacaggcacataacaccacacctggctagtttttaaaatattttttgtagagatggggtttccccatgttacccaggctggtttcgaactcttgggctcaagtgatctgcctgcccaggcctcccaaagtcctgggactacaggtgtgagccacgatgcccagctatgtatctctaaaataaagacttttttcttttaaatataatcagaatttcatgatcacactccaaaaatattaaccgtaattgtttcataccatcaaacattcagtcagggcacaaaccagtatcttacatctgctttgagctctgagaaagcgcagctccacgaaggccgcggttccccttgacgacattcagcatgcatgtgagtgttcagtggaatgccgtcttcccttgcgctgtaaatctgagagttgcaagggccgccaggggactgcctcacctcagctccttctgaagctgagtgtgagtgaaggtcgccagcagcagtgggtcgtgctgggtgtgaggctgctggcagaatgggagtgggagtggaggcagcggggagctgtggtgtgggccgggggattgtcgtggctgtgaggtggtagtagatgttgtaaaaacctttactacctggcccttgcagcccagtgactagatgcatgtatctcataatttgccataac

SEQ ID NO: 29305 - DNA, 1490 bp, Homo sapiens
gaccagcctggcccaacatggtgaaaccctgtctctactaaaaatacaaaaattagctgggcgtggtggccggcacctgtaatcacagctactcaggaggctgaggcaggagaatcacttgaacccgagggtggaggttgcagtgagccgagattgtgactctgcactccagcctgggcgacaaaggggagactgtctcaaacaaaaacaaggcctggcgcagtggctcacgcctgtaatcccagcactttgggaggccgaggcgggcggatcacaaggtcaggagatcgagaccgtcctggctaacacggtgaaactctgtctctactaaaaatacaaaaaattggctggacgtagtgatgggtgcctgtagtcccagctactcgggagcctgaggcaggagaatggcatgaacccaggaggcggagcttgcagtgagccgagattgcgccactgcactccagcctgggccagagtgagactgcatctcaaaaaaacaaacaaaatccttgtatgctttgacatgtttcctccaatggtgacattttctaaaacactagtagaatatcacaactagaatattgatgtgaatgtgtgaatatgatccatcgatcattatgggctcaaaaaaaatagaggttattttttctttttttggagatagactctcactctatcccccaggctggagtgcagtggtgtgatctcggctcactgcaacctctgcctcctgggttcaagcaattctcatgcctcaacattccgagtagctgggattacagccacccaccaccacgtcttgctaatttttatatttttagtagagaccatgttggccaggctggccttgaactcctgagatcaagtgatccgcctgccttgacctccctcaagtgccaggattacaggcatgagccaccatgcccagcctggggttattttttcttaaatgtttggaagaatttattaggccattaaaccttctctgtatagagagcctattaattatagattttgtggagttttagtatgttctggaactattctgattttgtttcttgtcagtttaaataagtcctttttttttttttttttttttttttttttgagacggagtcttgctctgtcacccaggctggagtgcagtggcgtgatctcggctcactgcaagctctgcctcctgggttcatgctattctcctgcctcagcctcccgagtagctgggattacacgtgcccaccaccatgcccggctaattttttttgtatttttagtagagacggggtttcaccatgttagccaggatggtcttgatctcctgacctcaggtgatccacctgcctcgtcctcccaaagtgttgggattacaggtgtgagccactgcgcctggcctagataagtccttttttttttgtttttttttttgagacagagttttgctcttgttgcccaggctggagtgcaatggtgcgatcttggcttaccgcaat

SEQ ID NO: 29306 - DNA, 1025 bp, Homo sapiens
gcttcagcatccagcggggctcctgagctatagcttgtgtggctcatttgcaccctggtccttaagagagaagtcctgaagacagagcttacatacgcaccattaggacagagggatggtggtcatcctttatcatcttttgagccactcccagaacctcccagaactcagtcattgtgtgttatgtgtgttctttctgggtctggggtgtgtcaggcaaagagtctatattctagaaaacgggtgcagtgctgcaccaaaggggaaaggttcctgttgtttacttagacttgagcagcgacactgaaaggcctctttttctctttcagtggctgaatgaagagaaggtcatccagaggcttgtggagttgatccacccgagccaggatgaagatgtgagtgtgctgcttaccgagcttcgtgcatcagtccaggcctgtgctgccaggtcacccactgctgcgggccagggggcgagggagggcaagtcatccctttcctaagatgaggatcggttaggtacttttctttctttaatcaagcactgacttctaggctggattttttttttctttttttttttgagatggcgtttcgctcttgttgcctgggctggagtgcagtggtgcaatctcggctcaccacaacctccgcctcttgggttcaagcaattctcctgctcacccagtcgggtgagccaccacacccagcctctaggctgttttcttcttgttgttgttgttgtttaaatagagatgaggtctcactacattgctcaggctggtctcaaaaacctggcctcaagtgatcctcctacctcagcctcctaaagtgctgtggttacaggagtgagccaccatgcctggcctacacttttttttcttaactgaaaaataatctatgtgtattataaaaataggacaggcgcggtggctcatgcctgtaatcccagcacttggggaggctgaggcgggccgatcacttgaggtcaggagttttgagaccagcctggccaacgtggcgaa

SEQ ID NO: 29307 - DNA, 1086 bp, Homo sapiens
gagctccactggggtagaggccagctccatggtcacagatggcttggcagcatccagttcctcagggctgtgggccgaggccgccctcagcattgcaccacatgggcgtctccacagggcagcacacaacgtggagctgagctttcccctcactcttaatgtatttggctctttagacctgggtggctgggtccagcccacactaaaagagatgggggctataaaggcatgaactccaggacgggattgctaggggccccctaggagccacccaccctggaagcacctaaggtgacaatggggctccctgtggtgatccctgttgagagtttggggtatatcccagtaggccttttcctagcattacacataccgatctatacatacaaccacgtgtccttggcagattggaaaacagtggtgctgactcgtgtctgaggccttcaccgctgcctggccaaccaccctactttgttctccatcagcccacagggctgatcagacagacaggagaggccacgttggcgtctgtaggaaacaaggaggccgccctgcctgatgttggcgtctgtaggaagcaaggaggccgccctgcctgagaactggagcccacccatgcatgtgggtgttgtgggctgatggcctggcctgggtcccaaaggcagacctgagagctaatctggctgctttcttttctccctaaaatactcctgtgagtgtttgctttccctcagtcttcccacagcatgtgaaccaatgctgcagggagtcaggggttgtttctctcttaatcacatttgtcttacctacagaacagccctacattgtcagcaggggcacgttcccatcacggattgcgtgttaatgtttccctagaaaagatgagtcctctgttttcttggtagcaacttccctattttcattagcttacaggactcattctgaataatagcagctacttattaccacatttaaaatatagtatcagtaacatggccacatattcagcatatttcaaaacgtggatcacaggtatagcccagtatctgcattgcatatctgaccattattagccctgttttgaat

SEQ ID NO: 29308 - DNA, 1049 bp, Homo sapiens
acataattcagcccccaacactgatagcctgtgcttttttaaagtgaaagaaaaaggaacaatgagaaaatgataagaaattgacttaaccttgatagtgaggttgttaggactctctttctctctctctctctctctctgtctgtctctggtagtacctaatacatatttgttagtttattaaccagaagtagtgttataatgttaccgttttctctagttaggcaactggaatattgatattttaatcttcataaacccaggaaagctgagccacttctgaggcccaagcttaaccctgtatgtgatagaggggactgtgtaaaaatcaggaaaacagagataagccagctgtttctcttagattattgtgattattattattattattttcagacagtgtcttgctctgtcacccacgtgggagtacagcagcacgatcatatctcagcgtggcctcagagtcctgagctcaagcgatcctcccacctgtcccccccaaagtgctgggattataggtgtgagccactgcacctggctctctgatttttaaaattattttgcatattactttaaaaaatatatgattacgtattacttttacaactggaaagagtgtttaaataaatatctcagaagacttgcttgaaaacaccacagggggtaggcgcagtggctcacgcttgtaatcccagcactttgggaggccaaggcgggtggatcacctgaggtcaggtgatcgagaccagcctggccaacatggcaaaatcctgtctctactaaaaatacaaaaaggaggctgaggcaggagaatcgcttgaacccaggaggtggaggttgcagtgagctaagatcgcaccatcgcactccagcctgggtgacagagcgagactctggctcaaaaaaaataaaaataaataaaaataaaagtcgacacaggaacagtgaaagagacagggatagcagtgaaggttttaaaagtgggacagagcaggacctctaactggtgctagggccagtgagtcctgtgttgtgtcacttgccctgcc

SEQ ID NO: 29309 - DNA, 1050 bp, Homo sapiens
aggtgaacctggaggagggccgggggcgcggacgctgggcaggggccgggcatttgccctggaggtgaacctggaggagggccgggggcatggatgctgggcaggggccgggcatttgctctggaggagggccgggggcatggatgctgggcaggggccgggcacttgccctggaggtgaacctggaggagggccgggtgcgcggacactgggcaggggccgggcacttgccctggaggtgaacctggaggagggccgggggcatggatgctgggcaggggccgggcatttgctctggaggtgaacctggaggagggccgggggcgcggacactgggcaggggccgggcacttgctctccgaagtgaacctggaggcctctgccacttggctctctgggtcgtgggtctggcaaggtcggggccaggaggccgccccgatggtgcctgttgctttcagggcagcgggtggcatgagacgtgggaacatgggccacctcacacggatcgccaacgcggtggtgcagaacctggagcggggccctgtgcagacgcacatcagcgaggtcatccgaggtgagcccccaacccggtcatccttctgctggtcgcgggcaccgggaccccgaaggagctgccgcctgagactaagctctgcccggcagcaggtgctgactgcactgacagtgagagacccatggccacctctgtcctctcacttcacacatcacatctctcctcgtgggggcctgggtctcatgtgtcagttctattgggcggacttctgtggagaccctgccaggcgtcagcgtgtggcacaagagacagtccctcccggggtagttggtgactccggagctggcactcagaagccgttagcgccaccgggctccttgcagctcagggagccctgcctggctaggctgtcctggctgtgtgctctgcactcaggtgattggagagtctcattctcactcaggtgtgagatttcgtagcacaagtctcaggggagcaggttgcagcctgtttcttaagaacgcagtgggttaggt

SEQ ID NO: 29310 - DNA, 1961 bp, Homo sapiens
gatctccagattgtgaatccttccaggactctgacctccccggaaaaacaggcaggacacgcgcccaggcctgtaggctgctgctgagtttgggcctgtgaggtggggggaaggaagctggctgctttctcagattctgttccacggcttctgcgtttctgggagttcctcagaatgggcttccacccaacagacttggaactcagatgcccactggggtttcggtaggggcagaagtgcccaccaccctgcccacaggtgctgcacctcaatctcactgtggccccaggcccctccggacacgcggctatgctgcctctttctcatccggcaaagcccctgcttcaggccctcagacgggctgaccacagtagcagcgccccatcctcccggacccaggatgcacctgccggagcccccgggtgccctgcaccatctgcacggggtctcccagggctcaccaggcagcacttcccttgcagggctccctgcggactgccgtggccgctgggagagcttcgtggaggagacgctgacggagacgaaccgcaggaacactgtggacctggtgaggaggctcggggctgccccctcggtgcacgcacggtgctgggacgccgtcagacgctcctgcctttgccctgaggcagaggccaagggaggcacaagggccgcacgcctgcctgctcctcttgactatgcggtgcccctgcatagtgtgtcctccgggctgatgtccgtaacagagaccccgtcctgtgccacacccagggctgggtctctgaggacctctgtgcagagccggtgttggcctcaggtccctttcctcccactccaggagctgtagcttgttggcagagggctccttttgcctgagacccacaacctgccccctgcacatggaggtcgggctgtcacggggccttggcctcacctaggcacctccttacacagcacggcctcctgggcccagagatctgatgagtgatgtgctgggtggggtctgggagccctgggctgggcatggtcctgggcgctgggctgggtggggtctggggcgctgggctggctcacacgcccaccccatctggcctgtgttttaggtgagcactcaccaccttcactcctcaagtgaggacgaggacattgagggtgctttccctaacgagctgtcccttcagcaggtgagggcgtggccggcacctgcaccctgccgggcccttcccggcacctgtgtgcgctgcgcttggtcctccagacgagtctgatggcatctcactagcaaaggggagcgggggctcgtctccgagcacgtatggggcggggtgggtctgaagggagaaccccaaagtcactccaccttgatgagagcactgaggacacggcagatggactcgaaagtcagagaatatggggcgtatctcagatgtgaccgcagcgagcgcgcagcctgagttttggtagaatcgtgagccctgaacagagtttactgcccacttgtgctggaggagaagctcccgaacaactagagagattgtggttcccaaagagcagcctccaggcctgatgcctcctccatgaccggtgtctgtccgtccctccctccctccctccctcccaggccttctctgactaccagatccagcagatgacagccaacttcgtggatcagtttggcttcaatgatgaggagtttgccgaccaggacgacaacatcaagtgagtctacttggagcgcactctgcacgaggcgcggctctccctgctgctgagctcccgtggaggcagctccctgaggtcttgccgggagtgccgtctgatgtccccgggagacagcaggtgttcccagttgtgtgagggtgctgaggcccccgatgagcaccgggggaggagcactgaggccccagatgagcagtgggcctggaggaacgctgaagccatcccccttgctcttgcagtgc

SEQ ID NO: 29311 - DNA, 1945 bp, Homo sapiens
ttacccacttctcctaaacaacccctaaaaaactgctctgaaaagcagggaatatcattgtgcaaagtaagttgtttttttccacggggctgtctgcgtaaaacttgccacttagagccctgcctgcaccgtcgtcacggcccagcctgcaggtgagcttcctcgcgcccccgcctgacctgagtgcccctccctcagtcagacacagtgtcgtcgccctgcaggaagccagggggcccgtctgctgctcgtggccaggctgggccttggggtgcccgaccccctccagagcaagccccttagatgcccggcagggtcctctctaccctcccatcccctgggaggtttccccagactgtgtccagtgtgaggctgaagttgagatcatagcacaggaggctctggggtccttgaagaatgaggcgcttgatgatgagcaggatctgagtgctgcctggaggaggtttgaggtcatcaatggacaggcagcttgtcccagtacttggaacttggggcagcagagctgcctagctgggcacaacctgggccaccccacaaagggcaggagtgagaggggccaaagatggtgctcccaggccgcctggacctttttgtccagctggtccttgggcatgaggcggggtggcactgagggtgggggtgcccgtaaccggagtccatgtttgccacacagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggtgagcaggttgagtgtgggggtagggggtgtggacagggcccgcagcccgcacggttccaaccccaccccattcctgcaggaagacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagttttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactaggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaaccgcgtactgtgaaccttccggcccc

SEQ ID NO: 29312 - DNA, 1050 bp, Homo sapiens
cttgcatctggtcagacatcccctgttctcagtgacttatggtaaatgacttagcagctttttttttttttttttttttttctgtgaagagtcttcctctgttgcccaggctggagtgcagttggcacaatttcggctcattgtgacctctgcctcctgggcttaagtgatcctcccacctcagcttcccagtagctgggactacaggtgcgcaccaccacacgcggcttttttttttcttcttttttttgtagagatcaagtttcactatattacccaggctgatctccaactgggctcctctgcctcccagagtgctgggacagggtctcactctgttgcccaggctggagtgcagtggcatcgtcccggctcactgcagcctagacctcccaggctcaagtgatcctcctgcctcagcctcctgagtagctggaaccacatgcgtgcaccaccacacgcagcgaactattttgtagagatggggttttgccgtgttatccaggctggttttgaactcctgggttcaagggatctgccctcttcggcctccccaagtgctaggactacaggtgtgagccaccgtgccccgccagccatctgtgattttgaccaacttcccattttatgatcctaatcaaagttccactgatgatttcggcccaggcccagtgactcatgagtaaccttgaccagtgttctcattagtgaccctaatgatccaccagtgatcttttagtgattctggccagggtctccatcatcaacctggattaatgactgatccgtggcgccccgtacctgctctgggctctggatgacattgaatccaggaatagactccagcttatccaaggtgcctcctgtgtgccccagaccacgtccgctgatcattggcacctggtggtcagggatgctgagtaccctgcacagtacccctcccccacctctgtgcatcccttcaccttccctggctaggagtgcagctggatttggaaagtatttaagcagctataggggtgcccagctggtgagggaatggaaaggaag

SEQ ID NO: 29313 - DNA, 1031 bp, Homo sapiens
tttctttctttctttctttctttctttctttctttcttttccttctttctttctttctttgtccctccctcttcctcttcctcttcctctctctctttttctttcttttctttctttctgacagagtctcactctgttgcccaggctggagtccagtgacactatcacagcttactgcagccttgacctcctgggctcaagcgatccttcagcctcctgagtagctgggactacaggtgtgtgccaccacctggctagcgtgtgtgtttgtgtgtgtgtgtgtagatggggtcccactgtgttgccctggctggtctcgaactcttgggctcatgctatcctcccaccctggcttccctgctgggattacaggcatgagccaccacacctggctcctttatttttctttctttccagtctattacttttagcctatcttggtgtttatatttaacatttcatttcttgaggtagcttatagtttgtgtctcactttttaaatacattctgataatctctgcctttcaatctgagtttagatcatttctatttaatgtaatcattgatattattgggtttaaatctaccatcttgctatttatttgtcccatcttacctttgttccatttccacttcttttctgctttctgatggattgatcaagtatgttttcgtattctgttttattaccactcttagcttattaattgtgtcttgttgtagtttttaaaatgttttctctaggatttataatatacatttttaacttgtcatagtctaccctcacatgatgttatggcatctacatataatgtaagagcctccttacagcagtatgttttcatttctcctcccatcctctgtattggtgttgttatgttttacatctgcatatgtcttaaggctgggcatggtggctcatgcctataatcccagcactttgggaagccaaggctgaagaattcttgagcccaggcattcaagaccagcctaggcaaatagtgagaccctgtctctacaaaaaaataaaa

SEQ ID NO: 29314 - DNA, 1047 bp, Homo sapiens
gggcctcagctacgactcagaccactgtgagaaggtgggagaagagttggggacacagatccagctcaagggagggcctcattaggttcttcttagcgttcacttggggttttagggtgggtgtgagctcagccttgaaccggggactcctctgatggctcctccccacttaacccttgaggtttccttggtatcaactctctcttattccaacacattgcaggcctccacgcagggccttccccagcattctccccgaccccatcggtggccagcccggggcagggaggtgctcctttgctttgggtgccctctgtcctcagatcactcccagaaagatctaatccctggcagctgccatcacaaccttgtcccctctgcagccctgtgccctcgtctgcagctcccatctgtctgtttcatgtctccccctgctgaaatcttttctcgtccatctcttgcttctcctcctccctgtctctccacatttctgctttcatttattgaagaacatttctgagcaactgccatgtggcaagtactgggggcttctgggtgctgggagtggaacaggacagctgctctctggagctgcaacttagtaggggagaaagacttgtaagggacaatggctgcccacgtgtcaagggctgcattccaacagggacataagttccacgagggggaagggaacccaatccacactgaaggaatcagggagaatttccagaggaaatgtcaaccatgccctgaggttagcagagccaggcagatggggtaggtaggagggaatggaggagaggaagtgccagcatggggaataactgtgccaatggccctggggttggcgcaaagttggtgaatcctcagagtgcagaggctgtctctccatttctgcatctgtttgatgtttactgaacatccgctgagccccaggtcttgttcttgggggcgggtgcaacagtgcataacatggacatgaccctgccctggtggggcttgcaacagaccaaaaaccatgtccagtaactgtaagttgtgttaaaa

SEQ ID NO: 29315 - DNA, 1030 bp, Homo sapiens
tcctgctgcagaactctgcctgcctctccctctggacgacgatttttgatttttgctaatgtctgggtggaggagctgggcagtgactccatgagcgaggccccgcaaggagctgctttccagtgggagcgaggggtagaccggaagagggttttacagaccaggggtaacgtccagccccacctcggagctgggcaaggggctgtcagtctgctaggcccgcaggaggaggcctgagttggcaggagatatggtctccagtagccaggcagaggccttgctctgtggtcctggggcaggccctgaatagggccacagagggtagcagcaccggctcagagaagggagagtggacgcccctggtcatcatggaattaactcagagcgtgaactcttggtaggtgcccagccctgtgcttgggctgaaaccaaaaaaagacaacttcagatcttgaaattgtgcgacccccacactcctgtcccttaccctctccccaagccctttgttcctgcctcttctctctacatcatttgtggggtggccaaggctgggccagggctctgacgtgccctccacactgacttgcccgcagctatttcggcttcatcaccaaacaccccctgctgagccgcttcgcctgccacgtctttgtctcccaggagtccatgaggccggtggcgcagagtgtggggtgagtggggccccagggtgtgggtgcagaatgggtgcagggttacggaggtggggagcggaggtgagcaggtgggggcaggagcctggcaggggaggtctggggaaggagaaccagatgtgctgtgtagagagggcagtggtgggtgacagtttggggtgctgggcatggggtgggaacaggcacagacacatggcccaggcactctggcaggggtagaattgctgggccaggagagctgagggtcacacttgggggtgacatggccatgcctgggtggggggttatggatggctgcagagggaggaaggagggagagctcagaggctctgtggaag

SEQ ID NO: 29316 - DNA, 1042 bp, Homo sapiens
actgcccacaggaggtgttgggggacgagcccagcacgcgaggggtatttggtgttgatgttcccttcgtcccctcgccagggagagaggagggtcagcagggctctggggcaggggtatggggaaaatgagaagactggggtgacaggtgtgggtctgaccccccaaccccgagagaccagcaggggtgcagaagccaaactgcagagggggtggagaggggggtggtggaggggggtggtggagaggggggtggtggagggggatggtggaggggggatggtggaggggggtggtggagagggggtggtggagaggggggtggtggagaggggtgtgatcctagccgctgatgtaattcaggggaggtttccgggccctttctctggccaggttggttggcactgatgaccaggtggacgtggtctctgacttggagtttgttggggagtcgggaatattgtgggggtttgcggaccaggaacagagccagaactcctctattttcagtaggagtgagatgtgggaagagtggtcaggctgctgaggttgtgtggtcatagaaggtggaggcagcagtgggctgccagatgggtttgggcacactgggaagcagatacgcccgggcctgttggatgactgggtgcagggtcacaggaaggggaggatgagcttggcagcttgggcagctgcggggccttggctgagatgggaaacatggctgcatgttgggacagaccagtgtgcccgtttgcttgggactgctggttttagctctgaacttctgtccaggcagcccctcagtcccaggcagacagagggtgggtcactccagttatagggtgtgcctgtggcatcccagttacagacaagagtgtgtgtcagtagagaagaggaatgggctggggtctccggggcccccaaccaaggaagactccacacacgaactggagaaggagcagctggggctggctggcgaggcaaagctggtgctgctcagcccctccctgctcctcaaggccttgacctcccctttccctca

SEQ ID NO: 29317 - DNA, 1065 bp, Homo sapiens
caagcccaagctcaagtccccgctggggaaggggccggtgaccttcagggacccgctgctgaagcagtcctcggacagcgagctcatggcccagcagcaccacgccgcctctgccgggctggcctctgccgccgggcctgcccgccctcgctacctcttccagagaaggtccaagctatggggggaccccgtggagagccgggggctccctgggcctgaagacgacaaaccaactgtgatcagtgagctcagctcccgcctgcagcagctgaacaaggacacgcgttccctgggggaggaaccagttggtggcctgggcagcctgctggaccctgccaagaagtcgcccatcgcagcagctcggtgagcagggcggtgcggggagggatccgtgccttgtccgtggccccgtctgtcattcctcttgtctgttctctggctctcctgttcctccttgttctgttccattccttctgtggcaacccccaacccgcccccgccatccacctctgaatccggtcttgcttggcctgcccgagagaggaggttcttctgggcgtctgacacgtcagggttgctgctcactgtgtccctgttggtgccagaagtgggagctgggctcccctcagagactcaggttgggcatgaggcgcctccatggccctcctggaggctcttggccccagggattcctgtgagttctctctctccctcccgacacaggctgtctttaccattaagggttgttttgtgttttactttggaggtacgcctccctcctcccatcctctctgtggccatgtggctgcccagtgtggctgataccctctgccttacagctgcctcctgccttgcttcctctggcggcttggagcacactgactccttttcttttgggggatctgccactaactccctatttcccatcccagaaacatttgtctcttggcaccaccttagaatcccttaaacatggattcccgtgtgtcatttctaaagtgcagtaagaagatagatggaagtcacgccatctccctgcactccatctgccctcttgccttctcc

SEQ ID NO: 29318 - DNA, 1056 bp, Homo sapiens
cttctggctgcaggcagcggagcggagcacaggacacttggtgatgtctgagtccagtcctgtttcagatctggtccttgtgtgcccaccgtggctgttgtcagctcttgtcctgcggcccctaatggctggagtccggtactcactgctcacttagggataaaactgctggtggaactgcctaaagtgtgggaggttctgacatccaggtatggctgcttccttcccagggccagtcgtggcagaggcgctaggtcaccctcagggccataccctgagctgtgtctccagccccttgtgttccacagtgtttgtctcccaggcccatccttctcctccctgaccgacaccatgaggaagggaatgcccacccaccttttccagagatggctcattcctgatgtgctttagccacaaggtgttctgtggcctgagagctttctggacaagttaagctgtcctgtatgtcgtggaaccaaagctcggtaacctgtggaaaaatgatgagctctggggccacctttgattttcaggggaacctggaggatgtggcactctcatgctgcctctggaaggtccaggaccttcggccttttgaatcctcgatcccagattgtccacctgctctgtgctcccagctccaagtctagctctgctggacagaccattcatctgcccagagcccctcctcggtctctgggccccacacctgactctgaggctacatttgggcatgattcagacctgactccgagccccacaactggccacaggcaccccatctgtctgaggctctcacttgtctctgagaccctggcttcacacctggctctaaactccatttgtcttccaggccccgtgctcggatctgaatcccatgtggggtctgaggtccatagtaaggctcacgtctgccttggcacttagctttacatgggactctcacatctggttttgtaggtaaagttcatggcaaagtagctttggaaacacaaaaagaggttctttgctgcagtacttctggtgcctttgacaagcttgtgtggaggagggcac

SEQ ID NO: 29319 - DNA, 1066 bp, Homo sapiens
taactcgatgtttcaccattccaggactgccaaactgttttccaaagtgcctgcactattttacttcctcctcagcagtgtataagggttccgatttctccacagcctcattaacacttgctattatctttttcattaccagtaagtggcatctcattctggttttgatttgcatttctctcatgactaatgatgttgagcatcttttcatgtacttatcggccatttgtatattttctttggagaaatgtgcatttgcttcatgtatttttaaaaaccattttatcgatatacatatttaaggtataccacttgatgagtttgaagtaagtatatacccataaaaacgtcaccacaatgaatgccataaacatattcatcacttcaaaaagtttgctccctctctcttcatttctaattcttatgttttgtgataaggacacttaacataagatctatttccagtaaatctttaagtatgtaatacagtgttgttaactatagtcactatgctgtacaggaggtctctaggactcatccctctggcatagctgaagctttgcacccaatgagcaatgccctagcccttggcaaccaccattctactctctgcttctcagtttgaatattttagattccttatgtacgtgagatcatgtagtatctgtcctactgtgtccggcttctttaacttagtatatttgctgcaaatggaaggatttcctttttattttattttattttaattttttttgagactgagtctcgctctgtcgcccaggctggagtgcagtggcgtgatctcggctcactgcaagctctgccttctgggttcacgccattctcctgcctcagcctcccaagtagctgggactacaggtgcccgccaccatgcctggctaattttttttttttttttgtatttttagtagagatggggtttcaccgtagccaggatggtctcgatctcctgaccttgtgatccgccggcctcggcctcccaaagtgctgggattacaggcgtgagccactgcgccaggccaggatttccttttttaaaaaggct

SEQ ID NO: 29320 - DNA, 1157 bp, Homo sapiens
tattatctttccaaacatagccatataattcctctgtattagaatttttcacaggaattctaactagtatattttttgtacatgctttaaagaataaaaaaatttgaactgttgaccaaatgtgatatattatatactattgtgtgtattttaaagtgagggtaaaaaaagacaccaaagcctctgggaagttaaactataaattgacttacagaattaattaattaggaagttaaactataattaacttacagaacttaccaagaagtgttaatgcctaccctaggaatgactataaacctattagttagaatttccgtatatctcagtttttaatatgtaattgttttgaaaaatttggccaatttgaaaaaaacaattaatatgtaaatggatatatctacattaattcatattctttattaattctttattagatactaatctgggttctgtacaattttgtatctggccattcatttgttttagatgccagtaacaaatatacaattttttgaaaccaccaataccaatatatttttaatggatggagccatctctatgctgatatatcacggttactacaccaatttatagttaagagatatccaaatgtggtgttggacctaggaaactaatacttataaacccagtcaccaggaatgcatggttgaatggccaaaattcaggaaatgtacaggtggataaaccaatgatccattaacctaacagtataatggttcccaagaaccaaggggaacaaaattggttggagaagaaatagaagatacttgcagaaaaaaaaccaacttgctgctaaggccaggttccttactggcatgccacccctccatcctgggggtagccagtcctgagtgagcctccctgaggttcactggtagtcactacacatgtctagctagtggcattccttggtcagttttgaatgtagagatagaaagcaaacaaacagttacccaaagacagtaattctctcccatccacaggagggttttgcctagcattcacatgcatgttgctacagtacaattgattcattaattaactttagccaattacttagtaaactcaggtcaacaagaaaggaggcaatgctttcattcatagctgaaaccatacatactgaggatctaata

SEQ ID NO: 29321 - DNA, 1050 bp, Homo sapiens
ctccctttcacactcatgtggttggctcatttaacaccttaacctcataggttctttgtttcctcagctctgagactttttcttgaattcagccttccactgcctatgtcttagacattttttaatggcctcaactgttccatgtaagtaaccataagcctaaatatccatattctcttacccttattttgatcttttaaaatacttgttgagtatcccttatcgaaaatgcgtgggaccagaagtattttggattttggatatttttcagattttggaatatttgcattatacttaccagttgagtatccttaatttgaaaatctgaaatctgaaatgctccaatgaacatttcctttgagcatcatgtaagtgctcaaaactttcagattttgaagcatttcagattcagtaacagtgtgcagttgtgataaacaaattatatatggaactgacgtgatcctacaacataaactctttgagaactgaggctgtgcattttttagattagtagatactttgcaatttttttgaatggagtctcactcttctgcccaggttggagtgcagtggcatcatctcagctcattgcaacctctgcctcctgggttcaagtgattctcctgcctcagtctcccgagtacctggatcacaggcatgcgctaccacgcccgaatattttttatatttttagtagagatggggtttcaccatgttggcgaggctggtctcgaaatcctgacctcaagtgatctgcctgcctcagtctcccaaagtgctgggattacaggcgtgagccacctcgcctggcaatcttctttcaacttaatcagcccttatacactcaaagagttacttggatgcatgcattctcattatctattttcatcactgcatatatctgaggaaggataatgagactctactatcagtagaaggatgcttggattatcacgtgcaacactttatagcctatcttgacttttctcccaaacttcatagaagaaaagatgggattttctgactctttttaacttcctaggactagag

SEQ ID NO: 29322 - DNA, 1035 bp, Homo sapiens
taagaagcaggcaaaaggcaagcacaggggtggcatgcactcacactggggctgctccttcctgggcaagtttcagaaactcactgacagttagagctagcagctcccgtagagatgaatgcccatgttttcctgaagggagaactgatgcttagaaaggctgaatgacttgtctaagactctgggaccagaacagggatcttattccagtatttcttgcatgaagccattctacttccacgtttctaatttataacttttaaaaggtcattttaaaaacgaaatagcatgaacatcaagtctggaggctagtggtgggattattcacatttatttttccacttgacatttgagggcgatagtgatgcttaagtaaaaccaaaattatcctgggagtatagaaaataatatatctgtttacattttggtgtgggatgagtagaatcttgttttcaaattccttgcttgaaaggctattaagaagaataaatcctcacttaacagttttctaaatccttggtagtgtcctctgtcctttggtaacacatgaaagtagagcacacttttctacttttgttccttctgcacccctcataaggtgaagcatgcatagagcactcccagggtcagtgtgagcccagcagcagctcaggctgccgatgctccagagtcggattccaccttccacttaaatggcagccacaggtagacgtgcccatcacaaccaactctgtgcgttcataatttctgtttattctacaggtggtttccacaagaaaaatggcacaatgtttctcagaagacaattacataagaatcagcatacttcaaattcacagcaaataatcagacaattgatgaaaatacttacccaaacactaattgtagactatgccttctgaatatgtttgtcataaacttggagtaaggaatcctcacaggcactggacaattcaaaaaacgtaaagttgtttgttagaatactggtgcttttggatagaaaccctcatccatatcctggtaaggcttgaagtt

SEQ ID NO: 29323 - DNA, 1029 bp, Homo sapiens
ccagctccagaagtgaaagagctggcttcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccaggaactccaggagaattttgtgtggtgtttaaagggtaagaagctgctgggtgtggcagctcacacctgtaattgctgtgctttcagagctacaggcaggaggatcacttgaggccaggagttagagaacagtccgggcaacacagtgagacaccccccactacaaaaaacaagaagacccctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagtctctacaggagctcaaaggatgcatttgtccatctgccctgggctcagcttccacactcagagtcactcacatccctccaccgtcgccacagctcacctgtgtgcccacacagacaaggtcacactgaccccaaacgcacactgtt

SEQ ID NO: 29324 - DNA, 1027 bp, Homo sapiens
gcctcccaaagtgctgggattacaggcgtgagccactgcgcccagccaactttttaatttttttaagttcattttacaagagaggacactaagcctgaggttactcgaccacattttatgggcagtaatctggatctttgtttttttttgagacagagttctgctctgtcgcccaggctagagtgcagtggcacgatctccactcgctgcaagctctgcctcccgggttcacgccattgtcctgcctcagcctcctgagtagctgggactacaggcgcctgccaccgcgcctggctaattttttgtatttttagtagagacagggtttcaccgtgttagccaggatgatctcgatctcctgacctcgtgatccacccgcctcggcctcccaaagtattgggattataggcgtgagccaccgcacccggccaggatcttctaaactttcaagttctgtgtcatatttattggcccaccagtaagctaatggattaagtttcgaacgtgtggtaatttttttcatgagcagaatattctacccaattatatcctttagtaacttgtcggttactgttacccttgacgaaatttttagtttcctagtacgtcatttataatgaaaattgctgatctttccttttgaataaattagaatccttgaaaatgaatcacaataaattttctgttttatatatgaaattagtgttcataagcaagtaacgcaggtcaccagctgtttaaaactgttaatcaaaacttgatgtaatgaattaatattgactaatttccctctaggcagaagaagagttcaacatagagaaaggtcggcttgtgcaaacccaaagactaaagattatggaatattatgagaagaaagagaaacagattgagcagcagaagaaaatgtaagtagatcctggttgcagtattaagctaagaagttttctgaagtcatgagcaggcgctttggagtcaggcatatataaattcaggtcttaactcgaccacctactactaatctgacaaa

SEQ ID NO: 29325 - DNA, 1034 bp, Homo sapiens
ccttcaggccagtgtccctcaaatcctattccgttgaaaagtccccccaggatgagggactccaccttctcaagcctctgtccatccccaaaaggctgggcctgccaaagccggaaggcgagccgttgtccctgccaaccccccggtccccgtccgacagagagctacgcagcgcccaggaggagcgcagggagctgtccagcagctctggcctgggcctgcacgggagctcctccaacatgaagacactgggcagccagagcttcaacacctcggactccgccatgctcacgcccccctccagcccgcccccaccgccacccccgggcgaggagcccgccaccttgcggaggaagctcagggaggccgagcccaatgcctcggtggtcccgccgcccttgcccgccacctggatgcggcccccccgggagcctgctcagccccccagagaggaggtgcggaagtcgtttgtggagagcgtggaggagattccctttgctgatgatgtggaggacacctatgacgacaagactgaggactcaagcctgcaggagaaattcttcacgcccccgtcctgctggccgcgccccgagaagcctcgccacccgcccctggccaaggagaacgggaggctgcctgctctggaggggacgctgcagccacagaagagggggctgcccttggtgtccgcggaagccaaggagttggccgaggagcgcatgcgagccagggagaagtccgtgaagagccaggcgctgcgggacgccatggccaggcagctgagcaggatgcagcagatggagctggcctcaggcgcccccaggccccgcaaggcgtcctcagcaccctcccagggcaaggagcgccggcctgactcccccacacgccccactctcaggggctccgaggagcccaccctgaagcatgaagccaccagcgaggaggtcctctccccgccgtcggactcagggggcccagatggctctttcacttcatccgagggctccagtgggaagagcaagaagaggtcgtca

SEQ ID NO: 29326 - DNA, 1025 bp, Homo sapiens
tgactgcagcaaagaagagccctgtatatgcttgcttcaggctctgagggttgctccgtcctcagtgttcaggcctgaggtgtccactgacaagaatcagcagagggatctaaaaaaaatctgtattcatatacctgtacatctgtacatgtttgcagacatatttaaattctagagaagtacacacttactgaggaaaatgctgaaaagtacagtaaaggtaattaagccacctgtaattctattaattaatattttcctgcccttctttctggtgtttttttcagtgtattcttgtttttgtagatgaggtcattcttaacatatacttttcgattctccttttttcatttaaccgtaggcgttcccatgttgttcctgactctttacaagcaccttttggaatgtgtgggcatcaggcttctcttagctgttgctctagtgttggatgttcgagttgtttctcatctttggataagcgttcttatgataaagcttcttttgtgtgttgcagctgtttcccgggatattttcctaggaatatgagcattgagtgctaagcagcactcccacatgccatgcatgcgagtgcatggcagcagcttgtggcttggggtgtcttggttagggcgtgtctctccccttgattgtctaaaagtcactctgacttcttacaagaggcggggctgggattttgaagattcgcactggaagtgtctcataaatctcaatgataactggagagagcagctggagggcagggctgcttctctgaatttctcttctctctctccgtcttttccatgcccatcagccattcttcctatggaccagatgggtgggagcagctttgcttggagtctggccataattaactacctcccacatctagtctttgcacgccagtcttttcatgctatggctcacagaaaaggtgatgatattcattgataaacggttgtggttgtctggaggctctggcagccccaggtgcccctaccttgggaaggctggaatgctgtccg

SEQ ID NO: 29327 - DNA, 1049 bp, Homo sapiens
gggaaagattgtgatcagtggcagaggatgggcaggtgagtcagctctgttccaaagggaacaggcagaagtggttgagggagcctagcaggtgggggtggaggggcgcctggagaaggttaggggaccgtcttctaggaaggcaaagcagcacagggacagcgcggcactgttcagcagcagtgaggtcatagtttcagaggctgaacctatggtgaggaggagtttgagaaaatggaaaatgctgtgggatcctagattaacacagaattaagggctgctgggttaacctgaagtcatgtaaagaagaatgcgatcagtcttctgaaaagcaagaggcttaaacccagtaggaaatggccattaatctaaataggaaacttagcaatggaaaaattttttgaggaggattttggaatttcccctccaggagaaggctaagattgatcagagctgatttagtaccttaacagcttgtcaggtctaagggccatggtgggtgatagtcccaggcctgtaggagcaatctgatccaaatgggagatgtatcatgttttgacattagtttaatgtggatgggccatacacaaggatcaagatatattaaagatagttcctattattttttatttttatttttagagacaggtcccgccctatttcccaggatagagggcagtggcacagtcatagctcattgcaaccttgaacttgcgggctcaagtgattctcctgcctcagcctcccaagtagctaggactgtaggcatatgccgccatgcctagctaatttttaatttgaattaaatttttaatttaaattgaactcctgggctcaagcaattctcctgcctcacccttccaaagtgttgggatcacaggtgtgaaccactgtgcccagccagtccctattctcgagctcacattttagtagtaaatttgtgttactagaaaaatgagagtcgttttttgactttctccctttttttctttggtgggtagacctttcatcacttcctgaggttgctttgcttttcctcagtaaaaaga

SEQ ID NO: 29328 - DNA, 1049 bp, Homo sapiens
gtcttgctttgttgcccaggctctctggggtgtggtggcactatctcagctcactgaagctttgacttcctggtctcaagggatcctcccacttcagcctcccaagtagctgggactacagctaatttttaaattttttgtagagacgaggcctccctgtgtttcccagactggtctcaaactcctagccttaagccatctgctggcctcggcctccccaactatagggattataggtgtgagccaccgcacccggccctgtgtagctgatttctagcacaaagtcccacagttaaaatgtgtttgtttttctcaaaccccaccttatttcataaaagatttaaaggtcatcatcctaacttctgtctgaactttacccagccttctatcccagactttcctttcagccattctgctcttaggtaggaatttgttacttgatatttgattttctttctgtttgactttgtaaatttctgccaggtgcgccatttatatgatactggcgaaacaaaagatattcacctggaaatggagagcctggtgaattcccgaaccacccccaaattgactcgcaatggtgagttctggtggtggctttttaaaatgcaggcagccccttcagagaagtctatactcattccctgagccacaaggtgcggtccgaggcagtggccgaagtactgtctgagacagtggctctcaacccagggtgattttgccctccaggggatacttggtagttgtctggggacatttttgatggtcatgattgggggtgggcaggagccagggatgctgctgaacatcccgcagtgcacgagacaggcctccaccacacggaattaccttggcctgaggtgttacgagagcacagagagaaaccaggtacagacgcggggcagaggggagagagggagagagtgtgagagctaaggtttcgggagaagactttgtggaaaaagtctttggctgggtcctgcaacatagccaggattcagtgacaggtgaggaccactccagattttgtatgtattgaaggccctgaa

SEQ ID NO: 29329 - DNA, 1062 bp, Homo sapiens
gctcagtgtgccaggaacctccaaaacagaaaaggagtttttcagtcctttgttcttctttgtgggtttctgtggaggctttcaagtcttacttactattttgaaaacctctgctccattttcaacatattccttcccagcctcctggactaccattgctcccacctccatgtctttttggcactcaagcttttttgagttcttcctttgggtgtcatgagttatgcaaggctgagtgtttcacgtggtcccatttgacaaaagccatttactacccagaagataatgaaatgccctttcagttcacaaagtactgtcaggtatgtgatactcagaacaaccctgaggcagattggataagatcaaagaagtagtcattgttccaagcaaatggaaaagccatgactgtgtgtttaggcagcaaggtctatgttctctcgggaataatccaccccccaaacccctctttttttttttttttttttttttgagttggagtctcactctgtcacctaggctggagtgcagtggtgctgtctcagctcactgcaacctccgcttcctgggctcaagcagttctcctgcctcagcttcccaagtagctggggttaccggcacacaccaccatgcctggctgatttttgtatttttagtacagatggggtttcatcatgttgaccaggctggtctcgaagtcacgtcctcaagtgatctgcccgcctcagcctcccaaagtgctgggattacaggtgtgggccattgtgcctggctgcctttccccccgcccattttaatggtataaaagttttggttttggaacgtggagtcactttagggggaagaagaagctgtggccctgggttgtgtaacatggttctggctgagtgccagagcttctccatccctaccctcctctttctctggagacaggactacgccgacacagagctcctgctttcccgagaaaacgtggaccaggaggctctgctcagctatgccagggaggcggcagacttctctacccagcagcagctgccgtctctggattttgccatcaatcac

SEQ ID NO: 29330 - DNA, 1036 bp, Homo sapiens
gaaattaaaaggcatccaaattggaaaggaagacagttatctccatttgtagatgatatgatcttatgtgtagaaaatcctacagattccaccagaaaaacctgttcaaggctagtacataaatccaacaaagtagcaggatacaaagttaatacacaaaaatcagttacatttttatatactaatagtgaacagtctgaaaaggaaatgatgaaaataattgtctacagtagcatcaaaaataataaaacacttaggaattagccaaggaggtgaaagccttgtacagtgaaaactaaaaaacatcactggaataaattaaaagataaatgagaacaaattcacgcttatgggttggaagacttactattgttaagatgtcacaattacccaaacaatacacattcagtgtaatccctatcaaaatcccaatgattttttttttttttttacagaaatagaaaaacccatcctaaaatttacatggaatctcaagggaccctgaatagccaaaacagcccttctaaaggagaccaaagctggaggactcatgcctcctgatttcaaaacttactataaagctatactaatcaaaacagtgtggtactgacataaaggcagacatataaaccaatggaatacaatagagggcccagaaacataccctaacatatatggtcaaactatgttttgttaagagatggggtcttgctatgttgcccaggctggagtctagctcctgggaggatcaaataatcctcctgcttcagcctcatgcacctcacttacggtcaaattatttttgacaaggataccaggactactcagtacggaaaggacaggcttttcaaataatgatgctaagttgcctatgttgaaggaagacagatcaggagcccgaggcatgttggcgatttgggtcctggtttctgagggaaaatatgatcaagtgttcctctccacctacttttttctttttttggtttttgagacaggatcttgctctgtttcccaggctggagtgcagtggcatgat

SEQ ID NO: 29331 - DNA, 1145 bp, Homo sapiens
tgaatgtttcatttccaaccaaatggatcctccttcccatggaagtggtgtggtgaggggtgtagctgggggagtgatctcaggggtcagcgggaatcagcagagggagaggtttggcttggagaagcatttgatccactgatgaatcatgcctaagtcccatactcttttaagctaatttcaagggaaaatacattccactgagctggtttagggtcagttgtctagatttatttctgctttggagagaacaactgagattttctccatgaaaatagttgaagaaaaccatggccttggagctagctagccctcattccccattcctttctgtggcttggaaccaagacacactgcttgggtttgagcatgcacagctaccttattggagaataaggaccctcctggaacaaggctgtgctcaccaagcctgtgccctggtgcatacacttgaacctggttttctttcgtcccgagccatttgcatctctaagaagcctgtgggcatgagtcttcccttcagccattctaactcttgggagcttcaacatcataataccagtgacttagtgtctgaaaaaggtgaggatcatcctggaatgtgaacagaaaacaacagtcctgttgttttcataattaggagccattcagactcctaatatgccttagggaactcaactgtggctgcttcctggtccttcttacaccccctaaattgtccaacaagttagtaacaagttaatcatcatgcaaatgccctttctccttttgtgtagttctgtgacattagatgttatggcccaggcgagacttctgtttatctttttccttctttcttggcatctgcccgcatctgtactacgtgcaaacatgaacgtgaattcctctacctagccagacccaaacacaaacgggtaggcagacctggacttaattccagagcaagtgaggagtgttgaaggggaggcacgcacccaggtgggagggaacacaggggaaaaggtgattggctgcttggggctggggtgggcggggtcgctttagtgaggtccggaatgctgagctgcagtctcaagtgcaggaggggcgttgtaggcaaaggtgaggaggcggcagaggtgaggaacacgtaaaagtgtggtgca

SEQ ID NO: 29332 - DNA, 1919 bp, Homo sapiens
gttacctcttcatgaagggaaaacattgtctcattggcagtttggccatgctggggggcccactgtcctctgggtgtgtagaggctgtcttggcgggcacagtcttgctggcagggcccaggctgcaagatgaacgcgtgcagcggctgtaggctggcctgggagaacgaagtggggagagggggccaatccagccatgtggccttgcagcccggctctgatcttagatggacagcagatatttgatgtgctgcgtttctcttctgaagtctcactcctcctttctttgtgatttaaacaatttcttccctcccactttttgtccaaattcctcagtccatactctttgaaatctgaagtatggagaggcgatagcagggccctccccacccatcttccggcttggaaggggtatcatgtggttcagctgggccctttgctggagagcagagggaggggtgttccccagggaagagggcaggaaagaccagaggttaaaaataggcagcttgtaggaacttgcccaccactccctcaggtcctcctgtgatgtgcacacttggagtagaatggctttggagcagagaaggggaaaatagatcagccctcacttaaacatcacattagccattggcttttcctctatcttccacataagaggaactttccccaatcacctggtggttttggatttgtgtcccctggtactttggggatgtgtccacatgtgtgtgcagtgcctctgtctgcatgtgtgtggcgctaagatgactcagtgtcgcatgtgctgagacattccggggctgcaggtgggtgttctcacagaggctcgcctgagggatcttttgcacatacaaagatgtgtcccatttataagttagttccctacactaaatgaaagaactctccggggccgtgtgtgtgcagtgaatacacatgtgggtcgttgtttcacacaggcggtgtcctggttgcaggcagagtgtgagaatgcaagctgtgctggctgctctgatatggtccacaaggtatgaggcagcttttgttctctttttgttcttttcggaagtaggggtgcctgcccacccccgaagccagggaaagtgcagtcttctctggcctcctggtcaggtagagctgctccggttaaaactgtcaagagcatcctgtctctgttccctgagacagccacaggggactcccaggaatacccagccaaggacttgagatgctgcctgctttgtcatctgtacctgcttgccacactctcctccacttaataccctgttgttactagcgaggatttccggtcctgactttcaatctggattttgaataacttgataaggtgattgctttcggatccctctgggcctgtgtctgcccctccctgtaagctgagagagcagctgggcccttcagtttctatggcccttccgccaccgagtgaacatgctcctgtggggcttggcctgtgtgacccacctcatcccttttgtctcagtcttcctgctaaatacagcctcttctctccctcatcccttctttctctgctctctgggcagaagagaagctttggctgtagtctttgatgtgggaggctagactggaaggcattctgggtgggggagggaggtgcctggtggaattggggcgtatgggggctgtgtggagaggggcccgctgcctttactgagcccctcccctccctgggcagtagggcgcgtgttaccccttgctctccacatctcagggagaagaacccaggtcctcatgtgaatcctgctgttttacttggggacacccgggaatgtgaatgggtgaaggtcttcctggctggtgcctttgtttcgggttgtttttctttgaggtgcctctcctactcccacagggcctgtgcaggggtgctcagagcccac

SEQ ID NO: 29333 - DNA, 1499 bp, Homo sapiens
gttctttcattctctctctctctctctctcgttttctttctctctctttttttttttttttttttgacatagtttcactcttgtcgcccaggttggagtgcagtggcttgatctcagctcactgcaacctctgcttcctggttcaagcgattctcctgcctcagcctcctgagtagctgggattacaggcgcacgcgaccatgcccagctaatgttttgtatttttagtagagatgggattttgccatgttgcccagactggtctagaattcctggcctcaagtgatcctccctcccaaagtgctgggattataggcgtgagccatcgagcccaggctctcagtaaagaaggctttctattcacatttttgtatcagatgagattagtttcagtcggaaattgcaaaatgtggcttagcatgaaagaagattttctttttatgtaaaaggaccctagagatgggaagcccagagccagtgtagccagctgcatggccatcaggattttgtctcgttccttctacctggacttgccagctaaagcctggtgattgtgtggcccactctatggattgacaggtgagagttcaatttgacctaactccactaccctggcacgtagctttctcatccttaaggttacctcataacaaagcatggctgccggagctccagccatctttcttttctttctgggtagaacaccaaagggaggaaatgtaaagaaaggcaaaatgtttttctatgtgagagactcctttaaaggagtctttcaggaagacccacacacttctgcttatatctcattaaccagaacctggaaaacatggtcacagctagcttcaaggaagtttgagaaatgcggttttgtaagtgagtgcatcactggctctagtaagattggggtactgttactaagaaggaaatctttctccagttggtgtctgacttcgtctctgtagtgtctctcacgtgagcaccttctgcttcatgtgagtccacttcttcctgccctgtatgcacgtaagcagtcctccctccagacacaggctggctgtcctcgcagctctcctttgctcttcttttctcggagctaagtcgtagtcgcagtgcaggagtcggctgtgcccaggctggagtgcaatggcgtgatcttggctcacggcaacctctgcctcccaggttcaagcaattctcctgcctcagcctcccaagtagctgggactacaggcatgcaccaccacacctggctaattttgtatttttagtagagacggggtttctccatgtttgtcaggctgatctcgaactcctgacctcaggaggcccgcctcggcctcccaaagtgcggggattatagccgtgagccaccatgcccggccggtagtgcatggatttctgtaggtaccatagcagtgtcagtgcaaagcttggcatacctgggaggttgctgcctctgtgtttctgggctcttctccccatcccctttctgcaactgt

SEQ ID NO: 29334 - DNA, 1054 bp, Homo sapiens
tgtttcccagtgtaaccttaactccctcgtgttatctaatgagattttcagctttatttactctagtataagacacggaatttaacagcaagaaatgaatttgggttatgtggacaagttaccagaatgaaaaacttaaactgtcttctaccctgatccccacaacatattttggcagtccatctctgcctatattgttcagataagattagaaagaaataaaacatttaacttacatactgatgttctgttggccgtcttatttgctccggctttgagccatgtagcactctttttttttttgagacccagtctggctctgtcgcccaggctggagtgcaatggtgttatctcggctcactgcaacctctgcctcccggttctagcgattctcctgcctcagcctcctgagtagtgggattacaggtatgtactgccacgcccggctaatttttgtatttttagtagagatggggtttcatcatgttgatcaggctggcctcaaacttctgacctcgtgatctgcccacctcagcctcccaaagtgcagcactctttaatagcaaatcctgtgtcccaaacatgaggacatatgccaggagggtgttcaggagagtctgtgtaactcactcttgggacagtgctgggttctgttttttggggacacacttggggtgacttgaaaatgtgctatttcatacctggtttgttctgtatcccttttagctctctttatcaggtatttccatttctaaattggggtaaatgaattcgttgaatttttttctttgtgcataatctgaacaagtgagtataagtcctgtagctggggggctgggtgtggggcatgggagcggaaaaatatggaaggcaagggaaagctgggtaaggaagagtgcagagtgtaagaagttctcagaaataccagaaagttgtgggaatttgttaggaagtcagtcaagtagggtatgagatttttttttaaatttgcgggcttttcattcactgtcagccgtgagccaccaagatccttgggtgactttctagcaagtgt

SEQ ID NO: 29335 - DNA, 1009 bp, Homo sapiens
attttatgatatatatttattactgtattgtatatgttattaccattgtgtgctgcatatcttttatatcagtaaaattgaaaataaatgtgtccatataaatacatgcacatgtttttggagaccagtctgttaagcatttgccagcacagtactgcagtgggtgaagtaaatactgccctcctgcagtccacagtgtctggaggggaccaatagacagatgatcacagacacctccaagtgtgcagggcactggtgggggccggggcaggcccagcgaaagtgcaggacctggcacttagtcggaagtgagggtgcagttgagcaggaactgagggtgacgggccagcacagccgcatctgggcgaggctgaggcagaggagcagacgggcagctggtttgctgccgcggaatgataagacgggcggaatgataagacggaaactgtggcactctggagaaagtgggtgtggctggagtgcacagctgctcgttgtaggttgcatgaagggcatgttgacagcctgaggattctgcctccttttctccgttgccacaaatacttataggcttcagaaaagaggtgttaaagtagtaattgttgtgaagtaaatacttaagttcagcaaatacagactgtccaattcctgtgttcaagactctgctgatggttttccaggagctgaaagttgtccttgcccactaggagggtattccatggtagggagccagatgtgtgtgcagtcagctgtgatagcaggcggatttgaacaaaatgctgtggaggaggccgttaattctgattgcggaatggggaaggcaggaaagtagtttgcagcaatttccttttggaagcccagaagaatatccctccttccaccaaaggccctttccgtctttatttcccagtttatctccattcccctgccctgagctgctgctgtttcacgaatgctaattcggcctctagccagactgctagagagggctacatcccatgcttcctcc

SEQ ID NO: 29336 - DNA, 1028 bp, Homo sapiens
tgcctggcaggagtggcttctaagaagagctgttgattgttgaactttgacgataaggtgagggtttggattttttggggatagctttattttggtataatttcagaaaagtttgagaatagtacacgagttcctatttacccttcacctagagtcacgatgatttgcgttttgccccatttactttttcatatttttttcttctctttgaatttttttcccagaacaatttgtaaattagtgaaagtgtctcccttgactcctgaatccttcagtgtctgtttcctgggaacaagaatattctctcggagtctgatagggcacctttagcatagggttcttccataggaagtggcatggtgtgaaggtgtccagagaggatgaaggtgtggcgggcagtgtggaatggtgtccactggagggtggggtggtgaggacagggtactaactggggacggagaagaggcgtggaccagaagacctggtgtgggacaagcagcactgccttctagggaggtaagccatgtggagactctgaggaggcagatttagcttcagccttgtacttgggagtacagagtcagagtttggaggtgcagctgagtctgaaggacactgccggtctccatccttggggcgcacagggttctgtcatgaggataataggtagagatggtctccatccttggggcgcacagggttctgtcatgaggataataggtagagatgagtgtgcccatagtcctgtgtggacttaggagttactagtgacagcagcaggtgaaattaagacccttggttgttaaaagagtgggaaggatgctgggaagccaagggccaaagccagcctaggggggtgcagggagggtcccagggaaatggggaggggtgaagacccaaggaggttgaagggaaggtggtgcagcagtgtgagaagagacagatttggccacgcgcggtgggtcacagctgtaatcccagcgctttgggaggccgaggcgggagagaccaacctgggcaacaaagtg

SEQ ID NO: 29337 - DNA, 1030 bp, Homo sapiens
gtctaacatggttattgaagtatgtagaagaatcattaagataattgtaagtgagagagggtaaaatgacttaaaagaattgtaaggtttctatgcttcagtcaaactggtaaaatgtcaacactagtagactgagatatcaatataatgtaatatgtagagcagctattaaataatttacacaaagagatacacactaaatcactagacatatcaaaatggaattctaaaaaggtgctagtaaccccaaggaaagtacgaaaaagaaaacagagaaaccaagaacagaggaaacaaagataacaaaaaaattctatggaagacctaagacttaatatacaggtaattacattaaatataaacagtctaaatacactaataaaaagatagattagtgagtgaaacaagccaggcacacaaagtcaaatatcacctgttttcactcataagtgggtgctaaaaaatgtgtacacatgaagacagagattggggtgacagacaatgaagacttggaagggtgaaggagtatgagggggtcatatgataggtaattcctaattgggtacaatgcgcattatttgggtaatggataccctaaaagccctgacttgaccactatgtaatctatgcatataacaaaactgcatacggccgggctcagtggctcacgcctgtaatcccagcactttgggaggctgaggtgtgtagatcacttgaggtccagagttcaagaccaggtgggccaacatggtgaaaccccatctctactaaaaatacaaaaattagctgggcatcgtggcaggtggctgtaatcccagctactcaggaggctgaggcaggagaatcacttgaacccaggaggtgaaggttgtagtgagctgagattgctccactgcactccagcctgggtgacagagtgagactccatctctaaataaataaatcagcaggtatttataaacataggccagataatgtcacttctctgctcacaaccttccactggtaccacatctcacagcaaatggaa

SEQ ID NO: 29338 - DNA, 1068 bp, Homo sapiens
ggtgctggccaagtggaggtgcttctttcaccaaatggctgtggagcaagggcaggcgggcctggctgccatggacaccaagctggaggtggcggtgctgcaggtggggcagccttccccttccccactcctgtggcttgtgagggggtgggcaccgtggggtcacacggggcatggtgggcagtggtcggaggtggttttgggaactcacccagggcatgtggctcactctgcagctgctggggttggcctggtggggaggaggaggtcagagggactctgaacagagaggggagatgctggcaggagggctggagacccagccctgcagggcgtgggcgtgcatcagcagcggggtgggaatagacctgtctatgcagtagaaacaaaccagacatggatcctgttcttactaacgatgtaataaagccagaaacagcaccagaggccaatgggtggggggaaggataaaatatgagtgaatggggctgatccaggccttctcacttctcaaggaaagtgtcgcaaagttgggcatcgcatccagggctgagattgaggactggttcacggcagagaccctgggagtgtctgggtgagagcagcccccaggctgagaggacacgagcatcagccatggttccagccaagccccagtgacgtctcccagtcctggctgccctgcctgagagggtgggccctgggatgacagtgctgaaggaactgcttttcacacagcaggacttgatggcttcaggagtccctgaggctggggctgggctgggcaggggagacacagggccagcacagaccccatagagggctctttatagaattatctgggtccagagcaaaggtggcactctcagccctccctggagtccacgccggcaggtgaaggatcagagccccatgccccatccttggagccaggggctgggacccagatcaccaggagcctccagttgaagtggggaggtgactggggtggtgcagtagtgagccatcccctcacacactgccagccttgcccactgtgtcctccctggccgcccggagctgtgtccg

SEQ ID NO: 29339 - DNA, 1112 bp, Homo sapiens
gcttcaggggggccttcaggcaggaggagtgtctcctggttttgcctagctcccctgcatcccctgtgccaggcccgtacctgcctctgacacccctctgtctcttcctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcat

SEQ ID NO: 29340 - DNA, 1028 bp, Homo sapiens
gctgttggacggacgtgggaggcctgtgtgcagccctggcccctggaaaaggatgtgcacctctgcaggagggccgctccccagccacacctggggtacacagcacatgagcgcagcctcctaggagtgctagtcctaggacaggaaatcctagtttgctccggtgatggtcagaggggtgttggcacacagcagcctggggccatggtgagatgctcctcctgacctgggattcgctcttctgcttctgtgctgtcaccatgttcttgattttgagcggccttatttcacatgtatcctaaagatggttgggtgcagggagacactgtgtgccttgtccacacagcccgcctgggcaggaggacgacagcatccccagcgtagcacgagggtggcccccttctcagagcggccatttcctcccctccccctcagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaactgtaagtgccctctgagggccacaaccctggtccccatccccaccccaggtcaccccatgtctccatgagctccccagccctggacagagaggggcagaggcaggtttgaaggccacatgttgtggggtctgtgtcctcacctgtgggccaggaaagttcttgccaagaccctccttattcccattgagccacagggtgggcagaactcggaggcctctgagggtcagaggcccggatcacccttccagctggaggggtgtggtcagccagaggctgggtctgacagaagtgtcagcccagagggacaggttggtgtggtgagggtgagacatgccacggagcacaccaggggtctcatggggatgccgaatgtggccgaggggtaggcagcggggcacaggtgtgtgcactcagggacggcaggcccagcctgggggtgg

SEQ ID NO: 29341 - DNA, 1027 bp, Homo sapiens
agctgggccctgctctgcctgccctgtggccatgcttccatgggctcctgactctcctagggccttcttctggaaagtgctcaagaaccgagacactatcaccaaaactggagactctgggaataggatgtcatgtgttaagcatcagaatgtcccctccaacaagctaagagtgtctactcttgccaccctgtcatcattgtgcttgaggtcaaagccagtgccagaaggcaagaagaaatgaaaaaccatccaggccagaggggaagaaatgaaaccatctccctttgcagatcacatgattgcatagaaaatcctagggaatctacaggaaagttattagaactaataagtgtgtttaagcaaggtctccagatataaggtcaacgtaacaaaaattcatcatatttatataatctatctgtaacagttgaaaattgaaaattttgagaaaagtgccattaataatagcaccaaaaaaaatgaaatacccaattataaataatataaaatatgtgcacattctgtttgctgcaaactgtaaaaccatgatgacaaaaaggcttaaataaaaggaaagataccatgttcatggatcaggtgtctcaatatcattaggaggttagctcttcccaaattatagattcagtataatcccaaccaaaattctagcagacatttttgtaggtattgacaagctaattctaaaaatcaggtggagcgaggcatggtgtctcgcacctgtaatcccagcactttgggaggctggggagggtggatcacttgagatcaggagtttgtgaccagtatggccaacatggtgaagccccatctctacaaaaaatacaaaaaattagttgggtatggtggcttatgcctataataccagctactcaggaggctgaggcaggagaatcacttcaacctgggaggtaaaggttacagtgagctgagatcacgccactgtactccagcctgggtgacagagcgagactccatctcaaaaagtaaaaataaaatagggctg

SEQ ID NO: 29342 - DNA, 1034 bp, Homo sapiens
caagctggtctcaaactataggcctcaagtgttgaaggacatctgggctgtttccagtctttggctattacaatgaaaactgccgtgaacatccgcatacaggtttttgtgcaaacgtgttttcttttttctttttttcttttgtgtgtgtgtgtgtgtgtgtgtgtgagacagagtctttctctgttgcccaggctggagtgcagtggcacagtcttggctcactgcagcttccgcctcttgggttcaagcgattcgcatgtctcagcctcccgagtagctgggattacaggcatgtgccactacgcccagctaatttttgtctttttagtagagatgggtttcaccatgttgaccaggctggtcttgaactcccagtctcagatgatccacctgcatcggcctcccaaagtgctgggattacaggcatgagccaccacgcctggctgcaaatgtgttttcacttctgtgtgatagatgcccaggattacagttgcttgattgtatcgtagttgcaggtttagtttttaaagaaacaagcaaattgttttccagagtggctgtactattttatagtcccactatcaacgtaggagtgattcaacgtaggagtgatttaatttctccatatcctccccagcgcttactgttttcactatttttcatcttagcccttctgttaggtatgcagatatgtatgtagacctgtggctccttatggtttcaatttgcatttccctgaggctactgatgttaaaacctcttcatgtttcatgtgcttatttgccatctgtatattctctgttgttcacattattcttccgttttctctttgcatcgtttgttcgttttgttttgagaaagggtcttgctctgtcacccaggctcaaacgcagtggtgcaatcatagttcactgtaacctccagctcccgggctcaggcagtcctcccacttcagtctcctgagtagctggaactgtaggtgtgcaccgtcatgcctggctaagttttttattttctatagagataggatc

SEQ ID NO: 29343 - DNA, 1075 bp, Homo sapiens
gcgagactctgtctcaaaaaacaaaaaacacacagtcattgatggttgcatccctcctgccgctgagatctctgtctctgtctctgtgccctgcaggttgtgggttggctatcagtatgttatcactggccggaaccgctccttggaaggtcgctgggaggtggcattcaaaggtgagcccttctggtgtgtgggagtgtttgaagctgggcagagtcaccctgattcggggcctcccctcctccctcttacccagtgctgcctggcccgtaggggtgctgtgcagggagtgggtgagccccagttgcagggagggctgcggtcatggggccagtgcagcctgcagatcaggccctgcattgggcggtggctgtctctggaaccctctgttgcatctcactttggccagctttctagattgtcccccgcctccttttgaagttaaagaccttggagtataaaaatgagcatgcagagtgtgcccctggcaggctggaggggaggacaagcttgccaggacaaaggtcagacgtagaatccagacctgaaggaaactatcaggcagatagagagagagagagagagagagagagagtgagcatgcatgtgtgtgtgtgcgcaaagattttatgcggagctgcttggaaataccaagacgacgtaaaggaaacatggctgctgtttcctttacattccctgggctcggacttggcttgcccttcctgtcccattgccctggcactggcgagctcctcctggacatactccagcagtgccttctccagctgccgccagggtcacactcccttgccctgccccttccctgtctgttgggctgtactttgtgcctgtggcttgagctaggatttgggttcttttcgtaaacacatcccagtcctgctgttgatgtcttaagtatctctaagaaggataaatgaggagtgatgggcctggggacagggttgaaaagggtcaaggcctgggtggccggcttccctggagaaaagagggccccacagaggcggggccatgcctggctgctgggacagggcaggagcagaggtgggggctgcag

SEQ ID NO: 29344 - DNA, 1071 bp, Homo sapiens
aacaaagcacaccagaccagaagggccacagcaaagtggcctgaggcagccagctctgctgtatgtcatatcgtggttaaatgtgggggcttgagccagggactggggctgctcccctgctttcaccacttactggctgtgatcctttgggcaaattgcatccataaaatggagaaaataatagtgcctgtcacttggggttgttgtgaggattacattacatgctacatataaagggattagacaagaatgtagcacacagtaatccctcaattagcagttactttattcatgtaataaaacttaaaaaaatgtattctgacattggtaaaatggcagtccaggaagctccaggttctcgttccaccatagaaaacattaataagcaactagggactagatggaataactttatagaagctctggaaaacagtcagaggtttcttagcccagctaagaaaatgcctaatcaagaaaaagccacattcaaaatacagattgagtatcccttaactgaaatgtttgggaccagaagtgttttggattttggatttttttctgattttggaatatttacattatacttaccagttgaacactccagtgagcatttcctttgagtacaacgttggcactcaagagttttggattttgggctgggctcatatctgtcatctcagtgctttgggagttcaaggtgggaggattacttgatgccaggattataagagaatactgttaagaattgtacattaacaaattgcttaacctaaatgaagcggacacattcctagaaacatacaacctgccaagactgaatcatgaggaaatagaaaatctgaataggactataattaataaggagattgaatcagtaatcaaaaacctctcaacaaagaaaagtcctgaaccacatggcttcactgatgaattctccaaacgtttaaagaagaattaacatcagtccttctcaagtgaattcattctgtgactctaacatgccctgataccaaagccagacagtaatactactagaaaattacagaccaatatcctttgtgaatattgata

SEQ ID NO: 29345 - DNA, 1032 bp, Homo sapiens
gttaccttatggggttacttcattgccctgctaaaagcctgctaaaaaggagtataaaaaatgtaaaaccaaagggacaaaaaaaggggaaagatgtaacagtagatcagtaatttctgcatgtttttgaaaagagggaaatgacatgctaggtacagcctgggcattcagtaccttcccactcactcccttctgggcttgtccgtgggtttcagaggctggaatgctggagcagtagcactcagaaccacctggcagcaggcttctgtgtgtcatttgccctatgacatgtgtcttgggaaatgtggcaagtggaagggaggtggaacctttcttcctcaggccatagtgtatgttgggggtgtgcatgggcttagatttttgaggtgactttttgcagtggcttctgccttcccccactggccagctgtctcagggctgcagagcagctgcagtattggcagcagatttttgcagtttcctaacctatagatggcagtagtagcttcctgactcttgacaatgactgtgggaattagatggggagttagcccactttacttttgctcacactatatagccttgccagttgttttgaaagcacctattttctgtattaaacccttcgtgttagaaatcccttagcatggtttctgttttcccagtggaaccatctttgtttttttttttttttccaaggcaggagaatttttcttagtacagaacaaaatgaaaagtctcccatgtctacttctttctgcacagacacagcaaccatccgatttctcaatcttttccccacgtttcccccttttctattccacaaaaccaccattgtcatcatggcccgttctcaatgagctgttgggtacacctcccagatggggtggtggccgggcagaggggctcctcacttcccagaaggggcggctgggcagaggcgccccccacctcccggacggggcggctggccgggcggaggcgcccccccacctccttcccggacggggcggctggccgggcgggggctga

SEQ ID NO: 29346 - DNA, 1041 bp, Homo sapiens
ttccagctatcctttgattagtgttaacatggtatatcttttttattcttttattttctcttatttatgcctatataaagtgagtttgttttaggtaatatgtagttgtatcttgattttttccctacatgacaaattctgcctttcagttggagtgtttagatcgttctgcgtatttattgattaggcaagtttaattaaaatctaccatattaccctttgttttcatttgtaccatctgtttgtcttttttttttccttcttttggattattttttattctcttctatgttggcttacttgccacaactcttgtgttattttagtcgggttcatcattaacttatcatagactaccttcaagtgatggaccactttacctgtagtttgagagccttaaaacagtgtgcttctgtttctctcttcccacctttggtgctactattgtcaaaattttacttctgtgtatgctataaactgcacaatacagtatctgtgtgtttgctttaaataattgtaggtcaacagctttttctttcagaactttaacatgtcacatcactgtcttctaggctgtatcgtttctaatgagaaatctgctgtcatctagatctttgtttttctgtgcatgtcttctttttctgcctgcttttaggattttatcgctgattttaagcaaatcaattccaatgtgacttggaattgtattgtttgtatttctggtgcttgtggttcattgagctacctggatttgtgggtttatagttttcatcaaattgggaaattttccccattgtttcttcagatgttgtgtctgttcccccatgtattagggtgtgtgaggttgttccacagcttactgatgatttgcacattttttcctggtattttttcattctgtgttttagttcagagtgtttctattattatatcttcaagtcactaatcttttctactacaaaatctaacctgttaatgttctgcagcgtacttttcatcttaagtgttacagtttttatctctaggtaataggttcgtaaa

SEQ ID NO: 29347 - DNA, 1033 bp, Homo sapiens
atgggctggaatttctcctgcatttctttgctggaaatgttttgattttcttagtgatgtaactgtggacatgtgtgcttctgctagtactctgtctccctcttgttctttgtgggcaaatgttgaagagaaatcaattctaaacaatttatgcagcatactaaatttcacacagtaatttgagacagctcagtttgagacagccttgaaacaaggctaaggcttgctgacaaaggagaaattgaatctagagaaagaatttgtattgcagagactcgtgggtttctacagggcatgaatccactaattcctgggcgttgcatagcccaaagcagtagctctccaagtgtgcccaggggtctctgggggttccctgacccttctaggggctccgtgaggtcaaaactgttttcatgataatactgaggtgtcatttgcctttctctcatcctcacaagcataaggtagcatttccagacactatttgatatgtgatgacatcattgctctgacagctaatgggatgtatgcttgggattctctctttttttctctctctcttttgaaagaacagtgcctcactgtgttgcccaggatggattgcagtggctgggtcatagctcactgtaaccttgaactcctgggttcaagaggtactctcacctcataataaaataaaaaataaaatttttattttattttatttgtagagtcagggtctggctatgttgcccaggctggtcttgaattcttggactcaagtgaccctcccaccttggcttctcaaagtgctgggattataggcatgagccaccgcacctggccttttttttttttttttttttttttaagaatttttttggccgggcacggtggctcacgcctgtaatcccaacactttaggaggccgaggcaggtggatcacgaggtcaggagatcaagaccatcctggctaacacagtgaaaccctgtctccactaaaaatacaaaaaattagccgggcgtgatggtgcgcgcctaatctcagctactc

SEQ ID NO: 29348 - DNA, 1032 bp, Homo sapiens
tggcatatgtgaaacttcagcagctgagcattgttggagtaattttctcttttgggcctcatcacctccgtggaagtcaggagggataggcagggcaggatggtcacctccatgctttacagatggaggaagcagcctggcgaggctgagcagggttgcacgggccaggagctgaagcctgctgtttgtctcgcaacggatctctggggcgtctttccaagccagtctccctgcgtggttccaggaagctacaggggtggggaggttgtgtgctggcctgctggtgctacggggcagtggcagcgatggggaaggggctagacgggcttcaggggagagctgcagggactggtgagccgggacccccaagaacctggatgtggggctttgcgggaaggttagaggtggcccttggactccataaaagggcagatggcatttgagcactgtagagaaggcagggagtttgtgatgtgatcacagttggttctgggatggtctgtgcactgtttggaatgccaggtcctgcctttcctcacttcctagctctgccctcccaggtctgctctctgtctgacgcaggttggtgttctgatgatgcactcctccatcgccagccgcgtccctttctggagttatagcacatcccatgaagctatctggtcccgaagtccctctggggccccggagtacagtgtgccttccagagcgtgcatcgctcccttccccactgggcagcacctgttcagaatgggtgcttgccagaggcctgcccatggcccctggtggctcagatgctggccatctctgaggccccattcaaggcccttattattcactcttgcctcaggacagaggtgacccctccatttagaaggtcaccgagcaatatgccctctgttttgtcttttagttgtgctatcaacagtggtctctgtcctccctatttttttagtttttgagatggagtctcatgctgtcacccaggctggagtgcagttgtatgatcttggctcactgcaacctctgcct

SEQ ID NO: 29349 - DNA, 1073 bp, Homo sapiens
aatccagcgttccaggttcttgcttgctttctctgttgcatgtttgtttctctctttttctacagtgagaaccctggctcccaacagcatcagtaggtttactcatttgcttagtcttacactgcacccagaatagtttcagaagtactgcattcgcaccactagtaacagcagacctattaagtagaatttaatttaatttaattttttttagctctttgtgttttcagattgatggtgtatactcaaggttcttgggttcaaaagctacttggattaattctcttctctcttccatgtgattgttacacagttaggttcaaaactgtgttgaggcagggccgggtggttcacacctgaaattccagcactttgggaggctgaggtgggtggattgcttgagcccagaagttctaaaccagcctgggcaatatggcatctctgcaaaaactacaaaaattagctgggcatgatggcacacgcctgtagtcccagctacttggaggggactgaggtgggaggatcgtttgagcccagtgagcagaggttatggtgagctgagatcatgcctctgcactccagcctaggcaacagagcaagacctgcctcaaaaaccaaaaccaaaaaaaaaacctgttttgatttgaaaccatgtttattaaataatattgagagtggtatttactgtaacctcagtatttataacaagcccctctttcattacactaattggtaaggaagcatctcaattttgaacggttttattattttcctaggttttttttttttttttttaaaagatggagtcttgctgtgtcacctaggctggagtgcagtggtgcgacctcggctcactgtaacctctgcctcccgggttcaagcgattctcctgcctcagcctccccagtagctgggactacaggtgcgtgccaccacgcccagataatttttgtatttttagtggagatggggtttcgccatgatggccaggctggtcttgaactcctgacctcaggtgatccacccgcctgcatctctgaaagtgctgggattataggcatgagccatcatgc

SEQ ID NO: 29350 - DNA, 1882 bp, Homo sapiens
gggctcaaggcgtgagtgggggaggggcagggctattgtccccacctcaaacctttcccggcctacctggcctgcccactctgtccccttcaggcctctgtgcctctcacttcagtatctggggattgccctgtgcagggacactgtgctgacctgccttcctctccccgcccctcctcccacccagattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgcagcctcctgtcctgtgttcgtccctgtatggacccatctatgcatgggcattggtggctgtgcctctgcaggggaccaggccacccccatctgaggacactgcagtagggggacagggaaagcctagtgtccacccagggcagagcagctgtggccacagtgttggctccctgagaagcccagcgccaggccaagaaggatctgggtgcaccctggccttccctgtggcctctgggcaagatcccgtggcatgggtaaaagggtgtgttgacaaggcctaggggtggcctggcagagtgttcagagcagggggctgggcccaggagatggagcccccaggacgactgcctgcccctcacccacagggaagcttagggaagggttgggttgcccagggcccctctggggtatgcccagctcctcagtgagtgaaatgggctgctcgtggggaggaggagatgggggcacgttgaggcctctgaactccaggtgggggtgggtgtctggcatctgctacccaaaggctctgggcaggggccctcccttgttccttcacctgggctgggaggcagctgccctggggcagcaggaggtggggctgcctgaccagggctctctgggcacctcatgccacagccatgagcctcagagaaaggtgtccctctggctggaggccagagctctgaactggcatgtccccatggggccaagcccctctttccacagcctatgagccacgtggaggacgctcaggcaggatgggatcacttagtgcccctggctgtgcagagaagccagcttcctgtccaagtgcctccgtgggggaagagtcatgcaagcgtttggctcagactggagaacaagcttttgccagccagaaactccatgtgaacaggtcccgtccctggggagactgccctgtcctagtgacctcacacagcaccagatgcctggaatcccgggaatgtgcagctggggaggagtctggggtgcaaagggcccgaggtggatctgagagccaagcatgggctt

SEQ ID NO: 29351 - DNA, 1023 bp, Homo sapiens
aataattatatagtgtgtttgaaggtgatcagttatagaggaaaatggagccggtttgagggcataggagtgcctggatggagtttcataaaggggcggtcaaggtagcagcaattgagggggtgacatttgagcaaagacctgaagaaatggaaggatttggtcatgggaacatttgagggaagggtcagtggccaggcaaagtcctgaggcagaagtgtgctgtgtattcaaggaaggggctggagccagagatggggcagagaggctgacggagggccagatctcaggccgttaggaaggtcacgggctgtacttgggatgggtgcagggctgtcgggggtaaaaggatcatggtggctcatgtgctgagacacatacttgaggagtagggacaggagccagaagagcagctggaggctgttgcagtggtctaggcgagaagggacagtgactctgactagggtggtggtgacagggtgagaggtgatcaggccatcaggattgggtgtgtgctttgaatgagcagccaccttgatatgctaatgcactgatgtggagtgagagagaaaagcccaggataactccatttggttttggcttgaataagtagaaataacggagttatcaccagtggatgaggggaagactgaaggtgcagcacgggagggaaggacaagaattactttttggacacatggtgctaagtcttgagctgcccgctggatgttcaggtgggggcatcatgtaggcagctggagacagatctggagctccacagaggaggggcctagctagagcagtgaacctggagttgctgacatataggtgatccacatccatctatgtttgcctgcagtcccctggggatgagtgtaggtgaaaagaccagactgcccaacaggggtgggctgaggaggggagcaggagcagccagtacagtgggaagaaaacccagagagtgtgctggctcctggatgcactggagaggaggggccggtcagcagggacagggcctgctgc

SEQ ID NO: 29352 - DNA, 1066 bp, Homo sapiens
  misc_feature (55)..(55): n is a, c, g, or t
agttcaagaccagcctggacaacatagtgagacccccatctctatcaaaaaactnaaaaatattagccgagtgtgtggcatgcacttgtaatcacagctacttggaaggctgaagtgggaagatcacctgagcccaggaggtcaaggctgcagtgagctgtgatcggggtgagctgtgatcggggcactgcactccagcctaggcaaagagcgagaccctgtctttaaaaaacaaacaaacaaaaagaaaacaagggggtgaagggcctgtaatctcagcactttgggaggccaaggcaggtggatcacttgaggtcaggagttcaagaccagcccaggcaaaatggagaaaccccatctctaccaaaaatacaaaaattaaccaggcattgtggcacatcctgtagtcccagctatttgggaggctgaggtgggagactcactggaggctgggaagtcaagactgtaatgagctgtgattgtgccactgcactccaacctgggtgacggagtgagaagcctgtgtcaaaaaaaaaaaaaacaatggttggaaattaagttaaagttttgaaaggtgttaaaagttcatcatgtaattctgtaaccaagtaaaattccagatgaaagaattaaaggtaaaaattgagcttttccttaaaattttttaaaaatatgtatttgaatttttgcatgagaaaggaatttttaaacatgtaagcagtggaagaaagcataaaggaaaatatcagttcagctaatacataaatatttgaaatatagctatagagttttattatttctaaacatggacctctaagtctagatgtaaaaatctatcccaagaaagtagaaaagatccacatagttttacctataaatatttaatcattgcagcatgattatgcaaataaaaatcaaaagccaatgtctggcaaaaggaaatagtgcttttgttttgttttgaaacagggtctcctctgtcacccaggctacagtgcagtggcacgatctcagctcactgcatcctcgacctcctgagctcaagccatcctcccacctcagcctc

SEQ ID NO: 29353 - DNA, 1034 bp, Homo sapiens
gccaaatataatggaaatccgactagctatttttgggagctgccaaaacagacaaatggcatattgattatgagttctgagtgtgctgtgggtccctggagagtggagcagggtcatcgagggaaggtgggcagcagctacggaggagacaggcaggtgttacaaggacaaaaatggaatggtctctcttcataggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggtgtgttccagtgctgcctccttccatgagctgcccttgctgatggcaggtggggcagaccatccgcaggacgtcccaggggcaggaagctggatctgtctcgccagggaccccttagtcccagggacagagctccactttatggcttaaagttctaaagtaacccttctatcgttttaagagtgtggaaagcagcttgaggctgtgctctaagtatctggcacttattgctgcattgtaattcatcaacatcccattagtgccattgtcaattaggcaggcaaagctgcagaaacaagtagaccactcagcactagtgtcataaagaacaggaagcctacttccttatgtggcagtccagggtaggctggaggtcagtggggtgactttccttcccactgtacttcaaggaccagcttcatggctgctttgccgtgttcagcacctcacctggatgtcgtcttcccagtcagctagaggaagggaagagcacagaggaaccagcataggtggtttttatgggcgaggcctgcaagtggcagatgacacttggattcacgttccattggaggaaatgaggtcatgtggccacacttaaaacttcaaaatgtgatctaggcacgggaccacatgaggggaggcatgattgtggtggcctgtggctgtcctacccaa

SEQ ID NO: 29354 - DNA, 1086 bp, Homo sapiens
gcagtgagccgagattgcaccactgcactccattcgcctgggcaacagagtgagaccctgtctcaaaaaaaaaaaaaaaaaaaagattttatgcctcatcaaaattgtttccaggagtgttcattgttttttaaatgcaatccccaactcctagttctgtatttagcctagtagagaagtctagtaagcacaaatgggatttgttttgttcaggtctccttctggtcattgctaatctaaggcttgagctcattcaaggagaatcggtagacttgagccctcacattgatcttgccatagaaaccctataagaatgtgattgctggctgggcacggtggctcacggctataatctcagcactttaggaggccaaggtgggcagatcatttgaggtcaggagttcgagaccagcctggccaacatgacgaaactctgtctctactaaaaatacaaaaataagccaggcatgttggtgtgcgtctgtaatcccagctacttgggaggctgagacatgagaatcgcttgaacctgggagatggaggttgcagtgagctgagattgtgccactgcattccagcctgagtgatggagtgagactctgtctcaaaaaaagaaaaaaaaaggaaaaaaagaatgtgattgcttaaaagctgcaacagtgacttggactcatcccagtaatagggctttatggagcctcagcctttctcacaggcccaactctgtgaccacatgggcttggcccagctgcaacatgggagaatgaagccttgtgcaaagggcctaagatggcttgaaggacagccagggatttgggacccacaagcactgctgccaccacagaggtatggatgtggacaggggcctgtgagttctggttgccaggctataccctaccctggggcaagattgagcagctggtcttaaaaagttattgccattgatcagggcttctcaccgaactccctgtttcataggttgcagatgccatccttggaaataaaatgtttactcattacgaccgggcccacattgcccagctctgtgagaaggcaggcctcctgcagcaagcactggagcactac

SEQ ID NO: 29355 - DNA, 1031 bp, Homo sapiens
ctttacttatctcttctgatttttctttaataatcacttactgtttttataattaggaaacaacatattaagtatattgttctgttacctcaatttattcaaatctacaagttagctgctaagaagtgggtcatattccaactctaggaaataaaagtactgttaatttgctgcttggggtctactggactctcatgactttgtgagtgtatgtaaccgtttctggtgaatgagatttgaaacacaccaagcgtcactcagaaacttggcagacagaccctaaggaatgcccagaccctaaaggagaaacaagtagttgggtgaggtgccagcaggctctggcttagtgccccaggacgctggcagtcttctctgggcagtaggactgcgtgatggtttctacattctataaaatacactgttgctatgaggagaaaatgtttgaaaacaagaagtaaagataaacctgaaggaaacaaaggataggagactcaggtaagtgctagatgttctaaagccctactcttagtactgtgtttgatcgtcaactctgtgcatcactctgaagtggtctggtgtgtgacagtggctgtggtcactctgtggccatacctggttggtgatgcagatcctagaaggaataagaaagagtgtgccaggtggcaggggaaggcacccaggagtgtagcttgtcaagaccatcattagatactgagggagcactcactcagccatgctgcaaggctgctgtgttgacctatccagtcttagcccaaaaattacttacttcaagagaatatttagtggctgggtgcagtggctcgcgcctataaccccagcatttttggaggccaaggtgagcagagcccaggagtttgagaccagcatggacaacacggccaaaccccatctctacaaaaaaatataaaaattagccaggtgggccaggtgcggtggctcacacctgtaatcccagcactttgggaggccaaggcgggtggatcacatggtcaagagatcgagaccagcct

SEQ ID NO: 29356 - DNA, 1050 bp, Homo sapiens
atagaacagcagttctgatgcacatcatctttataccatgcacaccctaactggggagggttgaaaaagcagatactatggtatttaagtaacttttctcaaccatagttgaaaaagatagttaaaagaagaaactcttggctgggcacaatagtttatgcctgtaatcccaactgcatgggaggttgaggcaggaggatggcttgagcccaggagtttgaggctgcagtgagctgtgatcacaccattgcactccagcctgggtgaaacagtgagagcctgtctcaggggaaaaaaaaaaaaaagtcgggaacagtggctgattcctataatcccagcactttggaaggctgagacaggaggattgcttgaggctaggagtttgaatccagcctgagcgacatagtaagaccctgtctctacaaaaatattttttaaaaaagaaagaaactctgtactttaaaaataaaaagtttaagaagaaaaattgtcagttccatccacataggtcattttgctgtagcgcagaacgcatcacacttatctgtgtgactttaataactacatagactcctatgctgttctgttttgttaccatttggctttcggctgctttgcctcctttcactgtgagggccaccatcacaggtgtgctcaacactcgcctgagaatgtggctaccactccagcatcggaagggaacatggcagagggatggtggagcactcttctaggccgggctgctctcacttgttgtgtccttacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaaggtgataaaccttgaatactgttcaagtgttctgagtgttaagaaccaaccttgagaggaaaataagtcataaaagcatttcacta

SEQ ID NO: 29357 - DNA, 1030 bp, Homo sapiens
ttagtagagacgaggtttcaccatgttggccaggatggtcttgatctgaccttgtgatccacctgcgttggcctcccaaattgctggaattacaggcatgagccactgcacctggccctgtttagctttttaagaaactgcccaactgttttccaaagtgactgtctcattttatgtacccatcagcaatgtatgaggatgccagtttctccacacatccatgccaacacttgatactatcttttttattatagcaattccagtggttgtgtactagcattttgcagttttaatttgtatttctctaatgcctaattatgttaaatatcttttatttttaaatatgattattaaccatttatatatattttctgagaaatgtctatttaaatatttgcccagttcttaattgtgttgtccatcttattattgaattataagagttctttatatattctggatatacatagtttatcagctatgtgatttacatatattttctcccagtctgtaccttgtcttttcattctcctaatgacatcttgtcttagtctgtttgtgctgctataatgaaatggctgacactgggaaatctataaagaatagaaatttatttctcatagttctggaggctgggaagtccaagattaagatgctaccagatagtgtgtctgttaagggttcacactccacttccaagatggcccctgttgctgcatcctctggaggggaggaacactgtgacagaagggcaaaaaggaacctaagtccctccatcaagctcttttgtgagaacatgagggcttgcctcccaaaaggctccatctcccaacacttggggatgaagtttcagcatgcattttggagagaacaaaaaacattcaaaccataggatatgttttgaagggcaaaacttactaattttgataaagcccaacttacctattttttttttctttaatggatcatgcttttggagtcatagctaagagtgcttagcctatggttttgtagttttaatttttttttt

SEQ ID NO: 29358 - DNA, 1035 bp, Homo sapiens
gactgaggcaggagaatcacttgaccccagtaggtggatgttgcagtgagccaagatcacaccattgcattccaggctgggcgagaagagtgaaaatccatctccaaaaaaaaaatgataataaaataaaaataaattttctctcctctcagcattattaattatgctttaaaaaattttttttagtgattgctctagagtttacaataaacatttataacctaactctactttcaaataatattataccacttcatgggtagtagaaagagttccccactctttccttccatgccctatgacattggtaccacttatttcactcattcataaactatagtaattcaagacatggtggctgttatttgtttgaacagaaagttgtctctcagatcagttgggaatatgaaatacaaaagattctattttatgttcattgttttttttctctaacatcactcttcctttcttcatgcagatgtgagtttctggcctgcatcatttatcttctctctgaaagacttttaacatttcttgcaaggcaggtcttctggcaacagattccggtgtctctttgtttatttttgtctgacaaagtcattatttctcctttacttttgaggcataatttcactggacacagaattctaggttggcaagaggtttgtttaagcactttaaatatttcacttcactctttcttgcatgaatggtttctgaagggaagtgtgatgtaatgtttttgtgcaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcggaaggactctcgtctcatgcctgtgtctctgtctgtccaggtgaggccagtgggcccatcctgccttctttagcccacctttctgtacttagagcttgaaggccctgtgtgcatggtaag

SEQ ID NO: 29359 - DNA, 1187 bp, Homo sapiens
aagaaataagtcatattcacaaataaaataactaggatgcaaccagagatgcatatcttaatgaagaaaaaattaaaaaccctactgagaggcttcaaagaaaactcaaagaaataactagaaattcataccattgattagctaggatggcatcataaagatgtcagctctcttgtagcctataaatttaaccagtacaaataaccgtaggaattttgggaatcagacaaggtaactataaagttatgtggaaaaatcgactgggcacagtggctgacaactgtaatctcagcactttgggaggccgaggcaggcagatcacctgaggtcacgagtttgagaccagcctggccaacatggtgaaaccccgtccctactaaaaatataaaaattagctgggagtggtggtgcccacctgtagctactgtagctactacctgtatcccagatacttggaggctgaggcaggagaattgcttgaacctgggaggttgcagtgagccaagatagtgccactctccagcctgggtgacagagtgagactttgtatcaaataaataaataaataaaataaagttatctggaaaaataaataggaatggccgaaatatttctgaaaaagaagattagccagggaagactagccccaccagaaattaagacttaaaagctgtcataactcaaaacagtgagatactgacacatgagtagatagtgcagtggaatatgatagaatatgaggaaacaggcccgaatatttatgggaattttaaaggtagcatttcacatcagtgataaaacattggctaattcggtaaatggaagacaggactacatggcacctcctagaaacaatgttgggtcccagcctcataacttatcattacatacattctaaacagcttatagtttgtttctttttaaattgttatttaaaatatttttgtttaaaattttagaagattccctggaagaatattttttataatctcagaggtcaaaaaagtgttttctgtaaatgacaatttagagtacacaaaaattttaaaattttagtgcatttaaaagataggctgtctgggcgtggtggctcacacctgtaatcccagcactttcggaggctgaggcagatggatacaaggtcaagagatcaagaccatcctggccaacatggtgaaaccccgtct

SEQ ID NO: 29360 - DNA, 1067 bp, Homo sapiens
tctggaacttggtgcacatgtctatgagggtgcccaagtgtggggtaggcctcaagtgaggacttttacaaggccctaaccagagccttgcattctctttcctacccaccgcccagtggggctcctttaccagacaagtagagttgaccaccttcagctggggacctgacactcattactcactggtcctggtagcaggtgcaggcagaaccattcaagaagaaaaatcaatgaaaagcagaagtaaatgaataagaaagaaccggatctttgaaaagcaaagtgtgagaaatatatacttggtatatttaattgggggttgggaagaaaaaacctagacaaaattagagtttaaagatctagaaaaacatttaacccagacagaaaaaaatcatcaaacagtacaatataatgtttgtactattaagctaaagaacaaaatactaaaaaataattttctagaaaataggaactttcataattgataccataggattaggaaaaactgaacagaatagtaaccaatgaagaaatgaaaggctgtcttcagaaatgcttcttggttctaaattagttgtaggtgcattgttttgagcttttaagaaaaattatacagaacaatagcaatatttataattgaaaggaagatataagccagggttattgtatctggaaaatacaagaaaacctaagaaaaataatgtaacaaaagcatagaataatatgaataaagatagaaaaatcagaaacaatactagtaaatataataacacttgaaagcagttactcatttatttatttatttacttgagacagagtcctgctctgttgcccaggctggactgcagtgttacgatctcagctcactgcaacctccacctcccgggttccagctattctcctgcctcagactcctgagtagctgggactacaggcacgtgccaccacacccggccactttttttttgtatttttagtagagacagggtttcactgtgttagccaggatggtcttgatctcctgacctcgtgatctgcctgtcctggcctcccgaagtgctgggatt

SEQ ID NO: 29361 - DNA, 1032 bp, Homo sapiens
gaacctttctggtaagagttctgtggggaccagaggtaaataaggctctctctctgaacagaaagctgtgtggaagatagatgagagagattgacatacaaaccgtattctagaatgcagggcaggggaaacaggagctagaggaataagcgtgatagcccaaggaggaagggcacttcaccagcagagtcgggtttgtggatgtgtccttggactgaaccttgacgtgactagaattgtgatggcagagaaggcgctacagcacatgagaccatcaggagaaaaggcccagagggtgaaagcatttagggaaagacatagaacatgttaggagggaggctaaacagggcaagagggagaatggggctgggaggcagagccttgccagcagcttgaacttccttcttggggttaggggagagaggagaacattgaggcttctgaggaagctggatgaaacacccaacctgtgtcttaggcaggccctagaggagttaggaatttctagtcttggtgagatgctcagggagacagggagatcacaggtgatggaggtgagaaatagagaggcactaaagacagggtagaggtagaattaatgggacttggccatgtaggcaggtgactgtagatttgggccactctgaatgtatttatttacttatatattttctttatttattttgagacagagtctcgctctgttacccaggccaggctggagtgcagtggcatggtctcagctcactgcaacctccacctcccgggttcaagtgattctcctacctcagcctcccgagtagctgggattacaggcacatgccaccacgcctggctaatttttgtatttttagtattcggtatttagtgtttttgtatttttaatacacattttcgccacgttggcctggctgctctcgaactcctgacctcaggtgatccacccgcctcggcctcccaaagtgctggtattacaggtgtgagccaccgctcccagcctctctctgaatttatttctttaatatgctgcag

SEQ ID NO: 29362 - DNA, 1039 bp, Homo sapiens
cacaactaaactgaactgatcatgtgtgtgttctcctcctgccacctctctctccttccatcttgtgtgacatctttcccatttttcagggactaggttcacgtgtttcttttgaaactgttcatcctgagttaccccggtagatgtgctgtatcactgtctgtgtgttttgcctggcatggaaggtgtgagggtactttccatatgcccccagggtagggactgcctcagtcccttctgtatgccctactgcattgaacaacctcttccacatgatgggtatgtgataaatattggctaaaacaggtaagaaagctgaggttttcataatttatcaagatgaagttaggtttactgtgcatgaaagccgaagccttgagttttagtttcatttctcctgttgatctccaagagcatttcctgatgtgtactgtgcagatctttccctggagaactggacaaatattgtaattatgaattatgatgcttgtgattaggaaaggaaaaatgttattatgaactagtttactgtgtgaaggtctgatagaatttttattttaaaatgctttacctaaatcagtttttgtgaatagcctacccttctccagcctctcttctactgtcatataacttgttcctttttgataagctcctttgtaggccaaaagttttatgctatgtaaacataagtaagtcaagatgcttaagtgacgaactaggtacaaatgaataagagactacactcagatcagcagccaagtgcatcagcctggcagagcaagcacaacagtggcccttattgctgagggcctctctacagccctagaatggagcatgataatatctactctaaccacttcatagtatgcttgtgatactcagttgggagcgtagatataaaaatgctccccaaactgttaagtgctttagaaatctgagataataagtaataataaaaagaggctgggcacggtggcacatgcctgtaatcccagcactttgggaggctgaggcaggtggatcacgaggtcaagagatc

SEQ ID NO: 29363 - DNA, 1046 bp, Homo sapiens
caaaaaataaatgagctatgcatggtggcgtgcatttgtagttccagctacttcggaggctgagataggaggattgtttgagcccaggagtttgaggctgcagtgagccatgattgtgccccactgcacttcaacctgggtgacagagcaatatcctgtctcaaaataaataaaaataaaatggtggtaatttctgaagcagtttggtattttatggtggtggtatgaagaaaacaaatactgtaataagagcaatatctttcaaactttttggacaggtgctaagtgtggtggctcacacctgtaatctcagctacttgggaggctgaggcagaagaatcacttgaggataggagtttgaggttgcagtcagctatgatcgtgccactgcactccagcctgggcaacagagcaagaccccatctctaaataaatgttttaaaaataaaaataaatgttttggataaaaccccatattaataataagtattttacattattatctggcatagactgttatatatagcatattattgttgaaatacaaaacaatatgtatccgtactgtatgtgatatagtgccattttcagtaactgctgtacacacagcaactcagatgaaactcaaggaaattcttcagagcaaaaacagccaatcttgaaaacatacatgtagcaggattccatttatgtaacattggtgaaataatgtaattatagagatggaaaacagattaaaggttaccaggggtttaggttagggatggtgagggggtggttcatacgagggagtcctgtggtgttgaaaaccatctgtcagcctgactggtggttacacagggctatacatgaagttaaaattgtgtagagttaggtacacaaaggagtacagatgtaactggggaaactgagtatgttctgtagactgtaccaatgtcaatttctgcgtcctgatgctgtgctgtagtgtataaggtgttaacattgggggaggctggggcaagggtacccaggacctccctagacaacctcctatgcaacctcct

SEQ ID NO: 29364 - DNA, 1156 bp, Homo sapiens
ggtgtctgtcatgttttccctttcctagggtccctctgctccctggtgtcctgtttttttctgtagagctggtgtagggtgtatgaaacagaagacttgcagcatgggggtcaggagctctgtcttgctctagagccgactccaggctctgttatcacagaactgtgtgccctgggtgggcttcgtcttccaacagagaccttgaacttcaaatataggcagcaccttctagctgagcagggtggtggcgggacagaggaaggcaagggctgagcatcctgtagacatgggcactttgtgggaatatggccaggcctggcagcaactggaacgcagtcacctctttgtgatgaggatttctacaacaccagcgcttcagacccatcgctctcctggttccttttctcaaaggattggacccttgaggatccaggatcagggcagagggcagatgtactgagccacccattcaggaccagctgctacatgggagccatcccaattactgaactcttttctctagcacttggggtggttggggacagagaccactgtgaagtttgcacacctggtcctactcacaaccacttctgggctcaatgttcaagttgaaacagcattgggcattgggacctttcaggctcagaggagcaaacatagtggccagtcagacctcaccctccagctcctccttcaggcaccatccaggcttcaccagctacaggctgcctttctcactaaaagccagtgcctgactccgacctaagaccttagcatgggacgtcccccaggctgactgtgacctgactgttgcaaatttacagaaggcaggggaggccagtgggcacagcaggcctgtttgaccataaatatgtatttaagaagtatatgtttaaagatgggattgaagacatatttagctctattccatcctgcagccccactaaggctgtggctaaaggtcatgaggtaagaaagacagtggaagaggaggcaactacaaggctttggaagccccaggtaccttagtagaccatagaaagcctagaagcagttctgtgtagattgtggaattctcaaaaggcacctctagaaatgagggactaaagacagaattctgttactaagcagttagagctgcattaccctccctccc

SEQ ID NO: 29365 - DNA, 1026 bp, Homo sapiens
aaatagtaaagttccagaagtgaactttccaggttaaaggttgttagtgtcttttgcagttagctgtataactaccttgtctaatttgaaccatatctggggaacagcatctcttcagcgatgggcacagggcagcctgtcccttatggcagtgttgtcacagcaagaagtgcagctgtaggttgtgtcatgggcatgaatgctgtgtcattcgcaggagccagtagagccacagtaacatggacagcgacagctccagtgctgccaggaaaccatccaactgatttctgtgtttgccccacagatctacgaactgcgtgtgatggagaccaaacccgacaaggcagtgtccatcattgagtgtgacatgaacgtgagtggctctgtccagttacagtgagcctgggccctgggaggatgggcagttggtgaccactgcaggccagggtgtcaggagggcatcaaacagcccctgggactctgggtaaagaggaggaagatgctgtcagaacatcatgaggagactgtgaccttgtgatctatctcagggccagttggggcaacagagtttgctgccagtgctgccatggttagctctgacccgttgaggagtgaatattctttttttttttgagacttagtttcactcctgttgcccaggctggagtgcagtggtgcgatcttggctcactacaacctccacctcccaggttcaagcgattctcctgcctcagcctcccgagtagctgggattacaggcatgtgccaccaggcccggctagttttgtattttggtagagacagggttttaccatgttggccaagctggtctcaaactcctgacctcaggtaatccacccgcctcggcctcccaaagtgctgagattacaggtgtgggccaccgcgcctggccgaggagtgaatatgcttaagagctaaggaagcgtactgaaccttctgagtaggaatgaagtgctgatgcacacagcatcctggttgtattactagggaatactgctgagcaaa

SEQ ID NO: 29366 - DNA, 1112 bp, Homo sapiens
cctccccacagccctgacggtggctctcacagacccttcctgaaaacagcaaagggacaatggtggcaacacccaatgacagcttgccactgctcccttagctgggatcacagaggtggcacatgggctataactctggtccttgcaggccgccctggtgcctctagctcttcactcagtggccatgctgatcctaagaggaggaaccctgtcccggagttgctgttacttgcagaagacaaagaacggctaagcccgccccagcttctcctgggttctccacgttcttctgtgccaggctcagtggcacctcgtcttggtttttggacatcaatgttcctatatttccatgtggctagagcttctccttgagcggtttttccgcaaggaatccttggtgtccacagagacctctgttttaccctcctgcttaccattttggccggctttggagttcaggcttgacaaccttccccagagctcgcaggcctggtctcaccatcactgagcctcttggttcctgactgtaatcacctctcccattactgagttcttttttgccctcttcattatgttgctctgtttgttccccgggggcccctttcgtcagatggttggctccccctgaggcccctggtttctgggcttgatgggcaggaggctctatttgtgtgtgcaggtgtgtacatgttacccatgcatgtgtgtgtgcatgcgtttgtgtggggcctagatctgtgagccatccctggggctgagtggggctgaagccctgtgttggaggctgagctcctggtgctgagtggagcagaagccctgctgtcagaggctaagctcctggtgctgagtggagcagaagccctgctggcagaggctgagctgctgtgggggcccctggcaagagcagcctgcacaagaagcgccgtggccctggtccgcgtactggaggtgggcgcctcagcaggtctctgtagctggaaggaccgggctgtgggcccagctctctgccctgcccggaggtgacctcagcacacccatagcatgcctgtggcagatctgggattcagacttggggtcccgggcctattctgtgtgggttagtgagggcagca

SEQ ID NO: 29367 - DNA, 1086 bp, Homo sapiens
cgctccttctagcatggtagaaggttccagttgtcctctgtcttcatcaacatttgacagactgtttaattttttgctaatctgctgagagtgtaattatatcacattgtagttttgacaggcattcccaggattattaattaggttaaacatctttgcatatatttattggacatttacgttgcttgtgaaatatctgtccaagccttttgcttatttttctttcggtgtttgcttttgtattctgttgacctctgtgttctttagatattctggatacgagtccagtgtggacttgtctttctccacccctctggcatgcttttatggttttaaatctacagaaaagctgcaagtgtagtaaaataaatacctgtacaccttcacctgtggtcaccagttgttagcattttgccacatttgtactacttctctgcctatatattcatacatagataggtagagattaagagagaattttttttgaaacatttgaaagcagattgtagacattatagcatttcacccctaaatactttcggatgtatctcgtaggaataaagacattcttctacataaaatactgttatccttccaaggaaattaataacaccccattatctgtagtccatattcagattacccacaaagatcccccagatgtcccttatagcccccttttttttgatccaggatctgatctaagagccaggatctaaggtttatatgtcatgtttggtcatcatgcccctttggtctcttaatgtggaagttacccagcgttttcctttggttgtttctcttgatgctgacctttttgatgagtccaagctagtagtcttgcccagtgtctcgtaacctggatgtgtctgattgtttcctttatggctggattgaggttgagcattgttggcagggacacacaaggttggtgccatgtctgtggcatcacatcaggagataagcaatgccagtttgttcattattggcagtgctagcttttctcagtggtgaaagtggtgacagccagatgtctccattgaagatacacattttccttttgtgatcagtaaacagtttggagag

SEQ ID NO: 29368 - DNA, 1060 bp, Homo sapiens
acttgtactaagagtagtatgttatggccgggcacggtggctcatgcctgtaatcccagcactttgggaggccaagatgggcagatcacctgaggtcaggagttcaagaccagcctggccaatggggtgaaaccccatctctattaaaaatacagaaattagccgggcactgtggcgtgtgcctgtagtcccagctactcgggaggctgaggcacaagaactgcttgaaccccagaggcagatgttgcagtgagccgaaaccacgtcactgcactccagcctgggtgacagagcaagattctgtctcaaaaaaaaaaaaaagaaaaagagtagtatgtcatattctccaatcactagtaggcttctttctgtgactctgcatctcctgtcgtttctgctctatagaggtggtatctctgttatatagtgcatagatattaaaaactgttacatagattaattatatattatatatagatattaaaaactgttatatatatagttttttttttagatagggtctcactctgtcacccaggctttaatgcagtggtgtgatcatggctcactgcagcctcaaactcctgggctcaagcagttctccttcttcagcatcccaaatagctgggactatacaactgtgcccagcgaatttttatttgttttgagagatggaatctgactatgttgctcaggctggtctcaaactcctggcctcaagtaatccttccacctcagcctcccaaagtgttgggactacaggtgtgagcccaccacacctggcaataaactgttatattttgtaaactgcaatgaagaattaaaaactatctgtctttgtcaagtctaatgctttttggctggaattcaactttgtctgctattagtatttcaacccctactttcttattgtttctgtttgccccatatacctttttgcccatctctaattttagcgttttggaattactttgtgttacactctttttcttattgagtgacatattctgagtcaaggagtaaattctgagaatgaatccttgaacagatacgtgttgtg

SEQ ID NO: 29369 - DNA, 1047 bp, Homo sapiens
agatagttgcatcatctttgtcacctccacccccataaaacaccccccttggtgtcttccacactggctgggactgaactgggtctgccacgtctgccctgttgggacctcgttcctgtatggggtttctgtgtctgtccccctagccccaccctctctgctccctgtgacttctgtcccagctggaatgtgaggaaggctgcctggaggaagtggccactttgattctgggggatgagtgggatagcatcttggcaaagaatgatgtttcctgtgggattaccagcagttctgggcagctggaaggtttggatgcaggaaggtgggatgcaagccccttgccaggctcagctgcaggcattcgccctttgtgtgttaacactgtagctctaatcgtgcctggtgttctgaagcaggctcctcttccctgctgctgtgctgccatcccctgctcactccgcactcgcatgcattgcggattcagcacttaagccctagtgtgtaaatgacttggatctccctcctggcagactgtgaccctcagcacaggggctctgtcttagtcagctctgtggcctggtacacaattggtgctcattaaacacgtgttggattactggctgaggtggtgcagtggctgcctaccagcaagtctttgtttcccattctgtcaggagcagaggcctggccatgagcattccaggtcagcattgcagctgtggtttctggcaggggctttgagggtccaagggtctgatcaaagaagctgggtggggctgagtagggggtgggtggctctgcaggtagagaactgacttccgagagctgtaggtgaagtgaggaccaggcagcagtccagagctgtgaggccccaggcccagaggaatggaatgaagaaagacctgttccacacaaggaggggttttctagtggaagctgagcttggaagctcctggagccaagtttaccacaggataggcaggtacagccgcccagtgtgtgcagtgtgtgcccactctggtgcttggacaagaagttcaagtccct

SEQ ID NO: 29370 - DNA, 1042 bp, Homo sapiens
atggggtgtggtcattgtgggcaacctggatacctaaccttggctggtggtgggagctgggccctggatcggggtcactgcttttttagagctcagtgagggactggactggactcgactcacgtccaggccttagtataatcctgcagtaaggtgggaagccagggtcatgggctgggctttcaggtgaagaccccccccccagaggggggtcagacctgagggattccagagtgtttgggtggtggaggtagggccagtggccctggcaggttctagtgctgcaggccaccctgggaggtacctggaggaactcaccctgaggggggatggccagcagataggagatgtgggatgaaggtgtgtgcaggccttgtgctcccagtgagccggtggcgtttgtgtgtggggtgaagcagagagtttcctggaggtcgtgagtgggcctccgtttgcagagagactggggagggggctagatagagttaggctgcagagtgtaagagccctacaggagggctccttgcactggaatagaactggctactggctctggagcctcctaggtgactgctgcgtggagaaggaggggcgggtccagccatcagactgggactccccagaccctgggcacaagtgactggagtggcgggagcagacagcaagtggggttccaggattttacaatggtgggggctgggatgctctgctgtggctgggatggggactgtggaaaggtggtgtttgtgggtgggggtggcattgcctgcaggtggcactcagttgtgagaggtgaatttggaaagcatgtggggtcaggagggagcagagaatagcaggctcactgctctgtcggggaagcaggtaggacctgctgtgtgcctggtgctgggatgtaaaagagcctaatgacgacgcggtctgtgcgttgttcagagtttttggggcggctagagcctactcagcagacaaatgtagtttataatcgcgtgctgtatagtagttaagcctctggtctctccagccagtttttgctgcttcc

SEQ ID NO: 29371 - DNA, 1051 bp, Homo sapiens
caggcaccggccccactggccagacttcccaacttctccccagacccctagactctagaggttagaggctgcacagagcaatgggaggatacacactcgtcctcctggagcccctgaagaacagttaactaaatcaggacaataatcataactgagcactcgaagcagaggctgggtgtctggtcactcaggacagttcaagcctcatcctgtaggacagactcccctagatccgaccagagcgccaccatatctgttatgtgtggccagtttcattccatgcacgacaacatggtcccccaccatgcagggggcccctcgacccagccccctggatgcttgtgacagcgagcagctctccccacaggcagtgagtgtagaggggtgtaaggacggggtcagggctccttcccagggatggcggctatgggaggcatggtggctggccctctgcccgcggtggactcgggagggagggctgactgtgtgtgtgaatgggcagagttggtgctatggaggttttgggggtctccaggacggagggtggcccaacagagttctgggaggcagtcaccacctcgtggccttgctgagacctggaaccctcagccagggcactccatctttcaaagcttcttggctgcatgcgtcaggtgggcaagctcaggaaggttaaatgcacccgtgctggcggagtcccataaaaggggattcggcatcaaaaggaggaaaaaggttcaaagggcatttatcatggggttcagaatcacggatgtgaggggcggtagtggggacaacagacagaaaagcttccccttcccatactcacagtccagacacggcaatagccaaattccaaatttctaggtattctggactcagaatggggaatatcatacgagacttagggggataatgcccttatcttcctattttaagggaaagaacaaactgaaccttctatgcaaaataggatgatgatcctggtcctcccagtaagaaataaaataagtagtctccaggcattcctttccgccagaggagcaactgt

SEQ ID NO: 29372 - DNA, 1042 bp, Homo sapiens
gcctcaggtgttatctgtgtttggggttcctctgcttatcatggctgctagctccagtgggactgaggcatagcgcctgggaagcatggcagggttggaggctgagtggtccatgtcccccaggaccctctgaaggatggtaaggcataccctgctcacatccacgctgccagagttttgccacgatgggtgctgttcagcagagtgggtgatggcttaagagaatggctcctggccattcttgttcctccagtccccaccctggccatctgcctgtccccccaaaaagcagtctctgtgggaggcatggctgacagccctgtggtttctcagtgacaattagtgcccattgtggaggcatggcccagccagtgctgtgcctaagtggtagggagaaggccatggcctccggatgcctgagtgacctaggctgagggatctagggcagatgggagggacaggatgactgactccttgcctgttcccaagtccttgggcatggaaagctgccggccgggccagcctagtgggagctgggtctgctgccgcctggctgtgtgggaggaccagcgtctggccgagaatgtcactgctcaggccatttggccatgcagggtcttctgggttgggacaaagaagctcaggcagggtacttggcttgcttgtggcacaggtgacagggcatctcagggtggcaggaggggctgtcccactgcccttaactcctcgtaggtcaccacacttcagggaggccaggtcagccagacaccaaacgacagccctggtaacagggtccgcaggagggtggttggctgggcaggtccgaggctgcccaggcacacttgctcactctccctcctgttgcttgctcctttcttgtcccttcttttccctcccccctccagttcttggtcttctctatgtttctctgtggccctctctgtgcctctttctctgcctttccccatctcctatcctgcccatctggaatgtggtgattgcttattcctgtctgctgtggtgattggtttttcatgtctgc

SEQ ID NO: 29373 - DNA, 1072 bp, Homo sapiens
agagttgagtaatgtggagttccactgcgggagggccgaggacctggtgcccaccctggtgagcagactggcctcccagcacctcgtggccatcctggacccaccccgtgctggcttgcgtgagtggcttttgcttaaggaggtggcacgggaacgaggacacatggggtggctcaccatgttatgcactctctggctgtggggacccagctggtgtttgcctcctcagattccaaggtgatcctggccatccggagagctaagaacctcaggcggctgctgtacgtctcatgcaacccccgggcagccatgggcaactttgtggagtgagtgtctgcaggggcctgggtgggggctaggcctgctaccaagcccccagctcccacaggagcccctgattagcctatcggctgaccttagcgccccccttttccccccacagcctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaacaaagggtgtttctgtgatgagagccaggggtctgaacacagggcctgggtgccagggaaagggccaaactaggcctaggcagctctgcaagcctctctgcatggctgggggagtcagggcagagcttactttaaaaaag

SEQ ID NO: 29374 - DNA, 1049 bp, Homo sapiens
agagcagggggactgcttgcccagttgtgggcacttgggccagctcgtgattcccacaggtccactccatactcggcatacgacccagagacgtacacaggccactggaagcagctgactgtgcgcaccagccgccgccaccaggccatggccattgcctacttccacccccaggtctcaacgggggccctgctgggggagggtgcctagcctaggtgggcctcagcacagcctgatgggaacttttcaccacttactccagaagctgagccctgaggagctggcagagctgaagacctccctagcgcagcacttcacagcagggccaggcagggccagtggagtgacctgcctctacttcgtggaggagggacagcggtaaggagcccgagtggggcggggcaggtccctgcagggactgtgacactgaaggacctgcaccttcgcccacagaaagactcctagccaggagggcctgcccctggagcatgtggctggggaccggtgcatccacgaggacctgctagggctgaccttccggatctctccacacgccttcttccaggtagccatgagtccctggtgggcatggggacatgttgagggaggcctgacgcaccatcaggacgtgatgggaacagtgggctcaggcggtgagatttgggggagtatccaggcaggtgagccacaggggagggtgaagtaagaaagaggttggtcatcactgatttgactcgggataacctagaggtacacacggcagtggcccttgtcacagggaggatgaggagtggccctcagtgcattaccacagggcactgctctgggctcggcaggagggaggccatggtggcctctgggctgggaaatactgtttcactgtttgctcactgctgcaggaaggctgtggggacctggagcggccgtttttggagacaggcctggcaggacctcctggagggctaggtgtgggggtgggagctgcagttgggtgattccaggggccccggtgtgagttgtgggaggcaaagcccccttgctggggcagg

SEQ ID NO: 29375 - DNA, 1031 bp, Homo sapiens
tctggggtcaaggcggatcgctggggaccaggcacctggaatgagacagaggggcagtgctgtgtgggcctccccagggacagaacatggagtgggagctgcgcatggagcccccgcttgggcagctctgcaggcctccaggccaccaaggcagccagcacagtggtcctggcaggagggtgagagggcggcacattccagccacagcccacctctcctcccaggatgcctggggaagtgcaggaagagccctgtgggggcggggatgggagctcgggccatctttggaaagaggctgttaagagaagggaacaagatggggctgcaggccattccctccccatgacaatgagagagctgcagccacagtccatgcggccccctgtgccttcagcatccagcctgctgcgactttgaggatgatggcagctgagggttcatcggggccaggctgtgtcccaggaggcatggacttgctggagctcagctggtcaacttccaggaggctctgaccaccaccaagttccagccatgagggtctcctcctcagccaggggcacccaaccccttgggaaaggaagggctaggcagctcccacaccctcctcaccccaggacgagcctgtagagaagagcagctgtgttttcagctagagccatgggcatgaggggtccagggaaagggctgtccggacaagccacctgcagtgcccacggcccagcctgaggcagctcactcccaccccagcccccgcccaggcctgagcccaccggctgttggccaggcccgaatggccaagatcgatgagtgcccagcacacgagccttgtttaccaggctgtactgtgtctgctcagcatcagggcctcccactgaagccctcccacaccctcacacccttgcctgcaccctgtgccctgaacctgccatgcacagccctggccaccccagcacatggggtccagtctgaagcagttgcccatgagggctgccccaggctgaagcccaggcccacgccacagctgaggtgag

SEQ ID NO: 29376 - DNA, 1018 bp, Homo sapiens
tacaaggtcagatgcggtggcccacgcctgtaatcccagcactttaggaggccaaggcgggtggatcacctgaggttgggagttccagatcagcctggccaacatggtgaaaccccgcctctcctaaaaatacaaaaattagctgggtgtggtggcgcacgcctgtagtcccagctactcaggaggctgaggcaggagaatggcttgaacctgggaggcggaggttgcagtgagccaagattttgccactgcactccagcctgggtgacagagcgagactccatctaaaaaaaaaaaaaaaaaaaaaaatcactggcctctgccctgggtggacacttgcactgccagagttgtgttccccactgttagccagcactgggggctgagacccaccagttctacacatgtccaggggaggcagtacagatgactgagtattaaatctagacctttaattacacatatttttacttttctgtgtgatgaaataggaaggatgcatgaggcttttttttttgagatggagtctcgctgttgcctaggctggagtgcagtggcgcaatctcagttcactgcaacctccacctcctgggttcaagtcattctcgtgcctcagcctcccgagtagctgggattacaggcacccgccaccacgcctggttaatttttttcttttttttttttttttttgagacggagtcttgccctgtcgcccaggctggagtgcagtggtgcgatctcgctgactgcaacctccgcctcctgggttcaagcgattctcctaccccagcctcccgagtagctgggattacaggcgcctgccaccacgcctggttaattttttctttttttttttttttgagacggagtctttccctgtcgcccaggctggagtgcagtggtgcgatctcgctcactgcaacctccgcctcctgggttcaagcgattctcctgcctcagcctcccgagtagctgggattacaggcatgcgcctccatgcccagctaatttttgcatt

SEQ ID NO: 29377 - DNA, 1037 bp, Homo sapiens
ggtcggtggggcggaatcctggagagatggggcggggtccaaggtggggcggggtcggatccgccttcggggcgggtccccagaggtggcggctggagtgcgggacgcgggcaggttccggctggctgggggcacctactcaagcaccggggccttccaccccctccgctcctcccctgcagagtgcccgcgccagttctggggccccgactgcaaggagctgtgtagctgccacccacacgggcagtgcgaggacgtgacaggccagtgtacttgtcacgcgcggcgctggggcgcgcgctgcgagcatgcgtgccagtgccagcacggcacgtgccacccgcggagcggcgcgtgccgctgtgagcccggctggtggggcgcgcagtgcgccagcgcgtgctactgcagcgccacgtcgcgctgcgacccacagaccggcgcctgcctgtgccacgcaggctggtggggccgcagctgcaacaaccagtgcgcctgcaactcgtctccctgcgagcagcagagcggccgctgtcagtgccgcgagcgtacgttcggcgcgcgctgcgatcgctactgccagtgcttccgcggccgctgccaccctgtggacggcacgtgtgcctgcgagccgggctaccgcggcaagtactgtcgcgagccgtgccccgccggcttctacggcttgggctgtcgccgccggtaagcgcggtctctcggccagggagggaggaggtggaagggcgggccgccgatggggacaggggtgaggcgggtcccagccttccctagcctccgacccctcccccaggtgtggccagtgcaagggccagcagccgtgcacggtggccgagggccgctgcttgacgtgcgagcccggctggaacggaaccaagtgcgaccagccttgcgccaccggtttctatggcgagggctgcagccaccgctgtccgccatgccgcgacgggcatgcctgtaaccatgtcaccggcaagtgtacgcgctgcaacgcgggctggatcggcgaccggtgagca

SEQ ID NO: 29378 - DNA, 1084 bp, Homo sapiens
tcttgtgtcttcactttgcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcaggtgaggcatgtctcatctagcaaggcagacccacacccaggtggggttccctgagatgcccatgatgcctgccgggcactagcattggcttgaagatgggtcaggaatgtgaggagaccaagcagtgacgaaggccatgaagtggggaagactctggagttgttcctggagctcaagcagagccgctctagacaccccaggcctctgcctttgccctcttctctattgctggttgtttccccactgtctgagtctccctgtcattgaaagcatcctgcacataagcaggtaggctgacccgaggctgcatgtggacgtcctgtgtgctctggggtctggcaatggggagcatccaccagcattgctgccagggcccttcctgcctgtcccctcactgggccacttcagtctcttgaaaacttatgtgttttgttactgaactttatctatctatttgtctgtccatccatccatccatccatgcatgcacgcatccatccatccatccatgcatgcatgcatccatccatccatccatccatccatccatccatccatccatctatccatccatccatgcatgcatccatccatggtggcaggcatccatccatccatccatccatccatgcatgcatccatccatccatccatccatccatccatccacccatccatccatccactcattcaatttattggagacaagctctctctctcttgcccaggctggagtgcagtggcacgatcacagctcactgcagcctcaacctcctgggctccagcaatccttctgcctcagcctcccaaatagctaggacctataggcatgtgccactacacctggctaatttttaaattatttttatagagatagaggcttgctttgttgcttag

SEQ ID NO: 29379 - DNA, 1024 bp, Homo sapiens
attattttcgaggctaattatattttttatcctagtgtgagtctttatacttttttggggggcatattaaggtgtttgaagaggaggcaccgacccagatcccgtgggatataagatcctatgtggcatgtgtacagtatttctcacgttggaaccttctgaattctaaaatacacttgatttaaagagtttggacaagggatcgaggacctgaacaagctgacccaagaaatatttttctcccccatctcacaccagaggcagcatactggtttgccattctgtacctgtgacatcctggaggtcccaggcaccagcagtagagatggccctcactctctgtgctgtggagtgttccgtgctgtcgatgtcctctatttatttggtcattcccctgctactgggtacttggtgaacaattttttaaaattgtggttctaaaataataaacacaaataacacttaccatctagttcagtaatattacgattattcacattattacgaaacagatctccagaacttttttatcttacaaatctgaaactctatacccactaaaccacaactcccttttctcctttacccccaggccctggcagctaccattctactttctgtctctatgaattaaactattctaagtacctcataagtagaatcatacagcattagccctttatcacttgcttatttcatttggcatcgtgtccttaaggttcatgtgtgttataacatgtgacctgatttccttcattttgaaggctgaatagtgtgccattttatggatataccacattttgtttgtctattcacctatcaagggatacttggtttgcttccatctcttgtctattgtgtataatgctgctatgaacatgggtgtgcaaatgtctgagactctgctttcagttctttggctatattcccagaagtggaattgctagatcattctattgacaattttctgaggaacatagcagttgcaccacttttcattcccaccaacagtgcacaagggtta

SEQ ID NO: 29380 - DNA, 1044 bp, Homo sapiens
aaaaatacaaaaattaggtcatcagcaaagcctgagtcctgtcctcttgctctcctccccggacagcatgagcttcaccactcgctctaccttctccaccaactactggtccctgggctctgtccaggctcccagctatggcgcctggctggtcagcagcgtggccagcgtctatgcaggcaccgagggctctggttcctggatcttcgtgtcccgctccaccagcttccagggctgcatggggtctgggggcctggccgcggggatggctggggatctggcaggaatgggaagcatccagaatgagaaggagaccatacaaagcctgaatgaccgcctggcctcctacctggacagagcgaggagcctggagaccgagaaccggaagctggagagcaaaatccagaagcacttggagaagaagggacccagatcagagactggaggcattacttcaagaccatcgaggacctgagggctcagatctttgcaaatactgtggacaacgcccgtatctttctgtagatcgacaatgcccgtcttgctgctgatgactttagagtcaagtatgagacagaactgcccatgcactagtctgtggagagcgacatacatgggcttcgcaaagtgattgatgacaccaatgtccctcagctgtagctggagacagagatcgaagctctcaaggaggagctgctcttcatgaagaagaaccatgaagaggaagtaaaaggcctacaagaccagattgccagctctgggttgactgtggaggtagatgcccccaaatctcaggaccttgccaagatcgtggcagacatccaggctcaatatgatgagctggctcggaagaaacgacaggagctggacaagtactggtctcagcagattgaggagagcaccacagtggtcaccatgcagtccactgaggttggaactgctgagatgacaatcacggagttgagacgtacgtccagtccttggagatcaacctggactccttgagaaatctgaaggccagcttgtagaacagcctcagggagg

SEQ ID NO: 29381 - DNA, 1011 bp, Homo sapiens
gaaagagaatctagctaatgcctgataatctgaggtggaacagtttgatcccgaaaccattccccgaccccgtggaaaaattgtcttccaagaaagtggtccctagtgccaaaaagattggggactgctgaattagaagacacccagctggtatctgtggcagaattgattgcttgcttgttaatggggaaaaaccctcacacatttggtcacagaagtctcctgtgtttgttgttgtggtataagaggagaggaaaaacagtgtgtttttttcattcagaactacagtaacatgctgtacaagtatgtagcttaggagcaattggctgtaccttatggcctagatgtgtagtagtctctaccacctaggtttgtgtaggtgtaccctttgatgttcacacactgaggaaattgcctccagcgatataagtctcagaatgtatccccaacattaagtgatgcatgactggaggtaattggagaataaacatattttggggagaggaaagtaggatgaagtgaggtggagaagacagatgttcacatcttgtagctgactgtgctgtgcctacagagcctgcagcttggccatgcctcacagtgtgggactggccactccctgacctgaacagctggctatccacagtcacttttggttgctccatggcaaaagtgcatttgcagtaggttcattttactgattaggttttagaggctccaattcaaatcagtttgcggtttttgaacgtactgactcaattattagaagataatctttaatttaaaaggcaatgcagatgaatttaaatgcatcaggttcaatcacagttactgtgcttgactctcagaatttcagtaaaggaaagtaggccctggaaatgccacccccttggcacccacctcccagactcctggctgtgtgtctcctgaccactactcaggtcttgccatttttatgcatccattactatgaggaagaacccaattttgttcattcaatgggagggagga

SEQ ID NO: 29382 - DNA, 1062 bp, Homo sapiens
gggggcttttgagatgtttgtgagataaaacctcacccctcaagaagccggaatctccttgtcgtgggtaaataggcaggtttgggccgggcgcggtggctcatgcctgtaatcccagcactttgggaggtcaaggcagatggatcacctgaggtcaggaatgcgagaccagcctgaccaacatggtgaaaccccatttctgctaaaaatgcaagaaaattagctgggtgtggtggtgcacgcctgtaatcccagctactggggaggctgaggcaggagaatcacttgaacctgagaggcagaggttgcagtgagccaagatcacaccactgcactctagcctgggtgacagagcgagactccgtctaaaaaaaaaaaaaagggcaggtttgaatggtggggcatatttgtcatgttctctgtacaatgatagagggagaagtaatcgagctagaccttgaccaatatgggactatgagagacagaatggcctagatgggtgactaaaggtgttcaggggatgacaggtatcccttttggactaaggactgctgatggggctgagtaggtaaggcttgaaggagagcagcctggggaggatgagacaagaggtagggaaactggtaggggcatcactgctgtggtctgacccagagtggtggccctggaggagtggagggtggctgtctgagatggaggagaggtgaaggaatcagaactagtaggttcatagggcacatgggttagaaaggaaaaatattaaaacagtgaggtttccaagatggaaatggtagctttgatagtaaaattagacaagttggagggctactagctagattaggcactgagctgtaggtgaaactgggaatgtgaaccactgggaaagaaggatgggctcgagcagggtgtgtgggatgaaagagagaggtcagaaaagggagaattatcatagagcagagtttccaggcaagagaatcctaagtgagaggtggtcatggggtatacaccttggctgtggccatctctggggccttggtgagaaagatgagccagcccaggagg

SEQ ID NO: 29383 - DNA, 1043 bp, Homo sapiens
cctggcacccgggcgggccctgttgcctgcggcaggtccgaatgcggccttcctggccgcgaccctccgcgctggagcgggcggccttgcaacaggcgggcgatttggggccggcctgacgagcctcagttccctcgatcgggcccggggactgcagccgtaggagcccagccttgccagctctcccggtttcctgagaggagccggagatcgcgctgtcagtgcaaaatcaccagagcgcgaagcgtcggctgccagttctgaccattttagatccggtgcgggccgagccgagtggatctggggcgggcagcggggcaccgccaccttccgcctgggctcctcactgggcgccctcgctccggccctccgcggggccgagtgcctccaagacggctccctgggagattcttccagagcgcaccctttggaaggctgccccgctgggaatcagcacccactccctctcctctaccgcagccgccccctttgcctttgtggccgaccttgcttcatgctgccaaggattgagtttctttgaggggatactgctcgttcgggggccctacagaaggctgagggtatctactcagtaaaatcgtaccgaactgaaagttcctctgaaatgattttgactctgccatccatcacttcataaaaattcatcttgtatccttcagtttgtagctatgtggcacattaagcttcctttcttctccccactgaaacttcgaacagtacaaaacggggaacttggcttgtgatgactaaaattggggatatgagactgggggcgggcgcggtggctcatgcctgtaatcccagcactttgggaggccaaggctggcagatcacctgaggtcaggagagactagcctggccaacatggtgaaaccccgtctctactaaaaatacaaaaattagctgggtgtggtgacacgtgcttgtaatcccagctactcgggaggctgaggtaggagaatcgcttgaacccaggagatgaaggctgcagtgagccaagaccctaccactgcactctagcc

SEQ ID NO: 29384 - DNA, 1026 bp, Homo sapiens
aatgctgggattacaggcgtgtgccaccacacccagcctggaatattttttaagtttaaaaaaatttatatcactatggcaatacaaatgtatatacatatttgtttatacttttacaaaaaaagggaacagtaggccgggcgcggtggctcacgcttgtaatcccagcactttgggaagccgaggcgggtggatcacgaggtcaggagatcgagaccatcctggctaacacggtgaaaccccgtctctactaaaaatacaaaaaaagattagccaggcttggtgggcacctgtagtcccagctactcgggaggctgaggcaggagaatggcgtgaacccgggaggcggagcttgcagtgagctgagattgcactccagcctgggagacagagcgagactctgtctcaaaaaaaaaaaggaacagtaaatcaaaagttaataaaaatggccaaagagggagagatcaggatggaactgacagatatgtaccatatttaataattttgactttggaactctgtcagtgtttacataattaaaaagcaaacttatatttaaaaacactacacattgaacattcatagtttgtctttagatccatttgccgggttagaattgggaaacccaaagtgaagacttctgcctgtgtggtaagaccacccccgactcacccaggtcaaaaatgtccatccaagggacacttcaccagatcagtggccacagactccaggaggctgcccagaaaggccagctcacctttttaaacctagggcatggaattaaaactggagtttcaaaacttatggctctaggaacaaaaaaaatttttttaattaaaaagaaaaactggagttactactatgagtggcggaaaatgaccaagaaggaagaggaggataggtccttaggatggtgaccacagttgtgtatattagtccattttcacactgctataaagaacttcctggccaggtgcggtggctcataactgtaattccagcactttgggaggttgaggtgggtgg

SEQ ID NO: 29385 - DNA, 1015 bp, Homo sapiens
ttgctccccctaccccaggccctgtgattgtcccttgatacccatgttcacccactgcctcaccctgaggcccaagcatgctctgtggagcgagccggttctggggctgttgccagcctggctaggcagcctggccaggcttccctctcatcggtggggtcccctcaaatccctgaatcctgccctcttcagccggaagtggtgaggaaaattaacgagatgacatatgcattagtctgccagggctgcatagcgaagcaccacagactgggcagcttaaacgacagaaatgtctattctcattctcagaattgtggaggccaaaaaacaaaacaaacaaacaaacaaaaaacatgaattctggaggccagaagtccaaggtcattgttcgaacagggttgtttccttctgaggcctgtctccctggctttttttttttttttaagagacagggtctcgctctgtcactcaggctagagtgcagtggcgtgatctcagctcactgcagcctcaacctctcgggctcaagctatcctcccacctcagcaccttccccgctacccctcccaagtaactgggatgacaggcgtgtgcgaccacgcccagctaatttttgtattttttgtagagatggagtttcgctatgttgtcccaggctggtctcaaactcctgagctcaggcaatctgcccacctccgcctccaaaagtgctgggattataggcctgagccactgtgcccatctccctggcttattgatagccatcttctccctgagtccttacagggtcatccttttgtgtgtgtctgtgtcctaatctccccttataagaacacctgtcatactagattaggacccaccctattgacctcattttaccttaatcatctctataaagaccctatctccaaatacagtaccattctgaggtcctgtaacatatgaatttgaagggacacagttcagcccgtaacagtatccatggacataaagtgctcagcacaggtcatggcac

SEQ ID NO: 29386 - DNA, 1046 bp, Homo sapiens
aaagttgctaggattctctctctgttgctgcaccttatccatggaaaccttctcgtttcagggatgatgcagtgtgtgattgcagtcgcggacaaagtattcgatgccttcctgaacatgatggcggataaagtaagcctctccagcatgaatgcgtgtctgtctgctggaggcatctggggcactgcggtacctgtttcttttgcatctctaggccaagaccaaggagaacgaggaggagctggagcggcacgctcagttcctgttggtgaacttcaaccacatccacaagaggataaggagggtggcagacaagtatctatctggtctggtggataagtaagctcattttcctgctaatgttttgtgtgtatgtatataaacttctgtgatttcaaatgctgggaaaaatcatccttatattattaatctaggaaaaaatggagtcagaatgaaaactcctaagggtgatgcagcctccctccaatgtctgtgagtttcctgcagagtctgaattttggtgcagaaacttctgttcattctgagctatcgatgttacttacagcacatttgctgggtgccacatccctgtgtctctcagtcccacccactctggcatgacctggtgcaccatcttctagcccagggcccagccagaggtcccctggtaggatcagtatctttgggcttctcaggaacaaaagcccacacagacccttctgtgctgtatactctttgttctgggagccaaaacagaccctgttgggacatgtccccacactgatgagaactctcacaggtgggctggaccagcttctccaaggtgagaaggccagaggcagcaaaacacccacatggaggctgcctgcagctccccagaggtatccagtggttctggagcctgttgcagatactgtgtgcctggtccaggcagcagcgccaccacaggtggtcaggagccagccaggggtcacgagaacgagtccagcacacacgtggcgtgtgtctgagctgggcttcctgagcagtgggccactggtgggtca

SEQ ID NO: 29387 - DNA, 1014 bp, Homo sapiens
tctcggctcactgcaatctctgccttccaggttcaagtgattctcctgcctcagcctcccaagtagctgggagtacaggcacccaccgccaggcccagctaatttttgtatttttagtagagccaggttttcaccatgttggtctgttggtcaggctgatctcgaactcctgacctcaagtgatctgcctgcctcggcctcccaaagtgctgggattacaggcgtgagccaccgcgcccagcccatccttttacttcatgtgttggtggcttcctctgtaaaatggggatgctaataacagtgatgacctcacaaggctgtgttaaagcacagagttagggctcagtaagtgtcagatgctactgtcacttcagcttggccttccctgtccccgttccagagtcaatcttgtgtctagttttcctggataaattatagctacagtacagttcttggcattcaatctacccacatacaaaaatagtatgttgtgggtttgctgtgagaactgtaaaggtgcctcttacctttgaagtagatgcagttgagaatcatcatctgggtagcagggtctatattctccagagcatcttttatgaggcccttggtgagcttcatgatgtggttgttggtttttgatatgaaggcagggtctgagaagtcagctatctgggcctcagcaaagtaatactctcttactttagttttgaagtcaagcaggattggaaactgcttctggatataaaggtcattgactgaccgcagtgtgtacccaaaattcctcctgaagaggcgatgagtcagcttacggaagagattatgaatggtcgtgatttcatacttgctgctggcattaacaaagtctttaaaatgcaaaatcgagtgcacttgttcatgggtctctcccttcagacctaaggaaatcatacccatcgcagtagaaatgccaacgggtgctatgaagatgttatcgaaagtgttgacctggtctttcagcactcggtagaggttgaa

SEQ ID NO: 29388 - DNA, 1058 bp, Homo sapiens
agtagaaaattaaaaaaaaaaaacacaaggaaaatggacaagggacatgaacagaaaaaagcatcacccagttgagatgcccgcattgtgagcttctctccatccccaggatcttattctggggctcatggatgggttttggggctctaaaccattctcactgaagacagctttgagtgtgtacacacgtgtacctcctggagaggcccagcccccagaagaggcctgagcaggctggaccctcagctccagaaggcaggtgcgaacccttccttaggctcctgtggtacaggttgataggacagcctctggactctgcagtgtgaaaacaggaatggagtgatgccatgtgaatttacatgcactttacattatccctggagaatctctgagatgattaggatgtggatatgctttgctttgggcttaatctgggctaaaaagctgccaatcacttattttattaaatctaatttattattcttcttattattttttagcacaaagattgtgtggttccttaccttcttcgacttctcaaaggtcttccaaaagtgtattgggtagaagaaagcacagctcggaaaggcagaggtaattgtatataatgttttccctgaatataagagaaaatacacatgttcagtgtctgtaggatcaagtgtttattcatactgacacatcagatgcatcttgtctccctcctggctgggaaacaactgcctgcagcattgtgggctgagcttacatccatgtgttggccacagcccatggatgagttggggagaaggtaggcctgggtaggccagctttccattgcattcttctgagagtgagcaagaacgttgagaccttcaagaaccttttctcatgtctcattggccagaattgggtcatctgcccgtccccaaatcagtcactgttacccttagaatttataggctcactcctggagtgaggtcagttttccagattatattgctgctgctcaaaaagggtgagatggaggttggagacccaacagcaatgttcactgtaaatagtttcatcactttgtt

SEQ ID NO: 29389 - DNA, 1024 bp, Homo sapiens
ttcaagtgatacttctgcctcagcctcccaagtagctgggacgataggtgtgcgccaccacgcctggctaatttttgtatttttagtagagatggggtttcaccatgttggccaggctggtcttgaactcctgacctcaggtgatccacctgtattggcctcccaaagggttgggattacaggtgtgagccactgcacctggcctattttttatttttatttatttaagagatagggtctcactatgttggccaggctagtctcaaactcccaactcaagttatcctcccacctcagcctcctgaatagctggtactgcaggcatatgacactgcactcagcttgctttattttgaatgtggttttctattttgtagagctgtttttgggggggtctcattttctaggtccaaaagcttctttgcatgtgtccagtggatttccatgggatcttccagttagatgaaagacggagagatgcagtgattgcattgggcatttttctgattgaatctgatcttcaggtaagtcttcatgaaattaaaagtttcttcattgtaaaagggggtgtagtgagcgtttaagtttgtatctgcttatatttacctaaagcaatagtagaagaatacatttgaacctaatcaaagtggttagtggagagggtaggacaaggtgggaatgaaacttcctaatgtaaaccttcttagaaaatttgagttttttagaattgtgtgcatatattatgttgtaaaaaaagtgtatttttgtttgtttgttattatgtgccacagagtaagttaaaatgctttgagaagtaattgtgtgccttccagggtaggtttggttttcaagctcaggtaaaatgcttatcagtcagactcaggggtattgtatttctccttccaaaaggacaaaatcattttaggtaattttgatataatatcatctttttcaaaattgcgattatgtatataaacttttagagtatgtatcagtgtatcttgttttttttttttttgagatg

SEQ ID NO: 29390 - DNA, 1048 bp, Homo sapiens
ggagataaaatagctgggcatagtggttcacgcctgtaatcccagcactttgggaggccaaggcaggaggatttcttgaggccagcagtttgagaccagcctgggcaacaaagtgagacctgcctctaccaaaaaaaaaaagaaaaaggaaaaaaaaatctcagcttggttccacaagccctgtagtcccatctacttaggaggctgaggcaggaggatcacttgagtctagaagttcaagactgcagtgagctatgatggcaccactgtactccaatttgagtgacagaggaagagcctgtctcaaaaacaaaacaaggccaggtgcggtgcctcacacttgtaatcccagcactttgggaggccgaggcggatggatcacctgaggtcaggagttcaagaccatcctggccaacatggtgagaccccgtctctactaaaaatacaaaaattagctaggtgtggtggtggacacctgtaatcccagcttcttgagaggctgaggcaggagaatcgctagaacccagaggcggaggttgcagtcagccaagatcatgccattgcactctagcctgggagacaaagtgagattctgtctcagaaacaaaacaaaacaaaatgccaggcacagtggctcactcctataatcccagcactttgggaggccaaggtgggaggattgcttgagtctaggagttcaaagttgcagtgagctaggatcgtaccactgcactccaccctaagccacagagcaagcccctgcctctaaaatataaatactttattagacaagcaaaaacagagggaaattgttgccagtagcactgctttataagaaatgttaaaataagatctttaccagcctgggcaacattgtgaaaccccatctctacaaaaaatacaaaaattgggcatggtggctcacacctgtagtcctagctacttcggggctgaggcgggaggatcacttgagccctggaggcagaggttgtagtgagccgtgattgcaccactgcactccagcctgggtaatagagtgaggccctgt

SEQ ID NO: 29391 - DNA, 1056 bp, Homo sapiens
agaagctacatgtagctcaccagtggttttctctaaggaatcacaaaagtaaactacccaaccacatgccacgtaatatttcagccattcagaggaaactgttttctctttatttgcttatatgttaatatggtttttaaattggtaacttttatatagtatggtaacagtatgttaatacacacatacatacgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatgcgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgt

SEQ ID NO: 29392 - DNA, 1032 bp, Homo sapiens
tgatcatgccactgcactccagcctgggtgacagagcaagactccatctcaaaacaaaaccaaacaaaaacacaatctaaaagtagagacggggtttcaccatgttagccaggatggtctcgatctcctgacctcctgatctgcccgcctcggcctcccaaagtgctaggattacaggcgtaagccactgagcccggcctaatttttttttatttttagtagagacggggtttcatcatgttggtcaagctggtcacgaactcctgacctcagttgatccacctgccttggcctcccaaagtgctgggattacaggtgtgagccactgcacccggcctctagttgttaaagagtgactacatggtgttcccttgtagggatgtgacccataagtgtccttcagccagactcacattggacattaaagtttacatcagttacctattgctgcattaaaaaaacactccaaaactcaggcttgaaataacagccatgcatttgttcatgagtccattgggctggcacagctgggtagttctgctgagcccacctgggttcagccatgcactgcagtcatctgctggctcccttcaccatccctcaattgtggtggtttaacgtcttaacagttggtccttcctacagttgcctctttatcctaaagtagactagactcagtggcttctcatgatggcagaaatattccaaaagagcaagagcctatgctgcaaggtctcttggaaccaaatctcagaacatcacttcaacagttctaccatgtttttttgttgttgttttgagacaaggtcttactctgccactcaggctggagtgcggtggcacagtcttggctcactgcaacctccgccacctgggctcaagcaatcctccgcctcagtctcttgaatagctgagaccacaagtatgtgccgccatgcgtggctaatttttttttttttttttgagacagcgtcttgctctgtctcccaggctggagtgcagtggcacgatgttggctcactgcaacctctg

SEQ ID NO: 29393 - DNA, 1047 bp, Homo sapiens
tcacccaggctggagtgcagtggcacgatcttggctcactgcaacctctgcctcctgggttcaagcaattctcctgcctcagcctcccacgtagctgggattacgggcacccactaccatgcccggctaatttttttgtatttttagtagagatggggtttcaccatgttggccaggctagtctcaaactcctggcctcaagtgatccgcccgcctcggcctcccaaagtgctgggattacaggcattagccactgtgcccagcccaagttaatcaactatgaagagaaaaataaaatcacataatcttggttgttcagcctctcataagaaagccaaattgttttttgcttttccatgttgtttacttgtatttctgaattgtagagtcaaaggagaagttcagagtcccatcagcaatgcacctgtcatacaggaagatctcatcatgtcctgtaacaccagataccattttcagtcttttctctctttctcctgcagggctacaccaagtccattgatatttggtctgtaggctgcattctggcagaaatgctttctaacaggcccatctttccagggaagcattatcttgaccagctgaaccacattttgggtaaggttcccgagcccttcaggagctagatttactcaagtttgtacagcttacatcaaagtcacttcattaaattaagaagagttctaatatactctttaacctgtggtaggtgtgaatttttaaccttctctgatttaaaatgttaaggacttttgtgtaaaaacataagaaaggtaaacatcaggagtggtgataagcaacggctcatatcaattatcagggttcattccgactcagagttgatggtgtgtagtcatttaccttggtcctgataactaatagctaatttttttatctgataggtattcttggatccccatcacaagaagacctgaattgtataataaatttaaaagctaggaactatttgctttctcttccacacaaaaataaggtgccatggaacaggctgttcccaaatgctgactc

SEQ ID NO: 29394 - DNA, 1105 bp, Homo sapiens
gccttccctgagacagagtctcactctgtcacccaggctggagtgcaatggcatgatcttggctcactgcagccaccgccttctgggttcaagtgatgctcctgcctcagcctcccaagtagctgggattacaggcacgcacaaccatgcctaatttttgtgtttttagtagatacagggtttcaccatgttggccaggctggtcttgaactcctgacctcaggtggtccacctgcctcagcctcccaaagtgctgggattacaggcatgagccaccacatccagactcttcatcttctgttattgaagtaaagtacagatttctcagctttttagtaacatcaccttttgttcttcccctggacaggtgtaaactccagccatattgaactatccagcacctggtacccagccttccgtgcttcagcttctgtagctccttcttccttaagtgctttttcgtgtgctgcctattaaaatcctacctgcttttcaaggcaccattaaataccaccttcttagagagaggtccacagatactaacatagagcagagcctgacagataataaacactcaataaattgtaggtattattaagtgagaattgttcataacttcttttcaataccatcattacctggttcccaataaatgaactgtaaatattttgagtaatatacatctataaactaagacaaagcagtattatcagtaagtgtaagcaagtttaaagtgaatgcgtaaatgattaatgtgtagaatttatttttaatctcagtttaaatgtttgtcagttttaatcagagcatagtgagaaaatgatttcatgggcagacatggacatttcttattcttcatacttaatcacaaaccccaccaatctataataagattgatttcgagtactgtcagtctttttttgtgaaacagaatcctcaagctcctaagaattctgttttttggccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcg

SEQ ID NO: 29395 - DNA, 1043 bp, Homo sapiens
tcccaaagtgggattacagcctggctgtcaatatgcttttaagtgtgctcattgctactgggtgtcactgcttctaagtcttctcagcagacagaactaggaaaataggcttatgtatactcagctacatattacacatgtatctatgtttatttctgtgtatgtctgtgtatatgttagaaattatgagttcatactgatatctcattctaatccaacactgtgtggtttattttagccttccctcttatttgtaattattttgccaacctggctgtcattatccttcatttttttaaacttactttttcagtcagtaccactgtctacatgaattagtgtcagaattgctaactcacatctttgtgagaaacaaatttacttactaggtagcagcatttgtgttacagttctttatgcctttagctttacaatatccagtcaaaataggttttcaaagtttcttcctcatgcccttcagtgtggttatgttattcctttgtaacgcagttagattcacttgttactgtttgtattctgggttctttaatttttttggtatgcgctacattactctggttttgagtcatctatacacaaagatatactcagagaaatatcactccttccttatccctaccatccattcccatttcgttttatccctttcccacctatcccctgtaggtagctgatctctttagtttctggtttatccttcctgtatttcttttgtacaaataagcagatatatgtatatgttcttattgcccatttcttatatgaaggatagcatagtctaaatcttgtactttggttttttcacttaacaatatatcttggaattcattctgtgtctgttcttagacatcttagaatgattttcattcatttttactgctgcatagtactccatgtggatataacatagtgtcttcagtctcctccaatgtgtgggcatttagattgtttccagtattttgcaattacaaatagtgctactgtggataatcttgtacatatgttttttcatatcattggag

SEQ ID NO: 29396 - DNA, 1032 bp, Homo sapiens
aagaattgggaagtcactgagaaccaaggcagtgcctctgtcattctctgtggagcagcaggccttgtttctgcagtccagatctgtctactacttggctcctctctgcagaatgaagtctgggtgcatgtggcccatcccagcattcccagttatgcaaccagatactcttctgccagccagcctggccccttggagtctctgtgctccagctccaggctgtctgagaagaggagctagttggcccagctctaccttagaatggattcttgtctgggctgggtagtacctcatcagctgtggccaggagcaatactctcaacagcacagacaaaaggggacagatccctattgggtaaaggtgatgtgggctggggtaagtaccctgagaggtgtctgtcacagaaaactgcctgagagaactttgtcaaagttctgggctccactctccaggggttttgttcagtcaataggtataaaatagaaactaagtgtccacttgtttaaaaagctccctggatgagtctgatgcctcttcagatttagaaatcactttactctaatacgtgtaaataaattaatatgtatttgtgtttgcatgaggaaataatggaaagataagcaactaataaaaatgggtaatgggtggagattgatgaggctgttgaggatgagggagcaggttctttcacacacacacacacacacacacacacacacacattttaaccaacttaaaaatttaaagaaacacttcagcttaacaattagaaatcagattcaaaacaatgattttaaaattgaagatactgaggtccagaaggtgcactgtatctgggaccaggtttctcatctgtgaagtaattccagtttttggtatcagtcacttaaatgtaatttattttttctcatcagcataatcccatagaagttcatactggtaggcaggagaagaagggaatagatcccaaagggaattggaagaatttgggttctattgctttgtctttgttctgtagagaaggtacttcc

SEQ ID NO: 29397 - DNA, 1058 bp, Homo sapiens
tgcaaatttttctgtggagatttttgtttcattaaattataggagttctttgtagattttgatgagtctttttttagattcatgtgctgcagatattttctcctttccaagagttacctctttttttttttttttttttgatacagtcgcaatttgtcgcccaggctggagtgcaatggtgcaatctctgcttcctaggttcaagtgattctcctgcctcagcctcccaagtagctgggattacaggcacgccccaccacaccctaggctcactgcaacctctgcttcctaggttcaagtgattctcctgcctcagcctcccaagtagctgggattacaggcacgccccaccacgcccagctaatttttgtatttttagagacgggatttcaccatgttggctaggctggtctcgaactcctgacctcagcctcggcctcccaaagtgctgggattacaggcgtgagccactgcgcccggccgaattacagctattttaaagatcatcttcagtaactagtaactgggtcactgtggatatgtggatatgttgtctcttttttctcgtttctgtttccttgtatgcttggtaacgttcaagtgaatgctggatactgtgtatgaaaattgttgatgctctaggtgacatttttctccagagagagctctccctaatcactgataggcagatacagtggtgacagataaccataattcagtgagagattgagctgattcgagggttggttgcagttttttttttttttttgtattacacaccttttaatttgaattaattaggcatgatcattattgaaaattggtaaagtgtagattgataacaaccaaaacaggggaaaacattcatttaaaactttcccaaataaatgctccatgtataggcctctattaaaataataacaataaacattttttgaaccactttatatattttaagatttgtttagggctttttcatttgcacgtgaaaatattcctttttttttttttttttttttagtatttattgatcattcttgggtgtttctcggagaggg

SEQ ID NO: 29398 - DNA, 1020 bp, Homo sapiens
ctttttgtttgtttgttttttgagatggagtcttgctctgtctctcaggctggagtgcagtggtgccatctcagctcactgcaacctccacctcctggtttcaagcaattctcctgcctcagcctcccaagtagctgggactacaagcgcgtattgccacccccaggtaattttttgtattttagtagagacagggtttcaccctgttgcccatgctggtcgtgaactcctgagctcaggcaatccacccgccttggcctcccaaagtgctgggattacaggcatgagccaccgcacccagctgtcagatgtctttactgcctccgtgaagatgatatgatttcatcacatttaacattgttaatgtgaagatcatgtcaatagatttccttatatggaatctctcatacctggaataaactgtgcttgtttatttgtattcctttttataatgtgccattggattctgtttgctaatattcagagattttgtgttgatattcgtaagtagtattcaactgtagtatcttttgtgcagtctttgtcaggttggggttaccattacacttgcttcataaaatgagtgtggaagttttctttccttttctgtgttctgaaatagcattaagactactttgtctttttttttttttttttgacacagagtcttgctctgtcacccaggctggaatgcagtggcatgatctcggctgactgcaacctcttcctcccaggttcaagtgattctcctgcctcagcctcccaagaagttgggactacaggtgcacaccaccacgtgtaactaatttttatatttttagtagagatggggtttcactatgttggccagactggtctcaaactcctgacctcaggtgatctacccacctcggcctcccaaagtgctgggattacaggcgccagccaccagtctaccttatcttaaaatggtataattttcctttgaaactatttgcctggtatttttttggttttcttagactggtttctgcttggttt

SEQ ID NO: 29399 - DNA, 1029 bp, Homo sapiens
aacgtacttgagtgaggatgtgttgaaatttgtgggaagctgtgaaaggcagcttttagcctaccaaaagaggactggcctggaaggcaagagacctgagtcttggtccctgcttctgatgacatgtcacatgggcatgtgctcgtcactctgcttctgcaagtttttgtgtttctcatctgtggagttaagggattgggatggtctctagggtctcgtacagctctaatattgtcaccgccctcaggaacattacatgaaattagcatatatgcaatatattaagattcatgtgtggattgtttcccagttactagcgctgtctttaatgtaatttacctcagaaatctctggataatcattattgagatataatgaaatagggaaaaacttgaggttaaaaactagtaaattgatttacttcaacattaaaagcccacaattaaacccttgaggaaaatgactatttttattttttattttttgctctgcaagtaaggttggaacttcgtaatactgtatgacagtagtcgtttacctcacgaattagattattcatgtgtgtttgactgaagagagtttttacctagtgactggaatgaatgttaatgctgctattttggcattggaaaaaaaaggtgtaatgaaaaatgtcaagtttgagagagagagaaatacttaaatagaactgatttaaaagcaattctgaaaaagaaagaacttggcacaatctttctatgaaagcaaagactttactgcacagctaaagaaaatgaagcaaaaacaatacattgccccaattaatgtttgaattcactgaacacaaggtaggctagcaaagtagagagtaatatctttgcctcaccttggccacaaggatttattttgtcagtaaccaagtttagtgtactgctatttagctttttcactacagatgtgaaaatgtttctttttggggtttgtttgaaattttctttcccttttcaatttagcagtgctgaacctatcctcaaataaatttacattttt

SEQ ID NO: 29400 - DNA, 1082 bp, Homo sapiens
ctgtgatgtttggtaagttaggtgtattaaatgtattttcagctaggctgggtgcaggactcatgcctataatcccaggactttgggagaccgaggcatgaggattccttgagcttaggagtttgagaccaatctaggcaacatagtgaggccttttctgtactaaaggtactaaaaattaaaaaaaaaaaaaattagccaggtgtggtggtacgtgcctatagtcccagctacttgggagcctggggctgaggatcgcttgaacctgagtggtcaaggctacagtgagccgtcgtcgtgtcaccgcattcccgcctggcaacagagcaagaaactttcccaaaaaaaacaagcatttcaccttatgaggttttccatttatgaagggtttattgggatgtaagtccatagtaagtcaaggagcatctttatatagttagaatagggacagtcaagtgtttcatgcataatccaaatcttcaggaggcaacatcaaggtaacccgagtttagggatattctgcaaaataactggcctgtaaacctcaaaattaagtcaagatcatggaaccaagaaaacactgaggaattgttccacactaaagaagtgtgcagaaacatggcaactccatgtggttcatgattctgaatcggcatgattggcaaaactagaatgtctgaaaattagattgtagtcgtgtatctgtgttaatgattttatttttatcttcttttttttttaactcttcttttttttggtattttcttttttgttttggtttgtccttccttttttttgttgttttttgttttttgttacaaacccttgtgtcgatagctgactgctctgctgtatacgaaaccctgacccagaaacaggttgtctgtgaatggtttagcacaggtcccccgtgaatgtgcattgtgtgacgggcaaaagtgtggccgcctttctactgtgccaagttttccagcatgagaggctttccatatctggtcctcagatatgtggtgtgaatgaaggggggaccagctatccgaggccaaccgaggctccacagttggctgccatgtcattttgcc

SEQ ID NO: 29401 - DNA, 1029 bp, Homo sapiens
tgagattcttaattttgcttgctcattgtttacttaacttttttaatcaagaagtctcctctacacttttggagctcaaagatgcaaggacagcagcttacatgagtaacagaagaatctagtgtttctgagcagagtttagagtaaaaggataagtcaaaacaaaattaatttttatattaatagcatccctaatgatgtattcctggtagttagctataaccattacaccattcccataatctgatttgtgtaaattcaagttgacttttccccaaaactgtatgtaatttattcctcaccttgctcacaatttatatacctattaattgaaaaacacctcattccccaacaaacatctagagctccttgcctccggcctactccacccaccctcttgcctaatcctgagatgctattttgctcccctttagatttgctttttttctttcacttcttgaggctcccacactgaaaggtgcctaggagctcatccagtagctgcgctgtctctgctccctctaggaaaggccacctgcctgagctttgaaatggcccacaccgtaccagaaggaagaagagagattccaggaggattcagacgttacccaggctttctggaaactgagcagaaccacaggaggagaaagctataggcagctgaacaaaatttatgtgtttctatttcccctgctataacatgaaaggactgggctctgtctgtggttttcaaatctcctcctctcttaggggcttcaggcctcaccccaaatagggaaacttcacatacagcattctctcccctaatccctgttttttctattctttgctcttctcttatctacctccttcccctcccgtttcccttcttcctctgcccttagtcttttttctttttcttaatttccttttagtcattatcatcttcagttcacataggtagtaactattagggttagcagggcaagatcccatttggaaaaaggatttgattgctttgaaaatgatgttgggcaacccacaggatag

SEQ ID NO: 29402 - DNA, 1091 bp, Homo sapiens
gttcctaagtagtgctccaccaaagatcagagttgagaaaatagattatttcagtaacaagaaatatctgttgtctgcttttgcttgtatcactttttagcctttaaaacctttcatgtagagttatttactcagaaaatgtttattgaactcttcatccaaataatgggatggaattggggaataatacagagaagataccagtgttacccaggagtttgtgaagtgctgagaggaagagaagagctgagtgacttggggctgtctttctttggcttcccagacttctgagctaggtgttgatgtgtgagtaggagtttgccttgagaaatgccttctaggcaaagcgaagtgtgcatgtaaaggcacagaccgtgaacacagtgcatcaggtcaggaaaaccacaaattacttgggaaggctggagtgtagggtgccttagtaagaaggtgggagttgagacagctgggggtaggcagggccaaatcctgaagggcattatttggtaaggactttggacttgatcttgtgggtgacggagtcattaaaggatggccctgtttctgtctgccagttccactcccactttatctcttatgctttctgcccattttgcctacttacttactttttttttgagacagagttttgcttggaggctcactgcaaccttgcctcctgggttcaagcaattctgcctcagcctcctgagtggctgggattacaggtgtgtgctaccatgcctggctaatttttgtatttttagtagagacaggatttcgccatgttgtccaggctggtctcaaactcctgacctcaggtgatccacctgcctcggcctcccaaagtgctgggattacaggcgtgagccattgcacctggccgcattgtgcctactttatctcgtggtactcagtgggggtgattttacctccctgctacagaggcatttggaaatgtataggggggcggctttttgttgtgttgtcacgttgattagggggtgttattggccgtcagtaggcatgtcaagggcagacatgctaaatggtctggattgcacggtacactccctccactggagaatcat

SEQ ID NO: 29403 - DNA, 1049 bp, Homo sapiens
tggcatgacctcggctcactgcaacctctgcctcctaggttcaagcgattctcctgcctcagcctcctgagtagctgggactacaggcgcgtgccaccatgctcagctaattttttttttgtatttttgtagagacagcgttttgccatgttggccaagatggtctcaaactcctgacctcaggtggtccccctgacttcagcctcccaaagtgctgtgattacaggctttagtcaccgtgcccggcctttttttgaaagaggcagtcatacatggtcaattttgaaattttttgggaagacaaatcaacactagtgggaatgaaggaagaagaaccggagtggaggaataaattaggaaagcctaaccacctagaggtgcagtaataaagtggcagcggaaggtagcagatggaggtgaggagttttgtattgacagaaatagtaacagggacccttgtgggaagagtggtaaaaagacttttaatcatggcaagtctgagtggaatcaaaggattatgagaccttaaagggtaagagaccaagagaggtgggatttggatttggagggatttctgagatagaacaaggcttgctggttgattggctatgggcggttgttcattctgaggcctctaggttgggagcctgggagatggtggtgccattatccaagtaaaggaatactgttagagcagatttgtcagggggaaatagttctggtttgaacttaagtttgtaatgcctgtaggccattcaggctatatccagaaaccatcttaaaatttgtaagaggggagcaggagctggagatgaaaatttgtgtaaatggtagttaaaatcttgagtggatgagcacagattcttatctgggtcattggttaggtgaaattgcaatcatggccaggcgcggtggctcacgcctataatcccagcactttgggaggcccaggtgggcggatcacgaggttaggagatcgagaccatcctggctaacatggtgaaaccctatctctactaaaaatacaaaaaaaaaaagtagccggccgt

SEQ ID NO: 29404 - DNA, 1027 bp, Homo sapiens
tgctgaatacaactgtgaaaattaatgtgaactcacaggcttaggagccaagacagaatttaaattaggtcgagcctgaaagaaataaggccctaaaaagtaatggagagaaagtattgccagtagcatcatttctccaccacacatcgcattgctgttgcactcactgggaagtgtgccagtgaacatgtctcattatgagaggctcagaatttcccatcacatcctttggcccttttaacaagattagcttatctaaaatgtggactgaaaaaagtattttacgtttaggacatgtcaattgaaaagatacccccatctgataagatttctcctgtctgataaggtttttactagtctgaagttgtttagatgtgggaactacttctgtcactgctgtaggcttgtttgaccttctgactctccatttgaaatgctaagtcccctttttgtgattgtcgtttcctaagtgaaatacaaatgtaattggaatttgaatccaagatccagattatagccttttatcaggttgatgaaataccctgctgttaaccttctccattgcacattattagcatttaataaatattggctaacagtgctggatttatggagggctcgttgaaatattcactaatatttgaatggtgatcttttaaaaaatgcttccaaaaggatttatggatttctagccattttttagatttacccccttctgtttccttatcagttcattaggaattgtgactattttgtttagagtcctttcctaatgattatgtagaggatgtaaagatgaagagtgggatttgagttgggcctttaagagtgggtgtgattttgatatgcagataataggaacaagtgacagcttgagctgtggaatctaatcttggaaatgtacttaggtggcaaactgtagaggactccaaaggcaaaactaagtttgactgtatatttgttcagtggaggaagcatcttatttatttatttatttgtttatttttttttttgaggtggagtctca

SEQ ID NO: 29405 - DNA, 1031 bp, Homo sapiens
ggcgcgtcgtcgggcctcaagcacagcccggggtccctcgctggctctgttcggaccctgctcggtcgctcgcctgggccccagccatctctcacttcagcccatgagttctgccccacgtctgtctccctgggtgtcttaagagacgcgacccgcaccgacgcccccgcgaatgcaccgcgaatgcacgtgaccgcgcctagtggcgccccctcagtcaacgccgtcgcagtgcccctcccgaagcccgccgcttccgccggcccgcgcggccccgcccccagccgcgaggaaccaatccgcatgcacacttcttgtccccgccccggcaccctcctcggcgcgcgcccctccctccgcccgcccgccggcccgcccgtcagtctggcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtggtgagtgtccgcgaccggccacgcccggcccccccaccgcccggggccgcagcggacgcagcctcggcctcgcccgcgcctcggcctcaggcgccgcggcgacctcgaacccggacttcaccgcggtccgcgcgccagggctcgggcgcggccccgggccggttgaggtttaggtgttgttgctcgcggttcccgggccttcggtcgctcgggaaggggctcagggagtggcgcggggggcgtaggccggtactagtggacccttggccccgggcgcagcgcggcctttaaagtctggaccctcgggaaggcaacggaagggtccc

SEQ ID NO: 29406 - DNA, 1073 bp, Homo sapiens
agctttgctggggccctacctgcatgcccagccttacccctcattctcacagcacagatgaggttgagaccatgcagtcaatgcattgcttaaggtctcttatttacaaaaaaaaaccttaaacatagtcgctgtcattcagacattcagagaatggttggccacaaacaatgaccaagtattgcttggcttaacttgaaggcctgctgtctccttctgggggtcagggacgcagctccaccctcaccactagcccaccctgcccgtgggcataaccttgacgaagagagagaatgattggcatctgcttttctcttttctttgctaataattctgttcctggctgccgagagtgaagtttcaccatgtggaggtttggctcctatcacctggtggtctgattcataccctagcctgaggctccactggaagatctcgcagcctcagtgtatgggaaaccctttccccaggcttgtcccagcactgccgctccccacccctgagccaggaccccagaggatggccatgccccgtgcctggcagaggtctggtgccagcactgggagctgctccgcccttgccttggggccgagggagccctcgtccacccctgcacagcagctgggcacagaggagcgctcttccatcttgaccaggactgcaccaagaagcaccaggtgtcttcagcctccaacctccggggcgaccttctcttccagccacagtcccatgagggcccctagccagggacactggtctgtaaattgtaatcctttctccagcccagctctccacttgttccttgtgtgagctgagcaggcagtgcacctctgagtgtcccttttgtaaggcccaggggttgcactgagtctgcagaggccgcgacctcctagaacgctgtgggtgcaggtgagccggcgtgtcctggggagatgctgccagcacacaggggccctcctgctgccagcaggttggggtggttaagtcttattagtgtctattcttaaaattaagtgggctggagaagaatggagctccacatgccagcaccgtatatggaatacaaaagctgg

SEQ ID NO: 29407 - DNA, 1062 bp, Homo sapiens
ctgtctccattaaaaacacaaaaaaattagctgggcatggtggcacgcccctgtagtcacagctactcaggaggctgaggcaggagaatcacttgaacccaggaggcagaggttgtagtgagccaagatcgtgccacttcactccagccaggtgacagagcgagactctgtctcaaaaaaaaaaaaaaaaaagaactgggcgggcacaggctgccgtcagggcctcgctcaggcttccctgctgtgtgaccactcacgtcacatgctccatcttggcccagcagctttcagggcagagacggtgtccccgagctagagacagggaagcagaaggatctgctgtctgtgtcgggctcgcaagcctcgtgagtgcctccctgacccagaatgctgcccaggggcgcaggcaccgctaggcggcctcaggtggtccgttcatttcaccattcctgcaactaaaggacttgtgggttgtgtataatttctcactgtttttgatgagcctcgtttgggtgcatctctgagcctcctggctttgttccagtgctgcggctttgaatgctgctgtcttagaagcagctgtgcctctgctcaggtagcagcagggggcttcacgccccatccccccggccctgcccccaactctggctgtgtttctgcaggatgagaaggcgcgcattgaagcattgggtggctttgtgtctcacatggactgctggagagtcaacgggaccctggccgtctccagagccatcggtgagagccaaagaggccgacccaagtgggagaaggtctctcggaagcccaggcctcgagtgtggcccgcggctcaccaggggttcagggaggcagtgtgatgggccgagggggatttgtcatgcactggggtgataccctcgtagtgtgaagggaacagggcagattcagagactgcagcaccagtgtctgagtgtaagttacactgtatgttattatctcacctaaaacagctcctacaaatctcatagaaacctgtggctcaccaccctatgggctggaagtagagcttccaatattccggaa

SEQ ID NO: 29408 - DNA, 1033 bp, Homo sapiens
agggagaagtgcacagtgtgatagggcaggaagagaaggaaacggaggagaggaggggactttcccataagcaggcagaagaaaaggcagctgtgttgtgatggacatggatgcagtggtgtccgatgtggggtcagccctagaggagagacagagagagagacagaaaagtgagagagtcctgacccttacgattaacatgggatctgcctgcaaatgctgtttagggccattgcctcttcctgtactgctatttttgagagtgatgctcctgagccccatgacccagtcaaatttgatgtcccctcgagccagattcagtgctgggagtccagtgtgatctgcctggatcttgctgcattgagaacaggccagatcttgaccccaatacaggggctggatatgaacaggcaatagctgggtttctgagtcagaaagacttggttgattgctaattgcttaggcgagtaatttaattttgttgagtcagattcctcagctacaaaatgcagatgacagtacttactcctccaggttgtggggaaaatggagattctgagcacgatgtccatttcacagaaaggtaccaatttggtggcttattttcctttctaccttcagaagtggctatccctgccacccaaacagacccttgactctcaagtgtacggggtcccatttacacagggggagagcttacagcctacgttgagtctatacttaccacttagtgagcatggtatccgctcaggggcctctgtgggcatccatctcctctgcagcatctttcctccccaccgctgggcctgcacatgaccccctccttgggttagacctctgatcagtgatgaccttggtatgctggtgatggtcagtcttggcaccaaatgagacagtttatgtcatcagctattcaataaaacactaatctagttgtcaccgtgaaagtattttgtgacattgttatgtacgtgttgttacaaatgtgcatgatgcatttactacagcatagaattttgcctgggtgccagcc

SEQ ID NO: 29409 - DNA, 1038 bp, Homo sapiens
agctcctgaaggaagcgctaaacatggaaaggaacaaccagtaccagccactgcaaaatcatgccaaaatgtaaagaccatcaagactaggaagaaactgcatcaactaacaagcaaaataaccagctaacatcataatgacaggatcaaattcacacataacaatattaactttaaatgtaaatggactaaatgctccaattaaaagacacagactggaaaattggataaagagtcaagacccatcagtgtgctatattcaggaaacccatctcacatgcagagacacacataggctcaaaataaaaggatggaggaacatctaccaagcaaatggaaaacaaaaaaaggcaggggttgcaatcctagtctatgataaaacagactttaaaccaacaaagatcaaaagagacaaagaaggccattacataatggtaaagggatcaattcaacaagaagagctaactatcctaaatatatatgcacccactacaggagcaccaagattcataaagcaagtcctgagtgacctacaaagagactttagactcccacacattaataatggcagactttaacaccccactgtcaacattaggcagatcaacgagacagaaagtcaacaaggatacccaggaattgaactcagctctgcaccaagcggacctagtagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccattcaactacatggaaactgaacaacctactcctgaatgactactgggtacataatgaaatgaaggcagaaataaagatgttctttgaaaccaacgagaacaaagacacaacataccagaatctctgggacgcattcaaagcagtgtgtagagggaaatttata

SEQ ID NO: 29410 - DNA, 1079 bp, Homo sapiens
atcaattgaacctgggaggcagagtttgcagtgagccaagactgtgcacaagactgtgccactgcactccagcctgggcaacaagagcaagactccgtctcaattaaaaaaaaaaaaaatctagcctgagagtctaggaggggagtaactattaaaccaaggtcgttccttatcaaaagacatgacagttgccacagactaaactgagagaaaaatgaagaatttacagatccttactactatttccactcttgctacctctctgaccttttatccccttcaagtgtatgtccaaatttaccttctccatgagacttactctgactacactacgtaaaattacaattctcttatacctcctcaacttctaagcctgctctattatttttttcctaattctataacgtcatcttccagttcaccagagaatttgcatttttattatacttactatctttcttcctccactggactgtttgttagttccttctgttgaaatagtttgtttttgttgttcatttctgtctgttaatgtttaccgatttctctcaagtgcctaaagcagtgcctggcacacaataagcactcaatattcattaatggaaaaaggttatctagaagtagtcagaaatcaattcaaaaaggtagactgagggaaaaagtggaaaatgttcaaatgtgggaaacagccaattttcttcaagtctgggagctcctaaggtgtactgttagaggaaatgtgacagccccacaatcctggggttcagaagaaaaatatatatggccagatctcatcataaggaccaatagtttggggaagcctttcctcagaagagtatgtgtgtggttaaaaactcgtgtgtggtaataacaatggtttactagaggctgggcacggtggctcacgcctgtaatcccagcactttgggaggccgacgcaggcagatcacaaggtcaggagtttgagaccagcctggccaacatggtgaaaccccatctctactaaaaatacaaaaattagccaggcgtggtggcacgcacctgtaatcccagctcctcaggcaggaaaactgcttgaa

SEQ ID NO: 29411 - DNA, 1145 bp, Homo sapiens
gaggcagaggttgcagtgagccaagattgcaccactgcaccactgcacttcagcctacgtgacagagcgagactctatatcaaaacaaaacaaaacaaaataaaaacagaagaaagaaggcacaaatcacccatatcgagtgtaaacagggctgggggcggggggttgttttatagatgtggaatacctaaaatgggtaatagagtcaattttaacaacattatgccagtactttgagatgaaatgagagtattcttagaaaaatctaatcaaacacatatatttgactcaagaagaagtagaaaatctcagttcttctaagggtattgaatacatagtgacaaatattcccacaaacaaaactgggttaggcagggtgcggtggctcatgcctgtaattccagcactttgggaggctgaggtgggtggattacttgaggtcaggggtttgtgaccagcctggccaatacaatgaaacctcttctctactaaaaatacaaaaattggctgagtgtggttgcacgagcctgtaatcccagctactccagaggctgaggcaggagaatcacttgagcccaggaggtggaggttgcagtgagctgagatggcgctactgcactccagcctgggccaaagagcgagactctgtctcaaaacaaacaaaaacaaccccaaaactggctcagagagattcactggtaggaaattccaaccttacacaagatcctccagagaataaaacaattctgaagaataaacgatgccttaatcacagtagtgccacatatagtgctggctagtacataatggacaagtctggtccatgcattccaaggatgcaaaatcggtttgacattagaagaatgacaaattgcaatattaaaggagaaaaaaatcacaataaaagatgcagaaaaaacattgaataaaatctgaagaatgattttcagaaactacttaccatacgagaaatgtaaaataacttccttaatctggtgagagactcctgcaaggaacctacagcaggcatcgtgtttaatagtgaactgtatataaacatcctttgtgacaagacaaggatgccgcattgtactgaataccagcagggagagtaaggtgaaagaaaaaaatgaaaggtgtaggaa

SEQ ID NO: 29412 - DNA, 1094 bp, Homo sapiens
tgcaacaccagcagtccagcagtccctctgtcaggggagggttaaaactagtgggtgccaggctgagaccagggtctcagtgtcctgcagggacttctaggcaaggagtccccatcagcgtcaggctttgtgccagggctgaggtcccagaggaaccagacttaccccaactcaagcacacaaaatgagggtgtcgtgtgaggtgacagccatatgcagtgtgatgcttgcaggacagagactgggacagggaaagcctgaggggtctccacagaggatgagtgacaggtgcaggggacacctggcaggggactcccaggcatagagcctcgagaagctccaggcggcccacagggctggaccaagtgagtcctggggccaaggtggtctgagagcaggctagacaggtgccaggcccagacccagagaactcatccctggaggacagactcatctggggagtcctggaggctgtttgcagggaatcgatgagaccagagttggatgggtgggcaggggtgtgaatccagaactagagacaccccatggagggtgttgtggtgacccaggcagtttgactgatatgaggacagattcaggagaagggggaacaggagagggatgagcaaggacagccctgggcttttttgatgaacagttaacactgggatcatgtcagcacatcctgtattttaaacaaaatgcccaagggaagtggtggtctgcaaagtgtccccagaaggcagcaagggcttggcttcgtctcccccaaggccatccactcatcgtcttgctcataaaggcttactaggggccaggctgggggacacagggagggtgggccaaacgcagggggactgtgcagtcaggaggacagatcatggcccatttttggagcaataaagggggagggggtcccccctctgcagtggggggatgccagtactggtctcacagatcaagcagcactggctggtgctgggcgcccctcaaaggcagcagtgccagtggagaggagaccaagggctgtggcggggagctcctgggggacacggagggagaggctgacagaccacagggtccttgtggcccgc

SEQ ID NO: 29413 - DNA, 1051 bp, Homo sapiens
cttaaagtcttagattaacttttccatttctccgcaggtggctgttaccggtttgatagcagttcttgtgagtctgtagatcatgtgtgtagtattgtgtgttagtcatgctgagtcttcctatccatgaatatgggaagcctttcaacttatttgtatgttttttacttttagaaactttatgttgacagctgattagttagatttaacatgactaatataaatttgtgatttctttttcttttttttttttttttttgagacggagtctcactcttgtcaccatactggggtgcagtgatgtgatctctcctcactgccacctctgccttccaggttgaactgattctcctgccttatcctccctagtagctgggactacagatgcatgccaccacgtccagctaatttttgaagatttagtagagacgtggttttaccatgttggccaggatggtctcgatctcttgacctcgtgatccccccacctcggcctcccaaagtgctgggattacaggcatgagccaccgcgcctggacaaatttgtgatatcttataccaatattttgtatgtctgaatgaataggcatcaaggtaaaaaaattacataagctagttaaccaaaaatcacccccgtactcatggacattttttcatgaatttgttcatttctattgatatacatttcctcatttcagtagatcatgtatatttgaacctggaaacttatcctcatggcagaaagtgttcagagtcacctctctcagcttcactggtacaggtagagcaggctctgtgagcttggcctgtttcaatgaagcctgatctttagggaatctcctcagggagattgacacagagctgctgaagcccttgatcacagggacccaaaagtttgtgttcacacaccatggttccagaagaagacttacaaagaggaaatcatgactatttttaattttagtattttaatatttaattttttaaatgatctctatgaaaaaaaaaattgtgatcagctgggtgcggtggctcacccctgtaatcccag

SEQ ID NO: 29414 - DNA, 1094 bp, Homo sapiens
gacagagtttcactcttgttgcccaagctggagtgcaatggcacaatcttggctcaccacaacctctgccatccaggttcaagcaattctcctgcctcagcctcccgagtagctgggattacaggcatgcgccaccatgcccggctaattttgtatttttagtagagacggggtttcaccatgttgccaaagctggtctcaaactcctgagctcaggcaatctgcccaccttggcctcccaaagtgttaggattacaggtgtgagccacggaggccagcccaatattgcacttcttaaatgcacttgtctattccttaattgtcttcattgttatattctcatagttttaaaagagtaaagatttttttggggctgggcatggtggctcacgcctgtaattccaggactttgggaggcccaggtgggcagatcacttgaggtcaggagttcgagaccagcctggccaacatggtgaaaccctgtctctgtaaaaaatagaaaagttagctgggtgtggtggtgcatgcctgtagtcccagctacttgagaggctgaggcatgagaattgcttgaacccaggaactcaggaggcggaagttgcagtgagccgagatcatactactgcactccaggctgggcaacagagtgagactcagtcaagaaaaaaaaaagctgggggtggtggctcatgccggtaatcccagcactttgggaggctgaggcacggagatcacgaggtcaggagttcaagaccagcctgaccaatatggtgaaaccccatctctagtgaaaatacaaaaattagccaggcgtggtggcactcgcctgtagtcccagctacttggaggctgaagcaggagaatcgcttaaacccgggaggtggaggttgcagtgagccaagatgccgccactgcactccagcctgggtgactgagcaagactccatctcaaaaaaaaaaaaaaagtttttttgaaaataagaaataaaggccaggcacagtggcttacacctataatcccagcactttgggaggctgaggtgggtggatcacgaggtcaggagtttgagaccataatggccaacatggtgaaa

SEQ ID NO: 29415 - DNA, 1062 bp, Homo sapiens
acaacaacaggccgggcacagtagctcacgcctgtaatcccagcactttgggaggccaaggcgggtggatgacctgaagtgaggagtttgagactagcctggtgaacatggtgaacacggtgaaaccccatctctactacaaatacaaaaaattagcttggcgtggtggcgggcacctgtaatcccagctacttgggaagctgaggcaggagaatcttgaacctgggagacggaggttgcagtgagccaagaccgtgccgttgcactccagcctgggcaacaagagtgaaacgctgtctcaaaaacaacaacagcaacaaaaaacaggccaggtgtggtggctcacatttgtattcccagccctttgggaggccagggcaggaggattgcttgaacccaggagtttcagaccaccctgggcaatatagcaagaccccatttttacaaaaaattaaaaattagctggacatagtggcatgtctctgtagtcctaactactcaggaggctgaggcaggaggatcacttgagcctaggagatcgaggcagcagtgagctatgatcgtgccactgcactccaccctgggcaacagaaaagtccctgtctctgaaaataaaaacagtaagaaaacaggaccatcactcacagcacctctgcctctgccctacctacttgaatgaggagcagggtgtctcagctggtcagagcagcccttgaatgagccccagctatttctggggtcctcaaacgaaacctcccatggccaagtcatacccaacacgggcctgctcccctgttctggcctcagctcggagatgctgagtgacagaggctcagccttcgggtgttcctggcaaaccctcacctccggaggccccacagctcagacctagtccttggttcacatggccccacttccatcctctttttcccttaagactgatttgtcctgggagatcactggatccctcattcaggtggagtgctgcaggacgacactttttccaggggtgacccaggcctgcagggtcccagtgtcacaggcaggccttgcccgagcctc

SEQ ID NO: 29416 - DNA, 1060 bp, Homo sapiens
tgcaaaatttttgtttttcctagacagagtctccttctgtcacccaggctggagtgcagtggcacgatcttggctcactgcaacctctgcctcccgggttcaagcgattctcctgccaagcctcctgagtagctgggactacaggcgagcaccaccatgcccagctaatttttgtatttttagtagagacaggatttcaccatgttagccaggatggtctcgatctcctgacctcgtgatccacctgtctcggcctcccaaagttctgggattacaggtgtgagccaccgcacccagccctacaaaatttttcaaaaatgtataggtgtggtggcacatgcttgtagtccgaactactggggaagctgagacaggaggattggttgagcccaggagtttgaggccacagtaaactgtgatggcaccactgcactccagcctgggtaacagagtgagaccctgtctctaaaaaagaattaaaattttttttaaataacaaaatgggctgggctcggtggctcatgcctgtaatcccagcactttggaggctgaggtgtgtggatcacttgaggccaggagttcaagaccagtctggccaacatggtgaaatcccgtctctactaaaaatacaaaactcaaccaggtgtgatggcacatacctgtaattctagctacttgggaggctgaggcaggagaatcggcttgaacctgggacacggaggttgcagtgagccgagatcgcaccactgcactccagcctgggcgaccaagtgagactccgtgtctcaaaaataagaacaaaatgtagatgcctacgtaccatctctctacccttggctcctggggagtaagggtcacccagtgacctcctagaaggccagtgacaatggggggtgtcagagtgctcttcagagccaagggagcagtaggaattgggatcttagtctcttagtctgactccaagctgtgagggagagagttgcagggcacttaagcttggtggagaccgtcagtgcctccttgcctgtccctgcagcaaaagttcaggacaccagagcca

SEQ ID NO: 29417 - DNA, 1020 bp, Homo sapiens
cggagcagaaggagttggaggaggaggaggtggaggaggaggagggaaaagaaatggagcaggaggaggagggaaaagaaatggaagaggaggagcaggaggaaaatgaaatggaggaggaggaggaggaaaaagaaatggaggaggaaaaagaaacaggaggaggaaaaagaaacggaggaggaagaggaggaggaggacaaagaaacagccaggccggacgtggtggctcacccctgtagtcccagctgctcgggaggctgaggcagaagaatcgcttcaacccgggaggcagagtttgcgtgagccgagatcgtgccactgcattccagcctggagacagagtgagactccatctcatctcaaaaaaaacaaaagaaaacaaaacaaaaacaaaaaaacagccaggagccgtggctcacgcctgtaatcctagcaatttgggaggcgataagaattattgaaatgcaataagaattaccgaaatgttgaacaaagacaccaagtgagcacgtgctgttggaaaaatagcaccaatactacactagctcaacacaaggttgccacaatcctgtaatatattaaaaattgggccaggcaaggggccgggaggggtggctcacacctgtaatctcagcactttgggaggccaaggcaggcggatcacctgaggtcaggagctccagaccagcctggccaacatggtaaaaccccatctctactaaaaatacaaaaattggctgggggtggtggtgggtgcctgtaatcctagctactatgtaggctgaggcaggagaaccacttgaacccgggaggtggaggttacagtgagccaagatcatgccatggcactccagcctgggtgacaagagcaaaacttcatctcaaaaaaaaagaaaagaaaagaaaaacaaaatgggccaggcgggctgggtgcagtggctcatgcctgtaattccggcacctttgggaggctgagatgggtggatcacgaggtcagaagtttgagaccagcctggc

SEQ ID NO: 29418 - DNA, 1051 bp, Homo sapiens
cttgcctttttcttgtctatttcatagccaaggaggaaggaaaaactggacctcatggatttactttaggaaggtacaaagcctgagaagcttaaggtatttcagtctgttttatattactcacttgcaaaaagcaggctcatcgaatacaggtgagtttcaacacatcttgaatatggcagcatttaaaagtctttagactgggcatggtgactcatgcctgtaatcccagcactttgggaggccaaggtgggaggatcatttgaggccaggagttcgagaccagtctgctaagcatagcaagaccccttctctacaaaaagtaagcaaattagctaggtgtggtggtgtgttcctgtagttccagctgcttgggtggctgaggcaggcagatcgcctgagcacaggagttgggggctgcagtgagctatgattacaccactgcacttgagccagggtgacagagtgagacctgtcttaaaaaaaaaaaaaagggggtcttcaaagacaagaacatctgtgctgtcacgttgggtggatgaggggctgccaggtttgcaatgaatgtttcccatttcttcttagtttatggacttaccataaactcaggatggcagtttggtgggttggagaaggatatggtgattgcgggagttacaagacattacttataggggaaaacagggttttgaaaggttaacgcttaaaagtgagaatggaaaagggatgaatgaatgaacaagatgaggtgagatggaagaggtaaagggaaaaggagaacaagcagctcttctctgcgtggcgcctgggatgaatggtttctggggacatccctgatggcagttttgtggagaggcgcaaaactttatgtggtaagaaatgagctgtaggcccagcgcagtgacccacgcctgtaatcccagaactttgggaggccgaggagggcggatcacttgaggtcaggagttcaagaccagcctggccaacatggagaaaccttgtctctactaaaagtacaaaaattaggcaggcgtggtggcaagtgcctgta

SEQ ID NO: 29419 - DNA, 1051 bp, Homo sapiens
gatagagttttgctcttgtctttcaggctggagtggggtgcaatggtgcagtcttggctcactgcaacctccacctcccagttcaagaggttctcctgcttcagcctcccgagtagctgggactaccatgcctggctgatttttgtgttattggtagagacggggtttcaccatgttctccagactggtctcaaactcctgaccttaggtgatccacccgcctcagcctcccaaagttctgggattacaggcatgagccactgcgcccggcccattatatcattcttatgtgtttgcttcctcatagcttagctttggtatataactgttttggaattatcatccttggctactaggatcagtgataagggtgacactagtctgaggctggacaggccactcctgggcagatgtctttgcagaagtattttttgtgtaaggttgtgatggcctttgtgtaatgttgtgagttgtgtttttgaggtagggtcttgctctatcacctgggctggagtgcagttgcactgtcaaggctcactgtagcctcagcctcctggactgaagcaatcctcttacctcaatcctctcacctcagcctcccaaagtgctgggattacaggcatgagccaccacacccagccgagaatggggcacttgtgcacgagagtcctctcttcatggcctttccctggctctatttttcagagttgttttttgttgttttgttttgttttgttttgagatggagtcttgctctgttgcacaggctggagtgcagtggcggaatctcggctcactgcaacctccgcctcctgggttcaagcaattctcccgcctcagcctccccagtagctgggattacaggcacccgccatcatgcccagataacttttgtatttttgtagagatggggtttcaccatgttagtcaggctggtctcgaactcctgacctcaggtgatccacccacctcggcctcccaaagtgctgggactacaggtgtgagccactgtgtgtggccgcagctctattttgacaattttcacagtctc

SEQ ID NO: 29420 - DNA, 1082 bp, Homo sapiens
tcaggtgattcacccgccttggcctcccaaagtgctgggattacaggcatgagccgccatacccagccaacttttatctttttagtagagacggggtttcatcctgttggccaggctggtcttgaactcctgaccttaattgatccacttgcctcagcctcccaaagtgctgggattataggcatgagccactgcacttggcctttagtggtgttttctgagatcttggtacactcatcacccaagcagtgtacactgtacctagtgtgtagtcttttatccctcatccccctccccttctactcttccccttgagtacccagagtccattatatcattcttttttttttttttttttttttttttttgagatggagtctcactctgttgcctaggctggagtgcaatggtgtggtcttggctcactgcaacctcctccacctcctgagttcaagtgattctcctgcctcagccttccaccagctgggattacaggcgcccaccaccatgcttggctaaattgttttggtattattagtaaagccagggtttcaccatgttggccaggctggtcttgaactcctgacctcaggtggtctgcctgccttggcctcccaaagtgctgggagtacaggcatgagccagcatgccggaccccgttatatcattctttttttttttcttttttaatgttattattatactttaagttttagggtacatatgcacaacgtgcaggtttgttacatatgtacacatgtgccatgttggtgtgctgcacccattaactcatcatttagcattagatatatctcctaatgctatccctccccgctccccgcatcccacaacagtccctggtgtgtgatgttccccttcctgtgtccatgtgttcttgttgttcatttcccacctatgagtgagaacatggtggtgtttggttttttgtccttgtgatagtttgctgagaatgatggtttccagcttcatccatgtccctacaagggacatgaactcatcattttttatggctgcatagtattctatggtgtatatgtgccacattttcttaatccagtcta

SEQ ID NO: 29421 - DNA, 1027 bp, Homo sapiens
ctacacataagcgttaaggcccctgaagggccagagaaggcttaggagtttctcaagagtgagcccagggtgggagggggccagagtcactgagaacagcccatttgaaaagtcaggcagagggatcctgagccctgaatatgcctgcctggcctgcggtaaccatgccagcagggtcagggcatttggccaattgctgtcttggtcgaggcaggaacatcttgcttccccagcccctgtctttttgtctccagtatccttggagcagctgcagggtgggtagtggggtgtctctcccagctgcttgaagagatgagcctccacccggctgcctctgccaggggaaacgagtaatgactgcagcagggagaaaagcgagcccagccccttttagaatcaaccctgctgctccgattctaattttcagttcagattttgcaggcacgagtgtgggtccctgagtacctgccctttgaattcttttggtgaggactgagcattcccccaggagcttctcatcgaaccccaaaaacacggcccccaattcaccacctcatcccttcccaggacctgctgaagctcacacccgtggaccacccagactgcctgccgctacaggatgccctccgcatctcccaggacttctttccggcatcagtgtggacattgaccccactggactgcagtcacagtggactcccaaggggcaggtgagctcatggcacagcaaggcctcacgctcaggttgaggagcccagagtggaccagatccccagtcccttctctgatggcacaggcatctctctgtgccccttgtctctgcaaccctgattccccattcccagccaaggagaggtcttcgatccctggtcatgctgatttgattccctgtggcattgtgggccctaggctgagagctttaagcccagtctctcaataatcctaagaatccagtgagccagaagagggcacaggaccagagagtctctccaggtacgccacacagtctttgagctgtgtcagagct

SEQ ID NO: 29422 - DNA, 1026 bp, Homo sapiens
agcttttataggtgctgtcctttccttggaggacgcctcaactttaggagcatgggtagacctccattcaaagcccagctcccccttgtagcttggtgatcgtgaggaagtcatagaacatccctgtgcctgttttctcctctgagaaatggcgttagtgagaattgtttccctttttaatcacagaaaataaagcatgcgaagaagttaacttggtgccattgggcagagggtgagagcccagcaaaccggagagatcagctgcccacatcagtggcgaggagtgcggagagtgggtgaggctggggcaggaagcaggccagcctgccagagcccaggaacaggtgaaaggcaagagtgagctcctcaccctgaattctcagggttcacaggcatgcaggggctgtggggagtacaatcatcagggctgctctcgttcccctggttccctccatatctgacgtggtcccagggcccctctccctgtgtttcctctctgccctactttctttctggctgccctcccaggactcatttttggccctggtaaggtggagtcttgaggtaactataggcctattaataactcctctgatgttcaacctgccatttgttgagacctctgagcttagtcagaaatctgctcctgctgggacctgagagagggctggagggagctgacagtgcaatggcagttttccctggggcagccactccagggtctattggcaggtatctgccgaactggagctttcttttgggtgtctggtgttctgaggtgtgattttccctctgaagataggctgagccccaggtgggtgccttagcctcagaaatgggtccccctgagctgggagctgtgctctaccctcagtgtcctaggacacctcacacctggccctgcccattctggcttccgaagcccacagagagggtctgtagaaattgctagatacaaaaggactacaaataagtcataggaagtgtatttacataacgcagtggttttcagccattactatatgt

SEQ ID NO: 29423 - DNA, 1049 bp, Homo sapiens
cttacaaggagagggggtcagcgcacagagaagttcaagagaagaccctgtgctgactgagatagaagtccgccatctccaaggcaaggagagaggcccagagaaaccaccccaggctgacagtttgacgttggacttccagtctccagaattgtgaggaaccagatttctgtggttaagcccttcagtcagggtgccgtgttatggcagccctggcaaactgctccagcctattaggacacgcataggattatgctccttgtagaaaggctgcctcgaaagggaattttatcatgacaggctccaccagcactgagaggctgacccgctgtggaaaatggcctcccttaaggaatgttacaatgacatgcgagggtacaactcctgcctgatggggctgcagggatgagttctgtgagatgacactttaaagactaatgcatagagtcgcttcaccttcttttgttgtaatcaatgcaccccccccacccccaccccttgtttgtgcaaaagtgttggattttaagtcctggaggaggtctggcagggcagcggagctgcctgcctgttgccggagatccacttagggtggggagttaaaatgataacagtgtgagtattttgctgcaatgttaccattgtactcaattcttaaagcaacatgccgagatactcctggcatagcctaaagtgaaaacagaaggattttctctggtcttcctctgataggtgaaagggactttgcctgtaaccaagttgccactggggactaatggcagccagattcctttgggagaggacagtgggtcactcaagtgggaacgccctaggatggagcttagggagtccccatattcgtgtctgagtcctgggcccaccttggttttcacaagtcctgtctgtggagacccttctgtgcccaatctcaccgcagaccggcactggacgtggttggtggtgtggtgcacgtgccctttgaagaatatggagaaattgaatccatccaacagctcttgtttggtctgttgtgtggagctctgcaaagagag

SEQ ID NO: 29424 - DNA, 1034 bp, Homo sapiens
tcatcacccctgctcagcagcccagcagcccagcagccattgccacatcccatttccagggcctcctgcccccatgcccccacgtgcccatggaccgacacaccactcttcctgttggcccaaggtaggcatggagggaatttttcaagtccacttttagtaggtaagtcaaaaccaaacaaaataaccactcgacacctggtccaatgcccttccaaactcactcttttctctgacccttaaacacttgtcctgcatctcccagactccactgtaccttgatcagtaggtccctcttcactgcagtgtcttttttgcagagttcttttagctctttcatgcttttgctatgggcagaggaaagaaagaagggtaaatttgggaatcaggggagatttgtgagttccagtcccttttgtttgaaaacccagtgaatcccagcttactgggtgagagttttcagtggagtcctctgatcacaggggctccagaggaccagggtgggacctctcatgctcctcccctgggccccatctccacttcacatgagccactgcgtgtttacagttagctttcagctggacacagagttccactgctgggtacaaacacctgaaagcctccagttggctccagtctgttcctgatggttaaaaaaccttagtcctgagttggaaatccttgcctaggagtccagggcagcttagtgaccacagccaccggcccatccctgcctccagtgtccctggactccaagaacctttcagagtcattgagggcacatggggggagacctgtgagtccctaggtcaaccctgatgctgccatggagagagccctcctcacctggacactcctgcccacgtcttgtgtagctgacctattgggttgctgcacagagcagagacgatgacgtgcaccgaggagaagttgttgaggcttaggcactcctggagagggaagaatgagctgtgcggttcagagttggagcttggcccactacagcctcagccccctctgctgagatctcccct

SEQ ID NO: 29425 - DNA, 1041 bp, Homo sapiens
gacatcagcagcctgttccaggtggagcccctgccctcccacctctgcatcactatcgccatcaacaacacgctcaccccccaaccctgccaccagggaccatctgtacatgaccgacacctccaagtggggaccatcctgcctccactgcacgcacccaccttcccgccccaccctgtggtcttcctgccagggacagggtggccttcgcagagaggaggccctggatctggggaggcatgtgagctgaggtcaaaagacccatggcaagggcccagcgaaccacaattctcccgccctaggtatcccaagggttactttgtccagaacacagactttgacttcttcagctacgcaggactgctgtggtctctgcttctatacacgacaccccccacctacatcgatgacgtcaccgtcaccaccggcgtgaagcgagacagtggtgagggcttctggtaagatcctccctcagtggggcccagggtggctgtgtttgttctctgtttggaaagctctcccagcatctctaaaccttcataggttcccatccacctatgaagctaaaatccaggctgtctgagccggcgtgggctcccgaaatcacccatgtggtagatctcgcttggagaagaggggtctggcctaacgtcacacagctcagggtggcaatcctgtcccttccccacggtgctgctctcactctagctccccttgctacacattgtgctcaaggaacaggcagcttcgaggggccgggtgcggtggctaacgcctgtcatcccagctctttgtaaggaggacttggtaggaggatcactttaggccaggagtttaagaccagcctgggcaacatagcgagaccatcaccacaaaaaattaaaaaccgtcaggcatggtgatgcatgccagtagtcccagctgctgaggcaggagaatctgttgagcctgggaggtcaagggtgcagtgagctgtgaccacgccactgcactctggtctgggcaacagagggagaccctgtcttttttatttttatttgt

SEQ ID NO: 29426 - DNA, 1076 bp, Homo sapiens
ttctcctgcctcagcctccaaagtagctgagattacaggcacgcgccattgcacctggctaattttttttttttttttttgggggacggagtctcactctgttgccaggctagagtgcagtggcgtgatctcagctcactgcaacctccacctcccaggttcaagcgattctcttgcctcggcctcccaagtagctgggataacagctgggataacaggcatgcgccaccatgccctgctaattttgtatttttagtagaggcatggtttccccatgttcgccaggccggtctctatctcctgacctcaggtgatccaccagcctcagcctcccaaagtgctgggattacagacatgagccactgcgcctgggcctcctatgagtctttaatgccaaggatgcttcctcaggataaaggcttatgtccatttcagtgtcgactgtcagggactcagctgcagactcttttgactcatctgctttttatttgtttttaatttttttgcaagcctttatgctgctttcctgtctttctcctcttcctgagttctcttccccatacctacagcgtggcctccgcacataccaagcttgcaagcttgctgtttgctgcaaagaaacctggactgacaatctctcttctgtcatctgggcagccagactgagtgtccccttctacctgggtgcctgtgtgcatgtcctctaacccctaaccctttgcagcttctgttttttttttttttctttttttcttttgtttttttggagacagagttttgctcttgttgcccaggctggagtacaatggcaagatctcggctcaccacaacctctgcctcccgggttcaagcgattctcttgcctcagcctcccaagtagctggggttataggcatgcgccaccatgcccagcttattttgtatttttattagagacggggtttctccgtgttggtcaggctggtctcaaactccctacctcaggtgatccacccgcctcggcctcccaaagtgctgggattacaggcgtgagccaccatgcccggccagcttctgtttctttatgtataaacagt

SEQ ID NO: 29427 - DNA, 1103 bp, Homo sapiens
ggggcagacagacaggagatggattggaagggccaggtgtgaaggagttgggctgtcacaagatcctaagaagggaaccaccaggccaggcatggtggctcacgcctgtaatcccagcactttgggaggccaaggcaggcagatcacttgagatcagaagtttgagaccagcctggccaacatggtgaatcccggtctctactaaaaatacaaaaattagccaagaatggtggtgggcgcttgtaatcccagctactcgggaggccaaggcaggagaatcacttgaagttggaaggcagaggttgcagtgatccaagatcgtgccactgcactccagcctgggtgaaagagtgaaactccatctcaaaaaaaaaaaaaaaaaaaaaaagggaaccaccataatcaggcttatgttttggatatttgactccattgttagtgtagggcatgcaccagagggagaggaggaagccggaggtcagcagctagtttggaggccagccctgaaaagatcccaggaggtagctctgaagcctgagctgcagagtggcagtgaggactgagagacagagacgctgcccatgcagcctcaggaagtagataagaggggaccggtcgggtgagaataagagcggttatgctgactcccaggttggggcacctggctggagggagtgcgactggagggtagagggaagagctctctttctctttcccagcaaaacctgcccccaatgtcacccagtagctggagtcttgctccttttctgcaatggccccacttcctggttgttgttgctgttgttgttgttgttgtttgagatagagtctcgctttgttgcccacgttggagtgcagtgggctgatctccgctcactgcaatctctgcctcccaggttcaagcgagtctcctgcctcagcctccctagtagctgggattacaggcacccaccaccacacccagctaattgttttgtatttttagtggagaccgggtttcaccatgtgaccaggctggttttgaactcctgacctcaagtgatctgcctgcctcggcctcccaaagtgctaggattataggtgtgagccaccgcacccagccc

SEQ ID NO: 29428 - DNA, 1054 bp, Homo sapiens
catgttgcacagggagcttttgttaagggtccctgtgtggctcagagttccaggaacgggtgtgggccctgataaaaccccagactcatggctcagtgaagttgcacagctggacaagcctggagaccctcaaataacttgcccaggctaccctggcttgcaaagggccattgctcatccaggagtggacggtgcctggcatgcagtgggtgcccagtgttcacctgccacgtccactgtccatgcacttattaccgtcatgctgtcaccatgaccagcgccttaggtgctgtggctggtgccaggcccgtgagagccggggcaggttcgctcagggtccagatttgcctgcattgtcccagagtcctcccacacccgggggagtgggctgtcattgggagccagtaagggggtgttgatttcttttccaaccagtagaggcaggggccatagacttaggtggaaccgctggctctttgctggctcccagggttctgacagctgggtcttctgagccctggggactggctgcctgtggctgagcccttcaagggcattgcgctccttctgcaaatgtcactcccagtctccatgtccaggcccaaagcagccccggggagtcctcagggctcattttcctgcaagggggtgggtgggggtcagctggggcaggccctgtggtgattagaagaggctgcctgcgcccacagaaggtgggtgggctactcagagaaggaggcccctgcaggctggcagggggcctggtggctctggccccagccctggtggttctgtggcatggagctgacaccacagacacctgtgaggttggaccgctggactagcagcacgccctgcccttcctgttggaagcttgtccagtccagagctgtcagggccacaggggctgagcatgcagctccacactccctggagactccgccatcaagggtcagctttgtctggtcttgtggaaactgtttttgcccccagccgtgagaggcacttttacacataactgagtcggagcatgacaggcatgtaggagagaaac

SEQ ID NO: 29429 - DNA, 1143 bp, Homo sapiens
ggctgcccacagtatctaaggccagcttggtcatcaaggcatgctggaaggtcaccccaggtggcacaggtggcttggggtgtgcttctgggtagcagccactatgcagcgctggcctccaagcagaagctactgtttcggacacctaaggtgtccccagcctccttcccctaccccgaggttttctggaatagctgagggggcagtggtgagctgcagggttggggtcctgggggctgcgtgtccacccagcctccagaggaacacatgcaggcccccatcacccgttcctgcccaacctgcttttctgtctcactcctagctctgtggtctcggacaagcatgttaactgctccagggctcagtttccccatctgtaatagggaatgatctttatgctcccacaggatcgtcctgaggctgcagagaggtggtgttgaaaagtgcctagctcagggcctggctcagtgacggttagctgttagggttaccatcgcattgcaattgttactccatggtgaagacaccccggggactctggacttgtttggctccactgaaaggctgcttgggtgaaacaatctcagctctgcatagcgtggcctgtgggttgcactcatgacagtgtggagcctgttcagtcggtaccgagtgtgcgaccttgcctagctggccccggcatttattttgtagctggagccctggtgggatggggtcgggtgggctctgggagtctgggggaacaggtgcaggaacctgcgggtgcccctcccctggggacctctgctttgttagaggtatggctgggggctgaccatctatttgtaggtgttgccagagcagtccccgcctctccttttcagaggacattgttgaggggaccttgccttctgcgtcttggctggctgcttcatctgtggggggctccccctggctgaccaacagccctttctggaccccttgcatcagcgcctccccagtcagcttcactgctgaaggcagggccagcatggccaccagggtcttccccctctgcccgaggtctctgcccgctcagcttccctcaccctggttgtggatggtcagtgcctctgccctgctctgctaaccaggccctgtgcccagttggcactccgtggttac

SEQ ID NO: 29430 - DNA, 1052 bp, Homo sapiens
ctcagcctcctgagtagctgggactgcaggcatgtgccaccacaccctactttgtacttttactttcatatctttgctcttattaaaagccaagtgctatttcatagtacacaggtgcactttacagcatttacttgattgagttttcccaggcttcattactgttacaaggcatgcttgctcgtgtgtctctgcatgtgtataagtgtttttataggaaacattcctagtcaaagagtgtgtccatttaggtttttaaatatattgatgccgggcacagtggctcaccccagtaatcccagcactttgggaggttgaggcaggaggattacttgagtccaggagttcgagaccagcctgggcaacattgggagacccccatctctacaaaaaaattaaaaattagctgggtatgattgcacactcctgtagtctcagctacctgaaagactgaggtgggaaaatctcttgagcccaggaggtcaaggctacattaagccatgatcatggcactgcaacagatctagcctgggcagcagagcgagaccctgtctcaaatacatacatacatacctcctaaaaggctgtaccaattcatacctgcaagcatctatgagaacatacacattcctatatcctctctgatgctggcaattaccagattttggttttttgtgttttctttggtcccaatttggttaaaaattataacaccttttgatttgcacaaccctcatttccggtttattggtatttacttttctgcaaattgcctacacttatccatctttctattgtttttctttctttttttgagacggagtcttgcttgtctcccaggctggagtgcaatggtgcgatcgccatcttggttcactgcaacccttgcctcccggattcaagccattctcctggctaagcctcccaagtagctgggactacaggcatgcgccaccacccccagctaatttttatatttttagtggagacaaggtttcaccctgttggccaggctggtctcgaactcctgacctcaagtgacctgtccacct

SEQ ID NO: 29431 - DNA, 1027 bp, Homo sapiens
ccggttcgcgactctgtttccagcggccgcgcggccggcccgcgtgctccgaggaccggctgaggttgcagcgagaaagttctgagcccgggtgcggggctgcctggccggtggcgctgcccctgtgagccgtggctgtgggtttccaagcggactgacacatgccaggtgccggggcgacccgaatgccccttgtggccgccggggtcccagatggtgtccctccccgggtcggctgcccggaggggggcggggggggtggtgacatggtcccagagcgcgggacagtaggggaggcaggttcgtgcctcagttgtactctccagtggggagagagtaaggccgggcaactttgtctccaacttttggtgtttcccaaggggtggagttgaggtcaggaggactcaggacacttaagcagtttgtgaaacgctacacatgttcttttaatttggagatggccatgtggtttttgaagcaagcctcttgctgcctaaatcattctcttcggatgtgcgtgttttgcttttctggagtatggccagccaagtggcacggcccgcaagtgcctgtgcacgcctgggctcctgttctgtttgtggcagtttagctgggaggatcttgggcccctttgtctgtgcctccttaaggcaaacagctgtctccttgaatatttccagtgtggatggtgcaggggggtggccgtgtagtctgttcccctgggctgcagcctctcttctggaggtgtagggggcagcggggaacaggaggagcttggcctttgtttcaagtcctcctacctctgacccaaacctagagattctgtggacagtttcaccccaaatttgcctctctcaggagcgtgtttacattttggggccttgtcgggagctagcaaaacaaggtgaagacaaaacagcgacagtatctggggagtacaggccagcaccgttcctttttccggaaatgcgtgggtcaaggaggcaaaaggggttttgaggaagctgtttgttttaaagggggagtt

SEQ ID NO: 29432 - DNA, 1073 bp, Homo sapiens
tgtttcttcctctggacaccagctcagcatggaagggatgactgttagcacgttcttgaggtccaaaaactttcagtgaggctgtggtttgacttcatcaggtgaatgcttatgtgtgcccgtgtgcgtgtcggcacatgcacacacacacatctgttcaaataagaggctcagtgttaaacgcagtgttggtcaggctctctcagtgatctgaacatgagatattatgattgtctttcctgagcacatatctttttacatagctctgcaaccttggtttaaaccaaatagctcataaattggcagtgcttggcattggatgtgttcatttattcattcatttagtggattcatttattgagcacctactaggagtcagacactctactaagcattgaggatacaaaactgagcgcatagaaaataactttgtatgtcacacctattgacttgaaatatcatttctgagactttcatacaggaaaactgatttaacaccaatatactcccaaaataacatgtaagcttcatgacatttacttcagaagcattctgtttgcatctctgtactttttatatgcacttatttttcttacatagctgttgaaaaatagtccacaaattatctgtgatctctaaagagacaccatttcttttatatgattattttcatttccttgactttataaaaagactctgcctcaggatagcactttagagtttacaaaggacttttggatgtgtcatttcatttaagtcactcaatagtcccgtactgttcccattttgcagttgactagaaaaatgaggcacagaaaacttggtaacttgctcctggtcatttgactaaaaagaggctgaacttgggatgttttttacctgggaactgcaaatgtttggggacagtgaccttctttcttgtggctgaagcaggcccaggaaaccccatttcagaccaagcctattatgacaggcctggcctactgagtcaagccctcagtggagcttgaggaacactgcacagccattaaagaattatatgatagaatatttaaagacgagaaaagcagttc

SEQ ID NO: 29433 - DNA, 1263 bp, Homo sapiens
aatgagaacgttaaggatgccctttatttttttcctaataatttgacttctaggaatatatcttaaggaaataatgtaactgctgaaaaaaatttatactcaaaacttgatcacaacaagctttatgaaagtgaaaaatcagacaaaacttgaatgcttaaagtaggaggtggcaaattatggcctgtgggccacctgcctacaaatgaagttttatttggctgcttttgagctataatagcagaaccaagtaggtgggacagagaccatatgccctgcaaagccaaaaatatttactgtcttgtcttttgcacagaaagtttactaattactggtctaaggtaggtaaatgattaatttactcatatcacttaaaccttcataaaattttaatcagccgtttaaaatggccaaagatgttttagtggcaggaaatgcgtgttactgttttaagcagaaatatgaaattttatatagtgtggcctcaaaagtataaaaactgcataggcttaaggaaaaaatacccaatattaatagtactagcttggggatgagggattgtatgtgattttttttttcaacgctttgtctagagtaaattgaggttaggcttagtaatctaaaacatagttttttaaaaatcaccaaaaaaggaagaacaccatatcattctaagattgaaagtcattttggctagaagagcagttcttgtttggtttggttttgttttggtgggttcttttggaaccctcagattgaaacgagagatgttttcatttttgagaaaatcatcaggttttaggccctgattgtgaaccagaacaaacgagagattgggtatagcattttgtttaagtcaaatcctttatcgtgagagtcacagtattttgacatttttattataatggaatttatgtgaattctacatcagggctgtggcagatgtgactgtattctagaatatgagttccccaaaggtgtaaaagagaacaggaatcctcaattttattcccagaagggagagagactgagaaaatcagaacgtagagtgtgatgtgagtttgggtggagctgctgccttgcagcctgtgtgggcccaggttcttgcttcatcccagccatagtgggagccagcagcttgggggagcttctgttccatctgcttggctcttagcatgtggttgggacaagctttctgggcctggctaagttttatgaacagatggcacagcaaattcctgatggttaggtcaagaggagaat

SEQ ID NO: 29434 - DNA, 1056 bp, Homo sapiens
actgaaaagggcattattttgaacattaccacacctaacgaaagttacagtaattagtaacagtaattccttaatattacctgatacccagactgtattcaaattttgccttattgtcttggatattacttattctgctcttccttccttccatgcacccatacttccatccttccatttctttttctttttcctaataaggatccaaacagcatccacatattctatttggttattttgtattttaagtccttttaataacagtcctcacccagccactcatctttttccccctcctctatgccattgaattattgaagaaaccaggtcatatgtgtagtagagtgttagaatgtcccacactctagatttggctgatttgttcctcatggtggtgtcatttaatgtctcctatccactgtatttcctttacattagtagtaagatctagagtcttggtgaggttcaagctcagttttctaggtaagaattcttcatgggtggtgtatacatttcctgtgtatcccatactgtctggctgtcctgtgcgttagttaaggctaaggttgattaggagattctgtacattccctcctgtgactgtgctctgacatggatagttggggttaatctgcatccctctggccactccgtatgggggatttgagtaggagtgaaaggctcatgcttctgctaagcatatgcctataatcctagcaacagaaatgcggttctgtgcagtcatcgcatgtgttcctgctgggtgttctcttagggttcagtcatctcaggtaggggttggcaaactttgtaaagggccagaaagtaaatattttaggctttgcaaggcacataaggtttcaatcacatgttcttctttgttgtaacctttaaaaagtataagaaccattcttagcttacaggccataggaaaacgggtaacagactggatttggcttgcaggctttagtatgctgtaagaaatgacttaagagttcaagaatttcagcttcctatctggaatgtgctcctttcccacagaccctgctagaccaa

SEQ ID NO: 29435 - DNA, 1032 bp, Homo sapiens
aggcatagtccccatggcacagtcctgaggatcgcagagcgtggtcaggtttgcagggtcggaggttgctgacctcaccgtggatggagggcttcttcaacacaggttgctgtaccccacttccagagttcccattcagcgtggtctccttgagccctgataatctgcattttgtgtaggttcctaagcgctgttcctgctggtcagagaacccacgttgagagctggggtagtagaggtgcagcagacgaagcacacgggcgctaaaacctgctgtgagatctcaggcaacgacttcacctttctgtgccttggcttcctcagctgtaaaatggaatgacagagcactgtcctcatagattagttgtgaggattaaatgagcgattgggaggcggagatgcgcggatcacctgaggtcaggagttcaagaccagcctatataattgattttaattgaaattccttttggtaattcttaaagataataatacattttgatgtttactcatgaacattactgatattccttcctccagctacatgataatgttttctctcctgtgggtgagatctaagaaatgaaactcggccaggcatggtggctaatgcctgtaatcctagcactttaggaggtctagacctcctcctgaggtcaggagtttgagaccagcctggccaacatggtgaaaccccatttctactaaaaatacaaaaattagccaggcatggtggctcaagcctgtaatcccagctactcaggaggctgaggcaggagaatcacttgaacctgggagatggaggttgcagtgagccgagcttgtgccactgcattccagcctgggtggcagacagagtgagactctgtctcaaaaaaaaaaaaaaaaaaaaaaatggccgggtgcagtggctcacacctgtaatcccagcactttgggaggccaaggcgggcagattacaaggtcaggagttcgagaccatcctggctaacacggtgaaaccccatctctactaaaaaaatacaaaaaattagc

SEQ ID NO: 29436 - DNA, 1050 bp, Homo sapiens
gtacacccaagattttcatttagtagaaagtgtccaatgatttgaagttgtaaaagaaagctttcaggagctcataattaataggaccttctaatgttcaatctggaaagtatcttagagttcatcagcagtttggtggggtactcagtcatagaggaaattcactatgggtgggtgacaggcaggggaatatttcctgaagcccaggcatattacagaataaaacacaaaattgtaggaagttttaggacaagtcattggatgtcaaggatatgtaatgtttaccacctacagccctagaccaatcctggccctcaaggaccttagttcgctcacccctgcttttagtttttcctcagtggagaatgaaaagtcctgatagagtctagttttcctgttacagagggagaaatgaggcccagagagaggttaaggatcctgacctttgttaaacaggaagtttaacaaagtagcactcctagtctagtgctactgtttggcagctatatctcacaattaagtgccatattctacatatacccaagttgtattgcatatgaggattttcagtgacattcattggattaggaagtacttcagcattggctcattgtttattgatcaaatgatctgtgaaagaccaactttgttgtcatttcaataaagctgggcacttagaagctagctgtgtcttatggaaggcttgttgactgcttctgcatccaggagcccagcttaagtgccaggggcctgcagagcaaggggagtagtatgtaaatatttgattttagcccaagccagcatccacaacaggaggatgtttccggggtgagaatattgacaccaagggcagcattatttacataattatcctcttctctattagctacatttatgtcccctgacagcacctagcacagagtaaagggtaaatggtacccacttcatacctgctgaattatattactaaaatatgggtttgtatgtgtgtatacatatacacatacacatacatcctgaattttcacattggtactctgttttaagggg

SEQ ID NO: 29437 - DNA, 1022 bp, Homo sapiens
tattaacactaatccgaatataccttatgctgatactattgtattttttctttgttcaggcactattattggtggagcaagtagtgtctagggatattacacctaacttgataatgatggttttactaagcccttattctggccaggcctctgggcattatacagataattaaaattgaatcataaaaaattttaaacacagtgcactttagcaataagatttttctacttttaaacatgattttaaaacccattttaaaaatgcatttccttggcctggtgaatttgctctcttttttccccaaggattacagaaagtgcatagcaaattcagccttcagaatacccaggagctgaagactcaagtaggctacagctgtcttcacccacagtattctaaaagaactaatgagatgagaagtctgcagctggtggcaagcacaataaaccatgagccaagggcttctcttcatcagagcctcccctttccccatgggatcccaaaggagacagaatactaacaaagccagcaggctgtctcattccacactattgctcatttgcagctataattggtagctgaggttgcattctgtatgctgaaactgtcatacatgaaggaatatatttgttcattgtgatacggatataaattggccagttttcagatacagcaagaccaaactagatacccaatagtgaaaatgtagcaaagaaaatactgttcaaaaaattaggtgtttgttgtggaaatacaaaactgaggttgttaaaaagctacttcctgcttcttaatatcttgcaacttaattcagctgattaaacatttacgtattcttcatattcaaactaacgtaaaacagaaattcctgggtcttgacaagattcattattctcatctttcaaggttaaagtgctattgttaataattgggttttgttacgttttcaatataatatctttaatattttctgctttgtattcaagaggagaaaaagcagagaggggaagacttcatttca

SEQ ID NO: 29438 - DNA, 1033 bp, Homo sapiens
acagtggctcatgcctgcaattccagcattttgagaggctgaggcaggaggattgcttgagttcaggagttcgaggctgcagtgagctatgatcatgccactgtactccagcctgggcaacagagactgtctgaagaaaataaaatttctgagtgttgtttctaaatgagcaaatacctttttggtcagattaaaaagtgttttggttagatcaaattgtagtaagaaccaggagtatccagcataaaacaccacagtgtaagttttaaagttttttaatttctaaagttgtcactgatacacaaccacagtaaaaagtttaggattccttaaatgtcctgatgaaatgcacatgcatatcttcagcacatttccaaaatatacacaaatgagtcagttgacatctgcttctgcttttttttttttttttttttttttttttttttttttttttaggtataaatttgaatctggctctttttaatcatctccagcactttgtctaagtagctttccatgatttatatacaaaagtcacttcccgggagaggaagactctttaaagtgtaagctgaagtatacacacgattaacatcagagagaccttcgtttttggaagtaatttgaaagaaaatgagcatggtttagaaaaaaaaaaagaaattggaaccacatttttagatatttatgtataacaagaaaggattgtatcagccttcctctatagtacatactatgtgactttatttgtataattttcaaggtactttttaagtagaaacaatgtttaatccaaaattttaaggcttacatacctaaaagtgatgcaccttaacatctgagtgttttttacatgttaataataaggaaataatgatataaaagcattaaattgagagatgtagtttaaaaatcgggatccatttaatattgaaatgaatcaaatttaaagagagaatgaaatttttcccctcgtctttcagcatgtttgagtgtaatgcttcagttcatggtgaaatttttcctaaatgag

SEQ ID NO: 29439 - DNA, 1050 bp, Homo sapiens
caggccttgccagggcagtcactcttcgagctgccacttgagcattctcttcctctcctcacactgctgtgccacggaccataccctatgctttcctgttccaacacactacttgttctcacctcctttctgggactcctttctctgtccaaagttgacatgtccttcaggatctaggtaggtcggagcttgcctcctccagggagatttctttcaagttgaaatcagtcttcctctctgctgaatttcagaagcttttgctcatttcattggtgtgttttgttctctttgtttagcaacctgttccctttttacagagtaggcccttcataaatatcggtcagatgaacctgatgagcttgagaataatgatgaaactaaacactatgagccaagagtttgtactggaatacaaaatcaatttgatgtccttttgataacacctgggttggcaagggatgaggaagcaggcactcccatacattgtctgtgggaatgtaaattagtggaactgttgctagtctagcagaattacaagtgtacatagcctgttgacccagcaaaattctgcttctaggaattaactctacccactgtaaagtgacaggtgtataaacctaggatcagaagtctaagtgtttctttatcaatcgggaactgattaaaatcattgtggcacactcatgtgatggagttcagtgcaatcattaaaagggagtgagctctatttgtactgatggagaatccttttcaagacaacctggagggagaaagacaaagaagtatgtataatatgcttccatttgttatattaaaagggagaaaaatagtttgcttagttatgtatggactatcaagaagaatgcataagatgccattaatagtgatttcccttaggacaggaatgggatggaagagttgaggtctgacagagatgtgtgcagtggatcaggggataaactcctctcaccaactgtatggtttctgttgctgcataagagatcactacatatttagtggctgggtaatgtgacctgattagtttgatta

SEQ ID NO: 29440 - DNA, 1135 bp, Homo sapiens
tgtgggggtgggcggtgttgaaggcaggtatgggtggtggcaggagagctaggaccagacccccatttcagggaggaggtgactgtgaaatctagtggtgcagggaccctgggtctgctcttttcttctgcacatccttgtctgtccactttcacaggcattgacagctgcccctacactctaaccctttaatttccgccccattgtttgggccttgactagttagtgttttaggattagcttctgtcccaaacacctggaccacctgaaggtcactacttcttaccagatccaatttggttttctgttaagttaattagttcatttcattctgcccttttaggtaattttgtcactcgaatattctagtctacagtgtagagaaaaggcacaacacctttgctattctaaaacggtaatgtcatagcagtcaatagtactgaatgcctgtgcagtgtgtaccagtgctgtgcatgcagcactgtggtagctgtcgaggatttgtatagcacctacaagagacttacagtcttagcaagagaagcccagtacaatgaagtagttaacaagtggcagaggcttacagcgtggtccaaagtgctgtaggatttcagagaagagaacagatgatctgtaagaatgcaaagctgaaaaggctgaaggaaagactcctgacatgaggatgtgtagagttttgatgagtggaacagtcattacactttttcctcttacactcgttgctctgacacattatacgtttatttcttcatttttctctctcccttccaagtagaaattaaacctgagagggaagagtctttgcaaccttagcccatgtctccccagatcctataacactgtctgaaatgtagtgggtactcagtgaattcctgttaataaatgaatcataggcaagcagaatagaaatgaaggtacaggtgtaccatctgacattgaattggagtagtttttcgagctgaagggaaccttagctacctaggcctccttgcatttagactgtgcttcacataatcctaagagtttcttgccccctcctccctcaggttatcaggatggagcaactagaataaggggctgagttccttcctgttccctctcccagcgcagttgtgct

SEQ ID NO: 29441 - DNA, 1050 bp, Homo sapiens
tgagacaaggtcttgctcttttgcccaggctagagtgcagtggtgtgatctcagcttgctgcaacctctatctcccaggttcaagtgatcctcccacctgagcctcctgaatagttggggctacaggcatgtgccaccatgcctggctagttttatattttttgtagagacagggtttcaccatgttgtccaggctagtctcaaactcctgggctcaagtgatcctcctgcctcagcctctcaaaatgctaggattacaggcatgagccaccatacccagctaaatattcttaatcatttttatttaaaatgtaaaaaattatgtgttcatttctactggattactttaggattgaaataaactagttcatcagacttagaacctggtcacctttgattgccatactctttcaagcagttggatagataccaagaaagaattgatggtgctgttaaatatatccagtatctctcttctcccagcaaagtgcctgcattcgtgaggatgattgctcccgagggctccttggtgtttcatgagaaagcctggaatgcgtacccctactgtagaacaagtaagcttggcccccagcagccattgcacccctccaccctgagaatgagagggattcccagtaccagtgtctttgagaaggtttacactgagcaaggtcttccttgggttcttggatagtcactgctagaatgatggcagaggaagggctgcattgggttcctccccctagaactttgtgacaggcataagttcattcccacatggcagccactttggggtcctagctgactatgctggctccaggggtaagccaaaagaaaggtcgtttacactcagaagggtgttttggtgtgtttcaacagtattttacttaaattgctacataatagaggaggaataggacagacttctgaaacagcatcctatcatttgctaaattgaccttataaataatgttttgcttttgtgacattattattctttttagcattatttttaaaattagattattgttcatattttatttgtactcc

SEQ ID NO: 29442 - DNA, 1048 bp, Homo sapiens
catcagttgttgaacatttgggttgttttcacttttggctgttacaagtaatgctgctgttaacatttgtgcatacttttttgtgtgtgtgtgaacatgttttcagttctcttggagatatatattgctgtgagtgaaattggctgggtcatatgatcactctgtgtttaaccttttgaggaactgtcaatcagcttcccgaaacaactacaccactttataatgttatcagcagtgtatgaaggttccagtttctccacatcctcattatcttttttattacaagcattctagtgtgtgtgaagtggtatctcattgtggttttggttttgatttgcattttcttggtgattaatgatgttaacatcttttcaagtgctttttggtcatttgtatatcttctttgtttgaagaaatatctgttcaaatcttgtacccccactttctttttagttttttttttttttttttttgggagacagggtctcactatgtcatctaggctggactgcagttgcttgatgatagctcactgtagccttgaactcctgggctcaagcaatccccccacctcagcctctcgagtagctgggaccataggtgtgcaccactgtgctctgctaatttttttttttgtagaggtggggggtctccctgtattgcccaggctggtctccaactcctggtgcttaagctatcctcctgcttcagcctcccaaagtactgggattacaggtgtgagccactggccttggctgcccattcttttttttttttttttttgagacagtttcactcttgttgcccaggctagagtgcaatggcgtgatctcggctcaccacaacctccgccttccgggttcaagagcttctcctgcctcaacctcccgagtagctggtattacaggcatgcaccaccacgcctggctaattttgtatttttagtagagacggggtttctccatgttggtcaggctggtctcgaactcctgacctcaggtgatctaccctcctcggcctcctaaagtgctgggattataggcctgag

SEQ ID NO: 29443 - DNA, 1703 bp, Homo sapiens
agaaacagtctttgtgaatattgacaaaatctgaaagttggttactcattgcacgggacatttgaaatgtctggtttccttgaatctcaggtgatacatcatctcatgggataatgagattttgtccatattttgtttgataacttagagtgagtgtttgcccatggtaattctgaacagatctagtacttatgtatttttactgtgtgctggtcactgggttattggaagtgttttaggtgggagtttattcattcctcacagcaactttttatagtgaggaaactgaggtccagaaaggtttaacttaccacatgtctcactgctatttggtagcagagataggacttgaacacagaccaactccagaacctgccctcttaaccactttgctcaactaaccactttgctctacgtctgaatcctgtggaagagttattttccatttcctgaagttaactccttgggagtttagagaaaaattcttccaaaaccacaggtttcaccatctcttactttctctgaagtctttaacgtctaaagtcttcttccaaaataaagctaaacttaacaaggtatttaagattcccaattgtataagtccatccagaacaaaaacccttggctgtaagcaatccagtctctgctgtcttcctaacataaactgttcagcccaccctgagcgtttttttcagccccttatgctggggcctctcataacctgcttggttttctgagtacacctcagaactatcctatgcagaggcattccatggctgattttattcacttcgatccctcttccctaaatccatcatatttgtcatttcgactcattttgatacctagtcatatatttccatatgtgcatgtttgtcttgttgtatcctgttttccactaaagtttgtttctttgataataacttagtagtagatggcagtgaaagaggaaggaatttactgggcagagaattttggagcaagacaaagaaatgtgttgtaactttcagatggtatttcagagaaaagcttgtagctctcctgagacctcactgtacgaacacactgaccagtcctttttgctagtttatttgctcacccttcttgaggaaagtcagctttattatttcttattctgcgtaagtgttacactttcgccatcttcagtcagtcctgattgatggggaatttataaagctttgccaactccagaaccaccttgtttcccaaaggtcgaaacagaagaggtttttattgaaaaatagttattttaaaatttcatgtggttccaaggtaagagttcatttttgtaagcaaaaggagtcatttgccaggaacttaaattatgtttaaaaatgaggaatttaaatcacttgaaaatgaaaggattgattgtaacatacttcttcacattcagagagcatcttgcacatgtaagaaattaataggctgggtgtggtggcttgcctggaatcccagcactttgggaggccaaggcgggtggattatttgaagtcaggagttcgaaaccagcctggccaacatggtgaaaccccgtctctactaaaaatacaaaaaatttagcggaatgtggtggcaggcacctgtaatcccagctacttgggaggctgaggcaggaggattgcttgaacctgggaggtggaggttgcagtgagccaagataatgattgtactccagcctg

SEQ ID NO: 29444 - DNA, 1037 bp, Homo sapiens
ggtggctcaggcctataatcccagaacttgggaggctgaggtgggagtattgcttgagctcaggagtttgagaccagtcggggcaatatagtgggacctcatctccacaaaaagaagaaacaagccaaaaaaaaaaaaaaaaaaaaaagtactaccagtatttatctaagggcagaagaccagtaatggcttttaagagtccattttgtcattgtctccctagttaattacaggtgggggatcttttgcctctattctcttcatattgaaatgaatcatactcatgttttgtggaactccttaaagttgtagctgtcatgatcagattttttttatatttcctcagcttaactctgctacttgatttacagtgacccataacctactcatccttggtttatagtgacacataatcttatctctttatagaaccttaaattttatcattattttcgcttagaatacagcatttctttgcttctgttgctggtttgacttaagaaataaggcagtaactctgatcaatcaattatccataaggaaggtcttttcatggtttctattaatttgttagtaccctaagtatatctgaaaaatatgtctattgagagaagattttggcattccagatggtatagtctatatatatttaaagttttgaatttgcttatatatactcagctttctttttctagcatttttgcatttacctgttaattgaagtataccccaccacatataaaagttcctcttaaagacactggactcttcctgggggttctaaaataagccaaaaagtttgatgtataaaattttttattggcctctgatgttctgtttagatcactatcctataagtaaataaatttgaaatagattcaaaatgtcctctggttgaaatctaagagttggaatgttgaggaagtgtttgatacattcttgcatggaaaagaacagtttgaaataatgtgtaatacataatacattacatgtgttttgaaaaaaatcagaaaaaaaaaaagcctaaaagaggtaca

SEQ ID NO: 29445 - DNA, 1034 bp, Homo sapiens
tcacctaaagaggtaagcggtgttcacatttgacgccttgtaactacctggcttacttatgatgcatgtaactagctaacttaactagtagatgtgaagtacatttttaatttcagtttgataatatattgcattttaattctttggcagaacctcctcctttatttgtaaattagaaaaggattatatctgcttataacaaaaattcagataaaaacttagtccctgctccttgccatcaaatatttgtaacacagagagaaacactagaagcagcttagagtttatctttctagatcattttctgtatatattcaaaggaatttttaaaacatagcgatgtattacttgtatcaattttagttttctacaacaaatggaccatatgaatggttttgcagtttgctttatttctgatgaacatcttccatattgttatttaatatctgtgtgattctttttaaagctaagtaaaatttcttctggacatagtatagtttacttaaccattccctacgttgtaagtccatttaggtattttagaattttctagtttttgtctgttataaataatgtttctggccaggtgtggtggctcacatctgtaatctcagcactttgggagacagaggcaggaggattgcttaagcctaggagttcgacaccagcctgggcaacacaaggagaccccatctctagtacaacaacaacaacagcaaaaaaattggccaggcgcggtggctcacgcttgtaatcccagcactttgggaggctgaggcgggcagattacgaggtcaagagatcgagaccaccctggtcagcatggtgaaaccctgtctctactaaaaatacaaaaattagcctgggtgtggtggcgcacgcctatagtcccagctacttgggaggctgaggcagcaggatcttttgaaccgaggaggtggaggttgcagtgagccgagatcacaccactgcactccagcctggtgacagagcgagactccgtctcaaaaaaaaaaaaaaaaaaagaaattagt

SEQ ID NO: 29446 - DNA, 1066 bp, Homo sapiens
tgtgagcagtgcgctggcttcctcctgcctcaggaatagagcccttcatcctccctgaagggaagattcatgagcagcgagggaagattcacgagcccagcccagctggcatttgtcatcattccagagacatgagccacgcccctgacccctctgccccttggctgctcttcgcagaccctctgtggcctcacctctctctgcatgcatgctgggccctctccttttcccgccaccacacagactgtgtgctttggagaaaatgaaaatgttcccgaagtaggttaataaacatcatctgaagaataaaccaataaagacagagtgaggtgagaagatcctctgctgagagctaggctgtcagtccaactgggtcccggcagccatgggacagactgtgagaaaagtgagccagtgccacctgctggagccccggggtggtgcagctgtgaagcccggagccgcagcccccaggaggggccacccaccatcacaccacctttagggacacagcggctgggagggcacagcaaaagcccctatcctgccaagtgggaggcctgatgccctaccagcctggtggctttgtgcaggtctcttgctctctctggtccttggttcctcatctgaagaggaggagtaacctcacaggccctgagccggtgaggccgccgtggcaggcctggctgtgccggcagaggggtgcatgtgtgttctactctgggctgtcttcattcctaaatgggcagcatggcccctgccacggctcacgctcctgccatgtgggaagcatgtttccacccctttcaaagctcccattctagcaagcgaaaagcactgttctctagagcccagagagctgaggcaaagagaagtcagccagggcgaaaggcctgtggagatcagagcaatactatatacactctaaagtgctgccttgaggagcccccggccctctgtggccgttcttctacaaagcagtgaaggactagattgtcgtgacagtgtaggaaggtggacggcagagagcaggtcatccctcacactccagtgcacacctgttagc

SEQ ID NO: 29447 - DNA, 1011 bp, Homo sapiens
tctgttaggttggagtagtagtgagatggctgcatctaagatcacgcactcatccagatagcgagcatgtgagtggtgactgcagaggacattgtgctagacagaggggagcaaggataaggacatccagactcctatccagaggtgctcacaagagttgaagagatgtgactgaatttgcaccatagcgttctagaatgttagggtgttttactgtacttttaaaatgattaaagacaatgtaaaggattaattctctaatttcctggttataaaaagtaaaacctgtgttgatattgtgatttgcaattttcaaagtacttattatagctcagtgaatttgatccttaaaataaccctgtgaggtagaaactatcctctttatagagaggaagaaattgagtctctgaatcttgccaaaagtcacacagccaattagtggcagagttaggaacacattctcttagcgctctccgggtctatgtctcttagtcttagaattctgtacttgatcttagccaaaaggccgagaagcaagtagtcttagaattctgaagtttggataaatttaaaatttgatactgagtttccagcatgtaaatatcagagtcatcttagacagtgtggcatgagggggaaaaaaaaggaaaatatcagagtcagaaaagtctgatggcctcactgatggaggagcctgttagagcatcaggacaatgtctccgttaggaatggcaattgtctggtcctcagaatgtctatgtgagtgggcatggctccttgaggagcttgcccagtgatgatctgagcctgggacactgaaccatctgcaaagagctatcgcccttcagagagtgtggcgctctcttcccctcaggctcgtccatttccgggatgccttcaccatacctgttctcactcccatccttactcaccatgaggcacgagggtggtgaattgtggttgcctgatgacaagaggagaggctttttgttttaataaaaatcagcactt

SEQ ID NO: 29448 - DNA, 1050 bp, Homo sapiens
agagcacgattgctacattgctcaagctgttactgagaatgaattctgacaaaagaagagaatttgggtaattataaaaacacaaaataggtctgtgtgacagtattctgctcatgggtatcaggaagaagaacagatctcttcccaacccttccccctcccacagacatggttactcctctattctaggcggaattgttgagtattcgatttgtgacttagaactcggaatatttgctatgtgaaagacatacatgatctggtgagccaacacttactgggcacttactttgcctgaataaagcagatgtctgccttcacgatgtaccttggaggcattactttttaaaaaagttttaccttcccagggagaatgtctagtaagaatagtgaatgttaagtctcacataaacccagatgaaacgagatgttcataatctgtttctttttcttgaaatgcatttttattaggtatgtcttccatcagtttcagaaaaatctggaagtagagcctacattaaatgcaaaattatttaaatgaccaaaaattatagttacttaagaagtactgaagagactcttttggtgtaataaatgaatcccttgtgcctgtgttgatgtggcttttcttggtgagtcagaagaggtttcgtggttgtggaattaactgtttgatgtgggaggtttgttttggtattaaatggtcctttatatggcaaaaataatctaaccaaattcttggacttgtcgtgaaaagagtcctgtgtattcttatgtcagagttgataggaaggagagattgtgagtgtgaaaaagagcacactgctacagttgtaaagggttccttcagtttctaggagacagctactcttttcccttagtagaaatattaatgagtgatctccacaatcaatttgaacctttattctataatcataccacccagatcatgaaagaattatgacataatgcagtgtatatatgtatccgctttcttactgttccctttcagtgagacgtaatgaaaaatgcatgcattttagggtcttt

SEQ ID NO: 29449 - DNA, 1192 bp, Homo sapiens
attttctccctcctttacatggtcctttgccctatagctaaatgagagtctgattagcaggctaactaaataatatattaacctttttggatcttcatccaagaagtttacaaagcatgactaaaatgaagtcttttgtgcaggtttgaagaaccctaatatttatgacttttagacaagaaaatcactaggatatcacactgtttcttcttttaagtacatgaacttaatagtctattctctgtatttaacatctagtcttaggaaactaatgcagttccacttttctagatattcaaataacagcttccattgagaatatatgaaaaggcctttgtgatccctccagcacacatttgaagtggcttagaagtcacaataataatgataaaggaatgacacttattgaatgcctccagtatgtgaacactatacttggtgtagcttcttatgcagcgattcattgtttaatttaataattcagaaagatagggcttattattcctgtttagaaatcaaaaacccaaagaacagagaggttaacttgtcaaagatctcatagtaagtgtgtggcagagctggggtgtgggcctagagctgtcagaatcaaaagtcagtgctcttttatgttacaccacctctcaaaagaaaatgtctaaaattatggagaaaagagataaagctgtagcatttctaagtgagtaggacaatgtgacattgtaactggaaattgagcatttctctttacccacagcttattttcatcctcgttcactcatccctatttcataacggctgtacttaagcacacatacagacctaatgcaaggtggaaacgtggctgctcatacactgccacctgaagtctcccctcttttccagcatgaaatccacaagagacacaagtgtttaagactcttcagcataattagtaatttcatggtaacttcaaaaagtagcttttttactgagaaccagtttctgcatgttgttcccgaccgaaattcttcttaaggctgtctctgacacagcagaaaatacatttgttgaattagatgaaagctggaatgcaacttttggttcatattgctgactaagcctgttctcaacttgactttcaaatagctttgttagctcctgaatacaggctctcagttttcaacagatttctgaaagtggtcctttatgccat

SEQ ID NO: 29450 - DNA, 1047 bp, Homo sapiens
accaggagtcctcatcatttagacatttaattttctttgaatgaaagcatagatacatggctgtgtttctctagtgttccctgtagtgtctaacatttatgagtatttaatacatttttatcataattaatatcccaaatggattgggattttctctgggggatggtataactggaggcttaggaatctgtggcaaagattaagtgtttttttaatgaattactgtttggctgtgtgtgagggcatcctgatttacttaatcattatgttccttgtgtggcagggtagtctttcacggagtgatgagagtcaggctactgtttatggtattggacacatggtgtggaaagagcataggcctcagagttagatggagctggatttgaattacagttccagtgcaatatggaaaatgtggacagtttcacttttcttgcaggattaatatgagaatagaactactgcatgtaaaggaccaggcaggacagtctcctgataaagatagctattactattaccgtttagacagagatattgaatccatgtgaccactaaaataagcaggttgccctactctctgtgtcagtgatggtttgcatattggctgatatcctatcacagtgtattaattcctaatagttgttgagttcagttctaagtgcctagaagagaagagagtgggatgtctttctctggggaagcttgcggtttaatccgggatacatagggataaactatttgctgaagtctatgcaacagacacatgctttggcattcagaagagagagagtgcccctatgggaaggggaagtcaggatggattttatgaaaaggtttacacttgagaggaatcatgaagaatgggtgaagttttgacaggcagaggtaggtataaggagtgggatcaaggtattaacaataaggcaatgaataaacatattttcttttgcttttttgtgttttcgtttttaacataacaataacataatcaaatgacctttggaaggcacaacatcagtctccttgtgatgagtgaggcagagataa

SEQ ID NO: 29451 - DNA, 1034 bp, Homo sapiens
tggcaaacatactcttaacgtgggccccatgattcctgcctttcttcatgcccttgtgtgatccgtttcccttgagtatggatggatcctgtgacttgcttctaaccaatagaacatggcaaaagtgacagaatgtacattattttgtgtatatgattatgtaagattgtagccctcattttgctggagtctctctctcccttgctggctatgaggtagcaagtagctatattggggaaccccatgtggcaaagaacttcaggtggctttgaggagctgagggcagtctcccctgacagccagcaaaaaactgaagctctcagttctacaattgcaaggaactgaatgctgtcaacaactgcacaagcagggaagcagatcctccccaaattaagcctccacatgagaaccaggtctagctgacaccatgattgcagccttgcagaggacccagtgaagctatgcctggactccttactcacagaactgtgagataataaatgggtgttattttaagctactgaaactgtggaaatattgttactcagcaatagataactaatacaatgtctcagtggagcaaaacaacatacagcaattagaatatctgttctggctaaatgcttagcatctggtaattagatgtgtaattgtgctttatcaaacaatttttctctctcctactaacattcctaaggaaatgggaaattgctattttctacatggaattggttcatcaccttaattgtcttattcctgaaacaggtgtcctagataaaggacaccagatgggatccagcagctgcagtaggaaaactctggaatcacagagactctgttgagtgtaaccttgtgtgtaatagaggacaaagaaaaaataaaagaactcttaaagattttcttgagagtgttcaaaaggtgtcagtggtgtctaaagtatagtgataaatggttcaggatgaatgtttgtcatcccttttgaaactgagacacttcacaaaggtttactggcagaaaatacaaacattttctaa

SEQ ID NO: 29452 - DNA, 1094 bp, Homo sapiens
attgtgggggtctgttctgtgcatcgtaggatgattagcggcatcactgacctctgcccactagttgccagtagcaactctcctaccacaagtcgtgacaactaaacatgtctccagacattcccagatgtccctggagggaggaaattgccctagctgagaatcattgctatagaggatgaaaagaaataacatataaagtgttttataaactgttagtctgtacaaatattagtcagtctcgtgggattttcccgccaaaatccaaagcccgtgtagaagggaaggtttaatatcaggcttttgtgagtttttatttctttataatgtcaggttttataactttcttgtgaactttactatattaatttagaaagccatttcttttcattttccatttttgagatatagtggaaaaatgtttattcatgtaggtaccatgtacacattaaatcttgaacctagccacttgtgtaattgtgcttgttttctataaaataccttctgttactgaacagtgagaccttttcagagaaatctctttgggaagttcaggctataatcattcaggatgttccactgctgtggccaactgtggggatgcaaaaacagatcaaatctagttcagataattaagttctaaaacacagatgtttgaagctcatcaaaatagattatagaagctgaaatcattatagtagcttcctgtaaacgtttaacaatgaatagtagaagtaaatattttctcaatttcaatttcttcttttgaagaagaaaccaaggtatcctttccagagggactttgctggcttcacccaatgtggagtaaaagtttctttttcacatcctttgcttcttatgctactgtataaattcttctctgaaaggaaggagcctattgcagtaagcacattggtatgttctcagtgagtatttgtgggatggaaagaaggaaggaccaaagagcaagcagacaagccaggatgctgcacaacatgctggctctggccgcccctctccatggaacacaactgttgtgttcagtgtcatgctgagagcgtctggacagaagggcctttcagttcctggatatt

SEQ ID NO: 29453 - DNA, 1072 bp, Homo sapiens
gagcagttccctgctgtgatctacagacatgagccactcttgtattaggtttatcttgtgactgtaggaggaattagaagagttaaagatgcaaattatatattttgacctcttcagggatttggacttaaaatttaaaaataggactccaggctcaatcccctgccttgtgtttaaaaacaaaaacaaaacaaaacaaaacaaaaaacaaacaaaccttagtctcagatgttctgattttctctttgtgtttctgtgtattaaagaacttatccgtgtattcagtccatgtattaaagcatttatcccatgtgttaaagcatttgtttacatatctatctcctgctgtagactgttggttcttcaagtgcagagactatgtttaatttatctatgtattcccaccttccagcttctctttctagcacagtacctatacgtgctagatatgtagtcagtagttgtggcatgaacagattgttgaaagaaaagaaaagattgttgaaagatactgactttagaacatacctaaataagtacttggggataacttgggcatcacccaagttatatactagtatttattataattcatacccataaaacacttgatacatttttcatcagtacaggcttcccacataggtgcacacatctctcttaaacattttgccaaaacctcacacacagaattgagtaatgaggttagacttcctattaggtcatttctcttggctgaggaggattaaaatcctggaattggaatgaatgagaactaatagtttacaattatataaaatttttctgcccatacagaaaaaattttggttcaactcacacttgacttaatgttcagacccttcccagctgctactataggatatacgtctaagggaaaatatcctatttctctcgaacctcccccagtctctctctgtattctaaaacatctgtgtaattcagggaaggcacctggatgaatctggcatggcatgtaaaggaaatgtggaggaacctcttttgaagaatctcctctgatgtccaggagaataaaagggttgttttcttttct

SEQ ID NO: 29454 - DNA, 1019 bp, Homo sapiens
attaacattccacacattagattgtggtacgtggctcaaaaaggttaaataaatcgcttaaggtcacagattaattactaatcatatgccaccctatatttgtgaatcactttacacttcagttagtaattcatacatatcctatttttgtttctcctaacagtgatagagccaggtatagactccagttctcacatttccagttttgtagctgtacttctgaacctggtgttggcaaacttcttctgtaaagggccagatgataaatactttaggtttttcaggcccagtggacacaactaaccaactttgccattgtagtatgaaaacagccatagataataaataaatagctacagctgtgttctaataaaactttatttacaaaaataggggtgagtatgatttggctgactcctgctctaaaccactaacttccaaactgctccttacaaaaggccttttatcgttcccatctgtgtctcctttcagtctcccatgttttgaaagttggactttgaaacaaactcaatattgaatgataatgagtgcatactcccatgtttaattaattagaggcataaataaatgataaccaaaaccagtcatagccatctttcttaaaagctgtgatcattgagtcagaagtagctttgtgatacccagagttcaatttcttattaagggcatagccacctagctgatgacttgaaaattatataactctcggctactttaccacttctttctttagcttctgtagtgccaaccacagaaaggggccttccttgccatcaggttgtgagatgaattctctgatgtctgcatctctaggcttgcatctcagccactgtttccagtcacttaagggtttgtttgtcagtcagataactagaatatagttggcccactatatccatgggttctgcatctgtggattcaaccaactgctgtttgcagatatttgagggaaaaataaatggttgtgtctatactaaatatgtacagacttttttcct

SEQ ID NO: 29455 - DNA, 1031 bp, Homo sapiens
ataaattctttatattgcttaatgataccatcatttacctggtcactcagataggaaacctgccctttgatcctggactcctcttctgcagtccctcttctactcagatactaggacttggtgttacctccttaatattttaaatatcacacctagctcctccctatgtggagtaatcttctacctgttcctaccacaatacacagttaagtcatcatttttcatttaacaagtatatattggatactatgtgccaggtactgtgtggttggtgctgaggttacagttgtgactaagacagcaaagttcctgaccccatggagctttaatctgcatgtaggagagagcaaacaaataaatgtgtaatgtataatatgatgttagaaaataagctagtgcattgcagtaacatttcattgtcacctagtggtgatttaggcaatttgcagtctttgtttattggaatgtgaataaaatctctcttgaagattccatctataattaaagttaaataccagaactataactatttatctgagttttatatgtgcaaaaaataaatttacttcaattgatttggaagtctgaacaattgttttcattacattgttgaaatatattccttaaagaatttgattgcatatattgttttatatgattgctttttatttaagctatatttagaaaatgtcccagaagtggaaatatgtagtcaatatatactccccctcaagagtatttataattttcttttcatataatattttgttttcagtccattctctgaaatatctgtgtaacctttctataggtatctttaaaatgatttgagtgtttcaggaaaaaaacaaactatagctactgagttgagtgaatactggagtacttaaatcccatctcagtatttgacaggaaggatgtatatttgggtgtttttttacccattttatgctgttcttttgggcctgctacatttggtaatgaatcagtcaacatgtttctaaaaccagcagctgaaccatgtaattaat

SEQ ID NO: 29456 - DNA, 1047 bp, Homo sapiens
actgtgaatagtgctgcagtaaacatgggagtacaggtatctctttgatatgtcgatttcctttcttttggatatatacccaatagtgggattactggatcatatggtatttctatttttggttttttgaggaatttccatactctgccccaaagtagctgtacttacttacattcccaccaacagtgtacaaaggttcctcattctctacatcctcaccagcatccgttattgcctgtctttttaatacaagtcattttcttgtattttatttcttatattatttttagagacagggtctcactccatcacccaggctagagtatagtggtgtgatcatagctcactgtaacctcaaactcctgagctcagacagttctcccacctcagcctcctgagtagctgagactgtaggcatgtgccactatgcatggctaatttttttgatttttggtagagatggcatcttgctctgttgcccagcctggtcttgaacttctggcctcaagcaatgctcccacttcagcttcccaaaatgctgagattacggcatgggccattatgcccagtcttatgtgtctgtttttttgctttttgttgttgtcattgttttttaccagtaccatgctgttttgattactatagctttatactaaattttgaagtcaggtaatgtgatatctccagccttgttctttttaccctgaattgctttggctattcaggttcttttctggttccatctaaattttaggagttttttttctatttctgtgaataatgtcattgacattttgatagagacgcattgaatctttactttctttaactcttacattaatctctttctctttaccatcagcctgtacatatgttcaagtctctcgtattttttttttttttttttgagacggagttttgttcttgttgcccaggctggagtgcaatggcatgatcttggctcactgcaacctctgcctcctgggttcaagcaattctcctgtctcagcctcctgagtatctgggatacaggtacctgccaccaca

SEQ ID NO: 29457 - DNA, 1065 bp, Homo sapiens
atatgtaatagaaagacttttaatcccattcttttctagatggttaaaatagactcctattccattagctaaatagaatggatatagtagtatcttggagttagttcaaaatgtgtcccctttaatgcaaaatgttatagtacaaaattacaactgctactggttttctacttcttccacttctgcttcataaaaagtgaattgtttagaggcatgtttatgtcctgtgatattatgctttaggacatgtgattgccctgaacaaagcacaagctccactagttcctaataaattattacatctttcacatctgttcccgtcttttctctgaagtgttcatccaagagagcacagcatcaactgaaaatataagaattgtgggaagacattttcctgataaatgcatagacagttgacttgttgtgattagaggaatatcgcaggagcagagggttggagctgaaaactgactttctgcctctactgccagtgtctccttttgtccttttcctcctctccttgcaatttcctctgagagaaatcatgtgaccatgtcaccatagtttttaatgccaaatatctaagtgtctttaaaatgcagcacaacacttttaaaggcaaatagtgaagtagtttcaactgacatttccattatagctgttcttagtggattctaaacatcatacataaatgtggctagccaattctttttaaaaaaaatacaaaccattgagctgtcttttcatatttaatgcttcatccattgaacatgcaacacattttttcatagaaacatacattgatctgaggttatctacaatagtccatactagatttttctagcatttatattttagaaataaagccatttctcatagttttgtaacatacccgagcatttctgggctaacatcagttactctgttatctctagtactctataagtccaaactgaagaaaaatgttaaactgccaccattattgcaattactgtcaaattgttgttttacttagaagtgaaaattgtgttctaatattgtgtatacactatttggtttttcatc

SEQ ID NO: 29458 - DNA, 1047 bp, Homo sapiens
aggtgaatcataatcattatcaatttgacacctgtgggtttgcatgaacagttactgaccaaaagaaaagactatttttgactttgtgagaaaattgagccttctggatttcctttaggatgtagctacaggaaattaattagatgatttttgatgacatcatcctgaccacagcactttctctgaaaacagtgctatttttcttggacctttttgcagacattttctacactatgtgctttattatataatttgcaataatgctaacgtgaaatccatgcaaaggcttgtggtgtgtgtgtgtgtgtgtgtgtgtaagagagaaagaatgtagttgaggtaattattttacttctaatagtacaggagagtgggttaaaaggtaaaaagcattacattttagcagagaaacaaatcctcttagggagtattaagttcatgaggggaaggcttggcaacttttctggggtgtgtatcttacaggcttttgggaaacaaataggattgctaaacagtaactctcaaatcactgaagagtgtaggacttggaaatgcttgcgaagaatggagacaggacatcaatttcttgattgtgttctttgtactttgtattataaatcggctgagtctgactttttgggcctgtagtgagttataaaaagctctttttcttctgctgataaaataattaccacctcaaaagaaattgtacacccagggaatatatgtatatatatgtataatgtatgataatgtttgcaaatcattctgccctcagctgtttcatcttttccaactgtaattttcaaagttctactttatcatcactccatctattatatttttcattcttctctttcagtcataacattttgtagtctcttcatatgtagagtagaagcaacttgagaataggaattaggagatctaaattcaaatcctggttttgccgctagaggccttctatcatggacagacctcttgtggaagctctttgggctgctagttcatcacctgtaaaacaggaagaccagattatatgattgt

SEQ ID NO: 29459 - DNA, 1018 bp, Homo sapiens
aagacagaggtcttgctacattgctcaggctgtagtgcggtggctattcacaagtgtgatcatagtgcacggtggccttaaactcctggcctcaggcagtcctcctgcctcagccccctgagtggctgggactacagacacacgaatgcatagcttaataggttgtcttttctactgttgctctcagatgcttaataggggaggtggtatcttctccacaggatttttttattctgactaaccttctgtctactttaatggcttcaaaattaattttaattgcccacagaggccttcctatgagttaatatgaattgtcagaagagtacataaattacataggattagagatagtgttctctattcaggaaatctgatatacaaatatgctggtaactccaaagtattttttatcagtctgatttgtctcttgagcttcatactctctacccacctgcctcctggatacataccttcaactctgttgactgagccctcaatctgtgcctatttctgcattcaccattgtcctgttgcccaaaccacctcctcccctcactctcatatttggttagttacttgattctcttcttctgtattagaaatctctttcctgcctcctcccatctcttttacctagactgttgcagtaccctcctctaagaacttttcagagcttttaatagatattcttatgcaagtggaggagaaaggatgtatactacttgggtctgtgagcaaagtctgaagctgctgctgtgagtagataatttctttccaatataggatagtggttgagagagtgaaattagatagtcaacaagcttgggcttgaattttggctctgccatttattaccatgtgacctaaaaattatatagctttttttttttttttgaaacggagtctcgctctgtcgcccaggctgtagtgcagtagcgtgatctcggctcactgcaagctccgccttctgggttcaagccactctcctgcctcagtctcccgagtagctgggact

SEQ ID NO: 29460 - DNA, 1043 bp, Homo sapiens
gggattatttctattttgtgtaagaggaaactgaggtccagagaggttgtgacttgcctaaagtcacagtaaggtatagaaactgagatgggaactcaagcctcttggctcctttccagtgctctttttctgtaacttcagtctgagagagtttgctctttgctttctctgcagtattctttagtaccattcaggcagatggatgggcatttgttcagtcgtggtaatggacatggattatgttcccatctgtttggttgaaaatcagtgactatactgagcaatgtccatttaaaatattaaattgcatcaaaacttatgacatttaaagtgcttttacaatttagttaagataacaatttcatctgtttctatgtaattacaggggttttgaatcatttcaatttagcaggctgaaaaaatatgacctctggctacatggccttttcattttatgggtgtgtacatgtctgtgtgtgtgtgtgcgtgcacatgcatgtgtgtgtaactgatgaacttgggaaggtttcattaccttctgctctgcttttccaaaggccctaattgtctctactgcaacccccaagccttctcctcctgtctgctgacagcagtcaggatttccatgtgacacagagcagcagattattgattttgttttttgtcagggcactgtgtgtgtcatttgaggtggtcttgtgggcatttagttcatcagtgattatgcacaggacccactttagcttgagctaggaaggaaatgtcaaacaggaaaggactgggacgattcttttaagagtgagcatcagggaatttatactagagagaaacactgacctgtcacttctctttcagcatttcactttgatttccagttgacatgtttaaagagcctgacatttcatttctctgtgttcacttgagcagggagtatgggatcagaagccatcgattggttagcagtagtctataactcttaagtagcatttggtcatgaatgaaaggtccgcatgtttgtaaggcagctcccaaacaactggata

SEQ ID NO: 29461 - DNA, 1015 bp, Homo sapiens
tgcaaattggcccatctacatcactatcctggtggacaggtacagtttttccagtccctatttcatgggcagaccttggtaactcttggttttattcaggtggctcattcctaccaagcagcttgcatgaagcctgcagcctgggtacctcttgctgagggggtatcagtgggctacccccaagtggttgaggctaatgactgactctaagtcctcctgcttcctgggagctttattggctccagctcctgcttacctctctgacttttatttcctcattgtttctggcacttaggaatttccgtttcttgaacatgagctccgaaatgtagcctaagattattttcatatattctgctcattctttgtttttagatttggagctgtgcctttccacaatagccctatataccatatttgctgtactgactgcaagcatctgcacttaccgggagatatatatatatatatatatatatgtatatatctctgtctaataggttcttagaattttcgattaatcaggttcttttttcagccctaggatattactttgcacatagttggtattcaataacaagctattaaataagggataagtagatgagatctaaggcattggttttcagttttgaaagtttatagatcattggtgaaaatttaaactttattattgcttaattttgtaattttcttctgccttatttttcttcttaaatgaattctgtgtaacctgttaattaaagtgaactgaattagagggtgggttgtagaggggagaatatctagaaacgaacacacagcagagtattcaaaattgtatcatgaatcagtgatccaaagagggaggtaagtatcaataagccactaaaagatattcttagacagaatcagtgaaaaatccccagggacccttctgaaagaagagagcagtgttatcagctccctgtgtatcaaccatttgtgtctcttcgtgaaattctcctccttatctttaaagcagactttgataaaa

SEQ ID NO: 29462 - DNA, 1058 bp, Homo sapiens
tttattgcagggtatcaaggaagtaggtctcctgatttcaagtgccttattcacagtgttctacccaggatcccagaggaagctgcagacttagttaagtgagcaggattctagcactgtgctctgcctctcttctctgtttgcatttaagcaggccctttttaatctgttttttatactggaattctggttaagattttgtttgaagaaagatcctggctgcttcaagatgatgatgatgataaagacaaaaggaggagagagagagaaagaggagaagagaggagagagggaaagaagagaggtaaatattttggcttagtactcagatgttttagaatgagacctgactgcaagctctatgtcatcttggataaattacttctgggccttgattttctcttctgttaattagagatgtggcagggtggggtggggtagggaaggtttaaagtagattatctcaaagtgtatggtatttttataatgtcatgtatattgcttggaatggagctatctgagctctgtgccctgaccctgccactctcacatccccaggccaaatggtattgtgaagttatctaatcctgacattgataagacatctttcctgtgtctcagaattaatcaaaatgcccagtagggtagcctattgtgatctataaacacagcttctcttgttaccaacatgcacctgcttggcatttggcagatggtgcttggacttaccatgaatcaggttatgtttcttgatatatatccatatacttactacttgttacttgacaccaggtgaatgccactgaatccagaaaggatttttcttttcctccaaatgtgttagatactaagaaaaactgaagcatatacagaggcatttattttctaacttcaataaaatatgtctcatatgaagaacatggattattggatttgggctaagtggattattagattaagttgggtagctgttttccttgacccaatcactaaaccaatttgcttgatcaatttaaaatttgatttgagaggctatcacagacaaaggttgtgtaaat

SEQ ID NO: 29463 - DNA, 1069 bp, Homo sapiens
ttttgtggccttttctttcttcttctattattatttttttattatttaaggaattagagtcttgagtcttgttctgccatccaggctggagtgcagtgccaggatcatagctcactacatcctggaagtcttgggctcaggcgatcctcccgcctcagcctgccgagttgcttagattacaggcatgagccactgctcctggcaccttttttttttaatatgcaacttacattcatgaacagcctggccaacatggcaaaaccccatctctactaaaaaaaatattaaaaaaaaaattagctgagcatggtggtgggagcctgcaatcccagctactcgggaggctgaggcaggagaatcgctcgaacctgctaggcggaggttgcagtgagccgagatcgtgccactgcactccagcctgggtgacagagcgagactccatctcaaacaaacaaacaaacaaacaaaaaacttaatatttgtatatcactttgatgtctgaatctttgtctctattttccaatgaggaaacagagtcagagaagagaagcaatgaactcaaggctaaatagctggtaaatgacagagtcacaactagatcagtgatttgggaactcctgtttaagtgttctttacactacccatattgcttcccagagaactattttatttgtgtctacatttacatactgttcaccaacaatggactttatattttttcaaggcaaggataatgaggaaccctatctttgtatttcacttagtggcgagcattcaatatataggtattatttacatgatatctatgaaaggaaaaacataatttttctgttactgtttacttccccaaattgagggtgattattgagtaattaatacatgtttgtttaagatactgttaaatggcaattctttcttcaaaacatggatgtgcaaatttactcttgagacattgtaattttgaaagcaaatgtcttctctgtaggtaaatttactgcattttcttttcagtataaagctttcctagaatcacatcaaatggaactgctacttgccaatttcaaggaag

SEQ ID NO: 29464 - DNA, 1067 bp, Homo sapiens
gtctcgatctcctgacctcgtgatccgcccgcctcggcctcccaaagtgctgggattacaggcgtgagccaccgcgcccggcctggtgaagccttcttatagaaaatgggactcgagcggggcttagaaagtttggaagattttggcagacttactggagggaaaaagtgtttttggcagaggtggagcaaagaacagaagtaggaaaatgctgaatgtgatcagacatagtgagtagagttgtgggtaaagattgcatatgggctagtgcatggggatatttagtgaaagataaagttggaaagctaggatggagctaaattgtagtattttaaatatcagactaaataatttgattcattccctatatagaggtaagccagttaaaattttgaggcatgaaataacctgatcagaggcatttggaaagtaaaaaattcacaataagtgagtgcctattacttatacttctactattaataaaattatatattttatattattttatttactcctcatgataatcctgaaaagtaggtattataagtgtggagagagtgtatgggaactctctgtaccttctactgaatcttgctgtgaacctaaaactaaaaatgtaaactgtaaaaaagtatattaaaaattaacatctattaaaagtagatattattatctacatttacaagtgaacaaactgaagccttgtaatcctagctacttgggaggctgaggcaggagaattgcttgaacccaggaggtggaggttacagtgagccaagattgcgccattgcactccagcctgggcaaaggagtgagactctgtctcaaagaaaaaaaaaagaaaaaagaaaattgcaaataatttgttcagggtcacatagctggaaatgacagctcaagtaaagcctatacctgtgtaatttttttttttttttttgacggagtttcactcttgttgcccaggctggagtgcaatggcgcaatctcggctcactgcaacctctgcctcctgggttcaggcaattcttctgcctcagcctcccgagtagctgggattacagtcgca

SEQ ID NO: 29465 - DNA, 1074 bp, Homo sapiens
tgtgaaaagaccaaatctacatctgattggtgtacctgaaagtgacggggagaatggaaccaagttggaaaacactctgcaggatatcatccaggagaacttccccagtctagcaaggcaggccaacattcagattcaggaaatacagagaacgccacaaagatactcctcgagaagagcaactccaagacacataattgtcagattcaccaaagttgaaatgaaggaaaaaatgttaaggacagccagggagaaaggtcgggttacccacaaagggaagcccatcagactaacagctgatgtctcggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaactgataccagccgctgcaaaatcatgccaaaatgtagaccatcgaggctaggaagaaactgcatcaactaaccagcaaaataaccagctagcatcataatgacaggatcaaattcacacataacaatattaactttaaatgtaaatggactaaatgctccaattaaaagacacagactggcaaattggataaagagtcaagacccatcagtgtgccgtattcaggaaacccatctcacatgcagagacacacataggctcaaaataaaaggatggaggaagatctaccaagcaaatggaaaacaaaaaaaggcaggggttgtaatcctagtctctgataaaacagactttaaaccagcaaagatcaaaagagacaaagaaggccattacataatggtaaagggatcaattcaacaagaagggctaactatcctaaatatatatgcacccaatacaggagcacccagattcataaagcaagtcctgagcgacctacaaagagacttagactcccacacattaataatgggagactttaacaccccactgt

SEQ ID NO: 29466 - DNA, 1050 bp, Homo sapiens
tatctttcctgacctattagcagaggggagcaatgtggaataatgggaagaacattggataataatgataaataagttttgctaccaaatagctatgtgatcttggacaaaccacttaacctctctgagtttattatttgtctgcattagtcatagttgtgaatatttttcacattcttagggcttctatatgaaatttataaatgcctttcctgattttgcttgctttgatgaaagataagccatagttcatatccaaatggttattagaccttgggtgcatggtgtttaaaaatattgttgctgttatttgaatatattttgtaatgtaaataattaggttgagcagcatatgtcaggggtaaaacagtcctacaaggatgtgtgggctgtttacacaaagtttatataaatacacagtaacaatgagtattggggttgttgctggtttttttttttttgtttgtttggtttttttttttgagacggactcttgctctgtcgcccaggctggagtgctcactgcaagctctgcctcctgggtttatgccattcgcctgcctcagcctcccgagtagctgggactacgggtgcccaccaccactcccatctaatttttgtatttttagtagagttggggttttaccgcgttagccaggatgggctcgatctcctgacctcctgatccgcccacctcggccagttattgctgttttataaggaaaatgttttctagtaccacacttgtctccctggaagggatagaagaaggagggaaggaagtagggaggcagggaagagaaagaaagaagaaaggaagggaggaagattaatttgctctctctttgtaaaaattatatatggcagatatttgtatgtgttaaaaacaaatcctgttgccatatccatgaaaatacatacatatgcatgcatatctctaaattgggttaaaggagcattgtcaggcctggttagacatacagtacaatgtacttttgatctccagatttttaaattgaaactcatgttcctgtctggggatttgaaatt

SEQ ID NO: 29467 - DNA, 1025 bp, Homo sapiens
ggaaggctgttttaaaaattgcctgttgaagatgaatatctggtgaattctcctcttggttgtagatgaggatggcttatcagattgttgtgaggctaggtgaggcaaggcaagggatggagtgctttgaaggataatatatggaccaataatacagtgattttggtaatatgaaacaacaagaattaaaaacttattatctttgaactgatagtatttaagataaatttatcagtttgtgtgattatagaaatttacttttctagttatgttttaggctgataatacaagtttctaggctgggcgtagtggctgacacctgtaatcccagcactttggggggccaaggtgaagtactacttgagcccaggagtttgagaacagcccaggcacctcgtttctactgaaaaaaaactagccaggtatggtggtgcatgcctgtagtcccatctacttgggaggctgagatgggagggaggattacttgagcctgggaggtcaagactgcaacgagctatgactgtgccactgcactccagcctatgtgacagagcaagcctgtctcaaaaaaaaaaaaaaaaaaacagttttagtctcaacttatacaaacattgtacttgatagggctcagaaatgagctgggtagctggagtatacaggcagggatttaaattttacagagataatgcggggttcatggtattaagagtttggcagcaatccccagaagttaagaaatttcaaacaaaggctgacaggagacagttggctggagaatgaaaaagtctggtagagttgaagtatatcatatattaggatcaacaccattgcaatgaatgttcattgccagatcactacagttagaaatgtaaaaaaaaaaaaaaaaggcaaaataactccccaaacaactgttttgatttctgtagtccatgtttaagtttaaaaacacatatatctgaaccagttattgtagtcctgttattttaaattgaagtaacaagaaggatatagaagtgataaactgg

SEQ ID NO: 29468 - DNA, 1019 bp, Homo sapiens
tgttatacgtgaagcagacaaaatgggcatttgcgagacaggatactatcatttacagttaaagagtcatctttgatgggctgccaggtatgttggaagttgaaggcatcgatttaatgtttctcctgaagcacttgggtaagggagctgaaggaaaagcaaaatgagccttcatggagacatcaggctaagggtggtatctgtatagaggacctaaaacagaaggtaacatgaataaatgttagcaaaactttgactttagatcctggcgtcatatttaaacaagggtgcagggcaattgttcattttatgagttgaactgtcactatggaatccacctgcccattctctaagccacatcttcttctggacatcagtattattaatattctgaggaggaaaacggctttattcataacggaatcatctgtgatgaagacaaaatgttttggaccaatcgtttttccatgtgtcagccttgtagatagtcgtgttgggtctctagcgctggttacaatagactattggccaatagcaaagactggtgatcatgttctgtattccctctataagtctggcaagagttggttgaggtaaacttttgtttacttctcctggtttgcttaattaacagattaagcccagtaaggagatacaaaagcacaacatctttagcttttgagattggctacttccgtaggttaaattaccttctggggactgggagattgtatagaagttagataggcctcttgctgatttctgacccaagagtaattagacttataataaaaaagacatcttaaatcttgctggtaagagcatgattggaaatgaaacttttgaaattcgtttctagtttcacagatggagttaaacagaggcatagacttactggagaaaagttgtcaacgctaatgatagcaacagttaccatttactgagtgtgtcctgtgtgcaaagcctacgctgctttacattttaacagtactgtgagagttttagaatgactgtttgag

SEQ ID NO: 29469 - DNA, 1030 bp, Homo sapiens
aaaaaaaaacacttagcactttggcaggctgagatgggcggatcatgaggtcaagagatcgagaccatcctggccaacatggtgaagccccatctctagcaaaaatccaaaaaattagctgggcatggtgctgtgcgcctgtagtcccagctactcgggaggctggggcaggagaattgcttgagcccgggaggcggaggttgcgctgagccaagatcttgccactgcaatgcagtggtgacagagcgagactccatctcaaaaaaaaaaaaaagaaaaagaaaaagcacaaaggttaattttatggcatatgaattatatatacacatatgtatgtttccatatatgttttttatatatgttatatataacatataaacacatataacatatgtatatataatatatattaacgtgtgtacattttttaaagtggtacaaggagcaggtgatggaaatgacagaaacttgttttggcttatttgttttatttaagaagaactttcaaagagttagaatggtctcaggatatgatgctttgctgatggaagttgtgattttctgttaatagacatagtcagctctggattgtagggctactgttgatgggattttggcatcaaataagagattgaattagatgactgctgggttgaatttctttgtctctgaaagatgcacttctctcggctctttaataatatgagtcagtaaacaatagacatgattatgagagtgatctcttttttagttttaagaactgtagtatttaagaattgttatttttcttctcatgattatcactaatttttcacagcaggaaaagggcagagtgaaactcccacattttgaaggtggatattgtataacattacaaggaggacaaggaagcaacgaaaagagtcataaattgcagctggaagcttggaactgattcctctatgctgcagtagctcagaagagattcagccttaagtttagtgaataatgaaacatgatctgaagaaattctatgcaagatatactgttg

SEQ ID NO: 29470 - DNA, 1792 bp, Homo sapiens
ttactcaagatgaacatttagtcatccagccaaaagctttcatctgtcttcttttataattaaaacaaagtctattagttctgtcaatcagcagtcatctggggtgatgacaagggctgtacaaacactggtagcagctgccaagcaatcaaaaatgtaacttttcaaaatcaaacttgctgcataggaaaaaaatcagcctttcatgataagattggtaactcaattgtttaacttccgataaatctgtgaattaataccctgtaatatggatttcaagatcttttccttttatttacaatcatctgtagccctttttcttgagaagcagtgagtcttagtctcattttagagcctctgttgggaaaatagcattctcaggtatctagctatttatgttacttggaagaagtaaaacaaagagaaactatatagtcttgtacttagaatatgattctgagatttttatttaaagtgaaatagtttcttttgtcatgatcagtttgctcataattgagcgctctagtttaattagcatgtagacataccatgcctcaaaggtgtttgttttcttatttagattgtcgataggctgtttagcatcatatgctttcagcaagagttctaaatcagcagtttgttaataatgccctcagtaagaaaatactaaagttctcttttggtatgtaaatttagttcaattaaacaagtatgaatgaaccatctactttgggcaaggaattagggctggaatggatacagatatttacataggagaggttttatttattaaagaggttaacttcttatcagatgatcaatgcaagcaacctagtgtaatacaaggcagaatatgagaagcatattataaagtactgtagaacatggaggagggaacaattcctgcttgaggaatcagagaagacttcttggaaaagatagtatcttaatttgtcatgaaaaatggatagaattttaacaagtagatatggaggaaatattgacagagtgagaaattgcagtttcagagagttatacaggattcttagttatgattccttatgtaataggggttctttggctcttaggttcttcagagtgacagtagattcaacaaaatgttaattcttaaactgtctggtcattataataatctaggcctagggatctttaaaaaatacacatttccagactctgctcctacagagtctgtctcagtaaatcttgagtagggctccagattctgattttaagctctttgattttgttcagccaggtttggaagataaccttctgcatgagttttcattgtttacacaaaaatacctttcttcttctgattttcccacttccaaattcaaagcaaatggacatgtttcagtctatgtttagttatttgatccttgaaatttcagtgttcaagtggtattgatgtttgttgttagctaataataggcacataggtgctcaatatttaataaatatttgttaaatagataaaaatatactaaaaaaatctcaaggttatattggagagtactacacaataaattcctttaagagactctttctctctgtgtgcctctttttttgtctgttctatgtttgactccagtcagtatatgaagctcttttagaaaagccctgcaggttctttgtgacccacactttgagcatcactgattgctaagttcctataccattattaagggcagttagataaagcaagtcatattgctgagaatttatgtaagtttaagcgttttttgtagcatgtatttttgcttcttca

SEQ ID NO: 29471 - DNA, 1035 bp, Homo sapiens
atcaggttaattcatatgagttgagtggtttaaaaaattttggcctttgcagatgtagcattcaagatttaaattgctctagtgatcccaaaatttgtgattttgctgaagcatacactgtaagttgtttaatgagtgaacatagctggctccccagcaacctcatatcaaaccattttataactatgcccacatttggattactgctagtgtaatccaacttctgcctgctgtgcaccacccatcatcctcctctttgtcataatggcctgtgtgctatacagtgactgtcatcaggacttggaagcattgctctgattttgcacaggcaggtaaggttaatgtaactactgtaatgatgcaacttaatggactttagagtttatttgcatgcccagatttattttagtggcattataaattactttagtccagtagtattatagaactatagagggctgaaacggattacttaaaattttatcatactttactgaattttgtggggaaagctatgtgctgtagtatcatttgcaaatttgtttttgttgttgttgttgttttcttttttcttttttctttttttctgatacggagtctcgctctgtcgcccaggctggagtgcagtggtgcaatcttggctcactgcaacctctgcctcctgggttcaagcaatcctcctgcctcagcctcctgagcagctggtattacaggcacgtggcaacacacctggctaatttttatatttttagtagagacggggtttcaccatgttggttaggctggtctcgaactcctgacttcgtgatctgcctgcctcggcctcccaaagtgctgggattatgagtgtgagccacggtgcccagggatttagaattgtccagagatctttaggaatgtcaagaatctacagtagtttttgactgttaatctaaaaacttttacatgacagatacatggtatgtattatctgtatttcttcattaaaaaaccaaactctgctttcactattttaagtgaagaagtaggtgactg

SEQ ID NO: 29472 - DNA, 1032 bp, Homo sapiens
actgttgaagggcagataagtttgaggtggtatgaaaagaatctctaagtgagatgctgcctgtgatagtgtgaactgtagtagaatatctctaggtattgaatgaaagtatggatttttgcttggttacttttttaatggggtactgttattcttttggacctctaatggggaaacaaaaggccatttctgaacttgattagaggggaggtcaaggaaggtcgttgagtctctcagcccttgtcttgccaagtagcttaggtaagaagaggaatactgagggggaaagagcaggatctaagtcttgtcaaaatagactagttagctcttacatggtggatcaccgagtggttcccttattcctagttccttaggaactaggaagtaagaaacttgggaagctgtacagatagatctcttggggttagaatgtaactattttaggaatttagaatggtctaatccaactcctgagcaaaccaactaaactatataaagatagattcagaaaatggactatgtaagcctgactttgtgtgtgtttaaatattgtttagttttgttaaccttggcattttaagtctttttgaaaatgttaccagctgtactgaagataaccaaaggaaggttttgttgttgttttccacccccactaggttgggccattcattgaacaaatatttactaagtgccttttgaattttctttctttcttttttttttttttttttttgacgtggagtctcactctgtcacccaggctggcgtgcagtgttgcgatctcagctcactgcaacttcggcctcctggattcaagtgattctcctgcctcagcctcctgagtagctgggactacagggcacacaccaccaagcctgactaatttttgtatttttagtagagatgggatttcaccatgttggccaggctggtcttgaactcctgacctcaagtgatccatctgcctcaacctctcagagtgctggggttacgggcgtgagccaccgtgctcagccaaaattttgttgaggg

SEQ ID NO: 29473 - DNA, 1035 bp, Homo sapiens
aaagaaaaagaaccttaaggagcatttgattttgcagactagtaagcagagtagcagaaaggtaaactggttcccttgggatcacatagctattcagaagctggctcttgacctgggtactttaagggggagggccgtatccactgggcttctctccttctgcttctttaggagtttgcaatctagggtttggtttgtttataagaaaagtctccatctcaaaagaataaaaaataaataaaagacaagacagttttatagacagtatattttgaagataccgagaaatttatttgctttcagatacattttctataacttatttttctaaaattcctttgtgctgaggctttaaaaatcataggaaaatgcaaatttgatagtaacatttgtgtgctctttgttatctttgctggccagtcatccagcaagatgttgagaaacaggatccatataaccacttgatgtagctggtagggaggattcatgaaacatcaagaccatagtgactgtgtgaactgttctgacaggcccactttggtggggaccctgggtagtcaagaaacaacattaaggggtctgtgttttgaggggacaggagaagaagatagttgagaatgaagatagaggatgttgaccacaaacttcacatactttataatttcaagggaggattagctttaggttactgtagatgatgcaaaggaccaagagaagggaagaaaaattaatgactactatcaataaaggtagaataacttaggtgaaaagtaagtagtttgtcagtttacacaaatacaaaatagatctcattgataagtaaatcataactgcatatgcttgtcattgttctaattatttctgatgctagcgtggttctcaagaaattttaatgaactatataaatgctgtcctattcatagtattcatgaaacaagcaatttagaagaactgggctattatagaaccaatatttccagtaaataactgtaaatgtgggcaaattgtgctaatttgagcagaactcggtgactt

SEQ ID NO: 29474 - DNA, 1028 bp, Homo sapiens
tacaccttctgtatactaagcagcatttttagagaagtcttgtgaaataagcttgaaggcagttgtcaaagctgcatataagcttttttgctggtagatatctctcaatttgaactattaaagaatgaaatttatctatcttatatctggttagtaagccaatggtcattcatgaatgcacccatatttccagcaccatttactttgtgagaggtaatattttagatttacatcatattgggggcctgagacttgtagaagcacagatgttgaggcaagcccgagttacggagcagctgacatttggaataggggcctggtagagttgggagccgggaggtctttgtgggaactgattgtttggacacacactcttccaaaaactcaatgtatataggcttgaacctataaagatggtagaggggagtagggaaggatgaaatccaggagtattagatattttgggagctgtgtttatgaagtagagattttcaggcataagtaagactgttgtttttttgaagagaaaatgtcacagtgagtgatggtggatacatgatcattttggtaggcgttgagtctttactgcttaataattagtttttgtttttgtttttccaacagagggtggaatggagagtagagatggggtttcaccttgttggttaggctggtctcgaactcttgacctcaaatgatccgcctgtctcagccttccaaagtgctgggattacaggcatgagctaccactgccccatacctgcccatttttttaggtgaagttttctaaaatatattacatattttctgccttcttaaacagaaggtactaagcatgatttaactttctcctgattactcagtattattatcacaagcatgaattattctactgctctaacacagtaaacctttaggagcttttaaggaatgtagaattatttatttctatactaaatgatcccagattgatgttttatttcttttaaaataattttatgtcttctttgtatggtttttatttttct

SEQ ID NO: 29475 - DNA, 1028 bp, Homo sapiens
aacgtttctaaatgtgggactggtccctaccctaggacgtcgagggagaaagacagctttcttcaagttgttggccgctgtacatttggctagggctcctttttgccaacttgtctgactgcccctaactgttaggcgaacccagttgttcactgcataacaggcctttttttttttttttttttaaacttcaaatacctcatttggccgtggtttttattgacattcttctgaaggaaaacatagcaaactgaatgtgctgtggtcctctccagccttgacctgtctctgttagccgctgcctggtttttacttgaactagctaaactgactcttttctttgtggcacgatgtgtgatactgtgttttatatcagaactgaaatagaaatcatgtgtgaggtgcatgagaagatattgtgcatttgttttattgctagagaatctaacaaaccctgccttagcatagcctggcgaattgaaaggttttctttgatatctaattgatggcattttgtcctctgaccctgtgtcttttctacttcatcctgaagtcaagaatctcttatatattataatagttctcatcacagagcttctttcagtgagattgattccattcactttggttgagagaactatatattccccacccccacctccaaccccaatacagacagaacgaggaaaactcatagaagaaaccatataattaagcaatttaaacagatgctgcgtattcctaaagtcccccatttcttctatatttgtaattgcatgtttatgagtagttttaagatgtctgcaaactctacattcataaacgtctgctttttctattttacccaatatgcagtaactcatgtggttatgtctgtggaaacccctctgggtactggtattgcttgaaccacggaagtattattcttggcagtcaggtggatttctggactctggaagattctgtttcaagtgttaggattcactctgcagtatttactcactctgtgatgcttaaattgctatacc

SEQ ID NO: 29476 - DNA, 1030 bp, Homo sapiens
agagatggggtttcaccgtgttagccaggatggtctcaatctcctgacctcgtgatccacccacctcggcctcccaaagtgctgggattacaggcgtgagccaccatgcccagcctattttggtaaatatttttatattacctttcagaaaccaattttaaaaaagattaggcctcatattcaggaacatatcttagatgtttttgtctttaccacattctgatttgtttaagaactttaattcaggagagattatctaggaagttgttgaaaagtaggcttagatacatttgggatttttcaaattgacccatttcagagtggtttgtagatataaatttgaaatgaagtacatactaccttcaaggtaaaatatactttcttaagttttgaacttctgtttggatgaatttattactttatctgttttattttatttttgtatctgtagaaatcctcagatgttgctctcatattcatttaaatgtattgtgttattattttggattgtactctaagctttttgaagtcaaactttaaaacagattttcatatcaaattaaggtaaaaacacagcaaacatattttatacctagtaaatccaaataagttgactgagattttagaaaaaataagagttccataaaataagcagcatttcacttagcgttctaagttagaaaataaaatggaaaaaagatacacatttataatatgcaaaaattacttaaaaataattaaataaagaccacgtataattttagataatgaaaatggcaaaacttcatttagagttataaaagggaattgaataaatggacatatattctgcccaagactatttctggacaatacgatgttaattagaatatcaaatcacatttttcttggaagttgacatgattaatttgaaatttatgtggcagaatgaatagataaaaatatgaaagattattttgaaaaaataaagctaatgatagaggggattaatcctaccacacaataaaggataattttaaaaaccaataat

SEQ ID NO: 29477 - DNA, 1028 bp, Homo sapiens
gagaaaattaaacgtctcccttatgttaagccactattactttgaattatttaggacctaaatctaactatgattaatataatcaggataaggcataattttttttttttgagacggagtttcgctcttgttgcccacgctggagtgcagtggcaccatctaggctcactgcaacttccactccctaggttcaagcgattctcctgcttcagcctcgtgagtagctgggattacaggcacacaccaccacgccggcctaatttttgtatttttagtagaaacggggtttcaccttgttggtcaggctggtttcgaactcctaaccttgtgatccgcctgcctcggcctcccaaagtgctaggattacaggagtgagccacggtgcccggcccaggataaggcataattttgtgcctcctataaagttgggaaattgactgtttctggaattcagattttttaaaaattaaaattgaacttctggttctcttctccttatctaggtctaacttattgtactctggctgtttgcctatatgcagaatttatcctgattgtgttttaggaagctagctgaagaaaatatttttctaccaaatgagacaaaccagtttgtaaacctaagttagtaaccagaaaatgtaaatctatgatgttttatagttctgcttgttatatatgatcactggacacacagaggtacagaaatccagtaagaaagtgaagttttgggggagtctataaaaatggaaagcatctggtgtgaagtctgtaaaagaccacaatatcaggtcatttcaagttctttcgtgagttgaaatctggcttaatataaatggctttcaaggagtattgcttccttctgttctggaagaggacattaaagcagtgaagaatgctgcagttcagttagatagatgtaaaaattctgggagcattaacagtggggtaagtatcatcttttccagtattgaaaatgaagtgataacagagggaaaaacttaagagatagtagaaaaagtagagat

SEQ ID NO: 29478 - DNA, 2374 bp, Homo sapiens
gctaaagaatggttacacaagtcagtctttaccattatgctttataaagataatagcaaccatttaactaaagaaatgtcaatgtatttttaaaaagaagagtgatagggaaatcaagaagaaactcatacaaggcggagaattgaaacgtgatagatagatataatgtttgatgtaaattaatagaatgatagatacaaatagatgctcttttgtgtttcttagtttgattagtgtatggtatcttattgaggggcttttattagctattcaggaaaggcagaatctttgaagaaaggtttgtgatattgtatcattcatttatcaatcaatcatacatcatttattaaatgttgaagattcaaagatgctttgagcacagtcactgcactccagagactcaaagatattctctggctttgaatagacctttctttaagagatatatcctaataaaggtcagaacatgaagcattaagtttttaccctcgcaaaagagctgtatctgatactggcctggcaaaagattggaatattatgttaatgttcctagtgttctttctcttgttatacagaaatcacactccactgcttctaaggttcagtggattagaggaaaatcttaaacctaggaagattaattcaaatcatatattaacctatttgatcatttcagagtattatgggataatttgtaattagtgacgagcatttggagttcatgagtaatcctgtttgagtgattgctcccttgttgtgccctttcatgctccctgttgtttccaagtgataaatgatactttagttatttattgttcaggacactctgcattttcttcaccaaataatacaagctcttcctagtttatgttaaacatgcatttttccctcctaggtcttttgtcacagagactgttctaggaaattatatctttatttctgatgattttagctgtaacatttcaacctggattaggtttttattatactgggattttgcttttctgcatcgctaatcaaagtttttaatgacattttgccttttgatgtgaattgaagattgaggtacaaagagttccagcacctaatgacctattccataaaggtactacatggaaggataatggttttttggaaaagagttgttctgcatactgttatgaaaactaaagactggtagacttttaataattattcacaaaagtacaattttccaagcgttgaaagatgaaagtattggtgaacctgctcatttttcattgttgaaaatggactgctttcctcattctgttaaggtctgggattcatgttggtagagtatagtttttgtactgagcgtctaagataggtttgatttgtgaagcatattttggcttctctgttgatcctctaaatctgtaggccttcggctgaaatgtggagaaaatctgtgcttgtcatctccacatttcgagtcatctccacatttcgagtctaaccttctcttagtactcacttctcttgtgttgttcttcacctgctaaaacctcctttttctatattattgccttactgatttttgccttctcagacggctgttttacgttccagtttcttgtaacttccttcttacaaacgtacttttcttggactccaattctttagggcaaaatgtaagtttttcttacattattttgtcaaaaaacgcatgctgattcagtttatgcagttatattagagaattctattattggataaaaataaagttacactttaagacagggcattctacatacaatacctaaagctacaagggtgactcctatggtagaaatttggggcactgttttagaccttggaggcagatgcatttttttttggagactgtgagttatgattcttttcaaattacattgcatagcttcttcttgggcttgcttatatcttagctaagactctggtgggcttaagcaaaatgttgaatttattgtcatgaaacactggtatctcatggaacccaatagcaagatgttcaggctaagctgcatgaaaacgtgaaagaatgaaatagaaagtagttaggaacccagccagccacctcttagtctctgcgtttaaggccacattgtctctatattagtttcctgttgccactgtaataaattaccacatagttaatggcttaaacaatttagatttattcttctaaaattctaggctgagtgtggtggcttatgcctgtaatcccagtgctttgagaggtcgaggcaggaggatcacttgaggcccaggagtttgagactagcttgggcaacatagcaagaccccatctgtaagaaaaagaggaaaagaaaaaaattaactggatgtggtggtacatgcctatagtctcagc

SEQ ID NO: 29479 - DNA, 1005 bp, Homo sapiens
ttctcatctatttacctaatctcattctgtaactttgttgggctttacaatgattgtcatatgaagactttctgcattttgttaatcagaatctagaaaaatttagactattgtaaattataaccaagtatccagacttggtgttttccatactaaagtatatccttttatgtatgttctacaaagaacacagagtcattgtttaaaaaaacacaacttttgagttttactcatattctcttttcagtttatatccccatatgattaattattagcaatggtttccgtattataggcatctctgaaaatggggaaatatctaacagtaagcccagtgttactctgaaatgtagattgtaactgcttttctgtgtaaattaataatgaacaaccaaaatttctgtggtatgtcttctgtcatataaatgacaggaataaaagttcaaaaagaaacatttcattcttttaaaagtatctgtcttgaaatagcttgattttatgttgagttgactttaaatatgtaatgcaatatatcacaaagaatagaataacagaatagcatagtagttaaggcatggggttatggaattagacttgaacttgcatcccatctctgctatttgctggctgtgtgaccttcagggagtcatttaaccttgataatcatcagtttattcatttataaaatgaggatgatcaacctatctggtataataaaccccttaaaaatagggcctcacatacagtcagaggtgattattctttgaaattaatgattttgaaaatagaaaatacacaaattaccttctcttttatcagctgtgaacactttacacagtaaagtgtattttttttctgtatttttttccttcttggtttgcttttctttctacccattctcactgttgtttcatttgataggaaacagtcttagaaagaattagcctgctaatgaaatgccctttcctccttgagcttctggaacctcagcttttgacttggttc

SEQ ID NO: 29480 - DNA, 1090 bp, Homo sapiens
tctccacatcctctccagcacctgttgtttcctgactttttaatgatcgccattctaactgatgtgagatggtatctcattgtggttttgatttgcatttctttgatggccagtgatgatgagcattttttcatgtgttttttggctgcatagatgtcttcttttgagaagtgtctgttcatatccttcgcccacttgttgatggggttgtttgtttttttcttgtaagtttgtttgagtttattgtagattctggatattagccctttgtcagataagtagattgcaaaaattttctcccattctgtaggttgcctgttcactctgatggtggtttcttttgctgtgcagaagctctttagtttaattagatcccatttgtcaattttggcttttgttgccattgcttttggtgttttaaaccaaggcagtgctctctttaagagaaactctctaaaagtatcttttgtcacctaacttcggtaagaagaggaagagagggaaagagatgggatggagagaagcaggtggacaagaaggaatgacaaagttgaagatttcctagattattcctaagcttaaaggcttgatagttttatttccccccaaaaaacttctcaaataaacaaacttcttgaatatcacaaaacttcttgaataaacagcttaaactactgtatgattgacttaggctttaggcaaagaggcatttctagtgatatcagaggaattttttaagtgcatagtatataatggtaatttttatttgacttctatctattgtggaatatcagccattttttctctgactagagaagtattaagttagtggggtaaattgcttagaagacaaccgcaccatttactcaattaataagggagcctaggatctggaaacaatgcctgaggctgttgtcaggcctacacttctttgagaccatcttgtggtcctctattaaagtctagcagtggaattattatataaactttcaactgcattcagttcagcatttatttgtttatcttactatttgaatagtccaaataactgtgtgtggtggcctttagttctatccaccagtatttctgg

SEQ ID NO: 29481 - DNA, 1589 bp, Homo sapiens
tttttcagttttagcagttatctattgatttttagttactgaagtttaagatttaactcatacctcttgtatctaacacctacatatgtatttccgatcccctagccgcccactgtagttttattgtaattttggttagatgagtgcttcttatttctggctgtacattagaatcactagcaaacttgagtgaacaaatctagatacctgagactcaccctcacaaattcagctttatgtgttttggggaggatcctgggtatccgtgtttttaaaaaagttttcaattgcttctaatgtgcagccaggtttgagaaccactgagtaaataataaataaatcagtatttattatgactgtgtaaatgctttgcatagctgagctatgtagtaagtcattacttttcctttcttgctcatattttccccctagtgttaagaaataatttattttgtatttgtttagttttctatatacctttttatacgttcagtaaaagtatgttgaacttctactctgtgttagggatatagctgtgcacaagcagattaaaattctccttgttctcccagagtctaagggggaaagatgtacagtaaactaaaatacttaatatattagatgtcgataagttctgtggagaataataaagcaagaaaggagacacaagaatattggaagtggggagggattacaatttcaaatagggtcattagggaggactttatcaagaagatgatatttaagtaaaggcttgaaggctatgaaagagagattcacgcagatatctgggggtaaaagtgttctcagtgggattcataagtgcaatggcttgaggtgggatcctgcatcatgttcttgagtagacagaggcagtgtgtctggagcaagtgaggaggaggaccaagggttagactgggtaagaccttatgaggctattgtcaagatgttggctttcatttggagctagatgagaagtctttataatcttctaagcggaggagtgactttatctgacttagggtttgaaaagatttctctggcttctgcttggagaatagactggagaaggcaagggcagagtacggagcctgttggtaggctaaggcagaacttacacaagatatgatgatgacctggacaagggtggtaattagcagtggcattggtgaaaagcagtcaagttctgggaaattttttctttagctaccatattaactaattggaaatattttaaaaggtagaaccaacaggattttctgatggattggatgtggtatgtgagagcaaaagaagggtcagtggcgactccaaggtttttggcatgaataattggaggaatgggcttttagctaactaaaatggcaaagactgccaggggagcagatgtttttgagagagatctggagcttggttttggacatgttaagtttaagatatttattagacacctaaggggagaggtcggatatagcaatctggagttcagggagatgacagtgccagagatacgcatttatagattcatataaagtgaataaacacaaatgaatggagtataaatggtaaaggggcccaaggactgaaac

SEQ ID NO: 29482 - DNA, 1034 bp, Homo sapiens
tatttagcaagcactcactaaatgcctattacgttgaaatactgcactaggtgctgagggtacagatttaaaagacattggccatggcttcaaacagctgtctttctaggagagcttacaggtaaacaccacatcattataatacaatagaggaagtgtggaattttatatatatataggtgtgtgtgtacatatacacacatatgtatgtgtatgtatgtatatatgtgtatatgagatgaatgtgtatatatatggctacacaaacagacacacacacacacatagctatataggctagtataggaatacctaggaaaactatataactcaaaattacttgtgattaataattacctgttatatatctcacttttacttgtttttaaaaaatatgcttatgaagacagttactagaaggatatacctgaaagaggttactgaacaatttggtttagatttattacacagatgagagagaaaataatttttttcctttaccatattcatgatcagattactgtagaacataggaaaagaaatgtatgttgttttattgccaggtttatattaaagatcaaagtctgtaaatgtagcaaatataacaaattattgatttacattagtctattgactcaagcgtaattgtgagtgaattggagaagctcatctttcactattgatccattctttagctggtgtatttgttcatgagcccaactccataggaaatacttttttctgaagcatgaattacagtagacctgacacgctttcttgtgagatggactattattattaaactgacaatcgtgagatcagttcttggaatctgtcacaggctgctactgactggagctaatgactacttattaatttttgccagatacttccattatttatcagcatcttgataatctgtaatatgcgttaaagttcttagctaatactattaagattggctaaagacaatattaaatgtgaaatgtccttgctgagaataataatagattaatatttttatgtaacatttt

SEQ ID NO: 29483 - DNA, 2338 bp, Homo sapiens
ttattttgcagacctgtttatgtgattgcttcatagtgtcactggtctatgtacttcagtgtgtttttgtagtggctggtagtggttttcctttccatatttagtgcttccttcaggagctcttgcaaggcaggcctggtggtgacgaattccctcagcatttgcttgtctgaaaagaatcttatttctccttcacttatgaagcttagtttggccaggtatgaaattttgggttggaaattcttttctttaagaatgttgaatactggcccccactctcttctggcttatagggtttacactaacaggtctgctattagtctgataggcttccctttgtaggtgacctggcctttctctttagctgcccttaacattttttctttcattttgacctgtgagaatctgatgattatatgtcttggggttggtcttcttgtggagtattttactgggtttcttgcatttcctgaatttgaatgttggcctgtcttgctaggttggggaagttctcctggatgatattttgaagtatgttttccaacttggttccattctccctgtctctttcaggaaccccagtcagtcataggttcagtctctttacataatatcatatttctttgaggttttgttcctttttattcttttttctctgttcttgtctgcctgtcttatttccgaaagatagcttcaagctctgagagtctttcctcggcttggtctattctgctgttgttacttgtgatggcattgtgaggttttcatgttttgtttttcagctcactccatcaggttggttatgtttctctctaaactggctattctggctatcagctcctgtattttatcatgattgttagcttctttgcattgggttacaacatgctcctttagctcagcaaaggttgtcattacccaccttctgaagtctacttctgtcatttcagccatctcagcctcaccccagttctgtgcccttgctggagaggtgttggggtcatttgaggagaagaggcactctggctttttgagttttcagtatttttgtgttgattctttctcatctttgtgggtttatctactttcaatttttgaggttgctgacctttgaatggattttttgtggggtctgttttgttgatgttgttgttttctgtttgtttttcttttaacagatagaccactcttctttagggctgctgcagtttgctgggggtctgctccagaccctagttgcctgggcttttcccatgcctggaggtatcaccagtgaaggctgtgaaacagcaaagatggcagcctgctccttcttctgaatgctctgtcccaggggattactaatctgttgctggcccgaacatgcctgtaggaggtgactggagacccctgttgggaggtctcacctagtcaggaggaatgggatcagagaactgcttaaagaagcagtctggctactttttggtagagcaggtgtgctgcattcgggggacctttccttgtccagaatgttcgtgttctccaaagctggtagaccggaacagctgagtctaccgaaccactgagatggcagccacccctccccccgggagctctgtcccagggagagatcagagtactgtctgtagaacccttgctggagtgactgaaacccctgcagggaggtcctgcctgtgagggggaatgggtcagggtcgcaattaaagaagcagtctggccatgacctgacaaggcagctgtgctgtgttgtgggggatccttcctcatccagaccgtctgtgttctccaaagctggcaggctggaacggccgagtctgctgaactgcagagatggtggctgcttctccccacaggagctctgtcccagggagagatcaggactctgtctttagaaccctggctggagtggctgaagccaccgcaggaaggtcccgcccagtgaggaagaatgggttgaggtccccttaaggaagcagtctggccacgatctggcaaggcagctgggctgcactgtgggggacccttccttgttcggactgtttgtattctccaaagccagccggctggaacagctgaatctactgaaccacggagacggtggccacccttcttccccgggaactccgttccaactcaggccgactccagcctgttgctgtttggcggctggaattccaagccagtgggtcttaactggcttccagtgacgtgccgtggaagtggggcctgcagagtgacactgcttggctccctaaattcagccccagttcctaggggtatgcatggttggatcttctgccttgcgggggattctggggctgaagtaggtaaaacttct

SEQ ID NO: 29484 - DNA, 1045 bp, Homo sapiens
gttttacatttaagtgtttaatccatcttgagttgatttttgtatatggtgtaaggaaggggtccagttttaattttctgcatatggctagccatttctcccagcaccatttattaaatagggaatcctttcctcattgcttgtttttgtcaggtttgtaaaagatcagatggttgtaggtgtgcaggcttatttctgagttctgtattctgttccattggtctatgtgtctgtttttgtaccagtaccatgctgttttagttactgtagccttgtagtatagtttgaagttgggtagcatgatgcttccagctttgttctttttgtttaggcttgtcttggctatttgggctcccttttggttccatatgaattttaaaatagtttttcctaattctgtgaataatgtccgtggtagtttgataggaataccattgaatctataaattactttgggcagtatggccattttcatgagtattgattattcctatccatgagcatgaaatgttttcccatttttttgtgtcctctctgatttctttgagcagtgatttgtagttctttctgaagaggtccttcgcctctcttgttagctgtattcctaggtattttattctctttgtagcagttgtgaatgggggttcattcatgattggtctttctgcttgcctgttattggtgtataggaatgctagtgatttttgcacattgattttgtattctgagactttgtggaagttgttttttagcttaggaagcttttgggctgagacagtggggttttctagatacaggatcatgtcatctgcaaacgaagataatttgacttcttctcttcctatttgaatatgctttatttctttctcttgctctattgccctcgcgagaacttccaatactatgttggagagggggcatccttgtcttctgctggttttcaagggaatgcttccagcctttgcccattcagtatgatattggttgtgggtttgtcatagatggctattactattttgaggtatgttcctttaatacctagttt

SEQ ID NO: 29485 - DNA, 1025 bp, Homo sapiens
aaaaaataattgaggagagcctttaatacctctttgaaaataattatgaaggttttttactatttggaagatcatagaatccaccatatagtaatttttaaatattttaaattggatgtttaactttaaattagaaaaaacaacattattgaaagcttttctttaatagaaaaattgctttgatttttatttcataattgatttaaaatattagttacatgaattattatttacaacttgcatagtaattttcatacatctccataataaaaattcactctgtaatctcttctataaaaagaagtaaacagcacctgccagagcactgtagcaacgagagccatcaagtgtgtattcacttcgttattcaaaacagcagtgaaagagttaataaaagctgaatacattacaggattacaaagatttttatttattaggggatagggagggtatggtatatatgggatgaaacattaataacctctctattctgcaagactgacctattgctttggaactactcttttagccccacagagactgtgaaacagtgttttggtggtctataggaaaggttcaacttggcaaatgtagtggtaagtgatgtcactgaatgcataccatatgtattgagagtcagtgaatgctattctctctgctgcgcacaggcatgtgtaagtgttggaatggaaaaatcatttttatgaaaatatagagaagtaaaacaagaatgttctgtcctgagcctgatcagatcaccagtagctgccaagagtgaacactccgtgtaaggttttctcttcttaattctccagcttccggccttttgttggctctcaaaagtagtctattcagaaggccttattcagcatgttctttcttgatatgatatgaacaccaaatgaaagttccattttctccattaaagtaaagctgggagaatattttagtgtgcatggtttgcagcagatggaaatgattaattgatttagctaacttgccaaattgttctctttcccagtaga

SEQ ID NO: 29486 - DNA, 2204 bp, Homo sapiens
aggtatgttcttctattcctaatggacccaggttactgtgagggttcctggatctgattgttaaaaattttcagtcatcttctttgttaccttccgcttagtatattatcaatggcttgcttcctgctacacttctccctgctctctttgactatttctgatctgctattgcttagaaaacttcataaccaaggttgtaaaaattatcttaaaaaataagaatactgtcttaggatttcagagggtggctagaaattgaggtccagaaaaattaagtgacttgcccaatgcacatgcacagcctgtcaacacagttgacaagaaaaacagaatcttctatgtactatactatagtctttaatttttttcatcatttaaaatttttagtccctgaatgatggcctaggagactgtattgagtacagcatattagtcatgaagacctttttactactttcgtaattgatagatgaattctgtctttttactatcttcctaattgatagatgaattctgccaaacatgttacttccacataagtttgtctgtgtgcttacacttatttaatcttagatactaattctttgtatgtgtttatacttatttagccttatatagtaattctttttttaaaaaatagagacagggtcttactctgtcacgtaggctgtagtgcagtggtgaatcatagttcgttgtaacctcactgcttgagggatcctcctgcttcagcttcctgagtagctgagactacaggtgtgtgccaccatccctggctgatttttgtatttttcatagagatgaggccctgccatgttgcccaggctgttcttgaacttctgtcctcaagcaatcctcgtgtctgggcctcccaaagcgctgggattacagatgcgagccaccatgcctggcctttgtatactcattttcaaaaatttaagtctatcatctgtgatttgagaataggtatttgttaatataaacaaaccagataacatctcagttctccaaaccccatgcagctcaacactaaagcagtcttcatgaatctgaagtttttgtgcagagaaagccaatgataggaacattttaagatttctgctaagaattgctgagcatgatatatctagtatttatagtagatatgccattgatgcttaataaacatttgaaaaaccctctctaaaaactgcagaaaaaagatgcacacctgtaatcccagctacttgggttaaggtaggagaattgtttgagtctagcttgggcaacatagtgggaccttgagtgtaaaaaaaaatacaataaataaaataaaaattttaaaaatgttaaaaaaattaaaacttcggacaagagaaaaattgcttaataatcactttgaatgtgtttgcgtttaatatattatgaagtattgatgtaaagagttgtaaatattttcaccctacagccctaattagaatagtcagaatgttgctttaataagtacttagtaaacatattcaagaaatttaaatgactttatgaagttttttcagttgggatgaattgtaggactccatcgggaacagaaattcttgaagtctgaagactgagacattctgtagcttaaaagttttcttaccacgaaaatagccttgccattggcttgtatactgaattaattggaagttcgctggccataattctgtcttcctaggatctgcctagagttttctgtctgcattcctttttttgagggtgaaggggagtacctgactatcttttgtaaagatttttcttttcctctttagattcctaataatgctgggtatgccaaatctttaatgatgctctgtgtagcctatagttgggcaaaagctgactggaagatactcttcagcaacttgatttttttagtatttaggacttactaatttttatctttggaaagacagttttatctttagctctaacaattttatctctagctttaactttgcagggacatggatgaagctggaaaccatcattctcagcaaactatcacaaggacagaaaaccaaacaccacatgttctcacccatgctctaacttgagctttatacctttattgtaagtctttttcaatttgatcagtctgatatagaggaaagctggtgggctttagatttggaaacacttggtttgaaaacctagctctgcgatttactaactgtgcaaccctg

SEQ ID NO: 29487 - DNA, 1889 bp, Homo sapiens
tgtaagttttaagggggcggaagaaaaaagggagaaaggaggaaaagggattgaaaggaggaaaagggattgaaaggaggaaaaggaagaaaaatatgagattattaatgtgaagctcttagtactgtgcttggcatttattaagcattttataaaacgtattattattgccactgctattattattaacattaaaacatacctgttttctatgggatttctttaggacctgacttttaaagatcttaagctatttagattctggagtcaggctctactgtgttctttgctaactgtgtgtgcatgaaaaaataacttaatctttctgagagtctgtgtccttgtttataaaattgaaatgatgatgcatctctctcactgggctattttgaggcttgttgagacaatatataaaaagggccaagcacatggaacgctctcagatactggttttttcctcgtctccacctcccttgacatccctttgaaagcctgagagagcagactagagctctgactagttaaggcctcagtagtggatccccatgactgcccagagtgagtatgggagatcttggtccagccctacccccatttgtttaataacttaatttatcatatggatgtatatagatttagaattgtgatatccttttgctgagttaacttatagaattattctgaaatactattatcactgtgactattattactattcttaattatttctattaaattattgctctgactatgaatgtctgcctagtaatgctgcttttgttaaagtttgatactgatgtagctgtgccagctttcttttggtttgtgtttacatgttacatcttttgctattttttcacttttgatctctctgtgtctttatatttaaagtatatctcttgcaagtcacatattgggttttgttttactttttttcaataacagctttgttcagatataattcacataccataacgtctacccttataaagtacatacttcagtgatttttttatgtattcatggagttttgcatgcatcaccactatctaattccagaagatttttatcattccaaaaagaaaccctttacccattaacgatcactctccattctccctctcccctgcctttaccttccagcctctgacaaccactaatctactttctgtctctgtggatttgcctattctggactttttacataaatataatcatacaatatctgggcttttgtacctggttttttttacttagattgtttttcaggtttgtccatatggtagtgtgtattggtacttcataccttttttagtattttattcttgctgtgcttcagttcattattgtccattgacctgctttttagttcatcactaatctgttgttaaacccatctattgagttcaaatttcagtagttgtttttcagttctattatttacaattttaatcctctactgcaattttcagtctttctctcagtattttctgtgtctcagttttttttttttttttgagacggagtttcgcacttgttgcccaggctggagtgcaatggcacgatcttggctcactgcaacctccacctcctgggtccaagagattctcctgcctcagcctcctgagtagctgggattacaggtgcttgccaccacgcccagctaatttttcgtatttttagtagagacagggtttcatcatgttggccaggctggtctcaaactcctgactctggtaatccacctatctcggcctcccaaagtgttgggattacaggcgtgagccaccgcacccagcctctccgttttcttaaacgtattaatcatggtactatgaaagttcttatttactaactctacttttttagttacctgtgattctcttgtt

SEQ ID NO: 29488 - DNA, 1506 bp, Homo sapiens
gcacagactccattttgtagtacttatgtcctatttttaggaagcctcatggagtatagataaccaggctatttaaacaaacttatttataaaagaaaaaatgaagttctcttaagtttaaaaattttcacctttccctagagtgatcttaatttcagtcatctagtttaaaaagacctgattgtttctgcctgaaagatttgtactagggaataactaatgaaaacaaaacttaggaggctggatgaggtggctcacacctgtaatcccagcactttgagaagcggaggcagagggatccatttgagctcaggtgtttgagactagcctgggcgacatggtgaaaacctgtctccataaaataatataaaagttagccagatgtggtaatgtgcacctgtggtcctagctactcgagaggctgaggtgggaggattagttgaacctgggaggtcgaggtacatacagtgagccatgattgcaccgctgcactccagcctcggtgacagagtgagacccgtttcacacacacaataaaacccccaaactttggattaaaagaaatttttaataatggcacattttagttatagatcattttaaagatatactaagtatgaagaaaaatcacaattcatataaccccagcagtaagcccaatgaactttttttctatcaataataagtcttgaacacattttatggttattgaaattaacaaaatatgattttgaataattcattattgcatgaatctttgcctgtgattatttcttacctagaattagaattacatggttaaagaatagtatgatttttgtggtcaatgatatgtaattccaaattgccctccaaaagtatatacatgaatttatattttcatcaccaacatatgagagtgcctgttttactgtgcatttgacaatgctggaatttataattttaaaaacttcctatttttatgaggtaaataatggtttctttgtcaatttgtatttctttgatttgttgtgagggtgacattttgcatatatttgtttgataccattaatttttttaaatactttttttgtatttttggtagagacaggttttcaccatttcgccaaggattgtcttgaactcctgagctcaagtgattctcccaccttagcctcccaaagtgctgggattacaggcatgagccattgtgcctgtctggataccgttgaatatttttttttttttttttttgagctggcttctggctctgtcgcccaggctggagtgcagtggcgcgatctcggctcactgcaagctccgcctcctgggttcacgccattctcctgtctcagcctcccgagtagctgggactacaggcgcccgccaccatgcccggccaatttgtttttgtatttttggtagagacagggtttcaccgtgttagccgggatggtctcgatctcctgacctggtgatctgcccgtcttggcctcccaaagtgctgggatcgttaattttttgagc

SEQ ID NO: 29489 - DNA, 1046 bp, Homo sapiens
acaagaacggcctcacacagccctcttgtcctgatgcaaggtctgacactgtcgaccaccttcttcttgatactctatccctgggcctttgtggcttgttcttttctgattcttctccccatttgactgtcctttccatctcctctttctctgtctatttctttcctttttttttttgagacagtgtctcactctgttgcccaggctgatgtgcagtggctcaatcacggttcactgcagcctcagcctcccaggctcaagcaatcctcacgcctcagcctcccaagtagctgggggtacaggtgcatgccacaacgcctggctaagttttgtatatttttatagagatgggttttcaccatgttgctcaggctggtctggaacccctgggctccagcgatccacccaccttggcctcccaaagtgttgggattacaagtttgagccactgctcctggcctctccacccatgtaggtgttcctcaagaatctattcctgacactttatctcctagcaacctctacatttcagcacctgtaagctcatccagttcaaatctaccccccagcctgtcagcccccgccttcctctccttgccgagctccagtcctcaattcctaacttcctgccagacatttccactaggacaatctgatgttgcatcaaatttagtatgttcacaatcaaatttaccaccttctgcagaacttgacctcaggcaggactgaagtctgggcctgtcaacaggcagtctatctggcaagttgaccttcctttcacatagtctcacagtagacagtccataatatattggggtgaatctacctcagttatttgcacccactgagcagacaagcaggtagtcaaaaaaaagttcacacaagttctttaaaatattcactttttgattatgtaaagcatgcacatagttccaaataaaaaaggtacttggctgggcacagtggctcatgcttgtaatcccagcactttgggaggccgaggcaggtggatcatttgaggtcaggagttcgagaccagcctgacc

SEQ ID NO: 29490 - DNA, 1089 bp, Homo sapiens
gataataataaaaaactagtgcatttgaattatgtgacataagagagttccaaaagagagcagcagtattgggtggttagaaatatagattaatgacccacaattttcgtatctagtattcttgatggagtgattgtagtgctaagaaactatgagtaaatatgtctttacttaaaattatttaatctttagcgagtatttaactgttggctctggttttgcattgtttactttttttttttttaactagggggagttaaatgatacatgtctgtagagttattttatgctacttttctttaacatgcctcagcattaaaatgtccttaagaatattgcatcatatcattaagagtctgactatggaaggaatgcgaccgtattacagtgagtaaatttttcatgactacagcccatggatgttaaataaaaaatgacagcttcttggatttgattgcagtataaaattgtgactcagaatactagattcattgactgggggtagaaagaggacactttaggacactttgtatgagaagcagaaaatgttttgcatactttataagggagagacaaaaatcttgagtgtagttttacatcgtttattaatggtagaaccactttgttgaaatgaattaagtgtagagtcttgtaccacttcaccttcattcattcagctgaagtataggaggatgattcgtgcttaaatgaatctttgcctgcatttgtgcagggaaaaactttggcagtcccaatcactggactgcacacagccatggaatattgtagcattactgccatgttccatgtgtatgtgtgcataagacacacacacacacacacactcacacacacacatacacacatgcagagagatcttaaaaatcactttattgaagtataattgacatgcaaatattataaaacatccatttaaaatatatagttcaatgctcaatgaacctaacaaatgaacccgtgcaatcagatttatatatttatattttgactgtgcagtcaagatatagagcacttccatgaccccagaaagttccctttgcccttttctagtcactccatccctgtgtc

SEQ ID NO: 29491 - DNA, 1046 bp, Homo sapiens
gaattttgggattttttttctcgttccgtgaagatttatggtgatattttgatgggaattgcattgaatttgtagattgctcttggcaagatggtcatttttgcaatattgattctactcatccatgagcatgggttgtgtttccatttgtttgtgtcatctgtgatttctttcagcagtattttgtagttttccttgtagaggtctttcgcctccttggttaggtatattcctaagtattttattattttttttgtggttatcgtgaagggggttgagtttttgatttgattctcagcttagttgctattggtgtatagcagagctactgatttgtgtgtattaattttgtatcctaaaactttgctgaattcatttaccagttttaggagctttttggatgaatcttgagggttctctaggtatatgatcatatcatcagcaaacagtgacagtttgacttcctccttactgatttggatgtgctttatttttttctcttgtctgattgctctcgctaggacttccggtactatgttgaatagaagtggtgaaagaggacatccttgtcttgttccagttcacagggggaatgctttcaagttttctttgttaagtgtaatgttggctgtgggtttgtcgaagatggcttttattacattaaagtatgtcccttctatgctgattttgctgagggttttagtcataaagagatgctggattttatcagatgctttttctgcatctattgagatgatcatgtgatttttgctttcaactctgtttatgtggtataacacatttattgacttacatatgttaaaccatcctcatccctggtatgaaaccacttggtcatggtggattatctttttgatatgctgttggatttggtttgctagtattttgttgaggatttttgcatctattttcatcagggatattggtctgtagttttcttttttttgctgtgtccttccccagttttgttattagggttatactgacttcatagaatgatttaggaaggattccctctttctcta

SEQ ID NO: 29492 - DNA, 1164 bp, Homo sapiens
ccattcaggttgctgcaaatgccattatttcattcctttttatggctgagtagtattccatggtataaaatataccacattttctttatctgctcattgattgatgggcatttgggctggttccgtatttttgcaattagaaattgtgctgctataaacataggtgtgcaagtatctttttgcataatgacttcttttcctctgggtagatacctagtaatgggattgctggatcaaacggtagatctacttttagttgtttaatgagtctccacactgttttccctagtgattgtactggtttacattcccaccaacagtgtaaaagtggtcccttttcactacatccatgccaacatctattattttttcattatggctattcttgcaggagtgaggtggtattacattgtggttttgatttgcatttccctgataattagtgatgttgagcatttttccatatgcttgttggccatttgtatatcttcttttgagaattgtctatttatgtcttcagctcactttttgatgggattgtttttttcttgctgatttgtttgagttctgcatagattctgaatattagtcctttgttggatatatagattgcgaagactttttctcactccgtggattgtctgttaactttgctgattatttctttctttttttttccttttaaaagacggagtctcactctgttacccaggctggagtagagtggtacaatctcggctcacagcaacctccgcctcccaggttcaagtgattctcctgcctcagcctccctagtagctgggatgacaggtgtgtgccaccacacccggttaatttttgtatttttagtagagatggggtttcaccatgttggccaggctggtctcgaactcctgacctcaagtgatctgcttgcctcagcctcccaaagtgctgggattacaggtgtgagtgtctgtgccagacctctgctgattatttcttctgctgtgcagaagcttttaagtttaattaagtcccatcaatgtatcttattttgttgatgcatttgtgtttgggttcttggtcatgaagtgtttgcctaagccagtgtctagaagggtttttccaatgttgtcttctagaatctttatggtttcagatcttagatttaagtctttgatt

SEQ ID NO: 29493 - DNA, 1492 bp, Homo sapiens
ctgacgaatgcattgctggacttgtagaaattaagtgaaattatacaatgtttatcaaaagtaaaaaaatcaaaataaaaacgatgacaaaattacagctaaaaattatgaactaagactggaacagtaaaaaatgatcatgaaaggtagccttggaggtaaatgtttatatcagcatggcagtgggaagccttaggtaggtaacaagataagaaagctgaatatgaaattctagccttaagccagggacacttgaagggaaccagagaagattgatagagcccatagttcctggaagaagcaaatataaattctctctctgaaggaaaaccttcttcatttaccacctaggattctctgtttaagatcaactagatttgaagtcacaatccaagatgaccaaatacagaaggagacaaatcattattaaggagttggctgaaaaatacaacagaccccaagaacttaagatattgaagggatcaggtatagaatattaaataactatgcataaaatatttaaagatacaagagaggaactcacaaaaatgagcgagcagcaagagagtatcaaatatgaccaagaagatttgaaaatgtaccaaatagaatgtctgtacatgaaaaatgtagttgttggaataaaaacctccagattggttaaatagcagcttaaacctagcttcagagagaattagtgaactagaagatggtttgaagaaatcacaaagaatgtagcacagaggcagagaaatggaatatatgacagagaggttaggagaaatggaatatgaaggtttaatgtaagtctctagtcagaatcccagaaagcaagacaagaaaatgcaggagagacaatattggaagagataatggctgaaaattttctaaaattattgaaagacttgaatttatagatatagaaaagctcaactttgacaaagcagaataattaaacccacacctgaagatactgtaggtgaaactgtgtctggtaaccagcctccaagatgatcccgaatgattctttctttcacacccttatattgtcctcactcacacttaatggggctgaatttcataactaatagggtattgtgcaaatgaaggggtgtgacgttggaggttaagtcatgaaaggcattgtggcttccaccttgcccattcttggatcactcactctggatgaagccaatcaccatgttgtgaggtcactcaggcaacccatggaaaagccctactggagaagaattgagccctcctgccaataaccagcatcagcttatgaggcatgagtgagctaccttggaagtgtatccttctgccctggccagcccttcagatgattatagctctagctagcatctcagctgcagcctcataaaataccttcagccagaatcagccagctaagctgcttctgagttcttgagccacagaaactgtggaataataggtgtttattgttttaagccgctgtgttttggggata

SEQ ID NO: 29494 - DNA, 1072 bp, Homo sapiens
gtatagaagagagaagactgaggactgagtcttgtggcacttcaacattcagaatttaggaaaagatgggaatatcagcaaaggagcctgaggaggagcagcgaatgtggtaagagaaaaaactggagaacgtgatatcctagaagctaagtgaaggagagaatgacccgttgtgtcaaatactaagattatgtcctgaagaaagaccactttggttataggatggatgatggactacagagaggcaagactgtaggtggggaaatagatgctgttgctctacttaggggagaaatgataaatattgtcttaggccggggtggtggcagttgggatggagtgtggtagataaattcagcaggcagaattagtagacttggtaattgggtatgggctgaatgttataggtcttaagtttaacttcgtaaatgattgaactttaaaaactatagtactcgaatgagtaaataaaaaactgaagttactgtggctggagtactttcggattctttggagactgagatttttagtattatttgaactgatcttggttgtacaagtttggctaagtgaaactaatgacattttaactgacattttggattagggcatatcaattgatctttgtagaaaaactgtttctaagcatatggataagataaagatatctaggggcatgcatgattaatgaaatcatgtgaaccattttcaagcagtcatttttgagcaggccctctacatatcaactctttttgggtcatcattcacttggaaataaataaaccgaaattctctcttttttttttttgagatggagtcttgcttttgttgcccaggctggagtgcagtggcgtgatctcggctcactgcaatccccgcctcccgggttcaagctattctcctgccttagcctcctgagtagctgggattacaggtgcccgccaccatacccagctaatttttgtacttttagtagagacagggttttgccatgttggccaggctggtctgttttgatctcctgacctcaggtgattcgcctgtcttggcctcccaaagtgctgggattaca

SEQ ID NO: 29495 - DNA, 1060 bp, Homo sapiens
agagggcacaaaaaattggaatgatattccatgtacatggattggaagaatcaatattgttaaaacatccatactacctaaagcagtctacatattcagtgcaatctctttcgaaataacaatcacattcttcacagaaatagaaaaaatactcctaaaatttatatggaaccacaaaagacccagaatagccaaagctgccctaagcaaaaagaacaaaactggaggacttcaaattatactacagagccatagtaaccaaaatagcatggtactggcctaaaaacaaacacatagaccaatggaacagaatagggagcgtagaaacaaatccgtacatctgcagtgaactcatttttgacaaaggtgccaagaacatacattggggaaaaagatactcttcaataaatggagctcagaaaactggatatccatatggagaaggatgaaactagacccttatctcttgccacaaaaaccaaatcaaaatggattgaagacttaaatctaagacctcaaactatgaaactactaaaagaaaacattgggagaaactctctaggacattggagtgggcaaatatttcttcagtaatactccataagcccagacaatcaaagtaaaaatggacaaatgggatcacatcaagttaaaagcttctgcacagcaaaggaaacaatctagaaagtgaagagacagcccacagagtgggagaagatatttgcaaactatccatctgacaagggattaacaatcagaatatataaggagctcaaacaactctatgggaaaaaaatctagtaatctgaattaaaaatgggcaaacaatctgaatagatatttctgaaaagaagacatacaaatggcaaaaaggcatatgagaagctgttcaacatcattgtttatcagaaaaatgcaaatcaaaattacaatgagctatcatttcaccccagtaaaaatggcttttatccaaaagacaatcaataacaaatgctgttgagtatatggagaaaagggaactcgcatacaccgtttgtgggaatgtaaattagtaaaactg

SEQ ID NO: 29496 - DNA, 1034 bp, Homo sapiens
gttataaaattattaatcacatttagttttctctgatttgtaataagtccaatgaaaggtacacttcatatatttgtattatttatacaaaatagctgaaaattgtatagatatccaaagaattttgatctcatataaaaaatattggttgaagcactttctatatatgctttaaatgtgtcaggtactcagcattattagctaaacatcaagatccaaggcctagtgataaacaggcaataatttttcaggtatgaggttcattcctgtcttgtttcccatagtgactatgccaaaagatcagtctttaaactttccttttccttttcatcctcttacacagggtcttgctttctgctttacagagaaaagaaagatcatcaggttttaatttcatctgtttcctgtcatccccttatactataaatatgtatacatttgtattcacttgatgtctatctttccatagatagaaatctatggagtcttgccccatcggttgttctctcactctatctttaatctttctatagattctttttaaaaatctatatattattgattttattacttttatttgtaaaactgtgtccaatacagatgtaactaaaacacagttaaaattgatctttcttactactttctttcttttttttttttttgagacggagtctcgctcagttgcccaggctggaatgtagtggtgcaatcttggctccctgcaagctctgcctcccaggttcacgctattctcctgcctcagcctcccgagtagctgggactacaggcgcccaccaccacgcccagctaattttttgtatttttgtagagagggggtttcaccatgttagccaggatggtctcaatctcctgacctcgtgatttgaccgcctcagcctcccaaagtgctgggattacaggcatgagccaccgcacccggcttcttcttctttttttttttttaattgtaccttaagttcagggatacatgtgcagaacttgcaggtttgttacataggtatacatggggcatg

SEQ ID NO: 29497 - DNA, 1020 bp, Homo sapiens
agcatccctcttgcctcagactcccaaaatggctgggattacgatgtgagccaccgtgcctctcccataaattattttttaaagactaagcaacaagatttaattatgcagttattttatttgaaggttctatggcagttgtaagctatgttggctgatcaaactgttaagtgcctagcacattgtaaaccttcaataaatatttgttgaaaggaagaatggaagaattacagctgatgacccatatttttttgtggactgaaagaaatgaaattagttggatggttgccaaattgctgtattccgagggacaaatttgttacccaataacaaccggagtttgttactctggtttcagagaacctggggaacaaatgacttttaaccttttggtcagtattttattgaaaataggacctttatacctcatcatactcataactgctttaaagtctcaatctagagccttcttctaattgacatggtactagggctacccttatttggacccctcatggactaagttactttttttagaaaaattatttttagtagagatgggggtctcgctattttgcccaggctggtcgtgagctcctggcctcaagggatcctcccacctcggccttccaaagtgctgggattacaggcatgagccaccacgcccagcttgctcatagactgaattacttggattttgtggatcccatcataatcagatcagctttgctgaaggttcatgagccattgtgccaagctgattgtggacattcagcaaatggtgtcatagcaaagcatttctttcagatgggggagggattaaaaagtttattctaaaaactagttaccaaaggttcagaatttgataatgccttacctgctcactgataataataaaaccgtccttcctacatttgatttgtataggcaaaatataggctaaattatacaatttagaagtagggataaagaacttgccatttatggctattctttttctttaatccttactagtcaaaa

SEQ ID NO: 29498 - DNA, 1037 bp, Homo sapiens
tgaagcttagtttggctggatatgaaattatgggttgaaaattcttttctttaagaatgttgaatattggcccccactctgttctggcttgtagggtttctgcagagagatctgccgttagtctgatgggcttcccattgtgggtaacctgacctttctctctggctgcccttaacattttttccttcatttcaaccttggtaaatctgacgattatgtgtcttggggttgctcttctcgagcagtgtcttagtggtgttctctgtatttcctgaatttgaatgttggtctgggttggggaagttctcttggataatatcctgaagagtgttttccaacttggttccattttcctcatcactttcaggtacaacaatcaaacatagatttggtcttttcacatagtcccatatttcttggaggctttgttcgttccttttccttcttttttctctaatcttgtcttctcactttatttcattaagttgatcttccatctctgatattttttcttccgcttgatcgattcagctattgatacttgtgtatgcttcatgaagttctcatgctgtgtttttctgcttcatcaggtcatttatgttcttctctaagctggttattctagttggcaatttgtctgaccttttttcaaggttcttagcttccttgcattgggtttgaaaatgatcctttggcttgaaggagtttgttattacccaccttctgaagcctacttctgtcaatttgtcaaactcattctctgtccagttttgttcccttgctggtgaggagttgtgatcctttggaggagaagaggcgttctggtttttggaattttcagcctttttgtgctggtttctccccatcttcatggatttatctacctttggtctttgatggtgtctccaagtggacgtccttttttgttgatgttgatgctattcctctctgtttgttttccttctaacagtcaggcccctctgctgcaggtctgttggagtttgctggaggtccactttagaccctgtttgcctgag

SEQ ID NO: 29499 - DNA, 1115 bp, Homo sapiens
atttttgcatctatgtttaagagagatactgatctgtagcctttttttttctcatgatgtatttgtttcgttttggtatcgaagtgattctgtccttatgtaatgagttgtaaagtattctgtctgtattttctgaaagagtttgtgtaggattggcattatttcttccttaagtattggatagaattcaccagtcaagccatatttatctttatctgtacttttctttgttggaaggttttaattatgaattcaatttctttgattgatgtagggctattcaaattttctaattctttttagatcagttttggtaattgtttctttcaagtaccttttcatttaatctaggttgtcaactttattgggataaagttgttaatattcctttattatcctttttaatatctgaagaatccatagtgatgttcgttttatcattcttgattttttttttttgagacagagtcttgctctgttgcccagtctggagtgcagtggtgtgatgtcagctcactgcaagctctgcctcccgggttcacgccattctcctgcctcagcctcctgagtagctggggctacaggcacctgccaccacgcctggctaattttttgtatttttagtagagacagggtttcaccgtgttagccagcatgcattcttgatattgttaatctgcccttttctggtcagtctacctagagatttatcaattctattcatctttctagacaatgagttattagtctcattgattttctatattgtagtgcattttatctttcactgatgtctgctgtttattatttccttttttctacttttttttgcatttactttgctctttgttttcatttcttaagaagagaacataggccattgactttagatctttctttttttttaaaatatgagcatttatagctgaatatttctctttaagcactgtttttgctgcatcttacaaattttgacatgtattttaattattattcagttccatattttccaattttccttgtaaacacattattgatccatggattatttagaagtttgttgtttaatttccaaatatttgtgttttcttagttatcttattgttgatttctaa

SEQ ID NO: 29500 - DNA, 1014 bp, Homo sapiens
ctgcccacctcggctttccaaagtgctgggattacagctgtgagtcaccgcacccagccttcctcccaattttatatatgggaaaacaactaaggcacaaaggttgtcttcccgcaaaagaccaagacttggggcttcaactgagaggtattatagtccttttaaacttgatatttagaagaggacgatcaagaggaagttggttatgctacttgctttcagtatacatcgttcagaggtcagaagccataagggagagaaatatctattagataagcatgtctgagttgggggctgtggtgaggactcagttgtcaatgatgacaaccagtaatttttggttctagaatttcacatcaaatgcccccactttactggaagcatattgaggaactttgataatcttaaagaagccagtgattttcttttgaacatttctccattttcctttattttcagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgggctttgtgcttctgcttgataatcggttctttagttgaatggctttattatttatttatttgagatggagtctcactctgttgcccagcctgaatgaagtgcagtggtgcaggcttggctcactgcaacctctgcttcccaggttcaagcgattcttgtgcctcagcctcctgagtagctgggattacaggtatgcaccaccatgcctgttaatttttatatattttgtagagacagggttttgccatgttggccagcctggtcttgaacttctgacctcaggtgatctgtctgcctcagtctcttaaagt

SEQ ID NO: 29501 - DNA, 1069 bp, Homo sapiens
ctgccttgagctcccaaagtgctaggattacaggcatgagccaccgtgcccgcccacaagcctttttaaaaaaaaaatttaattttaattttaatttttgtgggcacatagtaggtgtacatgtttatggggtacaacgcaagccctttttaatggtagctgtcacctactcagtgtattgctcccttattggtttattccatttatttatattgagtaaccaagaatattaacatgaattgagtacagtttgtggatatgtgaaaattttgtttcctaaaaaaatatggccaggcagggtggctgatgcctgtaatcccagcactttgggaggctgaggtgggaaggtcactttagcccaagagttccagaccagcttgggcaacattgtgagatcccgtctctacaaaaaaataaagaagttagctggttgaagtggcatgctttgtgcctatggtcctagctactcatgaggctgaggtgggaggatcacttgagctgaggaggttgaggctgtagtgagctaagatggtgccactgcacttcagcctgggggacagagtgagaccttgtttcaagaaaaaaaaaaaagagaaaagaaaagaaaagaaatatggcatagtatgttggtgtttgttcatttttatatgctatttcagacaatagttttttcaaagacaaagtctttgcattgaggaataggttaactcacataaacagatatatatttgtatcacataaatagatatttacaaatatatatttgtataggttccctttaaaaatattctcaggactgcaataaccaaatatatcattttggtggaatttttgtgtttatttggtatgttctcaaaacattttctgttacccatttgaatttttattgaaattgacaccttacatttctgctgtgtgaagagttgtttattatcttaaagtgaaatgaaaggttaattgttctaagttgcttttttcatttccctgctttttaaagatcttctcaaacaaatttgtaaactttaccccaacagttttctatgattttggagaatatggttgtgtgtat

SEQ ID NO: 29502 - DNA, 1081 bp, Homo sapiens
ggtggtttctcatttctgattttataacactcattatgtattgataacatttgtatggtatctatttgtgtattattttttatttttatttttgtgtgttatttcacacagtcattttaatttatttttattttatttctttgtgagacagggtgttgctctgttacccaggctggagggtagtggcacgatcagagctcactgtggccttgatctcccaggtcaagggagatcaggcatgcagcaccatgcacaactaatgtgtgtttttgttttttagagttggggttgcgctgtgttgccagggctggtcttgaactcctgggctcaacccatcctcctgccttagcctcccaaagtgctgagattagtagcgtgagccaccatgcccagccaaatatttctttttttatttcctgtgtgtgtgtgtgtgtgtgtgtgtgtgtgtgtgtgtgttagtgtcagagtcttgctctgttgcacaggctggagtgcagtggtacgatcttgactcactgcaacctccacttccagggctcaagtgatcctcccaccttagcctcccaagtagctgggactatgggcttgaaccaccgtgcctggctaatttttgtattttgtgtagagatggggtattaccatgttgcccaggctggtcttgaactcctaagctcaagcaatccacccatctcggcctcccaaagtgctaggattacaggcatgagccactgtgcctggccatgtgtatagtatttcattgtgtatatatacaccacatttactttgtccgttcattcatttatggacactttggttgcttccctatcttggctattgtgaataatgctgaaatgaacatgggagtgcagatatctcttcaacatactgatttaaatttttttttggatatatatccagaagtgggattgctggatcatatggtaattacaattttagctttttggggaacctttatactattttccaaaatggctgtactaatttactttcccaccaacagtgtaccagggttctcttttcttcacatcctctccaacatttgttattattcatctttttg

SEQ ID NO: 29503 - DNA, 1483 bp, Homo sapiens
gatctacctaaagtcatgcacagtttcactcaagtgtctgactccagatccgcttgcctctaatctctcatagtaacttgttgacacattttctccagttgtcctgtcttgcttaaaaagctgtggggaagactcagcctggctcaggtagtattagaccagcagtccctggtgtggcatactcagttttggcattgccttcctggtatgttttaaagaaaactcatcagaacctttgtatcttttttattttccttgagacagggtctcgctctgtcacccaggctggagtgcaggctcgatcacggctcactgcagcctcaacctcctggactcaagtgatcctcccacctcagcttcccaagtagctgggactacaggtgcacaccaccatgccctgctaattttttgtattttctgtagatactggatttcaccatggtgcccaggctggtcttgaattcctgggctcaagcaatctacctgcgttggcctcccaaagtgctgggattacagacatgaaccaccacacctggcagaacctttgtatcttgaaagctgtgtaaatacaatcagtgtgggtatcttagtccctccttatcagcggtagtagtttcacttaccaatggtcagctgcgatctgaaactattaagtggaaaattcataagaaatagtcaattcatggctgggcatggtggctcaggcctgtaatcctagcagtttgggaggctgaggtggacctgaggatcacctgaggtctgcagtttgagaccaggctggccaatacggtgaaaaccctgtctctactaaaaaaaatatacaaattagccgggcatggtggtgtgcgcctgtaatcccaactacttggaaggctgaagcaggagaattgcttgaacccaggaggtggaggttgcaatgagccaaaattgtgccactgcactccagcctgggtgactgagactccgtttcaaaaaaaaaaaaaaaaagaaataatcagttcataagtcttaaattacatggttttgcagtgcttgtgttcatgtcacccttatatttaataatggccccaaagcaaaagatgctggcaatttggatattgtaaagagaagctgtaaagtgtttccttttactgaaaaggtgaaagatctcaatttaatatggaaataaaaaaatttgtatgctgaggctgctaacgtctatggtaagaactaatcttctatttgtgaaattgtgaagaaggaaaaagaaagttgtgcataatttatatagggttctgtactatgcgaggtttcaggcatccactggggggtcttggatcttatccccctctgatggtggggactactatagtgttgtttcctatgttctcctagagtagtagcctgagtttggggaggaagagaatgccctcctctccctcccttttttttgttaatccgattaggtcagcagtggatgttactttgattttactggtggttc

SEQ ID NO: 29504 - DNA, 1406 bp, Homo sapiens
cagaacatctccccatggattctggcggtattgactcttcagattcagaggtagggatcattctgacttattaaagagctatataaccagttaattccatctgtttgatgcttgacatccctaactagacagatgagggttgaagttagtttttggtggggttggaggtgaacatcaactaccttcctagttccaggtaatatagaacatggagtgaagtgtagataaatgggtctggtgggtcccgaggtcatcttatcacataatgactaatttacattatggaacccagtacaaagtgttccagttagattttccattgtattctgacagttgtacttcatttaatttttgcctcttacagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatca

SEQ ID NO: 29505 - DNA, 1050 bp, Homo sapiens
gccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatcaagtgtgtccccagccagtgtgtcaggcccgaggctcttctgggcaggagtcccgggctgcagggaccccagggtcaaaggctccagtggtatgtgcggcagcagcccctcccgtggcactctgaggacagcgccttccctccatcctatccttggcaaactgactgctgcggcctgctgctgtccctgac

SEQ ID NO: 29506 - DNA, 1071 bp, Homo sapiens
tatggactccaaagtaccaggcagagtgggaaaggacgtctttctttttagtttttattttttttgagatggcctcagtgtattgcccaggttggtcttgaacccttgggctcaagcaatcctcctgcctcagcctcctgggtctctgggactacaggtgcacgccaccacacctggccccccttatttttgcctccacagtccaaaggagtgttttacagacagaaacgccctgctccagctgagaagcccacctctggcaaacaccccacataggaggggcccatcttagggaccagctctcagaaggctggtggggagtgggcctgcctaccagcctccccattgtggcagaggattaaagtgtcagatggggcctctgggagcggtagctgcttcaggcccctccccaccgggtccgctacactgggtgtcagtgggaaggttgcgtcatggacccagccagtgaggctaggactccctggggacccctggcagcccctcctgatgattcttcttcctgagcacgctcatgatgagcaaactgagcctctaagaagttgactgaaggggctgcttccccaaggaagcctgggggccagtaggtcctgacccttgggcagaccggggctaggggtggctctaccacttaccctcatgtgaccctggaggccacagaagtgcaccaggctccgagaggtggttccaatggttgcctctagcaaacttactgtgtgctgaatgcttcctgggcacccaggccctgtggcaccggctttgggagtattgtctcacttgagccacttgatggcccagcaaagtcactgccatcacccctttttagtaggtaatgacacctgggctccttggacagctcacatagcgagcagtagtggagctcccaggaaagcctagtgtgctgagccaccaagcggacctggggttccccaaatggtctccctctgtgtcccaggcaggctgatggcttcttgggcagagcacaggctggggtcagacagcccaaactctgattctcagcagcgccctcaccctatggggtctgacacaggc

SEQ ID NO: 29507 - DNA, 1035 bp, Homo sapiens
ataccaactgtgccctggtctcccaggtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtgagccagcgagctggccagggtgtgagtcatgactggcagctcagccccactgtggcccatactgccatgaaaccctcccttcctattacctcgtaaacagccctgacagacagatgagtgatgtgcgcgtaatggacaccgccccttttcctcctcactgcagtacagtcgagtcggggacacgtgagagtctgtggtggtgtgcgtggaaggcaggcaaaagttcttcattttgttttaattccatagtcatattttaataggaaatatattgacttggtttaaaattgatacaaaagcatatatagtgaaaagtttccctctcatcactttgtaggacacaaattctcctcccagaagtcatcacttttttgatttcttaggaaagttcaggagatcatttaggaatacaccagtagacccacagatacacacacatgcacccatccttcctatacacacatacacacacatatgcaaccaattcttatttttcatggtgcttctgttccatagtcatggcagacactgaattagcaagtactgaaccatagctcctaggagaaatatagagtttagtttctgtgagcatctagacccaacgtttttgtcaattgatcagttaataacctttttaaatgtgtgtttctgtttaaaaacaccttagttaatatatattgtcaattcattgacattgaactcatggccatggatactgtaattcatgccttagcgaagcttatcaaggacatgttttctctgaggcacatcacagccttctgtgcttggggacactaggcaagcacttcagtgctagggagcattttaaacaaggaaatc

SEQ ID NO: 29508 - DNA, 1039 bp, Homo sapiens
accacatctggctaatttataaattttttggtagagacagggtttcaccatgtttgtgaggctggtcttgaactcctgacctcaagtgatccacctgcctcagcctcccaagtgctaggattataggcatgaaccactgtgcccagccctaattaaggcttttttatttttatttatttttaattcatttattattattactttttgagatggagtctcactctgttgccgaggctggagtgcagtggcgtgatctccactcattgcaacttctgcctcccaggttcaagtgattctcctgcctcagcctcccaggtaactgggattacaggtgtgtgccaccatgcctggctaaattttgtatttttggtagagacagggtttctccatgtttgccaggctggtcttgaactcctgacctcaggtgatccacctgcctcagcctcccaaagtgctgggattacaggtgtgaatatatatatgtatatatgatggtatactactcaaccataaaaaggaatgtattaacagcatttgcagtgacctggatgaaactggagactattattctaagggaagtaactcaggaatggaaaactaaacattgtatgttctcactgatatgtgggagctaagctatgaggacgcaaaggcgtaagaatgatacaatggactttggggacttggaaggaagagtgggaggggggtgagggataaaagactccaaatatggtgcaatgtacactgcttgggtgatgggtgcaccaaagtctcccaaatcaccactaaaaaatgtactcatgtaaccaaacaccacctgttccccaataacttatggaaaaataaagtaataaaaattaaaaacaaactagttttattttttgctttaacatgtttactaatatagatgtaatttatttagccagtctcctattagtgtataatcagtatattttctgttgttccaaattataaccaaaactgaggtacatagatttcatatttgaatatttctgtatatacctaagtatttatttag

SEQ ID NO: 29509 - DNA, 1108 bp, Homo sapiens
ctggtgggcggatcacctgagatcaggagttcaagaccagcctggccaacatggtgaaaccccgtctctactaaaaatacaaaaattagctgggcatggtggtgcgcgcctgtaatcccagccactcgggaggctgaggcaggagaattgcttgaatccccgaggcggaggttgcactgagccgagatggtgccactgcaccatctggacaacagagcaagactccgtcttggaaaaaaaaaaaaagatgtagaaatgtaaaaatatttgagaattattacatagttgcagatatagtttgctaactccaagaggaaacacattttattttttgtgattgtcctgatgaaactttatccccccacaacatgctgttaagcttggttcccatcataagcatattccccctaagtggacttttactgattttccatggataatgcagacctccagtataaaagctattcctccaggtctctctgccgaccactgagtatcccagggataaggattttaagagtaagagctaagtaataaattcctgcccctagcagggccgttcattttacggatgaaaacctgatccttgctgggcgtggtggctcatgcctataatccaagccattcagaaggctgaggcaggaggattgcttgagcccaggagttcaagaccagcctgtgtaatatagtgagtccccattcagaaaaagaaaagaaacctgagcctagcaaggagaagagaatggtacctttggtggctgttaaatcaccaccgctaccctcagtccacatcagtcctttgaattccaaaggcaggtactctctagctcagaggtcctcgaacttcagcctgtgtgggagtcacccatcctggcacctgattagaaacacagacacccaagtcccattccaaatattctgactcaattgacctgagatgcaccaaggaagtgtatttttttatttttattttttgagccttgctctgtcgcccaggctagagtgcaagggcgcaatctcagctcactgcaacctctacctcatcggtttaagtgattctcctgccttagcctcccaagagctgggattataagtgtgcggctaattt

SEQ ID NO: 29510 - DNA, 1081 bp, Homo sapiens
aattagtaagctttcacatggagaaaaccttagcttgctggcaaataaagaaatgacaattacacttctatcaaagtagcaaatagaactcatggagagagccaaggtggaccagactctggggagtccgcagctttgtggcacagtaaatatgtcaaagtccttggagagaccaattataggacctcacattctgcaagctggcaattccacttaggacattctggaacagttggtaccagaatatactctgcagcattcagattaataggagacatctgagctagcctcaggggtgcagtggggaggctgccatggctggcaagctgagtcttagaactgcgcatttcccctctctcctctcttcccagccaaactgcaggccgctgtggtgttgaaccctggctactcctccatcccacctgttttccagctctgtttgaactggaaaggggagaaaaccaacagcaacgatgacaacattcgggtaagacccagctggggatgacaggaggagcaggcagagctcccgggggaggtggccgtggcagaacccactgcagctgaggacttgggcactgccttaattcccaaaacagaaggttgtgccaggatttgcagaatttgctggagcttgtgtggtgtactagaggaaagagcccagacctacttgcctaccttggggtccacaggtttccccacttagagagtaaggagaaatacctaccttgaaaggttattggcttgggctcctataaaaaatgtgaataagctctgaagcattatagaagcactggaatgacatgaggaatgacatcactgcagttgttaatcagcattgcagctgttaatcagcattgcagttgttaatcagcattgctgctactaagtcaaacatgccatggaacacgtttttaaccaacatcttctgacttaggtcttattttgagactgcttccctgcacacctctgttttcctggctgtgggcatatgaggcagggaaagctatgggtcagaatcaggaagacctcattgtcttgatgagggggcctgaggacaagccagtctagcttgatctga

SEQ ID NO: 29511 - DNA, 1049 bp, Homo sapiens
tttcatttctattttacatgggaggaaattcaggcttagttgcaagcccagtctgagcgctgagcctgagctctttgctccttccttcaccgctttctagtaccggacatctcctccttctccctcttcataacagggctgaggtgtcaccctcaggttgtaaagggcagggccacagggcctcgctccctcttctgcagtccctgcactcactttagaggcattgaaagctctgattcttcatacctcttctggcatctgactctgccagggctccctgctgaagtcctgggatgttgtgtttgggccgttgtgctgttgtcccacccaagccgcagcaagcctggcactgcccgtgggatctgacaccctcaagacttggtgctgagctgaggaagttgtctgtagttctaagacagttccagaactgtaaggaaaggctgaactctttggtatcagagtttctgtcctcactaccccactttcttctctttctattcttcatgtcttttaaaaaaaaaattctgaagaaactgaatatttcagatacagttgaggcctccctatcccactttattccctttctcctaataagtgaccactatttggattttatgcatttgctttccatcctttccccgctacacccttttttttttttttttcagtagagataaggtcttgctttgtcgcccaggctggagtgcagtggcacgatcatagctcactgcaatcttgaactcctggactcaagcaatccttcttccaccttagctccctgagtagctgcgactacaggtatgctaccatgctcagctaagattttttgtttttgtttttgtttttttgtagaggcatgttcttactatgttgccaagcctggtctcaaactcctggcctttcttccaaagtgctgggattgtaggcatcagccatcatgcctggcctctcccctttcaaaatttaatttaacttattttttgagacagggtcttgctctgttgcctagactggagtacagtggctcagtcatggctcactgcagcctc

SEQ ID NO: 29512 - DNA, 1050 bp, Homo sapiens
tgcctcccagttaagtgagacaatggcagccatgtgcttggtatagtgtagaatagagaataagcacttaggtgagagtcattgtttctgggatgtggacaggtgtggatttctgggtgagaacctctaagacaactggcagaggagttccatgtggctttaggccctcagtttgaatttctgtgctttggtgtgcaccaaaaaagagaggcattcactgctagtttcaggtgatgctggtttaggaatttgtacttaagttctctgttctcagtaaatgacggaaaaaaaagcttaagtgtcccaccttgtttcccttcatctggagcaaggacttttgcccttccacccttagtcagcaaggagctgggcagaggtgggagaaatgcagccccagagctggcctactcacactgcttagcagctttcctcagcagctttcctaacagacttcttcttgccccccagataagacgttatctgtggcaatcgaaggcagtgtggatgaagccaaggctctgttcaaacctccagaggactcccaaggtaatgtggtggttgggattcgtcccccagggacaccaggtcaccatccaagggcagtcctggtctttggagaactagctggactagttctgtgtagcaggaagcttgacttgaatgtcttagcaccctggagtagacaggaaagagagctcacttcccggagtcacaaggtgcggcccgtggatttcagccctgccactcactagctgactgaccccgaggaaggtatttaatatttcagagcctcagtttattcctttgtgaaaacagatagtaacacctcatgtaggattgttatgtggattaaataaggtaatgcacatacagcctttagcataattctcagcacatagtaccccctcaagttatgcatgcttctactactattattattatttgtgttactattattaccacagccaccaccaccatcacaaggaggggcttgtgttccatctaaatgacatcaaaaagccctttgaaaaaaatgagttatacgtcatt

SEQ ID NO: 29513 - DNA, 1089 bp, Homo sapiens
ataccacttagatatagcccagaaagcccctggcaggaaccatgtggtcagatgctggggagggactgagaaattatgctgcttcagagctaggagcttaagacagaccccttaacaagtcctcacagggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggaggtatgtgtctgagtggcgcttttccctcttcgcttgtccctccttggccctatctgagaggctggggcagcaggaaacctcccttctttgcttttatactcagggaaaaagtttttttggggaatagacagcctcaagcaactggtcagctctgtgctgcctttagagggtcccaagctgggggcatgctggactgtgtgtgaggagagagcaagttgcttcaactatcgaagccttagcttcccctctataaaatgaagagacgaaactttccatgaacgtttccatgagcccttcccggagctctcctctaaatagataaaagtggagctcctttggttgcaactgggaacagtgccaagtcccatggtttggccttcttggaagcccctccgtggggctccaggattccactgaacaagtgtagaaacctcggatctggtgccttctctccaggcttttccaggactggccgaatctgtggctgtcttgattggccaccaaggccaggactctcccctgcatgttgggaggcagcatgataagagagatgaagaccacacagactcaggcgaggcagctcaggggtgtgacctggttctgccacttggcagctgtatggccttaggcacgtcactcacgttgaaccttggttcctcatctataaggtggggacagatgtagtgcccacctccatgaggtgttgggattcccagagctatcacatggaataccctgagcctgactggccttcagtgctccattaac

SEQ ID NO: 29514 - DNA, 1018 bp, Homo sapiens
ctgcaacttccgcctctcacgttcaagcagttcttctgcctcagcctcccaagtagctgggattacaggcacgcaccaccacacccggctaatttttgtattttcagtagagacggggtttcgctatgttggccatgctggtctcgaactcctgacctcagatgtgatcctcctgccttggccccccaaagtgctgggattacaagcatgagccactgtgcctggcctaccgttcttttctaagtcagaggggttgcccaagcactgggtttataggcttagatcgggcagctttccccgagcccagaggacaagagttggggccctgagtcaccctcatcccatggaaccagcctcctccctgcacaccagaaaagctgctctcttgtcaggacacctggtttattttctctttctatcctctgcctctgttttgtgactgtacaggtctggatattgagagcagcttgaagcagttggctgagcggcgtactgacatcttcggtgtagaggaaacagccattggtaagaagatcggtgaggaggagatccagaagccagaggaaaaggtgcggctaaagtggaacctagtgccttctctgccccccgtcttccatacttggtcttagttccagaagcattgtggctttgctttcacttgcaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacagtaagccagcatctaccctggaactgacttttttagagcttcattcttgaggtcggacactgttggctgagaagtgcagctgccttttagtggggcctgagtgttggg

SEQ ID NO: 29515 - DNA, 1175 bp, Homo sapiens
aactcaaatgttcatcaaaggagaattgcttcaacaattttatgttgtaatccatgtgatagaatactgatatattttttaaaaaagaggttagctccacagaagtgacaggaaactgtccacaatgtgtcctgaggccaaaacaagttgcagaacagtatgtaaacagtttgtaacttttttgtaactacataggtaaaaatacttttggctttacttctttgtctgcttagactcccagattctctgatgataccactctggtgcttgtcctaatgggaaagtttcctgaaatcctgcgatgagtttgacagtttcaaaattccttcaaacatacagtgaatgacagacaattcctgtgaatatgtgtgtgtgtgtgtgtgtgtgtgtgtgtttgtgtatgtcctgttttctatttatttatttaagataacctgattgtcatcctcgcgcaggggccatgctaatctctgtattgtttcaattttagtgtatgtgctgacaaagcgagcactgtatgccctgtttattatggaaacatgtaatgcttctagatggaagatatttgataggataatagacattagcagtggtttcctctggaaagagaaaatgggcatgcacttggcagagaaagcttccacactttggcagaggaacaggctgcttttaatctaaccctgtttctttgagaagttgttccatttcagccaaacaccgcttcaggagaactgaatgtgaaaacaaaaacactagttctgccccatccctatcccggtcttctctcactgttctcagcaagaaaaaaaatatcctgtatttaatcctaagacttaaccttttcctgaccctggacaaaatgcatagtttagacaaagggtagacacaccacccactctttcctcatggtgaaggtgttagtcatctatttttcccctgtactagaggtctttcagagccaatagtccctctggcaagagtgaagcttcatctctgccctggatgatagagtcttagcaaccagaatcagccatgctggaggagaggtcctttgcattcattgcaccaagtactaggtcgataatggccctgcctagcaagatacttggcctcagaaacaagaaaggggttgatcagagaaccacaggccagagggaagtggagtcattgcagct

SEQ ID NO: 29516 - DNA, 1050 bp, Homo sapiens
ggattgaaggatcctggggtgaggagggggtaattgtgtcctaagagggtgagtttatgggctgggtggccagcaggtcccagggagctgagtctcaggacaggcagctcatgtctgtgtacccgtgtgggctctccctgtccctgtaggagttttggtggggaagtgtcctgggacaaatctttgtgcattggggccacctatgacgtcacagactcccgcatcacccatcagattgtcgaccggcctgggcagcagacctcagtcattggcaggtaggccctcaagggtcctcgtccggatttctgggtatcctgtctcaaaggccctgcgatgcagcaggaccctgagttgccctctgtgactcgtttttgcctgccactctgcgccaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggtgagcgggatgggactgggctggccttgacccctgggcccacgctggctgtttcccttagctgccaaggtggaaagctccagggaacaggcagtaggagcagaaagccctttgaagtcacctgtagaataaggcttaggagaagggacatctacctcctggggtcaggtgttatttgacgttcaggatgactgagcagaagaacatgctgcattgtcatcagagtttacattggaggcgacagagctcaggactgggggtcttggaatttcctctgatggcagctgggctgtggggaggtgcaagagagggccacaattgggacatccctgaactgcccatggctaaagacggcagggtcagagaggatggggcctgggcctgttgtcaccctgccagagagacagtagattcccagggcattcagaggacattggctttctctaggaaacctgaatgagtcagaagaggag

SEQ ID NO: 29517 - DNA, 1026 bp, Homo sapiens
caagatcatgccattgcactccagcctgggtgacagatcaaggccctgtctcaaaaaataataataaaaataataaatgcagaaggaattatagaattagaaaaaaattatatttgccaactcctaatgaaatactgtaatggatcaaataatcaccaatagttaactaagtgatggggttgatggggaacgtctgaaaggatcaggctgacatcagctgattctacctgttgatcttagcatcacaaaaagtgcaacaggatataatgtgcctccccccatgtgaccaaacaggaaaaacagcaccacctatgattatttttataccacctccctccattcaaaaaaactaaatctgtttagtttttagtttgaacagtacttttaaaatgcaggagacagaggaacatgctaaatggcagaaggagtcagtcagtcaaatccaaaaatagaaaaatctacatcctaacgacaagttttattcaataaatgcatggcctaggaaaaggaggtgaattggaaaatgttataaagtttcgaaagatgtatcaaccagatacagtgtgtgtgaactttattttaatcctgattcaaacaaaccattaaaaaaatactgctgggcacggtggctcacgcctgtaatcccagcactttgggaggctgaggtaggtggatcacctgaggtcaggagttcgagaccagcctggtcaacatggcaaaaccttgtctccactaaaaatacaaaaattagccaagcgtggtggcagacgcctgtaatcccagccactagggaggctgaggcaggagaatcacttgaacccaggaggtggacgttgcagtgagctaagatcgcaccactgcactccagcctgggcaataagagtgaaacttcatctcaaaaaaaaaaaaaaaaaaaaagtccgggcacattggctcacacctgtaaccccagcactttgggaggccaaggcgggtggaatcacctgaggttgggagttcgagaccagcctgaccaacatggagaaa

SEQ ID NO: 29518 - DNA, 1042 bp, Homo sapiens
cttcattgtcttctgacttcctttggaggctctcagtctaatctgttctcggtctaattggccttcctttggagatgaattttcaggatctcactctgttgcttgggctggagtgcagtgatgtgatcatagctcactgcagcctcaaattcttgggctcaagcaatcctccagcctcagtctcctgggaagctaggactacagacacataccactttgcctaatttagtttttatttttatttttttgtagagatggggtctcttctgttttcccatgatggtctccaactgctggtctcaagtgatccttctgcctcagcctcccaaagtgctggtatgacaggtgtgagccactgtacccagcctaatttatgctgtttgaaggtaatttaaaaaaatctgcttgtaagattttgttgtcttagtaatcttgcagtttcactatgttgtatttagctgtggatatctttttatttaccataattaggatttgttgagcttaactttgtatattggtgcttttcatgatttcttgaaaaacttttagccataactcttccaagattgcttctgttccataaaaaattcttttctccttctgaaatagatcagacatatgtgggatcttatctttcatgtcttaacgtccctttgatatttttcacctctttgtgtctctgtgttgtattccaaatttcttcagatctcacttctgcttcactaatactctcttcagctgtgtaatctgttgtaaaactattcactgaattatttttagtgattttaaaacattttcttgaaatttgtttagtatttttgaatatttactcttcacttattttcaagctgcctttctgtttctagaaatatattaaacatgcttattttctcttctgtatctgataattttgctgtgtggaagagttttctgtctgattctgctatctgttatttctggttgcccttgctcatgggtgcttgtttccttgtgtgtttggagattttatactgtgagctgctcattttccctgcagtttcat

SEQ ID NO: 29519 - DNA, 1057 bp, Homo sapiens
tgcaggattggagcacattccccctaattgttatgcagttagctggctggatgaattggttgaggggttaaggtagataactttaatgtgagaggaagcaaaatctcagagcacttcagagaacaactgtttccgagaatgagactgtcaagtggcaggaattaagagttggatttgcagctcctctagatctgccacttgaattccattttggggggagtgttaccatggaacattgttttatcagggggagtattttgggcttccctgatcatggtgtttcctatttggtggtgattttgtggaatgtgctatgagctcattttccttttgaagaaatgtgttactctatgtcagaaactatgactcagatacctagagagagcctgggcaggtagtaaagcaggtgagtgtatggagaacaggaaaacagagctgatgctgtgggtctcgtcttgggagtggctgctacacagccccagtgattactgctatgctggaaggaaggactaatgaatccagaatattctgagtttaaatcattttagtaattgactatgtaagctaaacacacatttggccgattctccttgtggctcagatgtctgcagagctgtttctggtgaggtctatgccccctcattgtgggagatcagggcagctctgtggactacccagcctcagactggactcttatctcctttcctatgtaagacatggaggccagggcttgaaagaaggggggctaagaggttctgtggaaagaaatccgcaacttccacagaagcaggtaattgaattcagacttacaatttaattcatctgtgttgattagctgtgattaaatttgttctggttctgtttagatctgagccttaatcatagcaaacttgttcaggtagggaatggtaggccttccgtcattacgtagcaagccagtgggtttgtctgcctttttggtgtggtatgtgagttcattctgcatacttgagtgagagaagcgtggcagctggaaagagcaggcttctaggagaagtaggataggaaaatatagcct

SEQ ID NO: 29520 - DNA, 1050 bp, Homo sapiens
tgttgttctggttttgagtgaagccccaagagaaaggtttctatttctgaaatgctcacttccagctgtacatacctttggatggaataagatttagtggaattggagtttgtgcaaatggaattgtgagtcacgtttccagtcttgtcgtggaaatgtgttgttttgtttgagggagggtggtggtttgatcagtcagcagcatcagttgggccttgtgtgcagttgtgctttgggtgtatggagaagaaagagagtacttccgaagaaatcaggacctggtatccggactttgtgatttgtctttcagggcaggaaccaaatggtaataacagacacttaccatgtgccaggcacacgaataatctcatttaatcctcatgatagccctgtgaggttgtaggtactattattttcagatgaagaaattgaggtttataagggtgaagttactttcccaaaggcattaaaaatgcctatgtgtagagcgctagggtaggaaccaggtctttctgactgcaaaatggagctgctgtgcatttcacttaaatgacaagctaaggttcaaatctcacttccgctactacgtctctaagcctcagcttcctcctttgtaaattgagatgataatgcataccaagtaggttaagaattacatgctatcattgctgtgagagcctggtttctgcctttatttctcctcctttgatgtttccatggcagattgctggcctgattcagtggatctgggtaggggctaggaatgtgtttttcacagatgaaatgaatcacctgtaatcatatgattctaatgcaggttatctaaatcccccaaaactgaagtctcctagaatcaggggaagccctgacttttcatctagattgtagatcagcctcctcctacctggttctgtcagttctgtggcctcagcaagccatttcacctctctgaatgtctgtttcttaatggcctcaggcaagccatttcacctccctgaatgtctgtttcttactctagaaaatggggttctaatctctgacatttataga

SEQ ID NO: 29521 - DNA, 1059 bp, Homo sapiens
aaaaaatgctcaggccagatggaggtgcctttccaagccaaagcatgtatcttacatctgagtgtgctttctcaggaatggtaacagctaccgctggaaaaatagggcttatttaatcaatgcacagatgctaaagcagagaatgggcctcttctccaagtgatgttgaaggtacaaatcgtaatggtcaagtctacttggaagacgttttttaaaaaagatcatctctgctgtctcctactacatttggtgggtaaatttcagcaaggaagtttagttcctgacactcagaatgaagttggatttcaatttaaatgaaaaaggacccagtgtgtctttattctgtgctcagtacaactcctgttatgctttgggaaatgtccagagaggaggagatgggggtctttgctttaagaacttagtctttaattggagagacaattaatgcactatggataattagagaacaataactagatcttgagggaacagtcaagacagttaaggattaaatggtgtgatagaagcactaagcaccatagcattttggaaaaagacttgatttacttcaagtaccaggagattgggattcttggctaagggatctttaaccctacacttttctaccacagggccttgttaacacattcaacaggagaaatcagtccgtggaatctttttttttcacccaggctggaatgcagtgtgctatctaggctcactgcaacctccacctctcgggctcaagtgatcctcctacctcagcctcccgagcagctgagactacaggcacacaccaccatacctggttaatttttgtatatatattttttcaccatgttgcccaggctggtctcaaactcctgagctcaagtaatctgactgccttggccccccaaagtgctgggcttacaggctgagccgatgcgcttggccagtaataatcttaatactataaagttcttgttgttagttcatgggggaaagtattttcttatctccacttctgaaactgattgataactggacttggaaatctttccaaacatcagatgtagt

SEQ ID NO: 29522 - DNA, 1448 bp, Homo sapiens
gtttgataaatggttatctcagctctgaattttggaatgatggtaagtctggaattacagattttatgataatcttggaagaccatgaactggacttcagaatttcagttcttgttccagcttcaccaaagactttatgggataataatagtaacaacagttaattgcttcatatcagtcactattttaaacattgtccaaagcaatctttacaggaagcctttgggataaggattattcctattttgcatttgaggaaactgaggttcaaagagattaaattacatggtaatggctatatagctgccaagtggcagacttaaacggtgccaagatttaagacagtgggatttatctggccacagtagttggtgcttttaaccattaggcagtgcctactgtagtcagttttaccttcaagagcctatttgcttgtctataaagcaaagggtatacttcacagtttaaaagtcttcaattttagtttatctcaatgaatctctaaggactctgggatatttctcccttctttttccccctttgctattttatagcttattgatagatacttggcactgccaaggaaaggaaagaaaccagttaagtcatttgttggggaattttctgggactttgacttacccatgttgaactggaaccacctgcttgcatgaacatttgagggttggagtatcattttggaagctctggaatttcttacctggatcacaaattcgaccttagaagttgttctcctttttgatgtattagtcctaccagaagacagtataaaccctaaaccaacaagataagttttttatttctaatttcagaagatttttaaaacattgtggtgacctgattggaagttcatttatagagaaaataaattttaaaattctcacatgatgtgacttgtagctcataaagatggaagatgaaccacctgtgtgtaaagtggttcagtaagtcatcttcagagaagggaagatttgtctctcttctcctttgttctgttaaaatcttaggaacacgagaccatttcatggtgtctgacatctacagtattgcgaattaggaaataaatggtcctttgcttacttctcattaaatgtagacttagaagcagtgaccagatgagaagtgtggaaatcagtgtggtgcagtgaaaagaccgtgtgcttgcaaaccagccaaacctggacttgagtgtttcctggctgtgtccttggacaggtcaagttcttgaatctcagtttcttcaactataaaatggggctaatctgacagtttttacgaggattatatgaaatgatgtttgtaaagttcttagctcatacggtggtacacagtaaacattgtgtgaatggtgagtgttactctataatagtttatataaaccagaagttggtcactgtggtggcaacttgtttggtgctagtcattagg

SEQ ID NO: 29523 - DNA, 1047 bp, Homo sapiens
ccttcaggaccatccacacgagactcagattgtctgaattgagctatcgcaacttaatgctaaaagctccttaaagctacagatttatgacatagttccttccaaaatattacatcataaatcattgagaagattaaaaaaaaacacttgaagaaattgtagttttaaacatctctgcatatattttggatagctactaggttactttaactgtcattaaggagcacagacttactgaagctttactggacagaatcctgggaaatcgatatcattataaggttatatttcccagttagcgggtgaagggctggagaccttattgcagtcatggctttcacaaattacagcagtctgaatcgagctcagctaacctttgaatatctgcacacaaattcgtaagtatcctctaggtgccactgaggtaaccagtaactcgttccttgatattatatggaaatcgtttccccagaaaattttgctttttcactttttgagatgtatcccactggagtgaaatgtgtcactggatatcttgagctctgtattgaagaactgagatcagtgaaatacttgttgctaatccagaagaatctgatttttgtttattggatcaaaattttctaaatgcaaactttagttatttgaagtcaatatgttgagttgtttcattcaagtgtttataggaatccaacaaatactgctctattggatcgccaaatgttggactattttagtatcaaccgtttcccctctgtagtgacaacgtcctaaacagttaggtttataacaagtgtttactttctaacaagaaaacagaagacatttaaatgacaactttcaagaagaaaatttttattttttcagaagttggcattatcttcctggcagattgctcacatccaatattatttgtatatgctaaacaggaaacggcaacttgtttatatctctatttagatagtctttccccaaaatttccacagaaacatacagtgttcatggttcttgagttcatgaaggagtaatctaatcactccaacatgg

SEQ ID NO: 29524 - DNA, 1035 bp, Homo sapiens
gaagaaagacgcggcgcgagcgccaacggccaccgggcgcgcgccgcggcggccgggcctgcgccccaagagctggatgccagagcaggagaaagagccgccaaccgatcgctcgatcgaccgcacgcccgttccttcgccctaccagacccgggagggggggagggcgcgccagggcttcttcgatttaggggcctgactccccggcgacgagacaagatggctcctccggtccgcaccgcagctaccgtcccggctgcgtcgctcggcccgcccccggtactgtttctttaaatggcggagagggtcaggaaagcaggaagagaggcgcacgctgtcacgtgacaggggcgggaccggccaaccaagatccggtcacatggggacacgcagcccgccaatcaggaggctgtacatcagggcgggggcgggaggagctgcagctttgtgattggctgaatgctccgcggaggcctcgggggcttggggcgtcggggagtgtgcgaggtggccggggctgtgtgcactatcggagacaaagcggtggctgtggtgtctgtgacggcggcggcagagcagctctaaacgccgaatttcgtgttgctgaatcctgtcaccatctcaactagcgcggcgcgcgggcggcgcgcgggcggcggcggaggcagcggcggcggcggcggaggcggcagcagcacatggttccaagagcgctctgcggctgttgggttccaattccgcggggagggacaaaggcagttgtgagatccgggtagtgcccggtcaggtggtgcgctcgccactgccctcgatccggtccttggaagccgggagtagctcctcttcgtggggaggcggccacgggaccgaggcccgggaagggcctgggaggctgaggctgttgtctgagggacgtgggggcggggcgcggcctgcccgaggtgctgtgggcgggtcatttgtgaggtgtttatgtgggccaagtgtgaggtaatctgaccaccaccctgaactgggtttggtccggctttgaaa

SEQ ID NO: 29525 - DNA, 1045 bp, Homo sapiens
acaggtgctgggctaggcagtctccctggaggatgacccagggtgggcctgctgggatctgtctttgccttgctgccttctctctctctgtctctgattctctcatcacagagcacattctgactcaggtagtgtgctgattagcccgggcagagtaggaggagcccagagggcagtgggggcaagcccggtggcctgggggggtaacctgcactctctgccctttttccaggtgtgggttgggagcagcagcggcctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggaccaccccagagggcagcagggcctttacccagtggcctgttggctagcctgggcctccctggagagggttgacagtggaagggaacaggaggggcatttggcctgagacccctgcttttgggagaggctagcagggtggttcctgcccagcatgcccagctcctccctgggtgactcggagtctttcccatgtcagagcccccaaatgggggtagcaaggagcacctttctggaaccccctatagcatccaagtttctttctgggctctcttgccttttcccccctttcacagatggcacccctgggcatctgtccttgcctaggtgattttggaggttggtgccttcctgggaactagccaccagcttatctgcttcccttcccctggcatcacttcccataggcctggggtttctagactggggcctggccacccctttccccactccacgagtgagtcggcctccagagaagactggcacaattccaactagagtcaacccatgctgccctctgcccttcccactcagatctagatcctgctttcatttctggctagtgaagtagacttttgtgtttt

SEQ ID NO: 29526 - DNA, 1068 bp, Homo sapiens
ggtgtacctggtagtgggcagtatcggacgtgttctccatgttggtgagcgatgtacatgctgtagctttattattctcatctataaatagggccattcatgccctcataaagttgttaaataagagtgatgtgtatgtaaatacctggccccatgctggcagggagtggagctttagtactattttacttcttacctaataggtgtgagtgtggaaatgggcaaatagtcaagttggcagggaagcagagcctcctgcctgccccagtgccacctgaactcctgtagtgttcttatgccactggaactggctggcaggggccagctctgacctcagagaattgtgggctcactctagggcaggaggagatcgcagagggcggaacggtggctcatacagccatgcccccaggtggcccaggacccacctgggagctacctccaatggctttgagcggtcagtgtgtggacaagcggagggaccgtgtctcaagaatatgtggaactcagcggggcatggtggctgacgcccgtaatcccagcactttgggaggcaggcagatcacctgaggtcaggagtttgagatgagcctggccaacatggtgaaaccccatctctactaaaaatacaaaaattagcccagtgtggtggcaggtacctgtagtcccagctacttgggaggctgaggcatgagaattgcttgaacccgggaggcagaggttgtggtgagccaagatcattccactgcactccagcctgggggatagagtcagactctgtctccaaaaaaaagacatggaacttaaacacaaggctaaacttctgggctggaaggaatcgagggatggccgactcaagatacctgcagccctgcatgaagctgtctgccaggaggctctacctaaaagcagttttgttttgttttgttttgttttttgagacggagttttactcttgttgcccagactggagtgcaatggcacgatctcaattcattgcaacctccacctcccaggttcaagcgattctcatgcctcagcctcctgagtagctgggattacacgtgc

SEQ ID NO: 29527 - DNA, 1023 bp, Homo sapiens
gctagtgagtgggatgcaaaagtcatcgtcaggacaccagcatcacctcttcatatcctcctgggagccactggcatggagcagccgccgatgggaaccgtcagagttctagggacatttccaagtcagtctattagagaagagtgagtggcacgtcctggaatgttggccaactctcctaggtttcttttgcttccccatttgctagtggatggggagatgggttgggggtggggggtctctatgtgccttgcttttgcaggttgacagtctatgccacactggagcagaaaaactgacatgagccagagggaaaagtgtgccacggctatgttctaggcccactgcctcagacatagcattgagacgagtgaaatacacacttggtcatccacggaggcttccaaggccatggccaaatacagttagaagagagccaggcttccgtaccagctctgaatgatgctaaccagattctgtcattctacatccactttgcccagactgtatagacacgacctatgtttcacctcaatacctctcccttcctgggacagggttcttagacactaaatgcttctctctgacttttttgcttaagggagtgggatgagtagtacattttgcccttgtccaggcatgtttaaggagctcctactggacaggttgcagactagcagtgagtcaacagagccctgtttgccagctctgttgccagtatagatgcagtgatgtggcggctatgtttcccagagacaacagtgggcacagctatagtgtcaccaacatggcagagatagtttcaactgtgcctgttacaggtgtggcactcgaaggaccagaagcagcggtttggaacatgggtaactgggagcagaggactggaagaaacagagctgggctccttccctgtcctgacaatgtaggagaggagttgttgtgaggccagccctgcccgtcgttgaaattctggacctaccctctagctaggtcccttcccctgctccaaagttgagaaggggg

SEQ ID NO: 29528 - DNA, 1052 bp, Homo sapiens
ttttaatttgcccttactattgctgtatttgacaaattagacatcaaataaaaagccttaatattccaaatagcttaggagggccttgttcattgtgtgtctctaatgtagaatcattgtgtgtcagtaaagtggactggttcaggcgggacgcagtggctcatgcctgtaagcctagcacttcgggaggccaaggcaggtggatctctttagtccaggagtttgagaccagcctgggaaacatggcataacgttgtctctgctaaaaaatacaaaaattagtcaggcatagtggtgtatgcctgtagtcccagctactcaaaaggctgagatgggaagattgcttgaacccaggaggcagaggttgcagtgagccaggatcacaccactacactctagcctaggcaacagagctagaccctgtctccaaaatgtttaattaaaaaaacaacaggctggctacggtggctcatgcctgtagtcccagcactttgggaggctgaggcaggcagatcacgaggtcaagagatcgagaccatcctggaagctgggcaccgtggctcgtgcctgtaatcctagcactttgggaggctgcggccggcagatcacctgaggtcaggagttcgagaccagcctggccaacatggggaaaccctgtccctactaaaaatacaaaaattagctgggcatggtggcacacacctgtagtcccagctacttgggaagctgaggcaggagaatcgcttgaatccaggaggcagaggttgcagtgacccgagatcgtgccactgcactccagcctgtcaacagagcaagactccgtctcaaaaaaaaaaaaaaaaaaaaaaaaaaccccacaggcgtctgggtgcagtagctcacgtgtgtaatcccagcactttgggaggccgaggcgggcctgaccgacgtggtgaagccctctctctactacaaatacaaaaaaattttagctgggtgtagtggcttatgcctgtaattccagctactcagaggctgagtcaggaggatcccttgaacctgggaggccgggg

SEQ ID NO: 29529 - DNA, 1068 bp, Homo sapiens
aggtgatccacctgcctcggcctcccaaagtgctaggattgcatgcataagccaaccaggctgcttttatttatttgtttatttatttattttttgaaacagtctcattcttgtcacccacgctggaatgcagtggcgcaatctcggctgaccacaacttctgcctcccggattcaagcggttctcctgccttagcctcccgagtagctgggattacaggcacgtgtcaccatgcctggctaatttttgtatttttagtagagacggtttcaccatgttggccaggctggtcttgaactcctggcgtccggtgatcctctcaccttggctcccaaattgctgagattacaggcggtagccaccacacccagctgaatcttcttttctactcttgcgcccatcttgcagaaaacaaacacccattacaagtgaaaaactataaatagtaacacacaatcgcttgtaacattatctccttcacaaagcactaaacagccagcacctaactctgatatgtagagaacacagaataaatatatttttagttaatgaataaattacacaggtatcaccagatatggtttatgaacccctgccttttggcaatgtagaggcttcaaaaattggcatttacatacttcagctttagggtttatagaacttaaagtgaactgggaaggagttcttggggtgtgatcactgagaatagttggaaataatttcgtcaatatcattgtaccttctaattgaaaataagagaagaaaaagaatttgagagttaaactactcatctcaagaatccctaaagagtggccaggtatggtggcttacacctataatcccagcgctttgggaggccgagacaggtggatcacgaggtcaggagatcgagaccatcctggctaacaccgtgaaaccccgtttctactaaaaatacaaaaaaaattagccgggcatagtggcgggtgcctgtagtcccagctactcgggaggctgaggcaggagaatggcatgaacccgggaggcagaacttgcagtgagccgagatcacgccacggcactccagcc

SEQ ID NO: 29530 - DNA, 1042 bp, Homo sapiens
tctccagaacttttcttatcatcccaaactgaaactcagtacgcattaaatagtaactcaccattctccccttaccccgtctttgacaacaaccattctactttctgtctctatgaatttgactactctaggtacatcattcaagtggaatcatatggtatttgctgttttgttactggtcttaatatttttaaaagttaaatattccaatcatgaaacaaatatttcaatcatgagaagttaaaccagtaaaataataataatttcctgtcttaggatcgtgtcccaaagttattaaaacttgtaactaggccgggcgtggtggctcacgcctgtaatcccagcactttgggaggccaaggtgggcagatcatcaggtcaggagatcgagaccatcctggctaatacggtgaaaccccatctcgcctaaaaatacacacacaaaaaattagccgggcgtagtggcgggtgcctgtagtcccagctactccggaggctgaggcaggagaatggcgtgaacccgggatgtggagcttgcagtgagcggaggttgtgccactacattccagcctgggcgacagagcgagacttcgtctcaaaaataaataaataaataaatttgcaactaataattttgggatttgatcaagatcaccctgctgagggtgaactatcttagaacaggcacagtggaagggacagctgcaagagccaagctgaattgtgaaagaatgtattcagttctgaactccactcttgtaggaggaaggtcaaaatctgttacgcatgcaaaggttactagcaaggatgtggaatagattggtcttatttaagaactgtgcaccaaagataatcagagatggacatgtgacatcccacatggatgatttagcattgagaactctataccatgcttggtttttattgtttgtttttttggtgcttacatataagctatagagtgttaaactttttacatatttttttccccataatggtagatccacctgggttgaatatgttgtaaacactttggttctag

SEQ ID NO: 29531 - DNA, 1079 bp, Homo sapiens
aatggaaatggaatagaaagggtaggagaaactggcacttctgtaagtacatcttttggtatagttctaacttcatacttgaaaaataactaactagacaactgggatgtgagatgggcccaaagctgaatagaaactataacaagtgagtcttaactgtattacaaatgaataacaaaaccaatggggagggtagcccacattactttagcaaacagtaattcgactatatcctcttaaagaataaagtcaaaaaagaatagaaaatattagtaaatttgtttctcacaggggtaggacttagccatttctaaacaaaatgcctatatgtgttctaggattggggaaataagtaaatatatgtggataatgagagccagttttctctcagagaaataaattacaaaggaggggtggcaaacatgaaccctgacccaaacatgaactccatgaattggagttatcttttttttttttttttttttttttttttgagacagtctcactctgtcacgcaggctggagtgcagtggtgcgatcttggctcgctgcaacctcctcctcctgggttcaagcaattctcctgcctcagccttccaagtatctgggactacaggctcataccaccaggcctggctaactaattttttgtatttttagtagagacggggtttcaccgtgttagccaggatggtctcaatctcctgacctcgtgatccgcccacctcggcctcccaaagtgttaggattataggcatgagccacggcgcccagcctaacatggggttcttaatatatacacatagaaatggaaatacttgagtgtatacgatagggcctagaggtagcaacagacaccttgtagcaatgagcacacctagtcttggctctaaatacttttttccgataaaagaaaccaagattccttggagaaatggctgttccaggacaggagagggaaaaacgcaagatgtgcccggagcaatttgtggccaaatgctcagaaaattatggggatatatcagaaggacacagcagccaacttgaaggggctcccagtggccaagtatgggatgatt

SEQ ID NO: 29532 - DNA, 1004 bp, Homo sapiens
taacgagctggtttagtagtgtcttgtgctagcctgggtagagagagctgaagtatttagtaagcagtaaaggaatggaatcccactttatccctatcctccctcaaagaggaaaagtcagtatatgaaattttccagagttcctcagtatatattcattcaacaaatatttgccgagtacgtactatgggatagcatggggatatggcagtgaacaaaaaaggtaaggttcatgcccatgaaaacaaacagaaaaccatctttattttctcatttacatcaggtctatccttggatgctttaggcatgtcttattctcttctacattggcaggcccttcacgtttaaattgagaattgttcataaggcagtatttgaattgagatttgattgagagctgtctaatctcaaacgttattaaaggttaaggtatttatttttctacaaattcattaaggagaaatttttggtgccagataatgctggcatttaaagtagaacttattttcttcgttgtagccggtttgaactgaggcagccttcttctaacctatcaaggttttaaacttttatcccttcctgtgatttgtgtcagggtgaatcatttgatgtaaaagacttgactccataatctgcatctgtcctaatgctgtcatctggagtagagactcagccagttccacttgattcctccatgtctgccgtggtacaggaattatactctgaactcccagtaagtgtctccagagagcttcatgctgaccctgagccaagtgtgattccagatgtaaaacctggagcctcaagctctcttttaagtcagaatagggcattgcccttggagctgcagaggactcatgtggagagttgttgtgaagaaacctatgagaccttggatcatgggagtgagcctgggcgatgtgggctagtggactccacagcaggaggttctgtggcatctgggatcttggatagggcaaagagaagcgagagcatggagccaa

SEQ ID NO: 29533 - DNA, 2056 bp, Homo sapiens
actatttgtttaacttgtctgaatctcagtccatctccaatttgggttctgttttcttagaattgtcatgcgggctaagggagcatttgtgtaaatactagttatatagtaagcttttggtaagctgttgctattactattacttaatctgttaaaaaagaaaactaatatcttgcacagagaagcatatttttccatgcatgcccctcgcagcctccatcacaagtgttcaaccatcctttctcactggagtggaagactccctcccacttaggggttagagaaagagacacttccagtccccttagatcctgctgttcaatactttcccaaattaacaaagagggcctcactgaaaataatcagtaaaaaaaagacttagcttttggaaacaggtctgtgctcttaagagaaagtgagacctgatgccagacgccagcacttcctttgtccacagaaggtatcacttcttcctgactggttagagatgccctctcccacttccctgacttactgtagtgacaaaaaatcttccatctgcacatccttcccacccccccaagtgggcgattccatattcttcctgtcttttgctctcccaagaaaatgaagactctatacctttgaggagagatctcttccctcttgtatatggaaaatgacacagattgtttcttttctccttttcctttataaaacagaggaaaatcttttatacaggaagcctctgtcagtagaaatcaggagcattttccagtttcactccttacgtggagacagggatcctttttctggatgttattaaagggaggaaatgggaaatagtccttgatgctttagagattttctgcacgctccatgttgaagcgcttgccctgtttagtgtatgaacttccctgcctcacttttggtttgtcttgggattttattaaaaaactcttctttctttgtttctcaagaagaggcccattctccaaattccctcttggagggaatggctacaatgtctgaatctttggaaaagaaagcccctttctcaaggtgaaaagagtgttgtgagcttctgagggcctggtcattattgtgagtattgttcctgaagcaagcatggcagcgcctagtgttattaacagcccctatgcattggaattaaagggaggggagactttcagattcgggattattgaggcacacggttttatgttctgttttttttttgcttgttgctgtaaattttgtacctccagaacttttgttttggggagtgtttgaatgactaaaagttgccactttgtcaggtttttagtgttataaaatgtattctgatgagattgagagcaacaatgttaatccttcactggtaggtttgttttcctgtttttgtttttttttttttttggtgggataggaattaacactgccaaattacctgaaagcacactaaagaaacgcttaccatctttttttgtatgtaaagtgttcttaaattacctcaaacgccgttgagtaattgcagaggggattagtgggagctctataccaccattgttggtgtctgtaggtgtgcttttctgaaacaaagggaaatagaaaagttattctttggagtcttaggatatttatgggtgacaagaccctttgagcttattttgatgaacatgtgaaaaacaagcccgggaaagttcacttaactttcacttaacacactcaagactctgcatctagtatgtgagagcaggataagggaccctggcttcctgatgaagagaccagcagttaagactgctgggagaggccaggcgcggtggctcatgcctctaatcccagcactttgggaggccgaggcgggtggatcacctgaggtcgggagtttgagaccagcctgaccaacatggagaaactccatctttactaaaaatacaaaacaaattaggtgggcatggtggcacatgcctgtaatcccagctactaggaaggctgaggcaggagaatcgcttgaacctgggaggcagaggttgcggtgagccgagatcatgctgttgcactccagcctggg

SEQ ID NO: 29534 - DNA, 1033 bp, Homo sapiens
acattcccctgagtacttctctgcattttgtcatggatttgattaatcatgaaggcaacaaaatgtattttgctactactattcccatgcattcacatattgagaaaggagtaatgaagaccatcttgtggctatttgtttacacatcccattctctttcaagttcctagagggcaaatgttgactttgtgtcccacaaactgtcactgcactctgaaagattctcaagtacgtcttgactgagcaaatagatgaactcagaaacacattaaagggaaagttggctttcattgggtttttttgtggaatgaatttgaatgtagcctacctttctgcagtaaatctgaactgttcatttaagggaaagctaactggtttggactttgtggctcttgttccagatgcgctggtagctatggagaaggccatgaagagagacaagattatagtcaatgatcggcagttggcttgtgctcgaatcgcttccccagagggtcaagactatctgaagggaatggcagctgctgggaactatgcctgggtcaaccgctcttccatgaccttcttaacccgtcaggtacagtagaagttgctcttctgttccgagtcattcatgatgatgttaagtgctttaaaacatagtgcagtccaggctggacacggtggctcatgcctgtaatcccaacactttgggaggccgagggggggcggatcacaaggttaggagatccagaccatcctggctaacacggtgaaaccccgtctctactaaaaatacaaaaaattagcttagctggtcgtcgtggcgggtgcatgtagtcccagctactcgggaggctgaggcagcagaatggtgtgaacctggaaagtggagcttgcagtgagccgagatcgtgccactgcactccagcctgggtgacagagtgagactcctgtctccaaaagaaaaaaacatcgtgcagtccagtcaaagcctatggtgtttggttttggaaattcacatagttaactttcaaaataccagagaagtgtc

SEQ ID NO: 29535 - DNA, 1028 bp, Homo sapiens
gttctccttcaagaacttttcttcctgcatcatccctaaccgtggctattccatctgcacacgatccctgagtgctcttgtcagctacctcagcttcagctgccatctgcatgccaacagactcccgagtcacctttttccttcccagagcatcaggctcttatatccagttatgtcctctacatctctactttgtctcccatggaaacctcagagcctaaacatcccagaccaggctcagcatcttcccagacaccctcacctccctccttctcctcctcctctgcttcctcctgtgacctccatctctgcagcaggaaccaccagtcatttagttgcctcaaaacagaaacctgggagtcatctccccctcctccatgtccaaatggtctccaagtcttgtcaattgccccttgttaatgtttctctgacctgtatctttctctccacccatttccactatcttggacagctctggtaaagtcaaagcattcccaagaattaaactctgtgcttaaagcttaaaataatccccaacaggacataaaaaggaaataaagagatgagaaactcaggtccagaagggcctcccaaaacatggaaaggagggtgcactccaaggattaaaaaaaaaaaaaatgacacagacgagaataaactgaggtttgcaaaaatgctgagatcaagggaaaaggacttttctccttatgtttggaatgagaaaacttgcagtaacagtctcgaccaagttgatgaagcaaaggatgtcatattcatagctgagagagagaaaaacaaagctggtacctgtggtacgtttaccttctcttgggagtgaagattgtcctcctggagacaagcaaagagaacgttcctagaagaaagctggtaaggaggctgtcaatgagctcagtgttgcttgaaatctacccaggcccccatggatgcaattgctggcctatcccaaattatacttcactcctttgttcttttatacttgtggtgcctactctatgctgagaattgga

SEQ ID NO: 29536 - DNA, 1071 bp, Homo sapiens
taaagcattccctgctcccactcactcttctcaacacttctgttgttttctcagacgatttatcatctgacattgtcatgtttacttaattgttcagttgtttaccatctgcccccttcactagaatgataatgaaggctgagaaaagtgcatgttttcacagctatatttacactgtaccaccagtgggagctggggggaatctggcacataaaaagcactcaataaatagttgtaaaatgaattcaaaagtgtgctatgtcctggaacaagttaactctctgggcttcaatttgcccattgataaaataaaggagaatgaaatgggttgtatcaaaggattctctttgttctcacattttctggatctctggatccacaagttgcccttgggatggatggatggatggatggatggatgatttctgggggttttattgaagacacctgggacagaggagttatcaggagcaagatggaggcagggaaagggggcaaataactccagtcagaatgtgcttcttttaccccaagtgagagagaggcatgatcccctctttcctctgtgcccaccccatggaccacctttacccatggctgcaccaggggaggtggcagcagcagctgcctgcccaccaccgggagctccacccaggagataaaaggagccgaaggaatgtgctggcaaagctgacgtccctgtcttctcaagggtgtaaatgggtttcctgctcccacaggttcaaagagcacttcatttcacagcaaaagtacagctaatgagaaacagattgtctggctccagctgcagctctgagagcccaggaggcaaaggaaagcccccaagaacctggatgtgaacgtgtgtactaagggactgtttcctcccctttctctggggccacagagctatttcaacggcaggggaaggagttgcagagaggtgggggtagaggcaagagcaatgtccccactggcagttaagaggagcccttgggagagggcttctgagctctgggtcttccaatcatgctgagttctttttaggcctgggcgccaagtcaggcaatg

SEQ ID NO: 29537 - DNA, 1025 bp, Homo sapiens
atggaataaaaacaaataacttagaaaccacaaaaccacaggctccctaagggttctcccaacacaggaagtttgaagttaattagattgattaattaaatgagacaatgtatatgtacaaaggtactttgtaaccctgaagctagacaaatgatacactgttatattgctgatggtgatgacttgtagattcttaaatttactaatcagaggaaaacagcaagaggaacccgaaagattcttgtgattcagcatttcctcatccccccaggatcttgagaaccttcctcagtgacccttcccaaggtccttctcagatatctgctgcctctctggggatgctttgatgatgtctaggtgagaggaaagggccttcggaactaagggtgaaaagcagaggcctgaggggcctgcctggactgggtccctctgattcccagcctattgatcaccacaatcccaactcccaaaaaaaccctcctgaaagactcagaagctgaaaggacagatcaagaaaactggagaagtgatcacggcgtactggaatgaaaaacaggcatggagcacgtggggtctgggtgaagtcgctgccctgtttctctgtgaccttgggcaagtcacttcccatcccagcagataaattgtgggtgataattaccagcctccaaaggtgcctgcaataacctaggcagcctcccccctaacctctccaaagcagtgcttgtcgaagtcacccatgaccttcttggtgctcagtccggtcatcgaggtgcaggctcgtggtcctgctatgttcttccagcttgtgggtctcagcaccatctgcacaactgacagctcccacgcttttgccaccgccaacctagaactctcatgaactttttttttaaacaaattgtatttttattttaagttctggggtacatgtgcaggatgtgcaggcttgttacaaaggtaaacatgtaccatagtgatttgctgcacctatcaacccatcactgaggtattaagccgagtgtgcatta

SEQ ID NO: 29538 - DNA, 1027 bp, Homo sapiens
tttggcattggagcgatatcctgtgtcctgtcctaatgattcaagaggaaaagaccttgaaaattacataatccagctccccactttcacatctgtggaccaaaatgactacaacggccttctaacctgtctggctcctttcatagacacatcctctaggtctatttctacacagtggccaggtagaccagatatccctcttgtctctaaccctccaatggcttactttcacaattggcttcaaatcaaaattgatttcaacatggcccttcatgatctgacccctctctgcttttctaaacattctcttacaagaatcttgttctaacttcctgatggagctggccatccctctgttcttcaaatgtgccttgctttttcctaccttagtgcctttgcttatacacttctctctccccatcctttatgtttcagcctaaagatcactcctgaaagaagtgaaattgtctctgtttgctgatgacatgatcttaaatatagaaaatcctaaagattctacaaaaaaaaaaaaacctgttagaaccgataaacaaattcagtgaagttgcagggtacgaaatcaacacgcaaaaatcagtagcatttttttatactaacaacaaactaactgctaaggaacttaagaaatcaatttcattcacaatagcaccaaaaaatgaaatgcttaggagtaaatttaaccaaggaggtgaaagaccttcttactggaaactataaaacattggtgaaagaaattgtaagtgacacaaataaatggaaaggtatcccgtgttcacggattggaagaatgatatgtccgtactaaccaaaatgatctgcagattcaatgcaatccctatcaacattccaatgttatttttcatggaaataaaaaaatcctaaaatttgtatagaaccacaaaagaatctgaatagtcaaagcaattttgagacaaaagaagaaagctagaggcacttgaaatctattacaaagctatagtaatcaaaacatggtactgacaaatac

SEQ ID NO: 29539 - DNA, 1058 bp, Homo sapiens
tagcgccattgcactccagcctgggcgacaagagtgaaactcagtctcaaaaaaaaaaaaaaaagaaaaagaaaagaaaagaaaaaaagactctagatactgcccacgaacatgcagatggagtggctactcgtaaccaaggccataccatttactgtgtggaggggggtgaggcagttccagatcaattcctaagatcttgaatgcagaaatcacatactaactcatttaatagaaggcatgaaaaagtatgtggtcaagccagttaattatgacaagattagagaaataactcaggggaaagattaaaatcctctgacagaaacacaatccagatccttaattttctgggaaaacaaggtgatatggtttgactgtgtccccagccaaatctcatcttgaattgtagctcccataattcccacgtgtcatgggaaggacctggtgggaagtaattgaaccatgggggtgggtctttcccatgctgttttcatgataatgaataagtcttatgagatctgatggttttataaaggggagttcccctacacaagctctcttgcctgctgccatgtaagacatgactttgcttctcatttgccttctgccatgagtgaggcctccccagccatgtggaaccgtgagttcattaaacctcttttctttataaattacccagtctcaggtatgtctttatatctcacacattagcagtgtaagaacagactaatacagaagggtactgggtatctccccacaaggcccaaatttctgcccaaagggtgaagtatctgagatgtgtgtttattcctgggacaaaaaccttagcccaggaatagaaagagaccattctggcactccagcccactcagactaagaaacagttaagtgcctttttgggaatggccagattctgccatatttgtattcccaggtttgggatcatatcaaaaccactctataaagctctaaaagagtgtgatcacaagcctttgaattgggacagaacctcacaacaggcattcttaaccctaaaagaaatgctgggaacatgtccc

SEQ ID NO: 29540 - DNA, 1050 bp, Homo sapiens
acttgaatgtgtatatgaatcgtttgtgagggtctcaggaaagtctgactctgttggtgctgcctgcgattctgcattttctaacgaacccccttgtgatacagaggaccacacataacactgtctccttacacctttaagaatccccttatttccagatatttatggagccttaacagcgtgtctggcattcaccactagacactacagaaaccctcctgtaaacaagtgattggttcattttttaaaatagttgctgggggtccaacagctgtgccagctgataattattcaaaaatgaataagacactatccttgccctcatgagaggcagatgggtgtgtgagtagtgacgtacaggctggtaaagggaagtggtgcccaggatgtgatgggagcttgggagaagggtgctcactccaggccggggatcatggaaggcttctaagacagatgacacctagtaaggaaaaaattattctaacacctgttaaaacggtaagtgagactctattcaggactattgccacaataggtgtcaagacgagagagcgcttggattcagctctgaatacagcaaggatagctggagatggatagccaaccagtggaatgagggggtcagtggatgcaaaattattcagaggacacatcaagggttgcttggttcttgctaaactgacttaccaggattattgctagaggcagtccaagaacttagaccccaaaggtggggtataaagaatttgatcaggccagacatggtggtttacgcctgtaatcccagcactttcggaggctgagatgggagggtcacctgaggtcaggagtttgagaacagcctgaccaacatggtgaaatcaccccatctctactaaaaataaaaaaaattagccaggcatggtggcacatgcctgtaatcccagctactcaggaggctgaagcaggagaatcacttgaacctgggaagcagaggttgaagtgagcccagctgagatcgtgccattgcactccagcctgggcagtagagcgagactccatctcaaaaaa

SEQ ID NO: 29541 - DNA, 1992 bp, Homo sapiens
ttaaacagctatgagggacagctggagacaagagggcttctcgtagtctcccaaagtcacataggcacccacacgcatgtacacacacatgtgtgcccttctttgcctctcactggttgatcacacctgtgtctgcactggccctgctgcttctcatcacacatcactagctcactggttcatgcccacacaccttgccaggaataagctaaaataagaaaatgatggtgcatctcagacccaggcctctgctttctctttaacccccactggctgatccacttcttacgagcatccacgagaatatgagtgcatgaccgtctgtaaaggacccaggaaggaaaaaacactgtttataagtgccctgtctcgtggcaggtgctgtgctaggccctgggcaaatgttatcttttttaggacaacctagtcaaagataagtgcttttattcccattatacaagtgagattaaaacacagaagttaagtttgcccaaaggtcatatgtatttaagtggcagagctatcgtgtcaactcaggtctttgtcatttccaaagaggcctcttcacagtcccatcctctctaccgcatagggcagttacaaatagattcctccattccctatacacttactgagtgcctaccgtttgcctggcactgtgcaggacctggaaacgtaaccatgaacagaggctcaccccagacctcaagcccagcagggctgagaggtacatgcacaggcagccaccaccagtgagcgaaacagtctaggatgaaccagtcccaaagaagatgcagacccaacatgaaggggagcatgaaaggagacacatcaaggcccatggaggtggggaagggaggtacggggaggccggtttttctaactggctatgcactaaatcttgagagaaatcagtgctgttccagggtttctgaaacagatgcacactccagcacaggtttctttatctcctcctgtccccttttaatataactttcataggagtccctgggaacttgtatgagaaccacatggatttcttacgactcaggtttgattaaacagtgggctctctgacatttgatgctgcagaacagggctgtggaaacccagggctccgagagctgacaagtctggttctctcccagcattctgacagcagccccagtgccttcagccctgcgattcccaatagtttgtcacttgtcagcattggcctcagccatttattgcaacaccgcaaagaagtcagcacgggcatttctgttacaggcgtggaaacctgagtggcagagatggggaattccccaacccctgcccgaggagtaggggccacaagaggtcccaaatggttaccagcatccagtgggctgaaagtcagtcatcctggtgagaaaagagagagtagaaagatgccttcagaattatgggatgggcttcttgaaataaggctagtaggagtggtcattagtgctaaatgcagagataattcaaacaaggtgagaatggataaatctgttagacttgacagtgaggggacattgctgactttggccagatccacagagtcaaagacagattataatagtttgagagactcatgggtggtaatgaaaggaaatagccagtataggaggctcagtataagccagtgacatgtaggatcagtacacatgttcccaatctcataatactctttgttttctgacctccgctccactttgctcattcaaggtggaatctgccatgtggatgagattgcatttaaggagcataggtacacagatcgtagcctcctgccttctccctttttgccattcctaaccactctcccactactgccttgacccatgaactcaaagaagttcatttttccagttgcaaggttgggaagacagacacaatcactgcattaacagacttggtcccaatacatcttgtggttattgatctttcctgcttaattttaagctggtgcagacttcattaata

SEQ ID NO: 29542 - DNA, 1057 bp, Homo sapiens
gagcttggtccagcgaacatctctttttgtctgccagtctattgctttttctgtagcatctatgaaaacataccctcctcaggcaggcacgcgatggctctcgcctgtaatcctagcactttgggaggctgaggcaggtggatcacgaggtcaggagttcgagaccatcctggccaacatggtgaaaccccccccctactaaaaataccaaaaaaattagctgggcttggtggcatgtgcccgtaatcccagctacttgggaagctgaggcaggagaatctcttgaaccagggagtcggaggttgcagtgagccgagattgctccactgcactccagcctggtgacagagcaagactccttctcaaaaaataataataataaatagaagaaaacataccctccttcttctggttttggaccagacaaccttcatataacccaagaaagattattgcccagtcttttaaacaaatctaagtgatgatgatgcctagtgcttatggaagtgtttgctgcgcgccaggcactgttctgagtgcttgagaggtaggatctcatttcctcccccaaagtccctgccgtgggtagtattatcaccttccttttctaaatggggaactgtgggaccgagaccaggagccgttggcccggggttactcatctaggaaagggaaactggggtggaaacagccagtctggctgcagagccaagtgcataagcaccatgacaactgcttctgtgaatctccagtgtccctttccagctccccccacatcatgggacggggtgtcagcagctggagaaagcactcggctaatggaaggcttagatggctgtgtgaagagtgcatttattacagaatagtacacaattcggattgataggagccatggaagtcatatggcccaaaggtcccatttcacacatgagaaaactaaagtcacacagtatcatggtccaatgacattttaaaaaaatcctttatttactgccattggtcagcatgaattatgccaatacctagtgagtgcctgcctagatccaggtaccatgag

SEQ ID NO: 29543 - DNA, 1028 bp, Homo sapiens
tttttttgacagagtttcactctgtcacccaggctggagtgcagtggcgtgatcttggctcactgcaacctctgcctcccgggttcaagcgattctcccgcctcagcctcccaagtaattgggattacaggcatgcaccaccacacccggctaattttttgtatttttagtagagatggggtttcaccgtgttagccaggatggtctcgatctcctgacctcgtgatccgcctgccttggcctcccaaagtgctggaattacaggtgtgagccaccgcgcccggccagaaccgactttttagagttgagtaagttgaggcacagagagattaggcaggttgcccatggccccacaggaaacaaggagcaacgttgagactggttgtgagtttcttaggatatagagaagaggcactttaacagaaaaagcagggcatggggagtcaggctgacctgggtttggctttaattccttccagttactacctgtgtgatctcagataagtgactcaacctctgtgcttcattttcttcaactgtcaaatggagaataaaaacttttgtggggccaggcgcggtggctcacacctgtaatctcagcactttaggaggctgaggcaggcggatcacttgaggtcaggagtttaagacaagcctggctaacatggtgaaaccccatctctactaaaaatacaaaaattaccaggcatggtggcaggcacctataatcccagctactcgggaggctgaggtaggagaattgcttgaacccgggaggcggaggttacagtgagccgagatcatgccactacactcaagcctgggcaacaaagtgagactctctcaaaaacaacaacaataacaacaaacttacatgggatgttttgacagtagctgaaaagttgcatgcaaagcacctagcttggtgttggccctgtgttacatgcatagtcaatatttgcactctgctctttccttgacccttagtattagacacagaagtacctggttcattcctttaggcagca

SEQ ID NO: 29544 - DNA, 1035 bp, Homo sapiens
aatgtatcatcagattcccatacctgtttctaccaaccacatattcagcctggtttcaaagtttatttctggtttccaagttctttggattgaatctatactactgattggataagactgaggaaatgtatgtgttaatggaaatggcaatgcattcctattgcagttgttaatctttccgaagattccagactctgatttttaatggtcttcatttattctaatgagttaacgtaaccacagattagtaaacagggactatcgatcttcacagagcgtaaggaaggaatttacacgtagtaagggcccattgttgtactaaaatcaccactgacttttcgttcagcattgactctgcaccaggccctgtgctaagtgcttcctgtgctttctctcatttaatgcccactacatcgtttgtaaggatcgttacaccatttattcaaaatctcactatttgtcggcagcaaagtcaagactggaacatggagcattccgtattgaaagcagaaggctcctgcccctgtagtgccttaagtatgtggtctgttgaaatcttcactccccacctagaaaaaaaggaaaagaaggaagaaagaaattacacatagtaatgttgattactccctaaagtaattaaccaggattgtgtaatgaatgacaacagagacagacctctctgatgaggtgacagtttagccgagatctgaagcgtgtcctgaagccagccacacacttggccagagaacaagaatgtagcagccctgatgtgggctccagcttggcctgttctggaactgacaggtgggaggctggaaggaggaacttgagttgagactggggagctaggctagagcttcctgggccatgatacaatgacacagaatttgcattttgttctgtaacacactggcaaagacggcacttggctgagaatatccatgagcttttgaacagtagcaatcatgcaatgtccttgtagggatctactgaatgcaggacgatctttctccctagaaagaaagaaagaaacaa

SEQ ID NO: 29545 - DNA, 1040 bp, Homo sapiens
cagtaataacccctagactagcgttttctagactaattccagaggtcactgcaagggatgtgaatatgtgtttagaaattgtgaacagaggccaggtgcggtggctcacacctgtaatcccagcactttaggaggccgaagcgggtggatcacaaggtcaggaaatcgagaccatcctggctaacatggtgaaaccctgtctctactaaaaatacaaaataaataaataaattagccggtcatggtggcacgtgcctgtagtcccagctactcaggaggctgaggcaagagaatcgcttgaacctagaaggcggaggttgcagtgagccgagatcgtgcctgcatactgtgtctgccctttggagattcatatgtgcatgttagagatcttataaagtctggaagtaaagaaagctattacacccagaagcatttcccagttttacttgatcctagagctacggaaataaattagggacaaactgcctgtagatggagtctgtagaataatcccactgaaagatgtgtgctattctaagaacagttcttctgacatcgtgctcaatagaaatgtctactccctactttcttttgtactgtaggttctcattcatctttctgctgcaaggatgtagacactgtcttaggtgctataacagatgtcccatagactgggtggcttaactacaaacatttctcacagttctggagcctgggaagtctaagatcaaggtacccagccattctagtgtgtggtgaggacttactttcttgtttgcacatggacaccttctcattgtatcctgacatggcagagagcagggaaagaaaatattctgtctgtatatcctctttttttgtttttgtttttttgagacagagtcttgctctgtcacccaggctgaagtgcaatggcaatatctcggctcactgcaacctccacctcccgggttcaagcgattctcctgcctcagcctcctgagtagctgggattacaggcacacgccaccacacctggctaatttttgtatttttagtgg

SEQ ID NO: 29546 - DNA, 1050 bp, Homo sapiens
gtcagtaactacctctaacttggggcaatgccttcaaatgtgaaccttctctttagtgagccgggaagctgtatgggattcccaggtactatggcatccactatcagattgatctgactctagttggagactaaaatcagaagcgttgcagcagtgtactggataatgaatggagtgatgtagttagaaaacagttggcctacaaataattctatttagagtagtaatagtagttatagaaacaacacatgtttactgagccgttttcatgttcttggcactgggctaaacactttacatgcactatttcatttaaattgcactatttcattaaaataacatctcagtcctttgtgagagacgaatgaggtggaaagaaaataaggacaaaatgacagggattcctctttattctctggtagggaagcggggcaaggttcatggttgatgttccatggagcttctggcgtgaataaatgaagatggataagacgcagtcccagccctttagtaatgtgaacttggtaggaataacttacccgaatatataaatatgatgtaatattgcatgatgcagattaatcaagttatttataatttacaatgatccagttgagggagcaagtaattatgcctaagcagagcccccctagctccagagggaaagtgcttctggagtcaggagttggaaaaggaggagaaagtggccagggatacaaggcggggaaaccgtgttctagcaaaacagtaagatgtgcatgtgaagtcactgccttccctgggacaggcaccctctttagagacagcaacaccacccagcccagccccatctacgcttgttcatgtccacttagcacttccattcatctgagcgcctgcagtgtggtgtttgcttcttgtttctctctgccactaggatgtcagctccctcaagccagggctttgttttgttcattgtttctattagttcgctttcatgctgctgataacgacacacccgagactgggtagtttataaagaaaaagagggtttaatggactcacagttcc

SEQ ID NO: 29547 - DNA, 1034 bp, Homo sapiens
tgagtgtctttccatgacaggtatgctaggaaggaaacacattaaaacaccatccagtagacgaccttagggaaggaggaagaacaggagagaaatggacttgcgccgtgttccacagttgcattcaggaagcatgtcagatggtaccctcagcagacacccgtgacggcctcccttgatacagctccaagaaatcactttgtacagctgttggaaatggcatttctcagaaatgttcctgtgggccccttatgatatctgttagtgctgtagaatgaagtaataggaaacaggacatttgtgagggattggtgcatgattaaaaacgaactgtgggaaattcgcagtggactggtacacttctctctgtaatgaccaattagtggggatttgcaaatagtgatggctcagcctgcctatctctatggcctgtgaaatgctcattggtcttcccaatgtttacatggcccatttgtttccggcctccaactcctggtaccaacaggctaccaggactgaaggtacctctgctctgaactccactcactcaaaacatgcagctcctgtctacaggaggaaaacttatttttgcgtagagctttgtcaatgatgcgtgctgtcactcatctctcatgatgaccctgggggttggaaagataagtatgattacctccacctcacttaagttaaagtgtggggttgaagagcatttgcttaagattagactgctaacaagtgctgacgctgatatttgacttttcccttcccaaaagaaatggtatgagatagaggattgtataattcagtagacatggatgtagtggagatcttaagggaatttgaaagatatggaccacagcccctggggaatgactgttggttaccactgttgagttgcacttgaattcaaaattcctcttttccatggctttggatcccacaggctgtggtctaacatctgttgtttaagaatcacttactcaaccattgtggaagacagtgtggcaattcctcaagaatctagaaccagaact

SEQ ID NO: 29548 - DNA, 1027 bp, Homo sapiens
aaaagttttaaaagttaaaaataaataatttttaaaacagaaaaatgcgtatagaataagaatataaagtattttcatacagctgtacaatgtgtttgtgtttcaagctatgtgttgttataaaacagtcaaaaagttaagagccaggcacagtggtgtgcaattatagtcccagctactctggaagctgagacgggaagattgcttgagcccaggacttcgaggctgtcgtgttctgtgatcatgtctgtgaataaccgctgtactctaacctggacaatatagcaagaccccatctcttaaaaaaaaaaatagacagttggctgggcgcagtggctcatgcctgtaatcccagcactttgggaggctgaggcgggtggatcacgaggtcaggagattgagagcatcctggctaacacggtgaaaccccgtctctactaaaaatacaaaaaaattagccgggcgtggtggcaggcgcctgtagtccaagctactcgggagactgaggcaggagaatcgcttgagcccgggaggcagaagttgcagtaagccgagatcacatcactgcactccatcctgggcaacagagtgagactccgtctcaaaaaaaaaaaagagatagttaaaaaaaattttaaatttgtaaagtaaaaaagttccagtaagctaagtttaattttttattgaagaaaaatattttttataaacttagtatagtctaagtgtaccatgtttataaactaagtgtacacagtagtgtactataatgtcctaggccttcacattctttgaccactcactgactcacccagagctacttcgatttctgtgaactgtaatcatgatgagtatcctatacaggtgtaccatttttttctcttatattatatttttactgtactttttctatgttaagagatagaaatactcaccattgtgttacagttgtctacaggattcagtgtagtatcatgtatacaggtttgtagcctaggagcagtagactctagtatatagcctatgtgtg

SEQ ID NO: 29549 - DNA, 1089 bp, Homo sapiens
atgtatgttatctgttttaatcttcactatacctgtatgaggtagatgttgttagtattctatttaacagaagaggacgatgaggcccagaaatcttaagtcatgaacctaaggatacagggttaataaataccagacctgggacgtgaaccctggtagttgggcccttgactccttgctcctaacaactgaaagtatgaattaacatttcaatgcctgttttaataactttctacacaaataactaatggcccattcacatcatcccctgcaaatgttttggggtgacaacttgttaaaatttaatattcagagcaatacagccccagctatttgacaatttcagatataaatctaccttaaagatgtacaagtacaaattatgcaatttgatttttaagtgcttttctagcaatataaataataaagtgtgttggaactggcaggtatagtacattaaattgagtgcaattaaaacactgtgatatttttaaattaacaagaaaaaaataagtggcgaaattaagaaacctgaatctgtctttgcagcctcctccagctgataactgggtggatgattgcagagggtattagtaacatttatactctggatttcaagtgtgatggttgtcacatttaacacaaagagcacttcaatttcacttctgcataacaggcagatgacatttcccacaacataatcttttcagttttttttttttcctaaagcagatgataagggggtattctgagaagacatctgagttgaaataatgacttgccttgtggataatgtctcaatgagacatctgaaagtcaagattctctttgttagacgcaggaataatctgcatctttcacactcatgggcggccttcaccctctccaaaagctaacagtctgttcattggaaaccaggaagatggtgcaactgttgaggttgtttttcacgaccttcccaaaggtttgatatggacagagtgagatctgctctcagccggtagttattgtaaaaataaaggctgatcaatacaaatttgtgcatcaaaggtctcttctgccccccaccccattctggagttagaaatc

SEQ ID NO: 29550 - DNA, 1033 bp, Homo sapiens
cgagaccagccaggcccacgtagtgaaaccttctctactaaaaatacaaaaaattagctgggcggtggtggcaagtgcctgtagtcctagctactcaggaggctgaggcaggagaatcccttgaaaccaggaggcagaggttgcattgagccgagattgcgccactgcactccagcctgggcaacagagtgagactctgtctcaaaaaaaaaaaaaaaaagaaagaaagaaagaaagaaagaaagaaaaatactgaatagatatctaccctctgacccttcagttgcagttgtagttatcgctggactatgaaactgttattgcaaaaacagcccaggtattcatcactgagagaatagataaataatttgtgttccgttaatatcatggtatgccactcaccaagcggtcagtaaaaacagattagcaatacatgaaacaacttgaatgaattgcagaaacttgatgttatgagagaaagcttacccaaagagtatatacttcaggattcctaatagatcgagtttggggacaggaagaaccaatctataacaaagcttaatcaataagggattgcctatggtgggaggatgcagatattgtcagagaaggagcttgagggaacttcctcatcactccagaacgttctgcatcttgaaaagtgtttgggttacataggagtatgcattgtcaaaattttcccagtgatttgtgcatttcattatatgtaacttttaccatgaaggcggggaaaaaacccataaacattattgaatcctggttaatgatatacatattaaaatgcctaggaagtaatgtgctgctgactatcttactgttttgaaatgcattaaaaaaccaaagatgtgttgatagatggatagaaggataaatatgatagaagcaaatatggtaagagggtcttggtacatcacaggggcagctatatatatgttcattgtagaattctttcaactttactgtgtatttggaatttttcataataaaatattagggaaaaatctgaaaataa

SEQ ID NO: 29551 - DNA, 1031 bp, Homo sapiens
gggccgagttgggacttgaacctgtggcttctttcctagccttgaagctcaccccttataccaggatactcttgctgctttctaggagctcccccttcctgtttcctcctctgcagtgcagatggtgccatgagagggagctttccctctgttctcaggccctgacgaggtccctcttggccattggaggcggtaccctggaggcttgtgtgggggtgtgggctgagccgtgtgatccatgtttgctataatgggaagcagctcccagaagagaaagacatgcatttgtatgcagccagtctgatggggttgaaataaactcagcactgatcaaacgacacacagccagcacattgcagggaagacaaaccaacatggaatgctgatttttctcactgtcatctttagaaaccttctttcttgtcgcccaccggggcagttaactgttaggagccagccctgtgttcaaatccatttattgatggatgtgttttccatttatcatctgtgggactcttgggtgatgtttcttttccgagctccaattctttcatctataaactgggcatgttaatggtaactcatagatttttagagttaaagtaatgcaagtgccttacacaatgcctgcacgtattaaacattcagtagtaggtaggtgctattatcatcatcgaaaacattatcatgtttattgccttattgacttggatgaacacggtagtgtatataataaagtagccagtctagaatctggcctgtggttatctgtaataaatgaaagctgtggaaatagtgtgggataactcaaagacctgaataattcagcagatacaatggagttggaagattctagggacttaaattcttctcccagctctgtctcaaaataactgcattgccttggacaagtcgctttgctttccataacttcactttcctcatcagtgaaatggggctgagcattgtgtggtattggaaaagaataactgaagtgcttagttccatgctggaatgaagtagagacgtga

SEQ ID NO: 29552 - DNA, 1050 bp, Homo sapiens
tggctcagtgcttggcacaggtggctgttcacagatatttttagaagcaaggaaaggaggaggggaggagtatatcataagacatttggcatctcctgcctttgctgagtaaaggggaaggaatttaggatttgtacggtgaatattgccacgtgtttacgagtatttatataatgctaatatttcagttgcagggaaaaacttgtcctgaagatgttaaagctggaagtcagtgatcttctacacctcctggaattttatagctgtgtgctctcaggtttagagtcaggaggggaaggcccagggccatgtgtcatttcttggcagagcttggcttaggactacttttcatccattccctgttcttttccatatttcccagttttcccatttttgtctcaatctgtctgcctgtctgttgcactctacccatctacttatttacctgtcggcttccactgtgctctagaatgttgcccactgtgatcttttgggcaagttaatgtctcagggcccagtttcctcaactggaaaaaaaaaaaaaaaagagtagctgtgaaaataaatagtgatttataagcgctagattttgggggctggagaatccttccttatggggggcagggaggctgtcttgtgaactgtatgacattttgcagctttccgaacctactatgtaccagcagcatctctcccctgatttgtgactccaaaagtgtctccagacattgccaaatgtctccgcggcaggggggcaaattgcccttggctgaaaagtactggcacagagtaagcaattattaaatattgttttaaaaaaaacactgtcattatgactattctgcagttatttaatttatctgaaaagtgttcatttggtgcttactgtatatactgcagagctctgagccgtgagaggcaagtggaaaatgtaagcctgatgttcttgctttctaggagattacgatgcggttcacagtcacacacctgtggatgggcttccgagggggctttgaacgttttgtttcaacctaaatttagcaaaaggac

SEQ ID NO: 29553 - DNA, 1038 bp, Homo sapiens
gccttctcctggctgagaagggccaaagcttctttcatgatcagcctttgtccttcctggaagaaggagtgaagggacactgctacctttgtaaactgatgtcctgcttttaggcagggcagagagcttttgttctgtttcttctcagttgtctcttattcaaaataatgcttttgctaaagtgacatattttgggctggcagattctgatctcctacaccttccaagttccaggaacatgttttggaggacttctatggttccttccaacttcgatattatgtgtttccaggaaacaggtgtgaggcattccatggtagccagaggtagcatggaagatgtttccttttgcctatgtctctgaaccccttactctgaaggggcgtgaccaccgactctcccagtttaaacagaggtgggagaaggtctttgtgatgactttccacttagtttatagaccagtcctataccagagctgaggccaggattattaggaaagagaagcatgaaccccaaactcctctccctcattgaaacatgaaagctaaacagggcttccatgcaatttcccaggacaaagagaaacaagcaagagagaaagcaaaaagccctcccgcagatgaacaaagagtgtttcaaagcacaatactactgttgttttagttcctctcgtaaaactcttcagtggtctctcactactaataggatgaagtccagcatcaaggcctctcatcaccagtgtcatccctcacctctgcaccagctcccccatcccatggtctcccattctctgttcctttgaccacatcagtaccctcttctgccgtccttgtaggcaagctcatgttcgtctttcaagatccaacacatcactatgatatggctagaattgtgtctcccacaaaagatgttgaagtcctaaccccctggtgcctgtgaacgtgaccttatgtggaaagagggtctttgcagataatcaaactaggatgaggtcattaaggcggctgtaattcaatttgactgtgtccttgtgcagag

SEQ ID NO: 29554 - DNA, 1080 bp, Homo sapiens
ctcactattgccatttagcatacttgctataatagaagtatgtatgccggtgttcaggaatccagaaaaaggggcacctaagtatctggggacatccaagaaagctttcatggaagaagatgcctcctgggctgaatcttgaagcatgactaggaataggccaaggagaggagtcagaagaccacgcttgagtcctgccattgttgggctctccaggaagcgatggtcaaggtctgtgtgctgagatcgtatgccagatgtggtgttagggatcggcatgtttaacccaatcagtcagatgatcccagtaggaaaagcaacacagcaagtctgaaacactgtatcataccacacagtgcctcagctctcaaatttctctattggcttttgagccctgcagaaaatcagctgtgtctttctacattcagggggtccttctccgcttctgtactcataccttgaggtgctctcatctcatcccccgcctccttccatgccctcatctttggctctcagtgattctgtattaatagcagcgattaaactgcctcatctcatcagggaggagatattaatcttcatcaggcccaaggaagagcttaattttttcctgctcttctcctctccccaggctgccccactgagctcaggcactgtcagctgcaccactgtctgtgggacatttagtgatctgcttctgcagatgcgtttcagtgagttcacttctctgactccctcccttagcctccctgcacccagagcttcacaggctgttattgaagaccactgtcaggagagggagagaaggggaaaaatactccctcaaatagaaattcccaacttcattgtcttgcgtggctgcagggtaaattagaccaggacagtaccgcagctgaaagctgtaggttttttggtttatgaaatcctattcagcccttggagaagtatgccttttttcatgctatgattctgcagttagctgtgaactgaggatgtcagatgcccaggggcaggaacaggagacagggaggctcgagagttcatcaagaaattaggatggaaaagagctattcccaaagc

SEQ ID NO: 29555 - DNA, 1060 bp, Homo sapiens
gtaggagagtctcagctccctccaccagaaatgtttgcaactaatccaggtgactaatatttgatgcttcagttgttggtctttctatagatatttatattgctatcaacctgtgccttgaaggttaaaactggcttttgggcctctttaaaccatctcctgtgctttgcacttagtgggagtgcattcagtagttgaggtggtgttcctatttctgacacttaatttgcatttttaacctacccaagggagcttgttattgcatgatgtatcaggtgagctattgtcaagactgtaatctaattaaatgctggggtccagaagcctcagtgcttataatgttgcagcgtttattccacacgtgtggccttcgtgctcagagtgctgcttatcatccacacagcagacatattttgacaaaggcttgccttcttttatgaatcccaaactagtagccttcacatttgcaattttccttctatttaatgaagtggttccagatcattctgtgacaatcgaaggtaaacattgctctgcacaaggcctactcttctgggattcttccatgcctctttcacatttctcaaactctcaggcccaaatgtcagatggtgtgggatttggagagtcgggaatcctgagcatatttgagttgaaaattcacacagagcttgagtgagtgaggatggcggtggcgggggagggcatgaactgtttttgcttttatttaatggcgcacctttgagaatgatcttgtggcttttgagcaggttgcaggacttcaaggtctccatagtggtttggtttgcacctttctttttggatgtggaggtttcccctaggtggccagctgattttttggtgcctccatttatgccctaaccccttctttttctcttagatcattgcataccgagcacatatttattaagtaccaagtgtacgtctgatactggactagagtccgagaaagacactaagattaagacatagtttctgtcctgatgaaaattgttcttttgttagtcttaggtgataatgacccttttctgaagataat

SEQ ID NO: 29556 - DNA, 1048 bp, Homo sapiens
cctgggcaagaggaagactagcagctcccaggtacgccaggcatccccattccattcccatcacagaggagcatccacctcctgggagtggggatagtaggactggagcggacaggggctttgcagtcagaacactcagggtttgaaacctgtctgttccacttaccagctgggtgaccgtgggcttgtctcttgccttctcatgtgtaagtggaaacaacaataccgtcctcacagatgtatttgaaagtctaaagaatgatgagttttgcaggcaactgacacatattaagttctcagcaaattgcagatacttgttttattcctttcgtttttgaggagatcatgtattgataaacttcagatctgtgattgcaaataaaatagagtattaaaaaaatctgttgcggcacatagttgttgctcagtaaatataaagcaaaggcataatttgcacgcacttggactggattcacagccagcggggcatgatggaaaaagcacaaaatgagaactgagagtggctgagtggattgctcagggtcactcagctggtatgtgaaagagctcactttctcattgaatctccacaacagccttgtgagtcaagctgggctaacgttatctgtctcttagagaaaattaaaacccagggaaggtgaatgtcttgtgcaagtcaaattactggattgtagaataatgaacttcatcactaaatagccatgtgacaagtcgaggactccctttcatcatctgtaaaatgggggtggtgatatctgccctgactacctcaaagagttgtggtggaggtcagatcgaagagcaataataagcctggcttctatatagagaatgatctatggtggacaggaatttaggccagatcaccggctgggtagccaacatacttttacagagaagcagtgaggtgacctgaacttagatggtggtagtggcaatggagatgaggcagaagtggctgcctggggataggttttggaggtagaggttttaggccttggtgatgtttgggttgtgaaggagagag

SEQ ID NO: 29557 - DNA, 1078 bp, Homo sapiens
ctggtctcgaactcctgacctcaggtgatctgccctcctcggcctcccaaagtgccaggattacaggtgtgagccaccacgcccagccttaattttaattttaacctgtgtgatgactatatagctgggctcactttatgataattcactaagtatttcacttaggacttgttcatttttctgaatatgttattttagttttcaaaaaactatgcaaatcttgatggtagcagaatttgaagtgattttgtaggttttgcattgtttttagatgagaggaattttcttaacctttgggatatgtgaatctatgtcattgttgggctttgaagttcaaatgctttttaagaatgaaacttttctttagagatcattgtttaacacttctatgtaatgacattggcttttttcctttctgatataccatttggacagatattcaccctatgagagtggatcacagcactgatttcaagatctgaaatttactcataaaaaccctaatctgtatgagtgttttcatcagttggaaacaagaccagtattcttaccagctcttgcaatgacacggctctaattaatactaaaacaatattactgcttgatattgaccccaagccacattagataatattctcctttgtgttattcaacaaacatgcattttcataaaatccttattcctggaaatggaaaaaaaaaaaaccttttattattgtattgtggaagatatagaaacacaagaaggaaatgtactatttaaactataacaataatggaaactgtagcaatcgtttctatttatcgcatgttaaaccaagattggctgcatctggcttgcacttgtgttgggtttggcccgcctactgcttttaccatttttgaatttgttgctaatggttaaatattgggagattgcacataagaagtcatgatttttggctttccctaaaaaaagtgaaaagatctgcaaaaccagaccctcatttcatcatagtagctactggctggagctgagtactggctgtccatgtgcacagtgctcggatgatccattttgtcacgatctccatccttc

SEQ ID NO: 29558 - DNA, 1056 bp, Homo sapiens
tcctcagggctgaatcagagcaccgctctgctccttgtcagcccctctggcccatcccctaatccccaccatactgcctcgcattatctggcatcctctacccagccacgccagattcttttaagtcctggtgtacatcgccctctgtgggctctgctcttcccacctgttctttcttctccctgacaccctctattgctcttacttccttcctcttctttgtctggctgcctagatccttgggtctcagctgaaacacaattaattgctcctgacccttaactagcaggcttccttggctccctatttacctaactccttgtatgtacccttaatactcagggctctttatttttcttgtttttataatcttttgttttcacagcagatttacaagctttgggaatggagaaagcgggtctctttagctcgcccttccacctctagcacctactgtagtgccgggagaagatttggtccccaaatgtttgttcaatgaatgagtgaacgaacacatgtgccctcctccgactttgagtactgacaggtctcatcattgcctcctggatccactgtggactccttaccatgactctggggtcttccacaattgttttttccccaacctatactgtctgtcttcagggtataataccctgttgaactacctgaggaaactatttctctgattcttaattttcactcttgcggtcttactgcccactattcagttcttttttctgtaaccctccctcccagccaacaccttcaatgcccatattcaatgtcattttcccctaatgccagatcccatgtggaaacatctatgaccagcagtcatcaagagatattttgcttgtttgatgtctttctaaccacttacctatgagtttcttgagagaaggaagtgttttattcgtcgttacactcccagtgtctaactgagcactcgctcctaatgtgtccttagtgaatgttccctgggtaggactgtggtattgagggacacaggaaccgctggtagggaagggctcttggtgctgtgagcatctgtga

SEQ ID NO: 29559 - DNA, 1038 bp, Homo sapiens
cactctttggcagaaagccaacccaaattgatttttggtgaaaagggaatttgatagttaataggatttgtaagttcagaggtagggcaggcttcaggcagagttggatccaggggcttgtagctaggtctccctctatccctttgttctatttttctctgccttggtttttctcagggtgactttatctacatagaggaagtttcaggcttgcatcctgtcctcaccaaccccagtagaaagaggattttttccttttgctaattcactaatattgcctctgattgaattgcctgtggtaactcctcctgaaaccagtcactgcggttatgggaggggagtgagggaggctggtacttttttgttaactttaagccctgtgcctatttctggtcacaggatgatggagagttgcttaaaacacgctgggtgagattgggtgactgggatggccaccaaaggcaaatggcatggtttcccaaaaggaagagattagaagttgatctggattatggagaattcataactgtctgtgtttatggttagatgtgttgatggtcaatttgaaggcagcttagaaccatcgtggccggtggagtgaatgtgatcactaactttgagcaatttcaccagactggcagatagattatgggaaactggaaagatcatgaaaatactttgaggcaacatgacagactgggtgtaggtgctgtatctatcaacatgatcctttagaatgaaccccacacttgggaccaaatcacgagctgcatttagtaggggctgggtgatgtgggcatgttaacacagtattttagctaggatgacagaggcaacagatttctgttactgagtgtcagttagtgtgcattcgggctgccgcatttgtatttgtggactctatgctgtaaggacaatctagatgaggcagcatgcttaggaaaatccaggtgagtgacagtgcccgttcaaatctggttatgtaagaaatggtgggaagaattgaggatgtttaccttggagaagcagaggctcagg

SEQ ID NO: 29560 - DNA, 1044 bp, Homo sapiens
gtaatcccagctactcgggaggctgagtcaggagaattgcttcaacccgggaggtggggctttcagtgaaccgagatcgtgccactgcactccagcctgggccacagagcaagactccgtctcaaaaaaagaaagaaagaaagaaaaaaaaagattaacgtctcctattttttttaaccctttttttaagtcaactgtggagaataaggtaagttttgtaagagtggccattgtcttatccaaggaagcctattgattcttcatgagagaatcattttctggtgctaaattttgagacataatttgtttcataggggtagtctcttttgaaaaatggatatggtcccttcaagaagagcagtagcatattgaataatgtgtttggaggagtttttttccatccgcccctccacccccaccccacccttctggtagatgtaagagtattctttcctttttcaatagttcttccttttccaagatacacagccttgaggcagaatcagagcacatcttccccacctcacacatgatttgtggttatcaaagcaaacaaacagtagtgtctgtactgtccttagattttgattggtcgaacagctatagtcaatcaatttattttagtcctattaatactacatagcatctcatattgttgtttgataatcgtattttggatttcatttgatctcttgcaatccttgcaacaaccacgagtgcctgatattgccatgggctttcccagaaaaatgacgggaggctccaggataacaaatcagttgccaggctcctgcagcttgtatctgcagagctgatgcttgaggccaggtttcctgactcccagagctttgtaaatgctgtgaggcccatgtgaaatgcagactgtgccttggagtttgcttgttatataacagagacaagatgggcacaattcgggtgacaactaatgtgtcttgactgcagagctgtatgaaaatgggtggttgaggactgtgttggatgcctcagggggccactgccccgatctgtgacaccacagtggtt

SEQ ID NO: 29561 - DNA, 1031 bp, Homo sapiens
catgcatatatacacatatgtatgtatacacatatatgtatatacacatatgtatgtatacacatatatgtatatacacatatgtatgtatacacatatatgtatatacacatatgtatgtatacacatatatgcatatacacatatgtatgtatacacatgtatatacacatatgtatgtatacacatatatctatatacacatgtatgtatacacatatatgtatatacacatatgtatgtatacacatatatgtatatacacgtacacatatgtatgtatacacatgtatatacccatgtacacatgtatacacgtgtatatacatatatgtatatacacacacatataatatacagtatatatactgtacaaatatagtataaatacgtacaaatataaactgtctatgtgtgtatattatacatatatgtgtatatacatatgtgtatgtgtgtatgtatactatatggtatacatactgtatgaatatatggtatatatattgtttatgtacaaatataaactctgtatgtgtgtatataaataaaataaagattcattttgtgcatattagtacctgtgactgtctcctgaaagcagaacagacttctttgagggtagaatgccacttttattctaacttttcaatacattattgatcttgcaccggagcacctaaactctgaactggtttaaaaagtgaattagggcactagaaatccttaccttccatttttgttccctcaaatttaagcgagaagttagtagttctttagttaacttccaggagctcccacgctatacacaggccatatggtgacaaatagacattctggagtcagattgctgggtttatatttttgttccatcatttactggcttgtgacttcgagcaaattgctttatttcctcttctatacattggggatagtattaactaatttacagggttggattttagtaagacaacgtatgtgaagcactcatgtatgtagagcttggcattgcagaaagatactgctcagta

SEQ ID NO: 29562 - DNA, 1030 bp, Homo sapiens
aagactgggtcactgtgcttaaactgttgatgcaaacaatatagtttattctgaacatctgttttccttctgggagtctacaattttggatgcctgcctaaccagtcctgggtgaaaaccctaggcacggaacctctaatgagcttccctcgtaaacatgttttcacacgtgtggtcacagctcattgctggaggaattaagtgtgtcctgtgtgactctactgggagagaactcttgaagcttgagcctggttccctccagactttgcctcatagaccttcttcctttgctggttctactctatgtccttttgctgtgatgagtcatagccatgagatgctgtaagtcatagccacatctacatgctgagtctggcgagtcctcctagtgaattgttgaacctcacctcctctgcatttttggttgttggtgttgttaaacagccagtcatatcatcttacggagctatgaattccattagcatttactggattccagctatgtacaacatacttgtaaaactccagtttgccttagaaactgagtcaaaccaccaaatgtgtccaggagtaactcgttcccaagacatttccagatatcaggcaatatggaagctacagagatgaagtctctgaagctcaattgagataggaaatgtaagttgtatagaagttgtatagaagcagaacccctagaacattgagggaaatgagtgctctaccaattccataatgtaatagtagcttttattaagaggagggtcatgaatgctgtcttgggggagttagagaagtgactttaaggcattggtggactttgctggtgttgagaaagaatattttgatcttccttggtatccgtcgtcatcttttagctttcatttgtgtgttgatctatccacccatcttcctgtccatccaattgtctgtctacccactcacccacccatctatctgtccagccttgccaggcagcttgttacattcatgagctttgattatgtgttaggctgtgttcaaggcactgaag

SEQ ID NO: 29563 - DNA, 1056 bp, Homo sapiens
ggtcttgggccccacctctatataccaaatcatgattttaccacttcctaaatacagcatgctcttccacgttgcgaatatttgggaaatctttttttccttggaaagctgttaactttttctccctgtcagactcctagtaatccttcaagactcaggttttgttggttgaactgaagctcatgcaaatgatcacttaagaggtgctgagattggcatacttctccagagtgcctggctttagtgtagtggaaattctcttcagccacgagcgtcccacaagggagcctagtttgttcatgtctttacttgctctgctaaattatgttttattaatgtgtgtgcttgtactgttgctcaggctactgtgctaatgactgataattgccttaatgagctatttgtaagaaatacagtaataccagtagggatgaaaccagaccccaccacagctggtggtctaatagccttttgactgactttatggaggagcagactgcagggttattgcagttaacataagcaagagctcagaatcacccacttttccctgaacacccaatttacccatcttccactcacgcattaatcatgtttatatgagtcgggggcaggttaggttatgctgcagtaacaaatctcgcatagaacaaaaaaatcactttgggaagccgaggcgggtagatcacaaggtcaggagatcgagatcatcctggccaacatggtgaaaccccgtctgtactaaaaatacaaaaattagctaggcacggtggcgcacacctgtagtcccagctacttgggagactgaggcagggaaattgcttgaacccgggaggcggaagttgcagtgatccaagatcgcaccattgcagtccagcctgggcaacagagcaagactccatctcaaaaaaaaaaaaaagaaattcatccctcaccctgtactacaagtccatcacaggctactcatggcactgctgcatgctgtcttcactctgggatcctgatagtgaggcagtctctatcagtactcttgctagtccttaagatagagagaaa

SEQ ID NO: 29564 - DNA, 1065 bp, Homo sapiens
tttgttccaacatatgtgtaaatggggatcttctctgccaggggttgaggaaaacatgcttttttctcgctgatatggtttggatgtttgtctcctccaaatctcatgttgcagtgaaatccacagtgttggagatggggctggtggaaggtaattagatcatggggactgattcctcatgaatgggttagcactgaccccttggtgatgaaacagttcttactcatgagaaatctggttgtttaaaagaatctgagacctcctccctctttcttgctcccacttttgtcatgtgacgtgtctgctcctcttttacctcccaccatgattgtaagtttcctgaggccctctccagaagtgcagaagatgtgggtgctatgcttcttgtacaagcctgcagaaccatgagccagttaaacctcttttctttataagttactcagcctcaggaatttctttctagcgatgcaaaaatgaactaatatcctaaattatttcttgactttttggtgggtctatggactgggctatttctgaagccactgtttaggtaaaagcattggtttctatcagaaattctacattcacttcctctcctggcaaaggtttttctattatgggagtagttcattcctttcatttttttcctccctgatataaacaaaaaacgtggagagccgtcacgggtaagatggattggattaattctgcagacacaatcagggagacccaggagcctttgggggagtgagggagatgaacatcatctcaggaagaacttttaacctctggaactccccaccagtaggacggactgttccagaacgcagtggtgatctactgccaaagatgttttattaggatagaaatcgctaaaggacaattatttatttatttatttattttgctggggacagggtggagtgcagtggcacaatcatagctcacactgcagcctcaaactcttgggctcaagtgatcctcctgcctcagcctcccaagtagctgggactgcaggcatgctcaacaacatccagctaatctttaaactttttgtagagatgg

SEQ ID NO: 29565 - DNA, 1031 bp, Homo sapiens
tcaaaatttgcgtttaatacatttaacctacattacagcatagtttagcttagcctgccttaaacatgctcactttcattggcctgtatttgggcaaaatcatgcaacctaagcctaggtatattaaatactgtactgaaaatgaaaaacagaatggttatatgggtactcaagtatagtttctattgaatgcatattgcttttgcatcatcataaagctggaaagtcatccaggtgcagtggctcacgcctgtaatcccagcactttgggaggctgaggcgggtggatcacttgagcccaggagttcgagaccagcctgggcaacgtgacgaaaccttgtctgtataaaaactagaaaaattagatggtcatggtagcatgtgcctggggagtttaggctgcagtgagccgtgatcacgccactgtgctccagcctgggtgactgagcgagaccctttcccagaaaaaaaaaaagctgaaaaatctaagtcgaattatcctaaatcggggactgtctgtacttaccttatatctagggttgctgtaaagatgaaggagggcaatagatccaatagtactttaaaagtggtaaaatactagatatttgcaagaaaagatgctagaacctttcacaccaaattttgactgtgtgagaaataaatcaacaatgtagtttcacagctccaagctaatagagattaaactatattactctcagtattttgccaaagtgagttggtcttcaaaaatagttttaaaagaatgtatgtataaaaagtttttaaagacaggaagtaaaactgcaacaggatttcttattcatttttatgaccatttttgtcttttaaaaactaggtccctttttatgcatggattctattatttttcctagattttacagtgaggggatgtgcattttcttgagggggtgccgatttggtgcagtgctgctttgcatatattattaaatcaaatagttttataattgaatatgaagtagggcaaaatcctaaacctagttagtatgggt

SEQ ID NO: 29566 - DNA, 1008 bp, Homo sapiens
tcttggacagctctcttctgctgtcccctaaaccccctattcctactgagatcagaggccatttgttgtacatagtcatcgcccaggtgccagcgtagggctgggtgcccgggaagcctccagtaagcagcacagaggtgcggggtgcgtctcaggatgccaagacttgatcccgactccatcatttattattcctgttctcttaaccttttaagcttcagtttctttgtcttaataaaaagggggcatgtgaagagatgacagtagtccttcatggttttgctgtaaggactcactgagcaaaaaacgtgtaatgagggcaggtatgggctttattaatttttgtatcctgaggttggtattcactacatattcatcagaatgatgatgaaaaagtaaggaacccccccactctgagtttcatttgctccacttcgaaaactaagatactggtgttaatctgtggttcctgggggcagagggctgctcatcagaaattccttgagggcctttcccagaagcacaggaccaagccccacctctgaaattctgattcctgccatcttggctggaatgtggcatttgggttctgaaacatgggtcctggggattgtaccacacagccctggtgaggcgtgatgggccctccagaccctgaggtctctcgcctgatcctttctgggttgggcaggttgggggcacatggagtggctagcaaatggttagggttctgacagtttcccactccacccctctaccttccacccgttcttcaaggcccactttatttttatttatttattttttttgagacggggtcccgctgtcttgcccaggctggagtgtggtggcgcgatctccgctcactgcaagctccgcctcctgggttcatgccattctcctgcctcagcctcccgagtagctggaactacaggtaccgccaccacacccggctaatttttttgtatttttagtagagacagggtttcaccgtgtttgccaggatgg

SEQ ID NO: 29567 - DNA, 1042 bp, Homo sapiens
tccagaagcctggtggggaccaagtttataccgccagaggccacaatgtaaggtgaaggctttttgtttgtatctgttgggtgcccgttgttttcctagtgtcatttctaccttttcccaaagctcgtgcgtttgtttccatattttaaaaatgactatgatgagatgtcgttctgaaattaggaagtacagtaatacaacattattatcatgatacaggtttgcatttataaggtgagctcccttggggctagtcatttttattttttttaattatactttaagttctgggatacatgtgcagaacgtgcagttatgttacataggtatacatgtgccatggtggtttgctgcacccatcaacccgtcatctacattaggtatttgtcctaatgttatccctcccctagcccccgaccccctacaggccccagtgtgtgatgttcccctccctgtgtccatgtgttctcattgttcaactcccacctatgagtgagaagatgcggtgtttggttttctgatcttgtgttagtttgctgagaatgatggtttccagcttaacccatgtccctgcaaaagacatgaactcatccttttttatggctgcatagtattccgtggtgtgtatgtgccacgttttctttatctagcttatcattggcatttggattggttccaagtctttgctattgtgaatagtgctgcaataaacatacgtgtgcatgtgtctttatagtagaataatttataatcctttgggtatgtacccagtaatggtgagagacaggactagctggatttcctaggccaactaagaatccctaagcctagctgggaaggtgaccgcatccacctttaaacagggtgcttgcatcttagctcacacccgaccaatcaggtagtaaagagagctcactaaaatgctaattaggcaaaaacaggaggtaaagaaatagccaatcaactatcacctgagagcacagcgggagggacaatgatcaggatataaacccaggcattcgagccagcaatggctaccctc

SEQ ID NO: 29568 - DNA, 1191 bp, Homo sapiens
attgttcataatatttgtcagccccaaacacaatgctacctgccaccctccttggtaaaggggtcaacctatatgcaggcttgcgaactcactgttcccaccaaatgactcatttaggttgaaaacatttatttgcacaaagtggagttgtgtcagtgtcactttgaaaagaaaaagacgccaatattccctaccaggatgttctgtcatgaaaacaaacagatgaaacaaaatctacttcgaggtcagagtgagaagaagagaaggtccggctgaaattatctgcagtcttgctggagggaacaaatggttgcagctcatgggtatagtggcattttacggctcccagctgtgccttcccttcttgaagatgggtgaaggggagtaggttctgggctagacttggggctatggagcaaaagcagagggagcttgtcctgcacagacgtggaagcagaggtcactgaattctgttccacagtagaagtcagcagtactttatgataacagtgcatccaaacgtgttctgtctgctgggctgggcctgacacccacggctgtgactctttcagaaactgcgaaccaacctgtgggtgggccagggatccaggtcaggagcagaagtaggttaaaggtgatcgagagagacatgtgagagagtgagcgagagatagaggcctgcaggataaggccacatcaggagtacagtccaaatataggcagtgattgtgaaacccagggactgtgggctaaaagtgctgtagattctgaaagtaggaagaggaaaaatgtggccacgggcctctggggaaagccctgttctgtgggctttggccacttaaatctatatgtcttctgctgctgtctcaaggcagtgatgcagccctgactatccttctgcccatctatccattcatccatccatcagtccagcatttgagtctctattctatgcatggtactggggatagtgtggtaaacagggcaccatccctaccctcaaggagcttacagtcttgcctggtaaaatgtacagaagcatgcatttttgaaacaagtaaaggaagaagacttaggcgctctccactccaaggccacctgcaccttgcctatgtagctttccccagcaacacgaagccagcattggtttcttaagttcccttcttgtctttatcatgtatgtacttagta

SEQ ID NO: 29569 - DNA, 1066 bp, Homo sapiens
gattacagggtaggctgcttggatccggtttggccctctcctcttgaatgaggagggaattgggcaagccgcaggtagaccaggtggccccgatagatagtgaccgaactggtacttgagctgcatctcctcttcttgtctagccatcttggtgttctaggtaggacatgagctaggtcctaccaaagacttgggcactttatttaagttctctcatgtaatcctactaacaacgttgtgaagcatgcactatttttacttactaaacaaaaaaggagcgatcgggactagaggacttgaaataactttctgaggcccagcctgctggtgcgaagtagatccagtgattcaacgtggctccatcccatgacatttagctgtcagggagctgcaaacctatgaaacagagctttcagattttggaaatagaaacgcaggcagcatagtgccacttgctgcctcctgggaaagccccttgtcgtgaataatagaaccagcgctagaaggcacgttgctcaggccggcaggtgagtccgagggctggggaggggttttctgggcagtgggacacctccctcttagggggtttcatttgtccagggccagtgaaaggctgtttggtccctctgctgagtgaacagtcccagcccacaggatgagtcagagcagagtccagaacagaaggcagagggcatgtgtgcaaaggccatgtttatcccaggcatttggatcttaagattcctgttcatgatgattaaggttttatacataacactgtttacagactgctttatgatcatttatgagtgtcacctggcaacagctgagttagccacatccatccaccgtggggtaattaactctgggcccacccagagcccagttcattgcttgtgcattattgagcctcctccccacaccctcattcattcatctatccatccatccattcattcattagagccctttttgtcagatgccacctttgtgggtagctttgtggttggcatttctttttcattgctgagaatacgtaatatgctggacatgttggtgttcctgttag

SEQ ID NO: 29570 - DNA, 1036 bp, Homo sapiens
gagcttgcggtgagccgagatcgtgccactgcactccagcctgggtgacagagcgagactccgtctcaaaaaaaaaaaaaaacaaaaaaaaacaaaaacaaaaaaaccccgcaaagataattgatagcatttgcgggtgtggcaaaggtgttagtacctcctctcctctgttaaagtgctattggagactttcattcagccatatttggcctcctggttacagtactgccctgagggctttgcagtgttagcctgatgtctggagaacctgccccatgtgccactgttttcatattcaggctcatgaagatgatcactcacttaagggttcctatttccttaaccttttgtagtgagacattgtaacttgtttcctgaaaccgcaaggcttaacatgagtgaaatatactctgtaggtgggtctttttcaaaataaggtccatgggtctatattctgtatgttttatgagagggaactatttaaacaaaactgttcaaattggggtttatattttgatgaatctgaaaaacaaatggctgtgattctttgctgtgataatttgccatggaaacatatttttgtaagactctgccttttaaccacacttctcttctttaaaaagggtcaagttattacccacatttgataaacccaattataattcttatttctttacctttcatttctcaaaaatcctttccaggtgatgaggtttagaccagccttcccacacagatgctcacctttcctctgagtcctccagctgctcatttggagagctggaggtgacttcgcctgggggatttagtgcagggacttctgggggcaccagggcccgctacaggctttgagcaagttgcttgttgagctggacagtaagccatgcagcgtgttgtgtgtgcagagcttctttttcggccccggggggctcgtaactgtgttctggaaacctggtacacaagaaggcatctggaacgtcagactctccatatgggagcctgtcagagaatgtcgtcgcgttttggcctagcagcc

SEQ ID NO: 29571 - DNA, 1051 bp, Homo sapiens
agagaattgggagtgagcttttaagggggagacagtttcagtttgggaagatgaaacagtgctggaggtgggtgttggtaatggttgcacaaaaataggaatgtgtgtgattctaccaaactgttcccttaaaaatgggtaaaattgtaagttttatgtgatgtgtattttactacggtgaaaataaggtatctctggcaggcagactctaagttggccctcatgatcctcatctcctgatctgctcttgtgtggtccctttcacttggggtgtgcaggggacttgtgacttgcttctaataagaccagagcagaggcgaaggatgtcacttctgtgattacatttccttatgtaagaccccatcttcatagcaaacttgccctgaaggatttccttcttggcttgatgaagttggcatgttgggggagcccatgtggcaaggaactgtgggtggctttgaggagcagagggtgacccctgcccacagccagcaagaaggcaaggacctcaggcacaaggaaatgaattctgccagcacaggagggagcttgcaggtggattcggccccagagctccctggggacaccttggctgtgtagccttatgagattcatgaaccatagacacagctaagccatgcccaggctcacactgagctataggaactgtgaaataatgaatgtgtgctgttttgagccatcaactttgtgacagtttgttacacagcaatagataactaatatgtagcctcccaggagacctgcctgagtccattccatcctagttttctactctggtcacctcaggtctccatctcctcctcttgtcctctgtgagtgggcagatggcctgcttttctgttttctgtttatgctcaagtgcattcatagttagagccaatttgtcctccttgtgccttcctgctctctctggtttccggtttgtgtgtcccatccagagaccgagggtgccaactctgcccacctctgtagaggtgtactctcctccccatcccccacagcacccccacttgcctctccaatataaggc

SEQ ID NO: 29572 - DNA, 1030 bp, Homo sapiens
tttgtgtgatccaggcactagcaaaactttatgaacttgcacttggcacgtggtgttggttatatggttcaggaagccctactgcttctccagtagtggtctgatttaatccataccaaggggtgcttgttctgggtcttagcttttgccattttcctttttcttctgcttggaattatctataactcctttggaaatacagcatttttgagctcattaaatttgttaatgtgtgtattatgttgagaaagcactcagttatttagagttgcttcattccctttcccttcatctctttgccttccccaccttagagtaattgtgcttggttaaccaggaaaccaagggctcctggggatgaagaagaggccagtctttctcttcttagccctgtccagagatctcagaaaatttgcagaggccctgaaggtaaaagcaaatggttgcccactaatcacctgaggcagtttttcaggagttttctgtctaccttgcacttttctctcataggaaatttgggctctgacagttaagagagatggcagccaatgaatgggataggaaaggccccttccttagcagtttgtaagaaaaggtactgaggtgtgctttacaagtattatgccttttgacagctctctaagctgagtagtttcattttacagctaaggaaactgaggcttggagaggttatttgctcaagcaataaagcccagagactggaaatgaattttgttttcagaatatttgcttttaatctctgtcctataatccaacaacccaggtgtcctaatactggaaatatacatacccctgggaaatacatgaagacttttcatggagtatgcagatgtggatacttctaagaaaataaattttcacatctccagcctcacatatgtgcccttccctgaaattgatcagcctgagatgatccctgtctggtccacggttctcccaatcctcctttcatggttatcctccctcattttgtttatttttatttttatttaattaatcaatttattta

SEQ ID NO: 29573 - DNA, 1030 bp, Homo sapiens
aatcaccaagatttagaggttagtgggttttcaagagtggcgaggaaaggaatcaaatccccctggcaggagagagaggtttttaacgggaagatcggattgctctggagtgagcagtagctgctgacaagtgtgggccctcctgcttcacttaatgaagtgtgctggggtgtggattaactttttgatgtgagccaatgcagattcctttggcttttaaaccatacctggaagggccttagaaatgaaatgaaaggtttttttcatctcatcataggtctcggaagtgcttccatctcttgggaaggttgtgacgaaggtttcctttgtttctgggttcctgagctgcgctttaaagttgatgcacagtgcagggagggtgcgtcctgtagtgtcgccatccttcagccacctacagtagcaggacactaggggggactagttatcttttccaccatcgaagaagaaaacaccagggcccatgttactgtggtttatcttgagggttcatgagcctgtggtttatgttgagggttcgtgagactgtggtttatcttgagggttcctgagatgaactttttgggatctagtacatgcttgcactagtgagtggattctgagtgcctaagggatgggcctgctcacatctaaattgtcatttggacaactcagaaccagttaactgcaaaatgttatgtgacattctgaaaagactcagttataatctctaagtatttaaggactacaaaaaggctctatcctttgaatattagaccatcctaactttaagttccctaacagtttgtaatcaacacttttggtgtttggtttttgactgcatattccctgcagtcatcataaaatcacatggcttcaaaatgtctctgcagtggactccatcaaacttaaaattccccttaaaaatacattccgtatacttagagatgttaacataacatttgacggtgtagttgcacttccacctcagacgctgtctgcacttttaatagtatgaaatcattaatgtcca

SEQ ID NO: 29574 - DNA, 1050 bp, Homo sapiens
catacaaagccttcttcgctccatcttcccagctgacattactctttcttccccctttccatgtagttaaattacttatttattcatttaaatttgtattgtgtctctcctacgtgccaagatctgtgatgaacatgatgacagaacagagttatggttctagctttctcaagtttatatcctttgaagttgtgggtatctagtaacttttccaccctcccctggaagattcctaagagccacttgtcttacatgaaattgataactcagacaggatcatcaggacaagaaaaacagatcttatatttgtttatattttattttatgtattttattttatttgagatggagttttgttcctgtcacccaggctggagtgcaatggcgcgatctcggctcactgcaacttccacctcctgggtttaagcaattctcctgcctcagcctcctgagtagctgggattacaggcacctgccaccacgcccagctaatttttgtattttcagtagagaaggggtttccccattttggccagactggtcttgaactcctgacctcaggtgatctgccatcctcagcctcccgaagtgctgggattacaggtgtgagccactgcacccagcctgatcttatatttgaaaggagctttggaggtcacctggtccagtgtccaggggtctagactgagaggaccccctctgcagtcttcctggaatcacccaggctttgccttggcttatctagcctgtcatctgcaggggacagtggcctttcctacattgttcactgtagtaacccccacatctggaccatgaggtgctcagttaacaattgttgacttttggacgaatgaggaactcttgattctaggaggcagcctgtgccttgattggacaactgtaacttttaaagaaaatccatgacattgagcccaaatctgccttcctataacatagctccatcattctgagccctactggcacagaatggcagctgccaacaaagctgccctctccaggttggattctaagacaactgtagctcctttt

SEQ ID NO: 29575 - DNA, 1005 bp, Homo sapiens
tgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaa

SEQ ID NO: 29576 - DNA, 1069 bp, Homo sapiens
aaagcaaatccttgcatatcgtagggcttaattttttattggaggaataataacatgcagactgatgcagtttgaaacattttcttcccatgtgtgtgtctatgtttgtgtcagtccctgtgtctacatgtgtgtacgtctgtgtgtgggcgggtgtgtgtttttctgtacacctggggggagaggtatctgtaaagtcagttctcttctctcctgtagggtggatatgcagcctacagatatgcacagcctgctactgcaaccgcagccaccgctgctgcagccgctgcagccgcttacagtgacgggtatgtacagagacagtggtgagctttgggatgcatgagagctgttccatcccaaaatgtcacccattttcctcccttcaccatttccacagcagctcttagcacatcgggcatcttgccagcctgggctttctgcagacctcttgatggcctctgtcatgcctaaagcacaaggcaccgactctgtcctccactccctctttcttgttctcatctcttctttgactttgactccagtccctctcttcctcatctccaactcctttcttttccattttatggaagtacttcagatttttttcagttattgcatttgggagtagaaatagaaaggttttttcctattccttgtaattccagtttccttatgataatccaagaccaagtgactcacaagtcttaaagcacagtaatccctttaatttttttagatcatacacttttctttatctgtctgattgtgtttcttctttccagttatggcagggtgtacacagccgacccctaccatgcccttgcccctgccgctagctatggagttggcgctgtggtaagtatataatataccattgctttataaaaccatttcattccttcttttacccgtagactacagaagatctagggaggtagtaaattcagcctttcatccaccatcaaggtattaaagccacatagatctacctggaagtttcatgtcaccctctttatttgtgtgttattataatgtgagccacatggcctagttaagggcagcagaa

SEQ ID NO: 29577 - DNA, 1025 bp, Homo sapiens
attaatttacttgtgagatgatcagcaggtttaaagtcttttattattgtcgtgtcatttgcatacataaataacaggactagcttaaccttaaaccagctctttcccttttctgcttttcttctcatttcacatccctctttagatcattagagctgtgatttagaggttaataagctttctgaactgtacattttcctattttacctactttgagagaacatgaccttgtgatagccaaataaggaaccgatgccagcaaagagtgtgtagtaatgagaaaacgccagatatttagttcttaaaagccattggaggaaatgagtagcataatcagcaacccagactcttcttacagctatttgactatcatagatttgctgactctactagccatagtaatatggactccattatttaaactgtctagctatcactaaagttccatgattggtttgtcacatattatttaaaatgtggacaaagtgatataattgacaaagtacaagtttttgagttttgaagtcttttatcatgacctctccagatggactttttctgaatgcaagcttgatttagtcgctcaagtcatcaagggaaaatttttataagaaaaacttgtcagcatgaaatgattctgtggggataggttaaaattgtctagaaatactttctccacccttactttccaaaatcaataagaggtcctttttagtgaactgtttccacagtctaccagagattcacaagcaacctaaaaaagttaatgcactttcagaatgcactcagaggttttgcgttttgcaggaagtagagatgggatgatacagttcttcgaaatacaggtgactcacctgtactacttagcataggcctgtaaggtatgccttaatttaataactacttgaaggaacctcagctatgatttggtccaacctcctaacttacagatatatttctcagagacttacccagaactacataaattattaatagtcaggcataaaacccaaccaatccatatt

SEQ ID NO: 29578 - DNA, 1035 bp, Homo sapiens
atgattccatagcaacaaataaatcctttgctactgaatggggaaaaggagtgaagatggcaggttttgtttttaggggtttctcagtgtcagcctaaaatgcaaatttttatagagtggtctttcatgagtcagttgtaccaaggacttcctcatcaaagatgtgacatttctcttcaccttttctctgccagataatgtcaatatgacatatttttttttgtattcttacggaggaataagtagcagcagagaagcttgttggctgctacttagttaaaatataaagggaaggaacctcctttgtatgtccttttctgacagcaaaattggcttagccttgaggtgtactaatttagcattcattcattcattcattcatagaccaaatggatgtaccattagaagttctccattccacagagttaaaacatttttattagacaaggtatgttgaagtgggcaggctccaaaagacactggaagggaactgcttcagaaattaacttttgtttggagtttgtagacatttaaatcacatgcattccatcatctccatcttatgccattacttacttttattttaatccttttttctctcaacttgacctttgaccttcaacctctgacatctctttaaagaagtgaatatgcagtattatttcatcaagaaatactcaaatgaaacattaaaaggaaccttttggaagttttacacactaggaaaattgtttgtgaaatgtcttccgttgtaatccaagagaatttactgtcatatttgcaaagagagactactcaccagaaacatgggacttccttattttgtaacattgctgaattactttataaagtggttgaatttagtcctgttcaatgtagtcgtttcagtatattgaccaaacttgagaacccattctctaccaagtctgtgtcaggtatatatttgctcaaagatattttatctttatgtctaatcatatcaatttctgtgcattacattgaacactgatttcccatgttttctttttattaact

SEQ ID NO: 29579 - DNA, 1085 bp, Homo sapiens
tacttcaaaaattctagtcatacctctcactttcctaatcatggactttaattctaagaggtatgtattaattccctatgacttctgaacagattaccacaagtcgggtggcttaaaaccacacatttattatcttacagctctggaggtcagaagtccaaaatggctctcacaaggctaaaatcaacgtgttgggttcttcaggaggctctaagggatcatctgttttctccccttttctatcttctagaggctgcccacatttcttggactatagctcccttctgtcttcagagccagcaatggccagtcaagtctttctcaggctgctttactctgattcggactctcctgtgtccgcttttcacttataagcacagtacagtggccacgttggaacactgtattacattgggcccaactggataatccaggataatctctctatctcaagatcattaacttaatcgcatctgcaaaatcccttttgccgtgtaaggtaacatattcactggctctggggattaggatgtggacaactttgggaagccattatttggcctattgcaaagtctgtttatcttcaaagcaaagaaagaaatcttcttacctttatgtttcatattaaagagtcccaaaacatcaacaaggctttcttcctcctatcaccccagggaaaagatgcttataaagattgctttatttttatgtttttggtatcttgattcgcatttcctttggtgtataagcatctttctttataaaacacttttaaaacatttgaaagtgaaattttgttccagaatgttagtcattattgagaaaatcttatccaagcagacatgaatgttaaactttgacatttgctgactgtgaaattgcagtgctcatcataccaccttccattcttttggatgcagttattgtatcactaatgttctttcaacacatttcagaaaagaaggttatggaagatacttagcaattagatttgaaaaaagatagaaggattttaggactaatatagtttagtaaatagaatactgaactgagatttgaaaaggcttagaattttctcaccatta

SEQ ID NO: 29580 - DNA, 1182 bp, Homo sapiens
aataaaacattttcctttttccgtgattcttctattaaaccaaaccaagatgtcttactgtagaaaacttgggttattaatacaagttttttgataaagatagtaggtgattcagtccaatggaacagcatgatttctgttttgctctttccatttttcagttttttttcacatttcccaaagtctggtttgaaacccaagtgaagtagataatcaggtatgactccaatactcagagggaaatataagccaaaaagatatctggaaattttctgcatataccttcaattcatttcatccaagcattgattaaaacagttttgtctctttttatatatactttccccctaaataatcattgtgttttgtgtaaccctctagtcagctatttagctacctaacagtagagtttaggcttcgtgtctttagtttttgtttgcttttctgaatgttaaaatgtttaaagaattaccaaagagagtggttatttaaaatattcttgatgttattgtagaaatattaaagtggtgaatagcatgtagcctatagaagtggtaacacagttatatattgattcggatagttgttcacaatctattgctaagttaaaaaataaaagcaatatatgctttggcaggctgaggcaggcagatcacatgaagtcaggagttcgagaccagcctggccaacacggtgaaaccccctctctactaaaaatacaaaaattagctggacgtggtggcaggcacctgtaatcacagctactcaagaggctgaggcaggagaatagcttgaatccaggaggcagaggttacagagagccaagatcgtgccactggactccagcctgggtgacagttcaagactccatctttttttttttttaaagcaaattatagaatgcatctgatgtctatagttacttatctctacatgcctgagggaaagcctggaatgctgtgtactaaagcattacgatgataggattgcagattatctttattttctgttttcccttttccttttgtttatattttctgctttttatatagtgaatatactttgcttgtgtaaaaaaaaggagggtaacagccttctatagtatattattctacttactaggatttgctttttaaatctgagactgttctaaaaactaagagatgtagttaggaaaattcc

SEQ ID NO: 29581 - DNA, 1067 bp, Homo sapiens
gggttctagataattttttatgtctataaatattcttgagctttatctacagcacaactgcgtttcttagaaaaagtttgatcctttcgggtcttgggttgtttgtttgttttgttttgttgtttgttttttgagatggagtctcgctctgtcgcccaggctggagtgcagtggcgcgatctcggctcactgcaacctctgcctcccgggttcaagcgattctcctgcctcagcctcccgagtagctgggattacaggtgcgtaccaccacgcctggctaattttttgtctttttagtagagatggggtttcgctgtgttagccaggatggtctctatctcctgacctcaagatccgcccgcctcggcctcccaaagtgctgggattacaggcatgagccaccacgcccgacctcaggtcttgttttttaagctttgttagacaggactagagctgtgtttagtctctggttaatttttcctggccactgaggcaagactctttttaaaactctaatggatgctccttacatcattaggttttccactctggctgttaagaacaggattattcttggcactgtgtgagctcctagtactgttccctgtatttctttcaggtggttctttccccagcctctggaagtttcacacatagatgtggcagtcatcactcaactgagtacttgagatctttagagctctctttctctctgcaactttctccagtaccgtcccctgtgctgtcttggcttctccagacttctaggtctatcttctcaattcatggaacccaccaggttctgcctgggtccttccttctctgctgcagcctggaaactttatccatgtgataagttggggcagttgtaaagctcaacttgcttgtttcctgactctggaatctctgtccttccttgcctactagacaatgtcttgagtgctgttgtttcatgtattttgtggtttttttagtagtttcaggtaaaaagaaaaatctgtttcttttttttttttttttttgagacagattcttagtctgttggccaggctggagtgcagtggcag

SEQ ID NO: 29582 - DNA, 1048 bp, Homo sapiens
tctttgtagctggaaggctgaagtctttcacctgagctgctgccagttcgctcttctgttcctgggtggttgggagaagagaagagggagggtattttatgctttaattaaagacagataagagagcaggtatgttttgctttgtttcattttctcttttcctgtttttgtttgtctggtttttgaaaggagttggagtagagaatctattctgtgattttgctaagcatatcccattttctttgaattctggaggtcctctcagcatttagtctccattttgtggcactgctttaaagtgattccattcggttgcctgccagtcatgctcccttgccactcgaaccttatcccacccttcatccacggagctgcagccacactgtttgttttggcacactttccactttctatgggctttgcaggatttggggagttggaggataggcggggattgtgggttggagactgaatttatgttcctttacaatgaaaaaaaaaagcctcactttttccagagatttggtttctttctgaattcttctacattgctccatatcttcagttataatcatttcttcgctgaggccaagattgtctcttgaaaagtattgcttttctaaaaattacttagctttcttgaaaagataaacagaatttcataaatgaagctatgatgaaatccgagcaatcttgactcattaaattgttttttccgtcttagtcaccccctaatcacacacacttttctctttcttttttggcccccttctctattttttcctttatctttctccttagctttgcaattgagtctaggtaagcttaatatttgacaacctattacttaaatttgtattgctacaggagacatcttcatattgaacagtaatgacattcctcattcctctcagtgataaggcataagctcaaattcctggttttgttcctccagttttctgttctcccctgagaaattccaaactctgatctacacagattgccatatgtaaacaattttatctctctcaaatttgaacttttcatc

SEQ ID NO: 29583 - DNA, 1057 bp, Homo sapiens
cattctggactatttctgtgtttatttgtggccgagtgtaacaaccatataataaatcacctcttccgctgttttagctgaagaattaaaaaaaaaaaaagaaaagaaatactgctttattttttaaaaaaaatttacataaaagataaatcctgtttctggattctctttttgcttgggagatgatacttgcttaaccttagagccctcattcaatttttattaactggcaatattagagggtaacagctctcttcttgcttagcaattactgaaggcttttcaatgacttgacttttcattatttattttttaaactagtgaaagaatgatctaaaatggaaatttttatgatgagttttctattgcctcttggaacatttccccttagtttctagaggagctggtaagtgtagtgtgtgtgaccattaagttagagtgcacatgcttatgcacacttaatattgtggtcgtaataattagtatttaaagaagccataagtttaggaatgaagtagaagaaataaatggaaactggaaagagagattctggggtgcttaataattctaataataaaatcacctgttttatcaggatgtgctaaatattgaagaaaagttatgagtttttgcccatcctgaaattatacaactggcaaggatagaatatcaaatttgtgaattttcagtattccagcgtatttgttttgttgtatatactttctgtgttaatgtaatgtacatagttgttagtaatctagggggaaaacaatcaaaggaaataaccagctgggccaagtctttcatttgtcctgtggttgtgttgtgttgtgcctgcgtgtgtgtgtgtgtgtgcacatgtgtgtgtgtgtgtgtttgagccagacatccaatcccaacatttgataatgacctgtcacataagctttctcaatatagaatgtctatactggtggttaggcctgggttttcaaagttaaacggtttattacaatgtaagagcgatgtatggatgtgttttcactgttttgctacttaggttctttgcatcttcaga

SEQ ID NO: 29584 - DNA, 1095 bp, Homo sapiens
agaaaagaaacagatgtcctctgtattcctggcttttgtgaatagtacacgattatgcttaatctttttatcctctgtttctatttctgccttcttgaagcaaggattcctcaaggttctattttcagcctttgccttctatctgtctgtgtctcccctccacctcccatttttcttttgtctctacttttctttttttggagtacatggttgatgtataataaatgttacagactgcatcagtgtgggagaggaatctcaaccccattatggccatggctatttctccttttctctttgatcttcgtgtctaaccctgacctctcctctagctgtaccttcaaccccgagtacctgttataccttctctaccattacttcaaaccagtttatgcttcagatttgtctgtattagcagtgttattcttatttggctagttagctagaattagaacctttctcttataccctacatgtggacagtcttcaattactgtggatgttgtcttcgtcatctcttatatatctataccttctttattcctactgctaatatgtattttttgcattagtcatctgtaacctcttgtaatggtagctgctaattggtttccccacctttaggttgttccctttttcattcttacctgcagccaccagagccattttcacaaaacgttatttatgtagcactcttttcctcttgctcaatctttaaagatcagatctgaaatacgtagcaggatgtcctagtccttccatagtgaacctacctacttttcttgtcatttgccaccacctacccatagtcaagtaaactggtcacacaatcccttagtcagtcagtcttgcatatttctttctctttttttccttttggagacggagtctcgctctgtcacccatgctggagtgcagtggtgcaatctcggctcactgcaacctctgcctcccgggttcaggcaattctcctgcctcaacctcccgagtagttgggattacaggcgcacgtggccacgcctggctaattttttgtattttagtagagatgggtttcaccgtgttgcccaagctggtctcaaactcctgagttca

SEQ ID NO: 29585 - DNA, 1033 bp, Homo sapiens
ggaacctgagccaactctgaaccctcagccattttttgtcagtgcctcttttgagcttactggatcccaattccttttttgctttgagtttgatggtattcctttccatgtggctaggaaaagtgagaccatgccttgtcatcttacaccaaagcccttgaataagaacagctcagattaagctagtctgatatattcttaagacctgaccatttggatcttgacctccatctgcagcacataataagtcttttcccagtttctaccttgaacagcctttattttagtttcataatttctgtacccaggacttcaccatttccctgtatttccattgttgcatattgaggttatgcagtctgaagctcctctgaactgtttttcagaatgcctttccttctgcttcggaccatcagagcttcctagtttcctctattcccttctctcaccttcacatttcttttgttcccctttcctccaaccatagagtacacattacttgggaaaacccgattatataatattttagagcataggtcttggaaacatgtttatgcactgtcaaagttgcgtttccattcatctgtctctccccaggtaattagcataaatgaaaatagtgaccttttagaatatctttcaagggtggtagccaacataccaacccaggatactgctgagtaggagccagctggcatgaagaagcaaggacaagagtaaaccttttaagtgggcagtttcaaaagtatagaactaaatggaagcaagaaaaatgaggggagtgtggatatggtgctaattctaatgtggcaaagattttaaaataatacagaggcaatccagaatacattgagagccccagtgaattgttttctttaaatttcatgtcatgtgtagtcatgtttctcaatggacaaatggttagtggaccaaatgacattttttactcatccctgagtaaaaagtccaacgaatatagttcattagactgctgcttgttgtctccaaacagatcctgaaagttcaaatgact

SEQ ID NO: 29586 - DNA, 1098 bp, Homo sapiens
aatggtggtgataattataaagttgctgattatcagctactgatttttgaatgccgactatttgccaggcttaatactgctacgggagggggtcagggaagtgctggatagagaaaggtgacccctggctagggctccactcctatggacctaggtgagtagaggcactccagctttcatgcccaagtgttgcatttttcaagaccatcctggcctgccatgccccccatcctgggcctataaaaacccgagaccctagcgggcagacatacaggcagccagatgtcaagagacgaacaccagctgaagaagatacaagcagctggatggtgggaggacgtcaagggagcaagccggcagaagagcacaccgacagacgtcagcaccctggcaggccattgacgggtgggacaaggcggagtttggctggggcagtcggaggagagccgaggccactgagcagccgaactctagggctaaaccatctcccttctggctcccacattggtggaaaaatccttccactcaataaaactttgcactcattgtccaagtccacgtatgatccaattcttctggtacaccaaagcaagaacccgggatacagaaagccctctgtccttgcaacaaggtagagggtctgattgagctgattaacacaagtcgcctatagacggcaaactaaaagagcaccctataacacatgcccactggggcttcaggagctgtaaactctcacccctagacactgtcatggggtcggagccccacagcctgcccgtctatatactcccctagaggtttgagcaacggggcactgaagaagcaagggggaacaagagaacctttcctgtttcaataccaagcattttacagtcattaacatgtcgaattctaagagcaaccccagtaatggacaggccattctagctatgtaaactcttcaaaggcagcacttggtacagtgctgggcacttacttgtcaggatttggtagatgctgaactgatttgaactctagcatcatcttgcttaaaattgtcattctttgcctacccttgccctgcccagctatggatacagaggttttacaaatttg

SEQ ID NO: 29587 - DNA, 1193 bp, Homo sapiens
cctcttaaacccacgcagccaggtttttattgcaaccacaccactgaaagggctctagtccaagttgccagtaacttgcatgctgctaaatctagtggtctggtctcagccctcatcttacttgacctatctgtagaatattctatcactgatcacttcgttctctaattcactttcttggatacttgacttgcaggacatcatactttcctgattttcttcccacctctttggaagtttgtactcagttttaaagttgtaatattttgagccaagtcctttcacctctttttttgattctctttcatccactctcatggctttagttctcagctaaccaggaaagttttaccagccgggtaaaatgtttttttcctttaacatatattaagttttcttttcttttcatttcttttttttttcttttttcttttctttcttttctttttttcttttgagacagggtctcactctgttgtccaggctggagtgcagtggcgtgatcttggctcactgcaacctctgcctcccgggttcaagcatttctcctgcctcagcctcccaagtagctgggactacaggtccatgccactacacccggctaatttttatatttttattagagacagggtttcaccatattggccaggcaggtctcgaactcctgacctcatgatccacccgcctcggcctcccaaagtgctgggattataggtgtgagccactgtgcccggccctaagttttcttataattaagaaataagaataaagggatagtgaaaaaacaactgcattagacattaaaaaaaaatttcttcctttttttttttttggagacagagtctcattctgttgcccaggctggagtgcagtggtgcgatcacagctcagtgcagtctcaatctcctggattcaagctatcctccttccttagcccctcgagtagctgggtgggactacagatgtgtgccaccatttttgtatttttatttatttttttgtagagacaagtctgtggctgtgttgccacaggctggtcttgaatgcatgatctcaagtgatcttcccacctcagcctcccaaagtgctgagattataggcgtgagccaccatgcctgaccaaaggttcttccccctcctccctgccacccgagacggagtctcactctgttgccaagctggagtgcagtggc

SEQ ID NO: 29588 - DNA, 1067 bp, Homo sapiens
gcctgggaggcagaggttgcgatgagtcgagatcacgccactgcactgcagcctgggctacagagtgagaccctgtctcagaaaaaaaaaaaaaaaaaaaaaaggattgtgggagaagatggcggccgctgcacaatcccgggttgtctgggccctgccaatgtcacattctgccattactgcaatagccacatccgtgtgtcacagcccactccattgccagcttcatcatgccctcatacctcatgggaaaggtgaatgttcctcaagtcagtgggattgtggccactgggtttggagcaacaggattcctgggccgatgtgttgtcaaccaccttggacgcgtggggtcacaggtgatcataccctatcggtgtgatacatgtgacatcatgcaccttcgtcccatgggagacctgggctagcttctgtttctggaatgggacgcgagagataaagattctatctgacgagtagtggaacacagcaatgtggtcataaatcttgttggacgagactgggaaaccaaaaactttgattttgaggatgtttttgtgaagattccccaagcaattgctcaggtgtccaaggaagctgaagttggaaaattcattcatgttgcacatctgaatgtgaatattaaaagctcttctagatatttgagaaagaaggctgttggagagaaagcagtgagagacacatttccagaagccattatcgtaaagctgttggacatctttggaagagaggatagattccttaattattttgcaaatatgtgttggtttggtgctataccccttgtttccttgggctggaaggcagttaaacaaccagtatacgtcgtagatgtatccaaaggaattgttaatgcagttaaggatcctgatgccaatgggaaaacctttgctttcgttgggccaaatcgatatctcctctttgacctggtgaagtacatctttgctgtggctcacagcaaaggggtacttcctcccgtaccccttgccaccttttgcctatcagtgggtagcaagagactttgaaataagcccatttgagtcctggac

SEQ ID NO: 29589 - DNA, 1050 bp, Homo sapiens
ataactgggagtaagagctctaacaaatcacttaattgcctttcccaagaggctagctttgagatggaccgctttctccatgtatatatacatctagagcttagtttagacatcatagaaggtaaccaccattcacagaagtttctgggtctattctctgaatgacatcagtagtagcagtgttttggccagtgcacaagtacagtatgtgtacaccaactcccaaaccctatctctgtcgtttgttgttgttttttacttttttcttgagatgagagttttactatgttgcccaggctggtctcaaactcctgagctcaagcaaaccctcctgcctcagcctcctgagaagctaggattacaggctcacatcaccacacctggcttcatttgttatttaaagtcttggtaatgggcagaggtagagtgcagggttatttatatccagggtaagtttttcagtgattttttttccagtcttgattcagttttgtcagtgaataggtatgatttagtggaaatgatcttggagtcttaaaaacgaacgttgaacttttggctctttattcactagctgtgagaccatgagtatattatgtaaccactttgggcctcaatttcctttgatctgtgaaaaagataacagggcctgtcttacagagatattgtgaagatgcaatgagataatgcatgcaaagttgtggcacataatatgctctgagtaaatagtagcggttggtggtgttacattgaaaccagcaagtgggagaggaatgttcactgttttgtcttccagggtggtttacatcccctaactggaaagtggcagccatatctacgccttctcccatgagtcgctactgctgcatgtggccagtgcctctgtctagaccagcttctcagatttcggtgtgcctgagagttacctggggcttttgttatcatatgattttgattttgtaagtctagggtggggcctgagattcttcaaatctaaggagtttccagttgatgctcattctgctgttgctggtccatgtgtcacatttg

SEQ ID NO: 29590 - DNA, 1044 bp, Homo sapiens
agattgcttgaacccaggaattcaagactagtctgggcaacatagtgagacccgccccttctctaaattttttttttttttttttaattagctgggcgtggtggcatgtgcatgtagttccagccacttgggaggctgaggtgggagaatagtttgagcccgggaggtcaaggctgcagtgagccatgatcgcaccactgcactccagcctgggcgacagagtgagatcctgtctcaaaacaaacagacaaaaagtaaaataagaaaattagctgagagtaggtagtgaagagtgaatgagggaggtttgaggagaagcaagaaatagtcattttggggagtaggaaagctttcaagggcagctttggtggattgcttggcatcgttgagtgtccatttgaggtttgtgatcatgaatatatagtgaagtcagtcagcttggttatgtgatttttcttcagcaacattcagctgattgggcataggcactagaaaaggcagacaattggatttaaccaggattggagttgtgtcaggtggcagtgatggagaggacaaatgattgagggtatttgcaagggagagattgtaattatggaacacggcatcaaaattggacaaagagggtgcagaaccggagtgggtagataatggaaaagtggttgggatgggaggacttcatgacgtcaaaaattgtagggaggggataccagagaaagctagttagaagtaagggaagttctttgagagtataattgaaacgtaataaggaaagatgggtcttttaagatgatgcagcttttcttctcttttttttttgagacagagtctcactctgtcgcccaggctggagtgcagtggtgcattctcagctgactgcaacctctgcctctagggttcaagcgattctcctgcctcagcctcctgagtagctgagactacagatgcaccaccacacctggctaatttttgtattttcagcagagatggggtttcaccatgttggccaggctggtcttgaactcctgaactcaagtgatccgc

SEQ ID NO: 29591 - DNA, 1052 bp, Homo sapiens
gagtttggcatgtactaattttaaggaacattttgatgctgcagccattgcttatatatgggatagaatggtaaagcccaaatggatttgtatggattaaaatagattaccttctcagaaaataatgttatttcagtttttttccgctagttcagaagaccctcaacctcctttgcatgcattcagacacataagttggcattacaaatgaatcatctagggaagtgggagtacttctaattctccaggaatctcacacagtaaagctgcttggatatggctattcagaacagaaaggtatagaaatggacaatggtatcccttccattggtattccttctgggcaacaaaaacccttaagctgtctgagtctgtttctcacacttctgttatcctgattgtagccctttaaattgtggagcaaattcttggcatctgtctgcctgtcagctacctatctctgacacccctggatagcttgttttcttcctatgagtatatgtgaaatttgtaaaaaagcatctattaatttaagtatcctgttagaagcctgcgaaaattcaaattgggcaaacaataaaattgcttaaaccgtgtttctcaaagttaatttgaccatagagtacttttcaaaatataatgaattgaataacacagcatcagtatgactcacgtacaatgtgtgtgtggattaaagtcaccagaagtagtgttaaaaagatgaattaatggcttcaggaagtgacttcattggctttttttcaaactttaaacattttggagaagttaaatcattttaagtataaaagttaaagagattcagttatattttgtttaaagagcaaaaaatcatgactttgttgaaattaagtaaatatttatgattgtcaatcatcaaaatagattacatttgtattgtctatgcctttgggtacaggttaaaaattatcttctttttctgcctaaaaaagaaagtaaggcccggcacagtggctcacgcctataatcccagcactttgggaggccgaggtgggtggatcacctaaggtcag

SEQ ID NO: 29592 - DNA, 1029 bp, Homo sapiens
tttgggattaaagaatagagacaaagaggaggcatacggagcctctgccacttaacttcctggagctgatttgcttgtgctcagtattgaggaatctttcctctttgagtgagtgtagagtggttttgggtcatttgtagtctacacagtttctgagagatgatctgtccagcaattccagattgtttagggtgggcctgggagagggtatggcttactcctcgtttctggtgccgtattaaggtgaactagagctgattcatgtactggttgagactgtaaaaggacttccaggtttagtcattctgcaggaggctttctctttggtttaactgtagctcttcatccctcaccctggtttacataattgggactttaaaatttcattgtggctgtaagaacaaagggaatgcacttttcagcagctccttactgaccagtcgtgtggagtccctgtagtgtactcagggagagcggctgcctctctgattctctgcataaaacaaaagtattttgtacatagctttgaaatgggagagagaaacttctgaagaaaaaaagagttgtttggggtaataagattttgaggaggcagacacttcctgcattctcccctggggaaagaatctagctacaattgaagggcattgcctcaactaatttagttaagtggccccgtcctggattaataacttgggcagacttcccaatggatttggcagggtattgggtttctctctccccaaaccctcccttctctctgccctgcacatgtgtgctaacataattacagaaagttacaaggggatggggctgctcttaaaggaggtggctcagaggagagaatgtgattgtgtagtcctgtcatatttccgaaatggcagagttcgagtaaaatggtagggtggaagcaagcaggctggtttctctctgtaatggcaaagggggaggagggttggtggcagtgtcgatttcaagcacctagagcacacgagcactgggtactaattttgtgctagagaaatatta

SEQ ID NO: 29593 - DNA, 1051 bp, Homo sapiens
ttcaagcaattcttctgcctcagccttctgactagctggaaaattagccaccatgcccggctaatttttgtatttttagtagagatggggtttcactatgttggtcaggctggcctcgaactcctgacctcgtgatctgcccgcgatggcctcccaaagtgctgggattacaggcatgagccaccatgcccggccttatcagtattcttaataccaacagagtttcacattgtatttgacactatttacaaactcagtttattccctctgtgtgaatactagccatttctaaaatgaaatgcaattgtgatttaaatttcacatatcattatgctaaatgctgttcactttttgttccatggtcctgaaacaattaacctgtttggagataagctgcagatacaagcacacagagaaggggacttaggaaagctggaggaaggaaaggtctgtcttgcctacatatgggcttaggaaaattttctaactggaaaccttgcctcaagtctgagtcacactagtgggactcttggccctagggtgggaggagaaaagggagggaaggaagtggctatgtcagtttttgtcaacagagggcacccagagcaaagcaagtgttctgtgacacaacagaatctgcccctctgccccagatgaatttaccagacaggcacagaacttcttgcagtggattctcttgtccatctcttcatttgtctgatctgtgtctgcattctcatgttttctcccatgctggaaccagaatattctaaatgcagtgttaataattgttatttgctgactgctttaagtggaagaccaattccctcaatgtgctggggtgaattatcccatgttgtaaggttggccttttgggtggatgtgcagtattagcttctaatttaattcagtatccagtgagcatgtattcctgaaatacttttgatgtgaaagagcacttcatacctgtataacatgttgtaagaagactttgtaagtcttattgcctagagcagtatcctcaaagtgtggcttcaaatccagccgcatc

SEQ ID NO: 29594 - DNA, 1049 bp, Homo sapiens
tacaatgtagtggtttagattcctagttgactgtttgtgatttgtgcatgtgcttaggcgtgttcccaggccttgattaaggctagaatgttttatggatttgcagtatttttaaagtgggagaatacttatgtgcatcagctctagggtttttatataagaagagcttaagagcagcaatctgattagaagagggccttgttctgcacagcagccttactgtttttgcgaagattatttatatgggatggctcttaggggtttcctagaaagtgatgggggtcctaaggctcctaaggctggcccctcgctcgcttttggtgcaacaactttatgtctgttataaataaggtgaccatataaactttagcattcaagttggggcacttttgagaataaaaagtgatgccaataattagtttcaaacagtcccaggtaaactgggatgtatggccatccttctctaattgaagaaatacagtcagtgttttcttaaccaaagtgatcagaactagtaggccgtgggttaatctaaacaattggttgaagtggggaaatattttaaacttttattttaatatagagcatttttaatttaaacaaatatatgcttactctttagtttcctgatatgaggtcaagatccttatatatagatgtgattgaaatactacttgaattttttgcataaactgtgctcccagagcatcatctgtgagttctaatttgtttttttttttaaagaggaacacggtcttgatgacattcagagcaatttgggtgaaactgtctatctagatttgtatggttttcccttcttgcccggtcttttacagttatcctgcccacatctaatttgagcctaagttttcagtgtcttgacttatttttcacaaagcattcacattagttattttcaaggaaattttctaatttatttcattgatgtgtgtatatatatatatatatatatatatataacatttaattatataattataagaacttacgacttctataaactggcaggtgaataaacacaagtgatt

SEQ ID NO: 29595 - DNA, 1018 bp, Homo sapiens
ggtacaatctcagctcactgcagcttccacctcctggactcaagccatcctcccatttcagcctgtcaggtagctgggaccacaggtgtgcaccaccacacctggctaatttttattatttcttatagacccagggtctccttatgttggcccaggctggtctcgacctcttcccaccctggcttcccaaagtgctgagattacaggagtgagtcactgtgcctggccagaattttatttattatttatgtacttcaaaatataattttgtcatgattgaattttattttatttttttaaaatgcaagaacaaagtggatttgtaaagaaaattgaaagaactgagggtgttagccaaacaggaattgatgacagcagagtggactatctggctgtatgaagcatacgttgtcatacctgggctgtgtgatacggccttttgttccgaggctgcacatctgtacagcatgtgactatactgaatactttaggcagttgtaacacaatgtatctaaacatggaaacatgtatctaatgtatctaatttatctaaacatgtacagcaaaaatacagtataaaagataaaaatgatacacaggtatagggcacttgtgaatgcagcctggagaattggaagttgctgtggatgagtcagtgagtgagtgtgagtggatgtgaaggcttcgggcattactgtacactactgttgactttatcaacactgtacacttaggctacgctaaatttttacaaaattatttttctttaacaacaaatttgccttagcttactgtaacttttttactttataaactttaaaatttttttaactttttgattcttttgtaataacacttagcttaaaatataaacacattgtatagctgtacaaaaatattttatttgtattcttattctataaggtttttttaagatttttaatttttttttttttttttttttttttttttactttttaaacttttttttgttgaaagctaagacacaaacacacac

SEQ ID NO: 29596 - DNA, 1035 bp, Homo sapiens
ttttctccctttcctactacaaggctctgacctgcttggagcccttattacttggtcacaattgatactttgtccttcagagtcacataggacatagccactgcgttgattcagtgctcagctatcaaatatggctctgagaaggaattacttctctagaatgcaaagtgggcatctgagccagagaatgaagccctggtccatatttagtcattatttagggagagtgaggagtaacaatttcaaaattagagtttggattaagcaaagaaaatactagtcacaaattggctggtgtatgaggtgagtagagctggatttttaccagaagtagaaacctttgtaggaactgcctgtggttcaagaagttatgtatattttatggtatatctatgattatgaaaggataattttctaaaagtttatgttcttcctctggggattgttaacatctgttaatatccacaggaattttactaataataatgccaacttactcttgattcagtccctttgacacagggacccaaactaatttacattaattttgtcagtaattcttataatatccctgtgtgggagctgctttttagatgaggtatgtgagaatttgttaagtttacatagtgggtcagtcccttggatggaaagttggacccaggatttgtgcttccaggcttagtgtgtttgatcactgaagtgtgcagtctttttacctaattctcctccccatttattcttcctatgatggaggaaatcatatcaaggaaatagcaggagaattccatcttctaagaggttaaagacttttctgccttgaggcgtggagttcccaatccttggcttaggatggaaggaaacagcggaacactgtgatgttcagctgaaatgacccaactgtttttttgcatagttttttgttctctttttaaaaattctcctgttgggaggaggtgaatgtgagaattttctctctgccaatcttatatgtgaggcaggtggcttggttgtttttaatgctcagcagatatcact

SEQ ID NO: 29597 - DNA, 1044 bp, Homo sapiens
gccattattcttatcatggagactatgaggagaacaaatctccataatattaatttttttccccccttttactctgtggaaatctaactcaaagtaaggcattttaggaaaacctaatttgggttaggtagaaaatctaaaagatgttgccttgccttctcttagctggtcatatctctcaattctgaacctggccttagtaaaattcttcaaagttcaagtttgttatgttgtcttatgaccatccctttgtaaatctttgttctccctccatggaatgctcttaccttcctcatttacttaaatgaactcctgctcattctccatggcatcttctaaaagtagcctttccttctgtgtgctgtcaccatacctatatacaccttggctatattgaataccacgcatagctctatttatttgttctttggggccagccttttgagattatcgactggtgtgtggtaagtattcagtaagtattggaagaaagaatggatgattgaaaatattatttgaaagacaataactattttctaaagaataaaatctgattataatatttgacatcagtagatacattttttttccagaaaaggtgattgtttgccttaatttccgagtaaaaaaggatatatgtttacaacagggtgtatgttgtggctgtaggagagaatgatgctaactggttcacatgggtagcagacacgtgaccttggcctctttagcatggtcctctaatcagctgatttaattttagtggaatccctgaagaaatgctctggttctatatgtggaatgtagaaatcataaatctaatgtatagatcctgactgcattagggtttgtggattaaaaccaacaaatagactgtgtaggtattatgacattataactgggccagtgtaggcattatgacagtgataatttttttcatctcaaatattatgaaattaattccagaatgttatctgaagttttgtcatttcatttcagcatgtaatttctcaagccaattttaatttaaaaagatctgagtagaat

SEQ ID NO: 29598 - DNA, 1021 bp, Homo sapiens
ttgcagttctggttttctctttaaccacaacattgaaactcttttctccaaaatcaccattaacccccttgcgactacatccaatgaatattcctttgtgtcatctttgtccttggaatgccgctcttcccctggcttctcttgtaccatgctttttagaatttctccctctgtctgccagtgcatttttgttatcccttcctcagcccaccacttaaaaattggtgcttgaaatgattctattctaggtctttttctttttaattcttttaagttatatatatttctccttgggcaagctcatctattgctaaggctttatttatcatctatatgctgacaacttccaaattgctgtctgtagcctagatctctttcctgcacttaggatgtctgtatccacctgctcagtgtgcatctgtgcttggataccccatagttaactgcaaacacaacatctaaaactgattcctccttatctgctctttttaagaagagatggagttttgccatgttggcaaggctggtcttgaactcataacgtcaggtgatctgcccgcctcggtctcccaagatgctgggattacaggcatgagccactatgcccagcccttatctggaatttctgcaaaattctgtccttgtgtaactcagcaaccagtgccaccatttacccagctgctgaagctactgttatagcctcttaaatggtccttctgtctttaatttcgtccctcccatcccacatcattgcgttgcagtaatttttttcagagtgatccttctgaaacaactctgatcatctcactgtcctttagtcccactaaaagactttggtgatctggctcctacctcatctcccaccccttgacccgctcatgcatataccatgcagcttcacttcattccctctataacatgtctccttctaccctttatggcactaacccttacctttgagatctcggtttattggtcttaataaacctttgggaatcttttactgaatttctaagatagg

SEQ ID NO: 29599 - DNA, 1090 bp, Homo sapiens
tgttttgtccattagaggctttcaaaaatttttatcaacatttaagtgcttaatttctacagtataccagggctggcagtaggtaggcaggtgatattttattcacataccctatatatttgcacattttgattgctcgttctgttaattaaggagagaatttctcttttgtagctgaaatgttttatgctttgaatccactcaaagacaaattattctggaaagcttgaactaaacctggtcagatgcttctgagttatgagagagggattgaaataaactttttcagctaaaaataattttgctcacaagttaccaaaaatggctgactagaaatgcttttaagatacttgtctaagctaccataagctaaaggtcaagaaaaaagtttagaacacgttatgagaaacgattggctctactttgctaaagcttttgccaaacctcttattctgtaatgaccacatgagacaaaagctggtgaaagtggtatgccttagattcagtggggacctagagattttttcagtggaacacatgtgctgcctatctcttctgacgacgaactagtacctgtggaaggcactagggttaggtgaaaatgggacacttcattctgaagctgttatacaattgcctatgccaattaattatttaaagcttttatcttctgttgcagagcaatttttgccctcagaatatttgtcagtcctcacaaagtgccaagtgatgggtatttagcatgtggcattgccgtcagtgttctgtcattttgtttagacacttctttgcatctcactgaattgcagaattaagaatcgttcacatttatgggcagcacgtttttgcagtatggtcatttatcattggagtttatattttatgcttccttctagactcttagtgtgctttcacgattatccagaggattcctttgcagcagcagtgtatgccactgattggtggtggtagccttgagaaactagggaggcatgttgactttccttaaggttgcttagtattgtagaataaaatcttgaattagagtaaaattcagagagagctgtttttccccgtaaacatcattctt

SEQ ID NO: 29600 - DNA, 1046 bp, Homo sapiens
aatctttcctttttttttcttttttctttgagacagtgtctcattctgtggcccaggctggagtgcagtggtgcaatctcactgcaacctccccctcccaggttcaagtgattcttatgcctcagcctcccgagtagctgggattgcagttgtgtgccaccacgcccagttaattttttctgtttttagtagaggtggggtttcactgtgttggccaggctggtcttaaactcctggcctcaagtgatccacctacttcgggctcccaaagtgctgggattacaagcatgagccactgctcttggcccctattttttgttaaacctctaggagaaaccattttagatcagaatcaatccattcatccatcctttcttcctaatctctcttcctttttctctaaaagggaaaaagtgctaacattttaaacactttggttatttatatttaatgtaatcctctcttattgtgtaacagccctcccccttcttttgcttggagacaaaatttgattgaacaaaatttgaatgtttaccacatgttaaacattgctagatgctggggttagttacagagttaatggaatgttcttataaaacttgagttttggggaaggtttatggaacaactataaaattagaataaaaatttgataacacaatggtttgataagggtgtgagtaaagaaataggaactcatattgctgtggtggtgaaaagtcacataacttccatgaagaagtatttatcaatgtctattaaaatgtaaaatgcacgtattctttgactcaacagttccacttccaggaatttatcctacagatgctcttgcatctgcgtataagaatatacattatagcattatttgaagtagcagaaggttgaagaaacaaaaatgctcgttgacaggaaatctgctaaataaaataaggtacattcttgatgagaaaaaaaaaggtacattcatacagtggaatatcatgtagccattaattaggcagctctgtatgaacatagaacactctttaaatatatcaattgtgaaa

SEQ ID NO: 29601 - DNA, 1024 bp, Homo sapiens
gagaattctgagaagggaatgagagagagcagcctgtaatatatcacttccttctgacatgtcctgcacttacgtggcatctagaaatttctgccaaaaattcaaggcacaggacacatgataaataccacttatgaagtagatgacattcttgaattgtcaaatgatggtgatggaataactgcttaaaaacctgttttcccaagggtggaaaacagcctttgaggtttagacttccacatgggtgtgttcagccataagacgtgggttttcttagggacttaggtccccaggtaacaccttggtgtgtgggatttttcccatgtataggctggttccttggtttctccgttgttgaagaagagagattttgcactgggtattggatattttattccaggcatgtggtttttgaggaggcatattgttgatgtattttttttttctggctgcattgatttttgtcagattctaactggaaataccacaagcaaagcatgatttatcatgagggatgggtggtgtggccgtgggactctcctagctctggggattggggtggaggcagaagctatgtgagtaaaactagaggaactacagacagggcctggggagactgggggtgtctgaatgtggcctgcagcagttgcttgagttggaatacttttgggcagaggctcatagaaatttctttcaattgcttttttttttcttttaagaagctttttcccatacaaattggaattgtttgaaggagtgggccttaattgttgccagccagagtgattttcaaagcagatctatatggatttcacttaggggttactttcagggggtatgtggcttgttctgagacaggaggacgttggttccattttcctggaagttgttgggactcctggatggccctgctctatttgtcttgggccattaggcaagtggaaaagcagctacatagttagccctgttgcatggagtttagtttcataattcatcctctcagggatttttatacagtcacact

SEQ ID NO: 29602 - DNA, 1028 bp, Homo sapiens
tcaatagttttcatctttgttttttttggaggagattcaagtcccagcttgttttaaccaccttattttatagatggggaatcagaagtccagagaagatggtgacttgggtaaggccacccagttagctaatagtaaaactagaactagaagcctggtcttctaattcctattcctgtgctgtctccattacaccactcttggaaatctctgcagtgctaaaagacttcctgtgctctgctccctgcttttcaagcctctgcctgacttcctgtgttagggacagagctgtacttaagcctagcatgtttgttgtatgcttcttggtctcctttgcagagtttaccctgttacttctgttgatttaggtaaagtgaccctcttggtgtttatttttgaattcttttgttttgtttgcctgcttttattttccattagaactctgtcaggcagagggattgtgagaagtaaaagctcagggccatggcaaaaaagacaggaatgtgggagacttcaggtgaggtgagctaatattggatgataaggagggaagactggatgtaggtgctggtgagcaggttctacttggtgtgtgtgtgtgtgtgtgtgtgtgtgtgtgtatgtattcatttatcatttctgtcaatcctagttaatagtgagacccccgtccctttccctcatttactcctggggcctattatctgttggttgccttcaaactggctaaagatagtgatatttggaaatggagcagtgtgtagggacttcgcaggggtgtgcagaggaaagagtggttaggtccttgggggtacaaattggcagctgagagttatccctccgagaatccttttttcacttcttgtattttattttctttctatacattctcttttttttttttttgcccaggctggagtgcaatggcacgatctcggctcactgcaacctccacctccacctccacctctgggttcaagggattctcctgcctcagcttcctgagtagatgggattacaggcgtctg

SEQ ID NO: 29603 - DNA, 1071 bp, Homo sapiens
caggagcagaatgtgaagaactttcctctatataaagatcagcatttattcaggccgggtgtcgtggctcatgtttgtaatccagcactttagagggcagggtgggaggatcccctaaggccaggattttgccagcagcctgggctgcatactaggagtgagaccttgtctcaaggaataatgttttgttttgttttgttttcctgaagaaaagactactgagagccagtaagactgaaagaatggacatcttcatatcctgttagtttgagtgtgaatttgtacagttttcatacagagtggctctaggtataaaaacttttgagatgttaatagcttttgacctagtcattctactcttaaaagtatcttaaggaaataatctcaaatgtgagcagttttacgtgagggaggatattctttgtagcataatttatatgaagaattagaaacaccctaaggtccatcagctaggggaggacagcagaggggacggggaagcatcaggagggctcggcagccacagcaggggctgggccggcatctagcaggatccaggtctttgtgggacaaagaatcttagagaagcaacggggacacaggctgtccactgcagcaccagtgagttcaccaagacgaagagttgagcacagagtgtgagacagggatttgcaatgaggagtcatttaccatgagcgtgtatacatgactcaatattgtatatttaagggagtagagcacagtaattgaagacatgggattgaagcagaagtcctggctctagcactattgtgaaaacacccataagttccctaacttttgtggattcctctgtgttcaaatgggaaagtggtacccatctcctgtcctgtgtgtgatcatcgaatgagatacatgtcagaggccatgcacatcacagacacacaatacacactggctatcatcaactagttatcatacatgttcccaggcccaggtcattgtcagaatgttccctcccatctctattcctgtgtatagactctgtagtttctgtaatgatcagatggctgcccctcctctgattatctt

SEQ ID NO: 29604 - DNA, 1048 bp, Homo sapiens
gcggagggcatccaggtcagtcgtagggggtgcagctgggaacacaacagtgtccccattgaatgttcagagtctaaaggggagacagaggcccaaagagccacatacaggtagagctccctctggaaagcagagtgctcagggagcctggggagggttgggggccgccgcatggaccaggcagctttgggtgggtctctgaggacaggtgacttgcacatggtggggacagtgggggggacattccagggcgagggagcagctgagtgaaggcctgaggctggggatgggagtgggaggagtagatgggctccaggaggcaccgaagcagggcgtcagtgggtgcctggacctaaggtgactgtggtggcagggagcggtgaggaaggtggggtccagagcatcagagggcctgtgtgccctgctatggggtttgaacttgaccgtggcttttcactgaagattcctcagaagggtgcagtgccacggctgaggcctgtaattcagtgctgtgggaggcagaggcgggagaatcacatgatgctaggagctcaagacagcttgggcaacacaggagatgctgtctctctgaaatgaaaaattaacaaattagtcctgcatggtgccgtgtgcctgtagtcccagctacctggaaggctgaggcagaaggatcacttgagcccaggggctctaggctacagcaagctgtgatagccccaaagcactccagactgggtgacagagcaagacagtttctcaaaaataaaatgaaaatgacgatttctcaggaaatcatttcgactcctctttccctgcccaaggaggatgccccacaaccacttggagggagatgctttgctgagagtccctgtcctctgcatctggagagcttggctcagagctgaggtgggagggagggctcctcttccaggtcgctcagttggacaccggaattgaccagcctgcaggctcacccatggagtacacactgtgtcctagtcaagcctgaggggcagtatccagcctcaacccccagcagaggctccag

SEQ ID NO: 29605 - DNA, 1035 bp, Homo sapiens
gcccgtcgtaagaagccgggtacacataggtgtctagcaaaggcctccctacgtgatccctagatgccagtgagccccggggaatgggtggtcctggttagggcttgttggccggaccctctgaaggagggtgttccctctgagccaccttgtctgtcatgcagggagcgccaggcagcctgcaaacaggtgcgtcggaccgagaagaagctgaaggatgtgctgctgcaggtggatgacgagcggaggaacgccgagcagtacaaggaccaggtgtgggcgctggtggggcagtgagaagggcagcggggctgggcagcagatggggtgacaggcagggcagtggggctgactggctgcacgcccagagcccctaaccggggccacgggccacacgtccatctccgcaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggtgagccgccctgcccacccgcccctttgcctcggcacttctctcaaaaggtagcttgttcctcaaccagagcccacaagcaaggcacgaatgtcaccaagaaaggactgcacaaagcaatccctgccccttctggctccttgcctttgaggctttagcttagtgttttgaacacacagtaaactctaggtagtttattcccagctgtcctaaaagtctattgtcttttgaattggaagttgcttgaggccacctggcccagtcctggcacatgttaggtgcctcagttaaatatctgcaaaacgaatgtgagcctcatgagcaatgcctacagaggttaaaaacgctcctttgcgtttctcagggagtgttaacactcaagaagtagtgaatgtttgaagcagaggatcttattctctgagattctcatttcttacgtgtttttttgtggg

SEQ ID NO: 29606 - DNA, 1031 bp, Homo sapiens
gccaccgaagatgccaagctgcggttggaggtcaacctgcaggccatgaaggcccagttcgagcgggacctgcagggccgggacgagcagagcgaggagaagaagaagcagctggtcagacaggtgtgcatggcctcctgctaccccatgggtgcccaaggctgccttggcttcacgcaggcttctgttctctccttccacctggattgtgttagggccccttgaccacgcctcccctcccatattccttctttctagcctcctgtctcggggttcagtgactcactttcttagagttcttatggtcagtaatccccactggtttcccgaggccccatggatcctgcagaactggcctgaggctcctgagttcagagctagggcagggtctcccagtgggtccagcttcccaagttgttgatgttccttcccccaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggtaagggtgggcggggcccaggtgagggtgggcggcacccgactgagccaactacatatgaaggtgccagggctcggcccagggcgggaacctggcagggtggcacctcctgggaaggtcctgggtgcttccagccccatctcactgacagagactcagaggctcagaggtgagtggaaacatgatagtccaacagcaaacttgcaaaacggtgtatgactgggtacataaaacacagaagcaaacaagtacaagcctagacatgggtggagttcaagaaggtctcacttaatgcagacttccagaatcacccgggtcctgacacccttcagccttctgggctctggggcgatggttccaagaagcagcccggagtgtgggacacatacttggaaatcttcacctcactaataattaaagaataattaacacg

SEQ ID NO: 29607 - DNA, 1029 bp, Homo sapiens
acctggagaagcagatcgccaccctccatgcccaggtttggaggcctgggggaccggccggactctgcaggctggggagctgctggccgggcactggcctgggcactgcaggacagccctgcccgctgggccggcccattgctgctctccccctgggaagccaaccgtgctctcccacatcagtgctctcaaggaaaggaatccagggatctgtggacttagatgggggacaccactattttcactattttacacctttattttcaccagtctttagctgaaattcagcattgcttccattatggatgtaggcagcaagccatggtggtggcagtccctgtgccgtcatcatctgtagaaatggccagttaccctgtcagggttgtggccgagctccttggcctcatgggtcccaggcctgcgctgtttgttatctgatgtgctatctagcagcacgtggcttcctgagccatggttttttagaatgtgtgacaactgcatttttctgtactggttgccctgctgatcccatgtttatttcatgcctgttacaacattgtcatgagaaggagtcccttggcctctctagactgcgaaggggtccgtagcctaatatggtttcagagcccctgctctagatcctatcttgggcctccatgtgccaggccagaaggcctgaaccacctcgggatgggctgggagtccattccacagtcagggtaggagtagcccgcgagcgtgcctgattgtgggtttatctccaagtgcaaggatggggctgggtgatggggaccccgtggacaccctacagggcactggccctgctctctgggagcagtctccgtagagcaagaggcttggtgtggatgtgggctgggagcccccacagcgggcctgggggtcagcctcccccgggcttcacacagtagacagatgcccctttgcagaagctccatttgtctcgcccctgtggagagggaagtgactgggggaggcggtttcataactgggcagatccctggtgcccct

SEQ ID NO: 29608 - DNA, 1045 bp, Homo sapiens
aggtgagccagggcccggagcccgcttctcctgggccctgctgtgcgtgcagtgagtcccagaggtgggctgctgctccctggcaggatcctgtcgtgagggagcgacgtcctccatccatgtagaactgagtctggccagctcttccccacctccttctcttttccaccctttgcaggaaaggagacttccccattttaataccgaaatgcaggtcatcatcatcctgttgacttttgctcctagtaactgccggccctggtgctatttgctacagttagaggagctatgaaaagaaatgtaaaagaatcagccagagacctaggatattacaggaactttgtggaaatgaaacacggccgtgcgttgctgtgtgcgaagacggcgacaccttcctgtttctctaatgactgtgctgagtgtcagttgctgtcgggacgcagccctttatttcttgggccatctctgtttattagcagctccctgcagcgtcccagggaagctgtgtgaacatggctgtccctgggtgacagatgaggatctcaggcaattagcacttagtccaacctgaagcacgcccttgagtgattgaaacggtcctacacgagtttccattcactttccggaaaacaccaaggcttccttgtctcattcagccgaagaaaagagtggggtgggatttgcctgtgtcttctttccttaggagagtttgtgtaaagaattctgtgtctgttgcattgtagaaatgatgttaatctctcgcctatattccaggcatgtggaatcgaggcaatgggtaaaatgaccaggcttctctttccttcctcagatatgagatcctgactccaaactccattcccaagggtttcatggacgggaagcaggcgtgcgtgctcatggtgagttgagctgctgtccctgcctctctggatgggcagccccttgtctggggagtgcccacgtggccagggcccaccttgctatatcagtggtcggtggatgcccaggctgtgtcccttctgatgctccgcgtctgactctgccg

SEQ ID NO: 29609 - DNA, 1047 bp, Homo sapiens
atttccaaaaagatgaaactgacacatactcagagaaaatgtgaacattctaaaaagacaaagaaaaaacaaaaattacttgtcttatgactaaaaagaaatagtaacattttgttgtccttccaggattgtttttctttgttcatattacctaaaaattttaaaaaagctgaaacccagcacggtactgtgtggccaccatgccatgtctagagccaggctcccgttgttggccatgccttgctttgaggctttggctctgcacgagacgccgcagagaacgtcttgatgcctcgctccccttatcctcaccacttccttcttaggggtggaaatgctggatcaaagggtcttcacgttttctgacttttccatgcatggggttagcctgtgctccggagaccctgtgagcacacatgtccccagcgcagcttgtgactcctgcctctctgaccccgccaggtggattacaaagctgacgagtggctgatgaagaacatggatcccctgaatgacaacatcgccacactgctccaccagtcctctgacaagtttgtctcggagctgtggaaggatggtacgccctttgcccttcgccccctgcctcctcttggctgcggctggtcatcttcccacctccacagtgggccgagctgccaaacaaggggtacacatgtgccccctgacataggccaggtggtctctgccctctgtagctcccatgagagagggctcctcggaccgaaacaggaggccactgccttgcgcacacaccgtggccgggtcctcctgggcggagcgctttccgtgtgtgggaaagtcaagggcagccccgagcctcgaagcccagggtcccagccccgcgccatgttgcattcccgcctctactccttggtaggctggttgctttgagtggttctttttaattctttctgttggtttctccttttcctttgcctgggttttgctttaacctctctgttgcagagatgcagagcactcagagagcctatttctatcatcgctttcctattctccacctagaac

SEQ ID NO: 29610 - DNA, 1142 bp, Homo sapiens
cttgtcttgtaaactcagtgtgcagaaggctgctgggtccctgggactatcttcctcaaggggctcctcctacatatcccatctcatcatagacatgcagacgcaaagcatgtgggttggcatctcccgtggcaggatcacagggtacttgttgagggcagcctcctgggcagaccccagtgcactgtgaagtcagactctggccccgcgggtcagcggatgtgcacttttcatcagacccactgagggtttcactaatgctggagaaccaccgcgatggatccttgggtaaaggtgtcagccgcagcctgggccccagaggtttctttagaagctagaaatcttcaacagtgctttgcttctcctggggagtgtgtcgcccaccgtctgtgggattcaggggattctgatgtccgggctttggcttcttgaagggtggggtgcccctcccagggtgcactcacctgtgctgatgctgcgcttcctccaggcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtgaggagcgctcacggggaggtgctggccagatcttcacaggagaggtggagtcgaggctctctaggaccaggagccgggcagctgctggggacgcaggggtgtgacctgagtacggttcttgcacaatgactcacccagtaatgtggccggtgacagcatcatcatttacacagcttacagagccccttcacctgctccatgctgttagaagcctgcggcactccaccgcggtgcccaggctggttgtcatcatgcattatcgttgggcctgtctgccaggtgcagagctttggctaaaggcatgtgctcagagtttgaatagagctctgccactcataagctgtttgacttcgggtcagttacttaacctctctgatccttggtttcctcatctggaaaatgagaatgaccacccaccatacaggattatgtggattaaacaagctcttgaggcccaacatgtggcatgaatcag

SEQ ID NO: 29611 - DNA, 1022 bp, Homo sapiens
atattagccatgtaccatagtgtgtgcctggggtcccagctactagggaggctaagctgggaggatcacttgagcccaggaagcggaggctgcagtgagctgagattgcgccattgtactccagcctgggtgacagaatgagactctgtctcaaaaaataaaaaataaaaaaaaaaaacaatgtattactcgatcacaatattttgatgattatatttcaaaataactactttctttgtaatctattggatgcaatttaaagcactattctgaaaaggctttaccagactgcccgcggtcactggctccaaagagtaaatgttgcccactgctgggtggataaagggaaggccaggagcatccgggctctaaaggcagcggcatggaggtgcccaaggaggcccttcctgtatccctgccccaccctccttctcaaggggtgtctgggcctctttagtgcagggttggcgtctctctgacattgttttctctccttgcagctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagtgagtaccaggcttgctttgacctcacacctgcctctggcttttcccttccggggcacccgctcctcacctcagctctgtgttggttgtggaggtgtcttaactccccttccttttggtgccacccggaggatgaagccccaaggctgagatccagtgcctgggaggcctgggtgggtgcctccattagaggagatgctctgggctgcagctgtgggctgggcttttcccagctgccggaccaggtgcatatgtggcgggggccctagcatcctgttttcagtcccagaagaccacccagcatcctcctgaaggctgggctcgataagcatttctttgtcttaaaga

SEQ ID NO: 29612 - DNA, 1083 bp, Homo sapiens
gtttagggtggtatggccgtagactgctgccttattttgatgagattgggcgcgtttagggtggtatggccgtagactgctgccttattttgatgagatcgggtgcatttagggtggtacggccgtagaccactgccttattttgaagcatcactttttctgtaaatcctttagtgtgtcctcattttatttcaaaagatctaagtttattgtccccatattgttagatattaggttgtttctacttttcatcattttaaataacaccacagtgaacatatttgtgtacgaagatttttttttttcccccacatacttagggctgttcctctagggggaggactctaaaagtgaaattactggggcatagggtatgagggttttcagatcctttgtatctgacaccacgctccccgggtgtgccccgcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatgtgagccttgcccttcattacccaccctgctgcctccttggcctgttggttgccttatccttggttaagaaccctgcttctcatggtcctgcatcgatctgagttggccatctcctttgcatgaagactttggttgggtgtggggttgtttttttttttttcttttttaaaagatagggtctcggctgggcacggtagctcatgcctgtaatcccagcactttgggaggccaaggccggcagattgcttgaggtcaggagtttgagaccagcctgaccaacatggagaaaccccgtctctactaaaaatacattagccgggcgtggtggcgcatgcctgtaatcccagctactcaggaggctgaggcaggagaattgcttgaacccgggaggcagaggttgcagtgagccgagatcacgccattgcactccagcctgggcaacaagtgtgaaactctgtctcaaaaaaaaaaaaaaaaaaagtcagggtctcgctttgtc

SEQ ID NO: 29613 - DNA, 1040 bp, Homo sapiens
aggtggggcggggggctgtggtctcccccgtgctctctagctccccatgtcaggggcacctctgatctcttgctatcctttcttacttagggcaaattcattcgcatcaactttgatgtcaatggctacattgttggagccaacattgagacttgtatccttgtggttcgttgggataagagtcctggatccggaggggaggcatgacctctgtagagaagaagctgcctcctgattccagcactttcccctttatgggcccatcctgacaccttctctgtggagctaggggactgtcaggatcggctagtgcaaacccaacacagagcttagggctttccttatttacaggcaggataacctgtgctttgaatggcatggagctgttgaaagccgtctagtgtggctcccagaggtaggcgtttgggggatgccactctcctgcgtgccaccgtttagcctttgcttgtgggaatgttcttgttcccattacctgtaagaatgagacaaggctctcgaaggtgtgagctcctcttggacatgccatgccccttgaaggtgagaacccaggtagtttgcttttgctgtgttttgccattttgtgccattcttccttcctggtgaagttcagttcctttggacgagaataagaggacaatggaaggctggccaggcacagtggctcacgcctgtaatcccaacactttgggaagctaaggtgggtggatcacctgaggtcaggagttcaagaccagcctggccaacatggcaaaactctgtctctactaaaaattagctgggtgtggtggtgggcgcctgtaatcccagctacttgggaggctgaggcaggagaatcgcttgaatccaggaggtggaggctgcagtgagccgagatcatgccactgcactccaacctgggtgacagagcgagactctgtctccaaaaaaaaaaaaatgaggaaagtggagggcttgccttctccccagcttgtgttgctccttaatatttgcaaagatcttttggagaaatctcgtgctat

SEQ ID NO: 29614 - DNA, 1022 bp, Homo sapiens
aactccctagtttccttagccagcgttagttagtccctggtggcatgggcctgttgcacaggtgcgaagacagggcagtggctgacaggttagggaggggactggaattccgccaccccgctctgcggattgatagctggatgaccttgagcacccctcccttggcctcagcttcctcttctgtgaaatggggctgctctgtcctgccccgtgagtatggtggggatccagggataagaaggcacaagggtgcattttgtctaccacaaagcaccctggagttcacagtaggatttattgacattctcagtaaacagcctggagcccaaagtgggcctcatggatcccgtgctcactgcctgtcatggtggttttggacgcggcagtggaggggctggtacagaaagtgaagcatttatcaggacacagatgagatgagcgtgtatattttccagatccgatcccctcatttgcttttcctatgaaaaggaataaaaatgtgaggattagaggcaaggaggtagagggaagctggtgtatacagggtggagacactgtcccagggtgtctgtgccgccggctccctagtttaagtgctgctttcacatgggtcgtccagggccaggttcctagagctgagggagcttcctgcctgccgtttccagggccatggaagtaagttcaaactgaccaaggtttccaaagcctggcgggaaggccgcacttggatgataccggggcctggccttggttggagtcgcacactggagcccacccggaaacctctgttcctggcacgttggacatgctgacacggctctgccatcgtcccccttccaggcagggcaggctcggcagcccaggtcgctgcccggccttcactgcgtccctgggttccttgcagggcgagctggagcggcagctgctgcaggccaaccccatcctggaggccttcgggaacgccaagaccgtgaagaatgacaactcctcccgcttcgtgagtagcgcggcggcgccccggc

SEQ ID NO: 29615 - DNA, 1011 bp, Homo sapiens
aaggagccagtgggaaggagggtggagcttatggcagaaaggaaaagcaagatctctccacaatccagctgggaaccagctcctccgtaacttctgggtggaaggcattccttcttgctctggatggtggcttttctttacctgaattgaagtagacactggggcctctcagcctctgaacttaacaaggagatccataaaccccattgccaagagagttaatggcacagaacattcctttaagtgacgtttcaaaggaacatgtacaagtgcctttgacccctaagtccacagctgcctaaaactgatttttaaaacacttggatgtgaagtcacttgccctgacaagtgaccaggacaggcagtggatttcagtttacttctgtctggcccctggagagccatgggaagtgaactgcctgaggattccagagcgtttatgtggcagtcccgttttctgccacacgttgggtccttcacgggcacccaacagaatgcgaggcagtggagcgtgcagtgggaagggacagaggtcaaggacttggccatgcctaagcccgggacttccttgcctctcttggtagtggtgaatctggagctggcaagacggagaacaccaagaaggtcatccagtatctggcgtacgtggcgtcctcgcacaagagcaagaaggaccaggtgagtgctgcagcccttgtccctgtggccgcctgcttggccttggtgggatgatggaggaagagcacttagtggtcccggcttcagctttacaagaggatgctttggggaatgaagcagaggctgggcccatttccattgaggcagtggcgtggcctgtcctgggagtggtccagcggtagcaagcccattccatccttggcctcctagccttctgagttgctatggaaactggcgaggtcctggagtttgcatggcagccctcttggcttttgcagctcgttgctgtgtgtcctccccttctgaggctggaaggcagattccaagacttgg

SEQ ID NO: 29616 - DNA, 1027 bp, Homo sapiens
ctgctgtaaagttcaggtggaagcagctgtggtctgcaaaaggtctgcctcgcctaggaaatggtgcttctggatcccgggccagaccctctggggtctcccctatggggaaaggtgtgtatgtctctacaggagaactcactggttgaggaatttgacatgagcccagttatctccccagtgagtagaaaaagccccttctatgtgaattaggtagaatgccaggtttggttcactttcagtgactttatggtattaatattttaatgagttcccagcattttgggggaagcagatctgctttcattctaggcctaaacttgtctgagagcaatttaaccctttgctctgtgccagtctcccttcccacccgatccctggttcccaagggaagctgcaccagaggtggttggtcacccagcagccgctcagagtgccagtgagtgtgcacatgcccctcggtgtctgacctttttctgtaaacaatgaggggtagaatttttgtgtatcttcacgtctgagcatggctcttcgaattcatacgtaaagaggcaggcacagataatgttaactggcttgtcgaaaagcccgcagagagccagccccagaaagcagtctcctgatttcctgtcctggtgcctgttaccctggcacaggcccgtggggcattggtgcccctcattttctctggctggtcttgaaggaattcttatctccagctcagtggttggggggcactaggggaggagaggccctctctttccttctctccacattctccctgccccgctagttgtgtctcctgtggaactgtctgctttccaatgtctttctgaggaaaagtgccatgtttggcagaggctcaggaaaaagcttcaaggggcagaaaagctctgtttgaatcgactcaccgggacaggcagctgaggaaggagcgccatggaagccacagatgggatgactctgctgaagcaggaatgcacccagccgggaggccgccagccctgccagccgtcagcacacaaag

SEQ ID NO: 29617 - DNA, 1068 bp, Homo sapiens
gtgtcacccgtggagcctcggggtctgcaggctgttaaaatctgctcctgtcttttggagtgaagtcttagtgcatgctgcccccctggctttgagggaaacagatttgttctctgccacttacatcttaaaaggcacagccggaaagttccttttgtgctttttctttaaacaagaactagacaaagatttccttcctgagctggctgtgccttatgacatactagcatttattctgccaaacggggcagttggtggctctgtctggggacttgtaggagaggagctctttgacccttcctggggacctccatctgcctttatctgttcagtgtactggtttgcctgtacagtcctgatttatgcctgttgttccacagttattattaatagcactctctttcactttcagaagcatcccagtttggaggataaattatatgtcactcacctattgtcagactaagccagggattctcactcttggcactagtgatatttgaggctggatgattctctgttgggggtgggggatcttcctgagcactgtaggatttttagcagcatcgtggcctctattcacttggtgccagctacaccttccctctccagttgtgacaaccaaaaatattctcagacattgccatcaagtttccgtggggggcaagattattcccagttaagaactactggactaagcattgcagattagttttactttgagtgtcatctccgatcgatcagtagtggctgcctggagccctgtgctggcaaggatttgagactcgatgcaggaattctgagatggattagtgctgtctgccgtgggcacgggtggggcatcacagcatgtagtgccttggattaggccgtggaggtaggtgacagaaggtgccagaatgccaggaggttttgacattatcctgttactggatgccctggcggtccaggtggagagacgaggcatgtttatagacagagatttgtggccctagctacaaaacaagacatttggtgcctacacctgcgccagcacgactgagccaatgtcaggtgtcctgggagttt

SEQ ID NO: 29618 - DNA, 1048 bp, Homo sapiens
agtgctagaattacaggtgtgagccaccgcgcccagccagttcttctgtttttaaagtaaaaaaaaaaaaaataaggtgggggtgtgtgtggtgtttattgcacaagcattattgcaacaaagctggcaagaagcagatttgccctgcacctcatccaccgttttgcatttttctgggttttctgtccatatacacatgtattttacaaaattgtaagcagaatggagactgtgtgtgttctgagttactactataatgcaaagttcctatgtttcattggtcgccagaattcatattttaatgaccctcttatgtccactgaggagagggaccatttttcatgttgccagaaagttccacgagttttattgagtcttggaaattcattcagcaaatgtatccagtacatctattctagatctaggccagaaactgcccgctggtcaggatgcagatgaacaagaggtcccaggccctgtcctggagggggctcgcagcgtagacctaggaacatgccacttcactctggtgtggttgtgattgaaggggctgaggaggtgggggctgcttggatgcccaattccagtcaattccagccgatggaaaacaggtaaaaccactttgtcagtagtggtgagaaggcttagaaacaagggagctgggagatctgtccgggcttttggaggaagctcttcaacctgttcaccccgcctccgccgttgtgtcacttccaaggcccctggccagaaaacccactgggaggaagtgagggagagaagaagtctccaagggaccatgacaacagggaggcttgggaaatagcccccggcccttctgagggagaccctaccgagggtggcagtggagcaggggcagctgagggcaggggcagggggaggatagtggggtggagtggtcttccaaagtcggaaggccattggcaggagacttgggctctgctgaggcccctgccttttccaggatggtgtgagaatggtagcaacaagttgcaacagtttagttttgttgtaaagaggaagtttcaga

SEQ ID NO: 29619 - DNA, 1099 bp, Homo sapiens
gcctcccaaagtgctgggattacaggtgtgagccaccacgcctggcaccatgtttgtttttttaaaaagcagatcaccacccactaaattaattttgcaaacccactgacgtccatatcctgcagtttgaaaaacactgcaataaatattggtaggaggtagaagttttacccttagcccaggctgccagtcctggcttccttccctttgcctctcagctgtgccctgagcctgcttgtgactaagccagacccaggccagctcagctctagctggacagaggagccaccatgtagctgagagcccttttgtagcgcgccgagagctcagccttctctgtgtctctcaggctttccctgcaggagtcatcaggcagcaatgatgtggattctgtctctactgcaaccctcagcccagctatgagaaaggcattcttcccattgctcagatgagaagcctgaggccgatcagggtgaagtgactatggcataaggacaaacaggactggtccgcctgtgaaattcagaatgtgaattaggcaggaaaattggctctctagaaaatactgtggaagtgctgaataggattgataggtggctgtggaaaagaaagtgctagagacacagaaaaccgatacaaaaatgggcagggcggccaggcgcggtggctcacgcctgttatcccagcactttgggaagccgaggcgagcgataacttaaggtcaggagttcgagaccagcctggccaacatggtgaaatataaaatttctgtaccaaaaatataaaaaattagccaggtgtggtggtgctcgcctgtaatcccaagtacttggggggctgaggcaggagaatcccttgaaccctggaggtggaggttgcggtgagccaagatcatgccactgcactccagcctagctacagagcaagactccgtctcaaaaaaaaaaaaaaaaaggctgggtgcagtggctcacgcctgtaattccagcactttgggaggcccaggtgggcagatcatgaggtcaatagatcgagaccatcctagccaacatggtgaaactccgtctctactaaaaatataaaaattagctaggcgtgg

SEQ ID NO: 29620 - DNA, 1030 bp, Homo sapiens
aacctcccaagtagctgggattacaagcgcctgccaccacgcccagctaatttttgtatttttagtagagacagggtttcaccacattggccaggctggtctcgaactcctgacctcaggtgatccacctgtcttggcctcctaaagtgttgggattacaggcatgagccaccacgctcggcccagtccagactttttaactacctggccccactgcagacacagttccctctagtccttcccagagttacaagaagagaactccagtagccttattctgtcagggacgaattgtttaccccatgataatgtaggatatcataaattcttcttcaaaggttttagcctgtaatttgttaagtacattgagttctgagatcctctccaaagaaccaatgtatcagtatgttcagctcacctgttctttgttcttcattttaacttttaatttcctcattctttatgtctccttgcccctagtttcagtaaacaatcccctcctagcctctgtcacctgctctgacctgagtcacctttagtcacctggtccgtaaccatctttcctgtctaaacttctcaccccaccactctggcttatacccctgctctctttaaaatagccagtcagaattagcttagattgtgcggtccaaccctagcccataggggaacaacacagcagtagggggtacctgcatcagggataagaacccattcccctcccttgttccggtgtgctctcgccattgcaccatccatgagacgcactcttgtatagaagtaaaattgccttgctgagaaaatgtatgtttgagtgctatttcttttgtggcactgaaaatttatttctaacaaatttggggtctcatttgggattcccatcctcctctgaggagggtctagacctctcccatgaggaggcacgtcccactgccttgttgcggtggccacaggggtaaggaatcgagaccaaccagtgtgacgaataaacctatactctcagcaaggcagaaagaaacgggctggcgac

SEQ ID NO: 29621 - DNA, 1058 bp, Homo sapiens
tttgcttttattttggagccttgttcttccagagtgtcaaggcagccccctgccctggagcctcgtggagggtcatgattcatgacctactcaggttggacgtgagatgcccagaaaggtcagctcccagtttcaagggatggaagataccaggcaaggcctgcagtgaagcccccacacctggcattggcagctcccctttctgcacccctccccacatgtcccagcctggctcattctcctcattttgcttttgtgtagagtcctgcttcctgttcgccctcacgcgccagaagttgccacccttttgccagcaggggtacctgaggatgcagggactcgtgagtaccgagagcctttggcagcacagagtggagagcaggctcctgcgggactatgcccccacaggcaggcgcctggaggacagcagccagcagcttggcgaccaagagccactaggttcccccctggctccagggcctctggctcagtccgtcgatagcaacaaagaggagctctgactgtcccttcctaagctgtgggcacagtggccaggcctccccacctaggcccatggtcagtccctctttccccgcaacctcacactcccgccaatgcgtgattgccaaagaccactcagatcatggcagtgtctgcagcaaagccaccagatggcacgtgagggctgaaagtcggggatgcggtggtctcctccctcctgtcagggggcagaagggcatcctctgccaggtgggagctgccttccccagcccagtttgtctgcaatggagctgtcgctgagccccaggccagcccagttctgccccgtctcaagtgctcctcttccttccaagcccctcctcagatgggcctgcatcccgcctgtggagtgcttcacaggggaaacccatccgcatcttaagagtttgtggcaagcgctttaaaacaaaagctctgatatcctcaacaaccacaatgggcaggtgggattgttgccccagatgactgctgaagacaccagctgtgggatgtcaagtaattccagggacccccagctg

SEQ ID NO: 29622 - DNA, 1021 bp, Homo sapiens
agactactgttcccgacaatgccgtgggttaaattacaactcacctaaaaataatggataatatgtcttcttttttttttttttgagatggagtctcgctctgttgcccaggctggagtgtagtggcgcaatctcagctcactacaacctccgcctcccgggttcaagcgattctcctgcctcagcctcccaagaagctgggactacaggcacatgccaccatgcccaactaatttttttattttttagtagagatggggtttcaccatattggccaggctggtctcgaactgacctcgtgatccgcctgcctcagcctgctgaagtgttgggattacaagtgtgagccaccgcacccagctgataatatgtcttttcaaaaggattagcagggccaggcgccatgggaaggcgccagggccaggtatgggtgggaagacagagctggagcaggatgggaggcctgtttagagacactccaataaagcttggatctcagtagggaagctgggagccaaaaccctccaaaggaggagatagatgacatgcatggttttggccctagatagagtgggagagaaaaatctctgaaaatattcaaccagtaggccctgcttatgtaaatttggggccaaacttcatgagatcattgagctatagaaatcacagaagcaaatgcacaccttctcaagaaatacacttttaggccaggtgcagtggctcacgcctgtaatctcaacactttgggaggccgaggtgggtggatcacctgaggtcaggagttcgagaccagccctggccaacatggtgaaaccccatttctactaaaagtagaaaaattagctgggggcagtggtgggtgcctgtaatcccagctacctactcgggaggctgaggcaggagaatcgcttgaacccggaaggcggatgttgcagtgacccgagatcatgccactgcactccagcctgggcaacagagcgagactccatctcaaaaccaacaacaacaaaaatgccagggt

SEQ ID NO: 29623 - DNA, 1067 bp, Homo sapiens
actgcactccagcctgggctacagagcaagactctgtctcaaaaaaaacaaacaaacaaacaaaaaggccgggcgcggtcgctcacgcctgtaatcccagcattttgggaggccgaggcgggcggatcacgaggtcaggaggtcgagaccatcctggccgacatagtgaaaccccgtctctaataaaaatacaaaaattagccagcgtggtggcgtgcgcctgtagtcccagctactagggaggctgaggcaggagaatcgcttgaacccaggaggcagaggctgcagtgagccaagattgtgccactgcactctagcctgggagacagagcgagactctgtctcaaaaaaaaagaaaaaggaggcactaagagttaaagctgttcagtgggggaattggtcacctccaaattcaggtttcccagaatagcgacggccaagtcttgactcgatggccatctgactggaacaccacagaagggagcccacaccagggagaagctgaactagatgagtgctgagacccctcgcctctatctgagtcttctcagagaaaggccagtttgaaagcagccacagccaggcgcagtggctcatgcctgtaatcccagcactttgggaggctgaggcgggtgggtcacctgaggtcaggagtttgagaccagcctggccaacatggtagagactagaaaccccatctctacgaaaaatgtaaaatatgagctcggtgtggtggcgggcacctgtaatcccagctactctggaggcagaggcacaagaatcgcttgaacccaggaggtagaggttgcggtgagcctaaattgtgccactgcatgacagcctgggcaatagagcgagactgtctccaacaaataataatacaaaataaaaagcagccacagtagatctcagtccatgtgagtcttagggaaacgccagcctcacgttgttagcttcagcactgccttccgaaaccacaagggaaaagcctagttcctcttcctcatggcagcctttcaaatatctgcaggtggctcttgaacagtctgaccacagcccagcatagg

SEQ ID NO: 29624 - DNA, 2690 bp, Homo sapiens
gaatcgcttgggttcatgagttcaaatcctgaactcaccagcttgggcaacatagtgagaccccatctccaaaaaatgtgccacagcaaactcacaggagtgctgcaggatattttaaattttttagggaaacacagagacatcttgtcagaatactaatacatggtttgaccctaactaaataaaaggaattcttggccgggcacggtggctcacgcctgtaatcccagcactttgggaggccggggcgagtggatcacctgaggtcaggagttcgagaccagcctggccaacatgatgaaaccccgtatctaccaaaaatacaaaaattggctggacatggtggcgggcacctgtaatcccaactactagggaggctgaggtaggagaatcacttgaacccgggaggcggaggttgcagtgagccaagatcgtgccactgcactccaccctgggcaacaagagcaaaactccgtctcaaaaaaaaaaagaaaaaaaatttaaaagaaattcttgagtatttcttttgccctgtgtttgccatgaaccaagaaagtttgggaacctctgtcatgtgacctttgaccagtcatttcactctgggtccaacttcccacgtctacaaatgatatgggtagaaaagaggatctctctggggtccttttctactgtgtgtgcatttatgtaaaatgtcagactcagctttgcacccactgcaggcttccacccccatctaaggccaactctgcctgtctttcctatcccaccatgcctctcagatcaagacctcctggctacacctgcacttgagccaatattctccacttggctcactgttacacgtcctctgtgaagcccttccttaccacgcaacacatagtaaacacttggctctgctgtttatatgacacttctaaagtgtgtgtgtgtgtgtgtgtgtccgtgtgtgtccatccatcattccctgtctaggcgagcttttagaagagaggaattgtaagtcgttgagtgactgctgtgcggcaggctgtgcaagggaagggactatgtctttgtctcttaaatggtaagatttagtgcgtacctacccactttctaagcaagcagactagggagttccttctctgccagaggaggtcccagcaccttgggcatttggagcttgcttctgtttctctaacggggctctcctgcagcactgtaatggcgttgactggcgtcagaagctggactctcagcgaggggctgtcattgccacggagctgaagaacaacagctacaagttggcccggtggacctgctgtgctttgctggctggatctgagtacctcaagcttgggtgagattcctgtgcaggagctggcagctgatcttgtgaaaggaagggtctgggtagggaggttgaccctcccctccccgtgtactggacaattgactggcagagataaatccaggggtggggtagagatggaggggtcagttaggagacaaatgccaaacagcaggcatgctgaatggagtcctgaactagggcaatggtgtcaatgaaatccagaactgagaactcagaagacgatgttttccctttcccttgaaaatagcagtggactgccgggcgcggtggctcatgcctgtaatcctagcactttgggaggcccaggctggcagatcacgaggtcaggagatcaagaccatcctggctaacacgatgaaaccctgtctcaactaaaaatacaaaaaattagccgggcgtagtggcgggcgcctgtagccccagctactcagggggctgaggcaggagaatggtgtgaacccgggaggcggagcttgcagtgagccaagatggcgccactgcactccagcctgggcaacagagccagactccgtctcaaaaaaaaaaaaaagaaaaaatagcagtggaccaggtatcaccatttaattgacatttgatcccaagtgttgctgtctctgtgctgccctgctctgaccactgatatcccttcccctgttagttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaaggtgtgtagcagcccactttctgaggtctagagtgatctgtgggctagcacgggagcaagctctgtagccattgtgatctttaaccttgataaaacttcgagaattccctgagacttaagtatgaagaagcattcactttggctccaagagcttcttctagagcctttagatcacatcaagtggttggggaggatagcggtgttttagagaagcggctggactgtggcagaggtagaggaagatgagggaagtcccagattgaagccggtggtctagagggaaaagctccgctccgggttaaatagcctgaaagttgtctctcctgctccaccagctggtgactgaaggaaatacctgcccagccctgtgagcatctgaaaggcttaacttcgga

SEQ ID NO: 29625 - DNA, 1050 bp, Homo sapiens
agcgtggctgaggagacctcaggaaacttgcaatggtggcagaaagcaaaggagaagcaggcacatcatggccagagcaggagaaagagaggggggaggttggtatacacttttaaacaaccagatctcttgaatactcttaccacaagaatagtgccaaagggggaagtctgcccccatgatccagtcacctcccaccatgctcctcctccaacattggagtttacaatttgacatgcagtttgggtggggccacaaatccaaacaaggcagaaatcatggtgtcaatagaaatagaactgagttctcatctggaggttctgaaagaaaagccacttccaagcccattcttattgtgggtaaagttcatttccctgcagttagatgactgaggcccccatccccctgccagttgtcagctgggagcctctcttggctcctagaggccacctgcattccttgtcacatggccccctccatctccaagatagcaacagcacatcagatccttcttgtgcttcagatctctgacttcctccgtctccgacctctacacctagatttaagagactcatacggttgggtgagcccagccaggtagtgtatattaaggtaaactgatttgcggccttacatctgcaaaatcccttttgacatacaaggtaggatgatcatgggggtgatacttgatcctagccataggttctgcccgtagtcaaggggaggagactctgcaagggcaagggtcactgggggtcatcttagaattctgcccatcccaggcctcaaccatgaactctttgaaaatgatttctcaaatctactctgatttattatacttcccattgtttttctgctaaaacaccttccccttccatgtgtccccagtcccgtcattgcctctgggccagctgtccatcagcattgtctttcttccacctaagctctgagcctccaacatctccaacttcttttttacattattctgttttgctgttagcaaaatagaaggctttgctgtcttctgaatctgtcctggatttcactgat

SEQ ID NO: 29626 - DNA, 1032 bp, Homo sapiens
ggtaggtcacctctctggtgggtattgtggccagactggagcacgggccccactctatagaatccccagtgaccacatgagtttcttttttgctgcagttaccgcaggtggaagcttggagatgatattgaccttattgtccgttgtgagcacgatggcgtcatgactggagccaacggggaagtgtccttcatcaacatcaagacactcaatgagtgggattccagggtgagccgccatctccatcaccctcctggtgacaccatgtctctattccctacagtgcctgtttacgcaggctaggttgtataaactgtttcttatcccctttcgttacttatagagctacctggatgtttttttttgtcttgtgagttttttcctctgcttagttccttgctgagaaagagcatgactgtgtgtgtagaactatgttaagtgttaagaacttttctgcttattttttacgcaggaaccagttaactcccttcttccagtactttcttcatctctgttccattgtggcctcctgttgacttctgctccctgagcatctgattttttcctctccttattatctgggttggcagttttcctgtaagtctggccgctcttctttttgacctcttctttcattgactgagccactgccttcaatcttttcacacattttttgcaattcctcatttctttaactcatggattctaagatctggctcagaattgactcttcagaggcaccttgaaagaaacatgcttccttcacttttcctcctctatttccaccccacccctcccaatccgcccccccgcccacatcacctgttgaaagagcacactggaaggtttgccgctctggggccagcggccttttcttggatttttcctggtgagctccccaaagcattcagggccgtcgtgcctgtgtcgttttgccgtctgtgttaccgcgttactctggtctcacccgtttccctgttccgtttgcatgtcgtctttgctggctcccctcctttttgatcccagtggagt

SEQ ID NO: 29627 - DNA, 1332 bp, Homo sapiens
tttgtttttttgagacggagtcttgctctgttgcccaggctggagtgtaatggcaggatcttggctcactgcaacctccgcctcctgagtagctggtattacaggtgcccgccaccacgcccagctaatttttgtatttttagtagagactgggtttcaccatgttgaccaggctggtctcgaactgctgacctcgtgatccgcccacctcggcctctcaaagtgctgggattacaggcgtgagccaccgcgcccggcctccaagaaatacttgtgtagtgaattttcctctaggaactcgccttctaagcattttcagaaggttacaacggaagataaatgcataggtttttttatagaagtgtcgggcagccatctgctatacagcgccggttttttaattcccaagagggctatagcattatgcagagtgcagactctggggtcagactgctttggttcacgtttttcatccactagcatttcaactttgggcaatttcttcatttctctgtgctttggttttcttatctggagagtgcggataacattggctcctacctcacaggattgttggcaggactgtatgaatgaatgagtggtaaacagtaagaacagtgcctggcagtattcatgaacatttaacatggcaactttgggcctgaggtctgtggggacctccttggccctctggcagttcttctgcctggctttatgtccgcttgcactgcacacaggatttgcgttgatggcagaaaattgaaacaatgagaaaggaaaattgaatttcaggatatacttaaagatctttttttctcagcactctatatacataaatgcacttttgcaagtctgaatacttgtgtggcattatacaaagtgcttagaacaaggatcttgtttattttgcagatggaaaagactaaggtggctggacgtggtggctcacgcctgtaatcccagcactttgggaggtcgaggcgggaggatcatttgaggtcaggagttcaagactagcctggacaacatggtgaaaccctgtctccactaaaaacacagaaaatagccaggcggcgcttgcctgtaatcccagctactcaggaggctgaggcaggagaatcgcttgaactcggaaggcggaagttgcacgccactgcaccccagcatgggtgacaaagtgagactctgtctcaaaaaaaaaaaagaaagaaagaaaagactactaagtcttagggaagttgagtttgtatgaattggtgaaggtatatctcagaaccaaaacaaggttactatatttgaaaaaacattaggacattttatcaaatctgacac

SEQ ID NO: 29628 - DNA, 1083 bp, Homo sapiens
ccttccactggccgggccgtgggggtacgcccgctccgcccagcccaggcccgcgcggcccccgcgccacccggcgtccccctcagacccccgcgggtcccggaggccccgcgcgcgaggttggcaggtgccgggcgcgaagcggccgcgcgggggaggcgcgggatggcggcgggcggcgcagggtccccctctggcggtggcgcgatggtgcgcgccgcctggggagctgcggccgggggtttgaaccggccaacttctccagccggccggggcgagcgccagcgcggcgtccggggcgagtgagtgcggggcgggggcagcggccgggcgcctgggccgccggtcgggccacctgctgcccggggaaggatagcgttgcgagagtgggacggggtgccccgggaacccctgatccacctagggcagagggcagcgagctacgggccggactcgggcactctggaggcgggcgagctcgggctgcctggggaggccgcaggcgatggcgtgtgcgcggctcgcggagcttcctagccgtgcgcccaccccctctgccttggaaggaaaggggattctaagcccaagatgccatcgccccccatcccgggcatgctttcattgctctttcctggcgggatcgagtactgtaacttctaggagccagatccccgccccaggaagcgcccctacttggagtcctcggaaactcttgccccacccgcttctgcgctgggcccccgggccggctgggaggggcggggccggctttccagagggaatctgcaaacttatcccgctgcacgccccagcctcgctggcttgctgtaaacaaggaacccgggggagtgcggagggagaaagagcttctcccaggcctcaccctactgcacacaccgacttccttcctcacgcctgtctctctttcctggttcccacccgtgccaggtgacacgcagagctgaagccatggttcatcaggtgctctaccgggcgctggtctccaccaagtggctggcggagtccatcaggactggcaagctggggcccggcctgcgggtgctggacgcgtcctggtactca

SEQ ID NO: 29629 - DNA, 1043 bp, Homo sapiens
gcaacgacttcgacacctacatcaccttcagcggccacctcatcaaggccgaggacgactgagggcctctgggccaccctcccggctggagagctcaggtgctggtcccgtcccctgcagggctcagtttgcactgctgtgaagcaggaaggccagggaggtccccggggacctggcattctggggagaccctgcttctatcttggctgccatcatccctcccagcctatttctgctcctctcttctctcttggacctattttaagaagcttgctaacctaaatattctagaactttcccagcctcgtagcccagcacttctcaaacttggaaatgcatgcgaatcacccggggttcgtgttaaatgcagattctgactcagcaggtctgagtgggtccaggattctgtgtttctcatatgttcctgggtgatgctgatggggtcagtctatgaaccacactggagcaaccaggttctaggactttctcaatattctagtactttctgaacattctggaatcctccccacattctagaattctcccaacatttttttttcttgagacagagtcttgctctgttgcccaggctagagtgcagtggtgcaatctcagttcactgcaacctctgcctcccgggttcaagcgattcttctgcctcagcctccctagtggctgggattacaggcgcctgctaccatgcctggctaatttttgtatttttagtagagatggggtttcaccatattggccaggctggtcttgaactcctgacttcaggtgacccacccgcctcggcctctcaaaatgctgggattacaggtgtgagccaccgtgcctggccaattccaacattcttaaattctctcatccctccagggctccccgtgctatgttctctttaccccttccccctcttctcttgctcaggcctgcaccactgcagccaccgttcatttattcattcattaaacactgagcactcactctgtgctgggtcccgggaagggtgagggggtcagacacaggccctgcccctgccc

SEQ ID NO: 29630 - DNA, 1006 bp, Homo sapiens
gtaaagaatgtaactttctgacaggcctgggagccccgagttatctcgggacctcaagaggagaggaatttatctaactcatacaggttcttgcaggcataggtaaatccatggctgggctcaaagctttaaaacatctaatctaagataccttatgaaacaaagccaattttaaaaggagcctgtatggcaaataattatacttgctgcactttatgcaaataatgaagccaagtataataagactaaagcttattttgcaaataaattggtcctaccatgatttgtttttaataaaaaatgggagactggagagagaaaaacggtgtttcaaaaaatatggtacacctgtcatagattctagtctcatccattgtttttgagttttttgtctgcaatttagactgaccttgcttctttctgtgaaccaaacagtcatctcttgactgcttctcgtcagaaacaagagggatggataacataaaaatctggatcagtatctaattctgagcatgtattggaatcgtctagcaactccgtatcagctcatctagcaattcctgtgactaagaatgcctaacctcctgggaatgcagcccagtaggtctcagcctcattttacccgataagtcacaggcattcttgcccagttcatggaaagccttcttatttggattacttgggataattttacttattttactttgctgttgtagaatatattgctgctatactctttgtgtaagaatgcaagataagcttactcagtgcttccttaaattgaacacattaatcttccagatatcaccttttgttaggactcagagttacaaatgactctgaacacaccaacattttcttactcagttcctctctgcaccaaacccaagagactctaatagttaggcaggaatatcatcgcctctattcagcctgaagaagttacagaagatggatcttcatgcctctacaacccttaagattaaacgttccctcgtaaaagaga

SEQ ID NO: 29631 - DNA, 1019 bp, Homo sapiens
ggtaaaatagggctgagacctgctgggctgcattcccaggaggttaggcatttttagtcacaggatgagatgggagtcggcaggactggtatcataagatacaggtcataaataccctgctgataaacaggatgcgctaaacaagccggccaaaacacaccaaatccaagatggtgatgaaagtgatctctggtcatcctcactgctcattatacactaattataatgcattagcatgctaaaagacactcccaccagcaccatgacaatttacaaatgccatggcaatgtccagaaattaccttatacggtctaaaagcgggaggaactctcagttctggggaaatctcccctttcttggaaaactgattaataatccaccctttgtttagcatataatcaagaaataaccataaaaacagccaaccagcagcgctcaggggtggtctgtctatggagtagccattcttttgtttctttacttctctgtaaacttgctttgacttcactctgtggactcacctcaaattctttcttgtgcgagtccaggaaccctctctttgggtctggattgggacccctttccagtaccattttttctagtgaaccacgaagggacgataccagaaaacaccctcaacccaaaggaaatagactacagccccaattggctgactttgggtaagtgagggatattttattctgggtaatgtatggatttgggttaggttccctcctcagaaatagggggttaaaggcccctcttagtgaagggcaaagatgcttatcagaaattgggttagaggcccaaatgaagaaggttggagtccttagggagttagaggtccccctcggtcatgtcccttggtaaggagaaatggattaggcactatgggatattaaccactattctcttttcattaatctgccttgcactgtttgctgacagctgtgagtgacaggattaggcacgtacaggatcatgggacatggggagctttcttctccccaaaggggga

SEQ ID NO: 29632 - DNA, 1045 bp, Homo sapiens
tattcatgtgccccccccccccaccccccagcacccacagagggcaaggggtgtcattgtcagcttcgtgttatgcatgtggtaactgacgctcagcagccggctcatttgcccaggctagggtgcagtttgccctggggtttggagcggaccgtgtgctccagccacaaagccagggccagcatagccaggccaggtctcaggcctgccccctttccatgccacctcgatgcagccaggacatgcggcactgaatgatgcctcccatgcctgcatctgtccagcccctcggcctggctctgtgtcttacctgagagggcggggctgttccccagcagtgccgattgggtgggaggtccttgcagccgcgccctccccaggctggcagcagggggcagtgcagctgtgtctgggctgcagctgctggggtggatggagatgcttcgccccgctgcctctccagccagcacacctgctgaccttggtctccccacctcctccaggccaaggtgtctggcaggggacttggggtccatttgtctctgagcctggccacaaggcctcaccttttctcatccagggacaggcagaaccctaccatgatggggattttggtgacgtcttaattgtcagtggtcctcctgcccatgggaggaaaaccagacgcctctgttccacgccctccaaagggtggctccagcttgcctttcctgggagctgcttcccaggatgtaaaataagaattagggcaaggagctcagcatggtgtctggcacatggaaagcacccaggaagtgttcgctgctattgttattattaaattcttccacgcatcctgtgttctgtcctccacacctttgctctgatatattccttcagcctggaactctgtttcctccatctgtcaccaaagtgcatctattcttcaccagcgtgtagcctaggtacttcttccgtgggaagcctctctctgcttccacggctggttgtaaccacctttggatctgtgccacgtgctaatggtgacctccctcctcagactgtg

SEQ ID NO: 29633 - DNA, 1049 bp, Homo sapiens
tccaccaccatgcccagctattttttttttttgtatttttagtagagatgggatttcgccatgtgggccaggctggtctctaactcctgacctcaggtgatccacccgccttggcctcccaaagtgctgggattacaggcgtgagccactgcgcccggctgaagactgctttgaaatgtcaccttcttctggaagaactccttcaaaatgagcctccccactgcatccggtccatcctccatgttggtatctatttcctgctgagatcgctgatgagagagtgatgtctgtgcacgctctgtgctcctggcacactgggaaatgaatgatcaggaccaacataggaattcttgttcatcgttccttgactgagccaaatgagagcaggtactctcctcctgggaccaatccagggatactcactggctagacccctgcaggggctcaggcacacctgggcactgcaggggaagggggcagctttggactcttcaagaggtttgtgctgtgacctagttctccagaggtgacctcacacctaggggagactggcaatgggccaaggaggctgacccccatgctctccccagtgtgcattcccaagtcagacaaccctgagtgcaaatcaggactttgtctctcactagcagagtgaccttggataagtcagtccccagcattggtctcagctccattatctgtaataagccataaagttcattgcctgacctgtagttatggtcaaggaagggtagctgttattatgactttttttttcttttttctttccttttcttttctttttttttttttttttttgttttcgagatcaagtcttgctctgtcacccaggctggagtgaaatggcaccatcttggctcactgcaacctgtgcctcctgggttcaagcgattctcctgcctcagcctcccgagaagctgggattataggagtccgcaaccacgcccagctaatttttgtatttttagtagagacgaggtttcgctatgttggccaggctagtcttgaattcctgacctcaggtgatc

SEQ ID NO: 29634 - DNA, 1050 bp, Homo sapiens
gccaactttggtctggttgattctagggctcttctgaggaatgaagcccatctccaacctgcttccccctcccttccccaccgtatgtacccacacccatgacccagctaccgagtctgcctgcttctggtcagtcagggggtcttggcctctgcttggttctgactcctcaggctcctctggttggaactggagattaaaaaaagaacacagcttagcccaacttattctccaggatgcatgcatctgtccacctcatccatccattctatcatctgtccatgcaacacccatctaacgtccagcatcagtagatccatgtatccatccaaccatccagtgtctatcacatgactcaccctctcatgtacccatcatccattgtctatcacccattcatgtatctaccctccattgatccatcacatatccatttacccaatacctacatatccctctctccatccatcatccatctacccatatctccaacatctatcatctgacattcatccacccatgccacatctatccattcatattccacccaaagttcatccatccatcacctaagcaacatccatcatatatccaccaccaccatatattcatcacccagctatccatccatcatcacccatctgtcatccatccaaaagatgtctattattcattcaacatgcatcattgatccatcatccattcacacattcaccctccattcattcattgttcacccactgacccctgtgtcctccatcttgcatgcatccactgagctgtcccctcctttatgtcaggccctgggccagagctagagttacagagataaagcaggtagagatcctgcctgtgtggagcttatggggaaatgacaaccctattagatggatgttgcatggacaaatggaagcaaaactgccaagcccagaaggggaccattactaggagtgactgttcagggaaggcttctcaggacagggagcctgacctaagacttcgacaatgaacaggcgtttggtggctgaacagggaagagcatgtgcaaag

SEQ ID NO: 29635 - DNA, 1102 bp, Homo sapiens
atatacaaaaacttagccgggtgtggtggcgggtgcctgtagttccagctactcgctgaggcaggagaatggtgtgaagccgggaggcggagcttacagtgagccgagatcgcgtgactgcactccagactgggagagaaagcaagactctgtctcaaaaacaaacaaacaaacaaaaaaaactagttttctgtctttttctttttttgagacaaagtctcactctgtcatccaggcttacgtgcagtggcctgatcactgcccactgcagcctcaatctcctaggctcaagcaatcctcctgcctcagcctcccaagtagctgggacgacaggtgcacaccaccaagcccagctaattttaaaacatcttgtagagacgtggtcctgctatgttacccagctgttctctaactcttgggctcaggcgatcctgtcaccttggcctcccaaagtattgggattacaagcatgagccactgcgcctggcctttttcttattgatttgtaagaattctttgtatattctggttagaaatcatttatcaaatataaatgacttgattttctgagcttgctgtttcattttctgagtggtatactttgatgaacacaagttcctaattttatttttatttatttatttatttatttgagacagagtctcactctgttgcctaggctggagtgcagtggtgtgatcttggctcactgcaagctctgctccccaggttcaagctattctcccacctcagcctcctgagtagctgggattacagatgcgtgtcaccacacccacctaattttttatttttagtagagatgggatttcaccatgttggtcaggctggtctcgaactcctgacctccgatgatccacccgccttggcctcccaaagtgctgggattacaggcgtgagctcctgtgccctggcctattttattttttattttttggagacagagtctcgctctgtcacccaggctggagttcagtggcatgatcttggctccctggaacctccacctcctaggttccagcaattctcctgcctcagcctcccaagtagctgagactacaggggtatgccaccacacccagct

SEQ ID NO: 29636 - DNA, 1050 bp, Homo sapiens
gcctcccgggttcacgccattctcctgcctcagcctcccaagtagctgggactacaggcacccgccaccatgcctggctaattttttatatgtttttagtagagacggggtttcactgtattagccagtatggtctcgatctcctgacctcgtgatccacccgcctcggcttcccaaagtgctgggattacaggcatgagagactgcacccggccacaccggttaatttttttgtattttttagtagagatggggtttcaccatgttggccaggctggtcttgaactcctgacctcgtgatccacctgccttggcctcccaaagtgctgggattacaggcgtgagccactgcaccagccttgcatacttttactcaaagttatctccatgagattcacccatgaatactgcctatatcagtacagtcttccctcagtgttcttgggattggttccaggaccccactcagataccaaactccatggatgctcaagtcctttgaagttggccctccatatcctcgggttctgagtccagggttcattgaatctgtggacacagtattcacagttagggagggtggactgtagttagtactttcttatgctggtttgtatttcattgtgatataccccatttatccattctactattgacggacatttgtggtgtttccaggttttagctttatgaatgaagtgttgtgaacattcttgtatatgtgatttgtggctgtaaacactcatctatcctctataaacctaggaatggcattgttgggtcactagggtacacatgtatttagctttagtaggtactactaaaccttttcccaaaagggatgtactgacacacactcccactccccaccagcagtgtaagagttccacctttccctacgtccctgccagtgcttgctgttgtctctctttaatcttaacccttttggtgtctcatagtggtttaatttgcatttctctgatggccagtaacgttgagcacctcttcatgtgtttattggccttttttttttttttttgagacggagtc

SEQ ID NO: 29637 - DNA, 1093 bp, Homo sapiens
tttcaataccctccaccacagtaacccagtacctcggccaggcgcggtggctcacacctgtaatcccagcactgtgggaggccgaggcgggtggatcacctgaggacaggagttcgaggccaccctggccaacatggtgaaaacccgtctctactaaaaatacaaaagttagccaagcgtggttgtacatgcctgtaatcccagctacacaggaggctgagacaggagaactgcttgaacccaggaggtggaggttgcagtgagccaagattgcaccactgcactccggcctggacaagagcgaaattccgtctcaaaaaaaaaatacaaaccggtaccccttagctgtcattcccaatcctcccactcccccagccccaggccaccaggaatctactttctgtctcaatacatttgcccattctggacatttcatataaacagaatcatacaatgtgtgtgctcttttgcgactggcttccttttcactgctggataatattccattgcttggatacaccacattgtatttactcgtttactcgatgtatttactcagatgttagctgatggacgcctggttgtttccactctttggctgtcatgaccactgctgcgctgagcatccatgtacgagtcttcatgtggacatatgttttcatctctcttgggtatataagagtagaattgtggggccatatggtaactctatgtttaactgtttgtggaacttccagaccgttttccggagtgtttccgtgtccatcagcagtttatgagggttccagttgtttcacgtcctcgctactatttgttactgtctttttgataatagccatcctagcaggtgtgaagcgatatctgattgcaatattgatttccggttcccagatggctagtgatgttaaacatgttttcctgtgcttcttagctatttatagatcttctttggaaggaaactctttttcacctgtgttaaactcctttttgcctgtaaatagttaaccatcaacattaagagaagagctgaccccctccttgactgcctcctcgtgggtgagggtccctcaggagggagctgtgggttgaacag

SEQ ID NO: 29638 - DNA, 1046 bp, Homo sapiens
cattcacactagcgcagggtcgggaaggcttccttttgattggatccagcggaaagcggcccctcagaagcatctacctggcatttctataacaacgcacgtttctgttcaccgttgtatcactctggaaacctacgtgccacttccttcttggtgctgacacccttctctacacacacactggcagccatagctcagggtttcagtaccaaagaggcaccctcaagctcccttgcagactagtgggcaccaaagtttgggaaataactgtgggagaaaaccttaaactttagaaattttattatgtagtgatttttttctgcatattgggaggagattgccagcattccttttctgggcgatcccctagccccgtgggatgatgtgaggacacctagagcaggaggaaggacccactgtgggaaaagggtgtgtggacagaggctgcgcagaggcgggagggcctccagaggaggacgtgtccgcggggttggggaagcacctcttgtgtcccatgcagcctgaaccctcctgcagctggaagggtttaggtccaactgcccaacaacatggagtgactcagagaaagctgatggagaatacagggtaccagggcatcacctgggcccacagaatcgaagctcatcaagctctcagagagcagctggtcaagcctttcctttttctttttttttttcttttgagacagagtttcactctgtcacccaggctggagtgcagtggcgtgatctccgctcactacaacctccgcctccctggttcaagtgattctcctgcctcagcctcctgagtagctgggattacaggcacgcaccaccatgcctggctgatttttgcatttttagtagagatggggtttcaccatgttggccaggctggtctcgaactcctggcctcaggtgatccacccacctcagcctcccaaagtgctgggattacaggcgtaagccaccatgcccaggctggtcaagcctttcctgttacagatggggcaactgaggcccagagatgggtggcaacttgtc

SEQ ID NO: 29639 - DNA, 1026 bp, Homo sapiens
tgctggacagatagccgggtggtcagtgttgtgacggctcctctgtggagctgtctgagcttctaggtgctgacaggtggggaggggcactgccagatcagggtcctcagctccccccaaccccctggacattgtcctgggactcaacatgtctgactggtgcccctgcccctgtgctggtcagattccattttctccagagcgcccccacatctggatcctggtcatgcaaagtcttggaggtgcccggggaggactccccaccctagggtgggtatcagggcctgtgggccaggcctgtgttggatgctggggatgcagagctgagccaggcataccccagcctcaggagcagggggctcagccagtccaggaggtgctggggacagagtcccatgggcggaggaggagagtcatctgtcaagttgccgggacgttagtgtccacggcggtttattgactggtatttcatttccttttgatgattctcaccatagccctgcggggtgagcagatggggaaactgagaaccagagaggatcagccagtgaattgggcagtcaggactgggtctccagcagtgtgcccagctctctaccccagcctcagggtcccagcatcccctctctggtcttccacagggtccaagggcgggcacgaggtctgagcaggcagactgggcagagtcctagcttcttctccaaaagggccacgtccttcttcagggaccatttcttccccatccggggtcttgagactcccaggggccatggaggggatttgagaggtctcctggctgatcctccggtgtgggcagatggcctcctttcagctaccctctgcttgtacatccctggccctggggaactcactgcctcacgggggaagtggggcagcttctccttcctggaggtgcagccggccccttggccctgtctgttctgaaggctcaaaggacagggctattccttgttttctgtgacaaacaacgtgggtctagcttttataagcttttactcttgaggg

SEQ ID NO: 29640 - DNA, 1059 bp, Homo sapiens
cttttgactaaatgaccttgggtgaattatggaccctcttagagcctcacctgtcaatagggaataagaattcttaggccccaggtggttattgcagcatcggctccgatgcaagaagaagcactttgtctgaagaggacacgcaagggtattcatgccttggggtttcaagaggaagagattgaggggaacctgggagctggctgggcagggtggggagcccttcccagagcagtgggcccccctttccactccagcccatttctctcctgtggcctgtggctcagctttctcctgggacagagtccttcctgtggggaagggacagatgacagggggagtggggggatgagggcgtggccgtgggcgaggcacagcccaggtttgatctagggacctctggggtagcagggcttggggacccacctgaccacagcatgccctgctctgtgcctcacagaactacaggatctcatgcacatctcacgggcccggaagccagcgttcatcctgggctccatgagggacgagaagcggacgtaagtggatcgagatcgggggcagagcggggaacgtgtgcgctttcctgcccctcacccaccccctgttgtgggctcagggctttactctctgcaccctcacagccggcgaagtggctctgctcctagtcttatagttctcagcagagacagaacatggagagcctgtgtcgctcgttcattaatgctgggcggtgcaggctctggagaccagcccagggtgccaggcttcttggacttggtggggctggcgcagtgttctggcctccctccctgatctccttatggctagaagagggggagatgcctgggtcccccctggggagatctcagcagctgcttcccactgctcctactggcttccttaaccacctcccactgcagaatagtggcgtgggctgccttccccagcacctgctgtatacctagtcccattgtaagaggcgggcctgggtgacaggatgcaaagagaagacgcccaggccttgcccttcaggcataatcccgggtgcttgaactc

SEQ ID NO: 29641 - DNA, 1022 bp, Homo sapiens
aggggtggcacatgggctgggttaaaagatgagagtttagaggtacacagattggggaggagccacagagtctccaaaacagcacagctggatgatggggagtgggtcagccattaaggaaagggggagaaatggcgaagaacgcacacaggccctcggaggaggcctcagcagtaaagtggttttactggctccagggtataaagatgttcaggcccaccaggaagctcccgaatttctgttgtgtgtccacggttcccagtgctgcctgtatagtcccaaacagagccgctgtccccagggggcctgcattctaggtggggtggggggaacagttaataaatacatgagtgaatcgagttagtcgggtggtgtcgatgtaatgagtgctctggaggaaaagaaaggaaagcagggagtcaggcatgcccagcctgggagaggctgacatgttttcatggtggtcaaggtagagacctaaaggaagggtgggagggaggtatttgactgagcagagacagccagtgcaaaggccctgtggcagaagcaggcttaatatgttcaaggaacagcaaagaggccagcgtggctgcagctgaggatggaagtgggaactgtaggagctgagatcatagaggacaggaggtcccatcgagtccttgggtacggactatggtttttactctaggggagctgggagctattggagagttttgagcagtggcggcctggtctggctaatccttggaagactcacaaacatgctgagtggggactggtcattagaggcaggggcagaagcagagaaactggtcaggggcctgttgcatcaatccaggggagaggctggctgggacagggtgatggttggggtcaatacagacatggtcaggaggtgggtggagagacctggaagattctttccaatgctgccacttgccctgggaggagactcacattgcaatttcttctctctaggctagcttgtcactttctgcaaaggtttccctcagggagcctcc

SEQ ID NO: 29642 - DNA, 1034 bp, Homo sapiens
aaagggaagagaatcaaaagtgtctttgcttgtctatgcccagggggtctctgggcagacaccgcaagtcggtgattgtgatgcctctggagggggtgctggtcatgggagattgcttgtttgctggagatcccatgtaccttttgattgctgaagcaggtgaatgtacgcctttccaagaaattaaaatgggccaggtgcggtggctcacgcctgtaatcccagcagtttgggaggctgatgttggaggatcacttgaggtgaggggttcgagaccagcctggccaacatgatgaaaccccatctccactaaaaatacacaaattagccagacatggtggtacatgcctgtaatcccagctgctctagaggctgaggcaggagaatcatgtgaaccctagaggctgagtttacagtgagccaagatcatgccattgtactccagcctgagctacagagcgagactctgtctcaaataataaaataaaataaattaaaaacataaggactgtaaccttgcctcctgcccagtgtaggaaggtcaaggttctggctacttctcaagtacaggagcctcactcaggccccagaccactaatcaaaaaatatgtgcttggttctcacaaaggggccgagtgtgagggcttgggtgttgcttggtaaatacgacccccggtcccggccttggagagatggagccctctctgggccccttggacacactgctgttggctgactttgtcattttcaacccttgctccgattggctcacgtcatgatttctgaaacctttgggggcttccccactgacagaaagatacactttaactcagcactgggcatcccaggccctctttactgggcctcttcttgagccgcacttggcctgtcaccccttcctctgtctgccctcttaactccccacctccgtgcctttgctcatatagttccctttgcctgcctttccgtccagagcagtctccacgtgcccaggtcctgtctgactttcaagggccagcttagtttccacttct

SEQ ID NO: 29643 - DNA, 1053 bp, Homo sapiens
tggaggtgatgatgcctgtttctttctttttttttttttttgagacggagtctcgcactgtcgcccaggctggagtgcagtggcgcgatctcggctcactgcaagctctgcctcctggtttcacgccattctcctgcctcagcctcccgagtagctgggactacaggcacccccaaccacgcccggctaatttttggtatttttagtagagatggggtttcaccgtgttagccaggatggtctcaatctcctgacgtcgtgatccaccctcctcggcctcccgaagtgctgggattacaggcaggagccaccgcgcccggctgatgatgcttgtttctgagggttgccagaattcagtgagacctcagatgaacacaagggctaagctcattgagggttcacctgtgccaggccatttccaaccctttgctcccaaaaagactgcgaggttaacgtattatgttccttatattattttatttattttttgagatggagtttcgctcttattgcccggactggagtgcaatggcacgatcttggctcactgcaacctccgcctcccagattcaagtgattctcctgtctcagcctcccgagtagctgggattacaggcatgcgccaccacgccaggctaattttgtatttttagtagagacggggtttctccatgttggtcaggctggtctcgaacccctgacctcaggtggtccacccacctcagcctcccaaagtgctgggattacaggcgtgagccaccgtgcccagccatatgatccctattttatagatgaggaccctgaggcacagaaaagatgccctggctcgacagcccatgctgctaacattgactccacagtcccaggtgcctcctaagcgctctgttgggataactccttgtttcaaacatgaagtgtgaatcttccttccagggactcatggcctagtcaggggaaggactcagagtagcaagtggttcaccccaatccagaatccagtgtgagaggcctagtgtgaactcaggacaaaggagggtgggaatgtgtctggta

SEQ ID NO: 29644 - DNA, 1555 bp, Homo sapiens
ctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgatgcaggcagccctttgtccacctctgtgcccttagggcctctccctgcagacccggaagtgggtcttgctgggagcagcaggagtcagtgaggaacaagccctcgccctgaaggcaggtgtggctggggccactttcagaacacttgggctgtggttgggatgtccgggggctttgaaaacacgagtgcacacaggtgccacgccacaggtgccacgcgggggtcttgtaaagagggctggggtggggctgagagcttccccctgcacactccaggtgtgctgatggcctggggcccctctttgagaagcaaggccctaaaagctcttcacacatgattttatccacacaagtatcctgagttaggtcctgttaatagccctgccttcggacaagaaactggtcctgctgtaaaatatcttgcccacagtcacagctctggtggcagaggcaagacgagccgaggtcatctcgctgtgggggttgtgggggtgctctgaccctctccactgctgaccctggggctccatgaaggagagtgctggagcgagctctgatagtgactctggatgaggtccttcagtcaagccttgataaaagggcagcgctcagcctcgcctgccttggtctcaccagcttggaaaagaatctgtccatctgcattt

SEQ ID NO: 29645 - DNA, 1029 bp, Homo sapiens
cattcttagctacagacagggacatcttagagtcactggaatcacacaggccttccctcagcttgaggggctgcctggaggtgggggtgggggtacacctcctcagtggggagagacttgccaaatctctatcgccagcggctaagggacttgacttgaagcttgtacctccctctctctccctccccctctctccctccccaccctcaaaagacaagtgtgccatttgaccatctcgggaagtgaggagagcccccattggaccagtgtttgcttaggtgagtccatgactgctgcagatgcagccagcccagccgacctagaagctcccagggccccagaaagagaccaatgtgttgtggaggggtgggtggcagtggcagtggcagatggtaccaggcgccccagaactctaaggggcctcaagtagtttaaaacctcggaggctgcctgacttggggccaagggtttctatgctcaggcctgacccctcatggattagtttctgctggaaaaactttttctgccctcggccaggtctctatctccttctgccttaacatattttggaaggttggttcccagcagagacggggccatgggctcacactctgacctctcccacggcattagccctgtctcagcctctgggctgttacgcaagttaattcctgcacaagactcacaacagggctgtggaggaagcaaaggagccctttttatgcctctgtagtaggactgagagaggccctctggccagcgtgagcctgctggttcttcccggactgtaccaggccttgaggcggggtatggaaacgccccactctggggcctggcttggggaaggggaggcggcaggggttctttgggcttctcgagggtataatctgagctctctggggaacgtgtgtccatttgtaggcagtagtccgacacgtcgggggactcaactttacactgggacaatctgtgtgtggtctgttttgtagaaattcatccacacaagagagtggaggcatgaacagggct

SEQ ID NO: 29646 - DNA, 2142 bp, Homo sapiens
gccccatgacagcgaagggacctttctgtccccgcccctgtccctgtgctgggcccacgtactcacccacgtactggtaaggatcctctgaggtctggcttttccaaaatttgccacttgaccagtgagcgcaagaggctgagcctcagctgtgctttttgtccctttcaggtgcccggctcccctgggcacccagagccccccagataggccggtggaggaggtggaggagctgtccccccaaaactactggcctgtggtctggactccagggccccatttctgatgtcgccaggtgtgcctgagcccatcggggccaggcctgaggaagtgtttcttgggaggatgggatgaccccctgttcccaagagatggcagcacagtggaggccatggtggaaaaggccctgccatggggtccttgagggccaggacagcctgagggagggatggtggccactgcccacaaggggcctggtgggaacgggtcccaggacagactcatagctagaccccgttggcggcctctgtgttgaaccagaactcattaaacacctcctcttgcttcatcctggtgtgcctctttcatggcagggccctcagccaccctgctagatggttaggaccaaggctctgttctcctggaagccaaggtcggcacattggtcttgggcttctcttctctctgggtttcttgttcactaaggagtaacacagaggtcaggcagagaatgggggtctcgcaggctagggacctcagggagaggcctctgttgcccttttcagcaaggctggaaatgggatatgggcaggggacgtcttctctgacttcaccctagaccttctggctccaaatggggcccatggccttgagcacctgggaccagctctttccaccacagggcattgggcactgggcactttcttatcgagatagtcactcccacgtctggttcgtgatgggcttggccctccagctcagcacaactgcaagaatggattttgtattctctagacggacactgtccaagatggtagccattggccacatgcgacacatttttaatgaattaaaattaatcaagactggaaatgtcggccaggcctggtggctcatgcctgtaatcccagcactttgggaggccatagagggcggatgacttgaggtcaggagtttaagaccagcctggccaacatggtgaaacccatttctactaaaaacacaaaaattagctgggcatggtggtgtgttcctgtaatcccagctgcttgggaggctgaggcaggagaatcgcttgaacccaggaggcagagattggagtgagctgagatcatgccactgccctccagtggccaccacatccggcaaggcagatgggaccatttccttcatccagaacgttctgtggacatcactgctctaggttcctcccttatggagtctcacaagactgtctagccagcaagatctcttttccaaccaggccaggagcacctctccacccactgctgctggtctgaccgccttcctggaagtccctcttgaggcaggccctggagttagaagctgggcagaggcacccacagccttatcctttgccaatctctgactcaatgccacggccactgtagtgagctgaaccacctccagcagtcccctggcagaagcacctggaaaacatgcaatgggaaccttcaccctgaggccaggcccttcccatgctacccaacagtagacaggacaccctgtgttgttggctgcaccggggtgctgggatctgtggatccctggggcctggaagccactctcagcacatacagccactgtgttccgaggtccagtcagctggccgggaaggaattcaacacagccaaggacagaggtccatatgatgacgggtggatgctcgtgtgactttgctgaccttttatgttttctatgggcaataaaggccaagagagctccctgctgtgtgtttcttgcgtcctatgggttggatgggaccatggagagtcgcccacttcttgcctcggggctggcaatggcctgagcctgctgggctcacaaagggcaggggctccagccctctgcttggctgctggctgcagggctccacaccttggagtgagtcactcagcctct

SEQ ID NO: 29647 - DNA, 1022 bp, Homo sapiens
atcttttcctctgatgtgaggtcctgcctttctcctgtcttgaactcctcctgaggctgtgtccctgggggttgttctggcctgtttgtgtcctgttgcgacactgtcctactcctcctgctgggctcgctgctggccccaggaaggagacaccctgtcgcccagcctagccccagcccttcatctcatccacccatacagccagggaaactgaggcaaggtacactttgggcttggtctttcttgtgacttcttgagttgggcagtgggcccaggcagagagcggggccttggtgtgtgtgagggtattttcttagagccccttgagaagccaggagtggactgggggagacggggaggtgcaggcaggacctctgacctatgctggaggccagcagagccggggttgatctcaaggccgccatttacaggtcaggtgaccttgagctgggtctctagctgggtctctgttttctcatctctacaagggggttgagaatcgaatgagacactggattagaatgtgcagggctgcctctgaaggcatcagcattgactgaggggttgctgcggctgtcccatcctcatcctgtaggccagggtggtcctggcttgttctggtgtgttcggcagcccagccccattgggcctcttctgcacgtgccaccatctcaacccgacagacctcactgcctgaatttgctctaggactcagccccctcccttaggtggtctgtgagccttttgcatacctgacccttgccccactcacatcgggccttcttgtcgccccaacctgtggccctgggtagcccttgtgtgtcacctctgtccctcacagcgctgaccttctttcccctcaggaaccctttgccggggctcctttgcccccttcccagcctcccccaagagctcctcaagggcagatggccccgggcccggcacacgccagatctcagaaatgcttagtggggcgcctgggactgcctggcctttgagggtgaccctggtcccttgcctcc

SEQ ID NO: 29648 - DNA, 1089 bp, Homo sapiens
cgaacatcatggagcattgactgtgtgccaggcactcttgtaagcatgtttgtctgtcagaacatcccaatgagccagatagtgtcatcggtttacacatgaggtacctggggctcagaggggtgaagtgccttgtccgacgacccctggccaggggatgtccgagtcaggatttgggctctagtaggttggctctgaaactcacacttcaaccgctgcactctcctgcctctctgctcatggggaaatggagcatggccaggggactctaaggatcctcactgtcccctggaaacctgtgtggctcatcccagtgacgagcattgatgtgtcaaaagctctttacagtttgcaaagtactttcattcctgttgctggctagattgagttattcattctgtttttctttttcttttattaaaaatccaaatactcaaaaatcaaaacacaaaaatgtgttaagtgaaagaagccagtcacaaaaaatcacgttgtatgattctgtttgattctatttctgtgaaatgtccagaaaagacaaatccatagagacagaatgtagattagttggggggcaggggatggagcgaggagataggaccttaccccactaaaggctacaggtgttttcagggtgatgaaaatacagccctcctgggccaggcacagtggctcatgcctgtaattcctgcacattgggaggctgaggcaggtgaatcacttgagcccaggagttggagaccagcctagagatggcaaaccctgtctacaaaaaatacaaaaattagccaggtgtggtggcttgcgcctgtagtccagctactcgagaggctgaagtgggaggctcacttgcgccccagaggttgaggctgcagtgagctgtgttagtgccactacagtccagcctgggtggcagattgagaccctgtctcaaaaagaaaaagaaaatacagccctccaccttcggtacctgtggggaataggttccaggatccccctcagataccagaatcctctgattctcaagttcctgatataaaaagctgtagtatttgtatataagctacgcgcatcctctgtatacttttt

SEQ ID NO: 29649 - DNA, 1673 bp, Homo sapiens
tttatccaagcggctatgggcctccgtgtgaggtcttggtgtcatgacgtagagatggggaggtggctggaaggtggatggtcgagggcattcttttctgccttccccccagtaggggatgcgactttctcctgcaaggcgtgctgggcactggcgaggtctggcctctgggcaggggcagtacttgggaagaccaggccaggctgtgggagcctggggggtaggaggtgtaagagggctgatgcccgttgtgatcccttgagaagcttcttttgaggggcccctgaatgagcatcccccaaagacatgcttgcttggctgcttcctctctggccacactgaaacctgtcctcagcctgccttagctgttccccaggtgtgtggagtgcaggctgtgggccacctgacacctgcagaatgtggtcttcgagaatgcaggttttcgagttcctggtggctctgcctggccttggtggactggacccctttcccggctccccacgtcgctgaccctcatgttcctgcttcctctgcagcaagagtgagccatggagctacgtgtggggaacaagtaccgcctgggacggaagatcgggagcgggtccttcggagatatctacctgggtaagtgttcctagctccagctggagcccctggggccagcccatgggaccaagaggaggaaagaccccaggatttggggatctgaagtcagaatgtggctccaggggcatgatttgccccagggccatcccagatggggaaggaagcagcaggttgccgggaggcaggccagggggctcctctcgcaggccaggctgggcactggagggtatttttagctccagtttctgcaggagtcatgcggttcttttgtgcctcagtgtcccgggtcagctgggtcaccagctgggtgtgggaaaacccaggcggggttcacatcctctcccctgcttcctgggagaaggatattggtagatagaagggacttgggttgctgctggacccctagccaggcccccctctctatgtcctggcctcctggaacccagcccaggcaggctttgggatgacgcaggctcccctgtaacctcgggggtggggtggggggatgcggtctcctcattagggagttctctctctctctttttctctccggatgtgcttcctgttgaaagtatgagtatgctgtgatgttgcattttaaacaaatcactgacctctcagtcctccccttggcctgggagaaatgaggcttgcgcctttcagtgccacttctgaggggcacggtcatgagtcttggcccttcctttgtgcttattggtccaaagggaaggtatttagtgttggtgcttgtggattagcgggtggaggcttgaagttgctggagtgaggtggccagcccttctacgagttatcctcattcctgtccctgcaccctcagaagcaggctagacacacctctgtgccttggttaccctccttggaaaatgaaaatcagctctgtccagtgcagagaacaccaagtctgtgtgtcgtgtccatcagctcagaacttcggggtttctgttaccccatggttagggttccttggagtatgaaatgtgctaaggaagcctcaatggagacggggacggagactgggagttccctgaccacttccttgcagggta

SEQ ID NO: 29650 - DNA, 1156 bp, Homo sapiens
caaagacaaagatattttaaaatagcaagagaaaagtaacacacttataatggaatccccattagactaacagctgatttcccagcagaaaccttaggctagaagagaatgggatgatatattcgaagttctgaaagaaaaaaaatctttcggccaagaatattatacccagcacagctatccgttacaaatgaagacataaaatctgtcacagataaacaaaaaccaagataattcatcaccactagaccagcgttacaagaaatgcccaagggagttttacatctggaagtaaaaagatgataaccaccatcatgaaaacatgcaaaactttaaaagtcactgttagagtcaatacataaaggagaaagagaaaggaatgaaaccttatcactacagaaaactacccaacttcaaaagtaaacaggaagaaaggaataaaacatatacaaaacaaccagaaaacaataaaacgttggaagtaactcctcacctaccaataataactttgaatgttaatagattaaataccccatgaaggatatagacttactgagtggattaaaaaataagatccaactatattttatctaaaagaaactcactttactggtaaagaaacacatagactgataatgaagggatggaaaaagatattctgtgcaaatggaagccaaaagtgagcaggaatagctatacttgtatcagacaaaacagagttcaagttaaaaaccataaaaattgacaaacaagattattatgtaataataaaggattcagttcagcaagaaatataattgtaatatgtgtataattgtaaatatgtatgcactcaaacaccagatcacctagatatataaagcgaatattactggatctaaagagggagatagaccccattacaataagagttgggcacttcgtatcccactctcagcattggacaaatcatctagacagaaaatcaacaaagaaacatcagacttaaactccaccatagaccaaatggacataaataacaaacatatacagaacatctcacctaacagctgcagaatacacattcttttcttcagcacatgaaacattatccaagatagaccgtatgttaggctacaaaacaagtctcaacaaattctatcaggtatctcatctt

SEQ ID NO: 29651 - DNA, 1052 bp, Homo sapiens
catctaggtgagaattctgtagttactcattaagcaatagcatgtgagttttgtatgtagtattgatttttaagccaataaataaatttttaaaagaatttattttataggatgttggaggcatgggcaaattaaaatgtatttctattattattattatttgagatgaagtctcgctgttgcccaagctggagtgcagtggtgcaatctcggttcactgtgacctccatctcccgggttcaagcgattttcctgcctcagcctcctgagtagctgggactgcagtcacgtgccaccatgccagactaattttttgtatttttggtaggggcggggtttcactatattggccaggctggtcttgaactcctgccctcgtgatccacctgcctcagcctctcaaactgctgggtttacagtcatgagccacagcgcctggctaaaatgtatttctaatatgtacataggtttaatttatatataatttaattaatctctgattaactgaccattgataaatgagtctctgttaattgttggacttcacttactgggcttatgtggtaggatttgcgtaccctcacttattacatatgtatgtatttcatatttatggaaaatctactccttttggtgcaaaaaatgtatttgctaatagtgtcaaaaaagagaaattcattatatgtctatgtacctttttactccatcagcactgccttcagtgaaatgacaacagtaacacatgaacgaacattccacaaaatttgaggtttaagtaaatagaaagctagatgtaaacacacacatagacacacacaaaagtaaatacacacatagacacacacaaaagtaaatacacacatagacacacacaaaagtatacatgtagaaaagagagattcagatttgggaagttcattgtatggagcatccataacaatacagagtgttttagacactgttttctaaagtcttattactgtagtatctgcaggtacctttctttctttgatctagttggataaaagaggaataggtcttaagaggaatgc

SEQ ID NO: 29652 - DNA, 1047 bp, Homo sapiens
attacaggcgtgagtcacctagcccagcagggccctttaaaaaaaaaaaaacatctctagtcagaggaggatggtactgaattgtcaaggccttttgaccctctcctgccatcgtcagccttccctgggaagccccatgtgacaaggaagagaaaatctggccatctcctggtggttgtcacatgagaacacaatgccaagctcatacccttcactttttggccaggccttgcacgggtcagcctcgaattagcagctgaacctctctctcctgctaaaatggtctgtggtggcagcagcgtgctcttatttgagcaagtcactgcagaccaagggttttcagggggatgggatgtcacagaggctgctccatggggaagggtggaggtctgagaagtgccagggaagcagctttcctgctaagctccaggatgtgctgggggcactgggaacccaagacagggcccagcacatagcaagggctcaggacacctgctgtgggctgtcggggaggcaccggggtgaggggtaaaccatgtccccatcgggctgcactgtggaggccagtgggctggtgggcctggggagtgagtgttgccgctggggctgaggattgtggaagctcagaattgaccctgggcactcgataatggggaggagtgggcactgctggcgaggggatgcccaatctctgtagccatcaggggatcggctcccttacccccaaggcccctccagaggtggggaagtccaggaagagatctcgtctgcagcaccaggtgaactcgccatgtcaggaggcaatcccaccgggcagagaaccagggatcccctggaaccctgggcttgtgtttggccttgggcagggccccccaccttctctggagctcagtgacctcacccgttgaaggcctgggccgccacaccctgtcccctctgcctctatcctgcacacctgtggatggtggtccagtttggactggctggtttcttctcttcccttgccccaaaacccactccagccccctgcagggaggaagtggatga

SEQ ID NO: 29653 - DNA, 1053 bp, Homo sapiens
cctaagggctttattgtattagtccttattcctatttgtcttaaatatttcacatggaaattaaaaccagaccaggcaaagcctgacagcccgccagccctgagggggacatccgcagcccttgccatctgccgcctctgtggcctcatcctggtccactcactcccaggctcacttcacagccacaacctggccttcctgcagcttctcaacaccagactcagacttttggagtattctttctttctttctttctttctttttttctttttttttttcagaaggactcttgctctgttgccaggctggagtgcagtggcgcgatctcagctcattgcaacctccacctcccggattcaagcgattctcatgcctcagcctcccgggtagctgggagtacaggcgcctgccaccacgcccggctaactttttgtatttttagtagagacagggtttcaccgtgttagccaggatggtctctatctcctgacttcatgatccacccacctccgcctcccaaagtgctagaattacaggcgtgagccatcgcaccaggccctttttctttctttttttgagacagagtcttgctctgtcacccaggctggagtgcagtggcacgacctcaacctctgcctcccaggttcaagcaattctcctgcctcagcctcccaagtagctgggattacagccaccacacctggctttttttttttttttttttttgagacagagtatcgctctgtcgcccaggctggaatgcaatggcatgatctcggctcactgcaacctcccccctcccaggttcaagcaattctcctgcctcagcctccctagtagctgggactacaggcgcctgccaccacacctggctaatttttgtatttttagtagagacagggtttcaccaagttggctgggctggtctcaaactcctgacctcaggtgatccacccacctcgacctcccaaagtgctgggaatacaggcgtgagccaccatgcctggcctaatttttgtagttttagtagagacagggtttcaccatgttggc

SEQ ID NO: 29654 - DNA, 3352 bp, Homo sapiens
ccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccgggagctaccaatatgataggttacatggggcagactgcctaccaataccctcctcctcctccccctcctcctccttcacgtaaatgaaaccactcaagtggtagtgactccagcagacttaattacattttaaggaacactgtctttcctttttttttcctcttcgccttttctttttttttccttttttctttttttttttttaatttttccccccaaccatcgtgatttgtcttttcatgcagattagttagaattcactgccaggtttcttctgcccaccaaaatgatccagtctggaataacattttgtaaaaaaaaaaaaaatatatatatatatatatagctgactggaagagattaatttcttcccccaacttcttgcatgttgaagatatttgagctatttttcatctaaaagagtaaggtattaggcccttttgtgggagccccatgttttgtttttctgagttggtggggagggagggagggggagggctgaattgttttgcagaggaagatggcatctgtgctttaaatttctcattactgggttagaaaacaaagagggattgccctgcacattttcttttgtgcttttaaatgtttcttaagttggaacaggtttcctcgggcctgttttgactgattgctggagtgcatttgatagttaaaaattactaattggttttatttcccttcacactctgcctccccacttctccccccgttactgaaaaataaccattttagtgtcaggctagaaattgaattgctgagttttgtgtatcctttaaattaaaaaccacaagtgtttattgtagtggttaaactgtagcatctcagcatctgggtggaagctgcctatatttcttcccagtttaactggggaccatctgtgaaattaattttccatccagacagctgctgtgagcaaatgaacataaatgctcgctggaaatttactaaccagtttttatattgacctgcagtgtaaaaagcacatttaattataaacaatatattcaaaatgggcaaattttattttcaaatgcagtgtagagctagattaaaagcaactctttgccacctactctgcccttttggcaaagttaccttgaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcacttttcctccatctgaaggtaggtgagttcatcctcttcatggtaatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatggtaggcacagaagaaacatggcaaactgctctgtgctttcaaaccaaagtgttccccccaaccccaaatttgtctaagcactggccagtctgttgtgggcattgttttctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaataaggtgtgagcttttattgcttaattctctgaataattcaacgtagacgtcttaaaacagtttttgtttcaagacaaagatgggggatattggattgactgattactttcgcacctaaaactgaaaggaaaaaacttaatacaagaattggaattgaaaaccctagcaggatacctagtaggtaagggtttggatatatctgtatctgctcataagtaaaacagtgattgtgcaaatggtactcgcctaagtaccattaggttattggtattaaggtactaagtacaaggcaggtatcagccactggtttgaaaaaattcaaaccagtaaaagatgagtcacaaaactcctccagccaaacctggtaaatttggtttgcttctggcctgaaggcagtgtgaaagtgaaataagtttcacacttaaaactagctgacacctttatatcttgaccacctaaatttggtcatctacctggaaagtggaaattcacaagaacgtaccctaatattttaactggtctttagttgg

SEQ ID NO: 29655 - DNA, 4653 bp, Homo sapiens
agagcttgggattttctggcaccattatttgaaattttaacatggttatgtaaacagatcagatagcaaggaatgcttatttgatgatgattattgtttgtttttacagagttccgttctggaaaggcacccatccttattgctacagatgtagcctcccgtgggctaggtttgtatagataggtgtctctgtcaatggtatatgtatcttttggtttaaagattcgtcatttcaaattcagacttcaagtttagaaagttgtatatacatgtggttagataaatatttgaaagaaaaaaatacaaagcgtgattctccccattccctgccccccccacaattttttttaactttggtttcccccaccccccttttattttcaaagtctcttcctgctcctaacaaacaggctttggtctgcagcaaggcctaggcatgactattcaaacagagggagaggagacagacagctgaatggctcagcttctctctggtggtggtttctggctggatagaataagcctgacgaaacctagctattgtaagctagtttcttcagttattcttttccctatccctgtctaagctagatatatacagagaggtccagttttatgaatgcttattagatggaattttataagtctaatgcagtatcagaatagcaaatatgtgtattgcccagtttaatttactgaggtcaaattatcatgggcacttggctatcccctcctacccatgcacttatctgtaggtgtgttatcaactgatgattttctggagtttttgacccattaccatttaagatatacagagaattttatggtagtttagcccactattctgagctaaacaggtctaactcagaacttctatattttaaaaaaaaagattatttgtattacaaggaaatccttaaattattgacaggtatttaatttgcccagtaaggtgagaagtaccatattattcccttatactatataatataaagagaacaggtattcaaactggaatacaaaagtaatgaagcctttttatgcattgcactcatcattccctccttcagaggtggtgacctgcagccatgatggaaagttctctctgcccctctgccctctgaggtcatgtctggatctgtgccattagaacttgggcctgttgggagaggaggcggaggcctgaaagcagtttacataaagctttcagtaatggttggtttttaaacaggcttgctatgtgctggtagcttctttgtgcatcttgcctagacaattaaaaatatttgctccatgtccccttgcatttctaaaccaaattaattggctaccattagaataacttagactcttcatcccacccccactcatccaagtgaggggagagggaaggtacccgagtctgtttcttgttactcaacatcagtgcttgttttgggcccctttgtttgctgccttgtaaaaaatcaaaagagggagaaaacccaccaaaatggcagaattctgaccaatgtcctacaagatcctggaaagtgaaggcttctacctcatagacaggggtgcaattttcagctgagtcaccagggccttttttcacttcctgtcaagcgatggtctcttaaatgttcccttcaggtaagttctttgattcccataattttataatagtcatccttaggctaccacttccctttccactgggatattttttatttttccttttttttgtttgaactacacactgttaaactaaaagtattgaatttattttgttttgttttttaacagaagctttgatatcagctgcagatcactcaatacatggccgagacaaatctacattggccggaagcagctctagatgagcctcttggctagacttagtccctccttattagtgattggcgattcaggccatgtcatagggcctttcagacaaaaggttcttatcccagtcagctggccaaaacattaactttggatttcttaccctgctacagcatcttctagaaaggcagcaagataatattgtggcagtgcacagataacatcagggtagacttgactggagaaaaccaaattctgcgcttgctcctgtgtgcccccatccagctgtgcatgcacacacaggacacctttctagtatgaagaacttgcatcatgtctgccctctattgagcacccccttctagaaatacttccaagtattagcatgtgaactgttgactccaccctggtgctttctgctaggaaagcacacttaacgcatccagtgtagtaattgaacttgttctactgccatggtcatatgcagtgggattgcataaggagcattatcctagctctgaagataccatggagtagaattccccaccccctgtcttacatccaccctggccctgtaaattcttttttcctttgttgcgtcaacgaccctagccggagactcaagctgccccctgtgataagtgccttctcgtctttctggtgtgattcaggactttaggggtcagtaaagaccgaggagcctttattgtaataagaaacagacataatgccccttcttcacaagccctgtaacaacagctaattttttttttttaatctcccctttctcccttgaaattaatccagtctgggcaatagatgcagtctgaccctttggatgtaacttacatttttttttattaattatttttttctacaatcaccccaattatccttgggggaggcgttggaggacctgaaatttttacccgaacccaggttctccggcgcttggcaaccaaatggggctacagagaagcatctaagccagttcacagagcgagcgtgtgtggggacttctcactgccacggacccttgatgcatgctccccgcgctccagtggtcccgtgtcagaaggcggagttttcgaaaggaggccgccaaaaataaaaggcaaagagacgggatcggctgcagcggtttcccaaaggaggagggagtgtgcatcggtctggtaacaaacagagaatgttttttaattatttatatcacaaaaatctgtgttttatctaggatattttctgaatattctttgtaaaatgcagatttttttccacaaaacagtaggattctttgttatattcttaaaattgtttgtttaagtaggtaaaaatatacattcagctgaaagcattacactaacatttacattttaagccttaggaggttattcagcccaattcccagcagtagagagaatactaaacttgtgtctcaaggtttcatggttttcccacgttctttggctattaatttaatttcccaggtcacgtagacaatcattgataattgaaacaagtcctgagttgaaataaccttgagttgagcaaaaatatcctcattttggcagaagctgggcttggtagtacagtaaaattttagtgtaatgtgctcttgtaattgaaaggggatagataatctggatgtttctgcaaaggaaaataggtgtgtacttaacagctttggctctactcagtttcttaaaaagataagagcaaaaaaagttaaatgttaatcaaaacatttaagtttcctttaaattgtagtaataaaatatatgaagctcctttttttactttgctctgtgactggtttaaaggtaagtttgttatgttgttggtagattttgccaggcttctcccaacagagtagaagtgatttggcctcataacttcacagtggtttaccactttgttctatgttctggttttgtaaaggatagtactggaatttgcgtctgaagaccaatattggtgtaactcctgtcagtatattggtaaaatgtagcagaggcaggagtttggatgtttggatgggattcccttaggattctacagccaataaagatcctatttcctatgcatgtcccaggaatcagtaatcctcttttactctgttgggatgagtctttttttgtttctgttcagagtggttactaacttcaccttctttcctcttgctgtcatctgcattcgtgcttcccacctgttgttggcatgtcctttaccttctctttccctgccacatcaacctacacactgactcatcattgacgtggaagatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtaagggtaagtcctggagttttccaggtactgccaaggtatctctttacgccttctgtgacttgcttttagttgctgtttttaagaaggctgtaagtatgttgcttaatagcaaaggacactgcctaatgctttttataacctttttcaactaagaaaacgtgaagtttgttgtgatagtcctattagttaagctaaattgtgaatttttttttcttagagactggtctgaggtttggttttgtttgtttgtttgttttgagacggagtcttgctctgtcgcccaggctgaagtgcaatggcgcga

SEQ ID NO: 29656 - DNA, 1052 bp, Homo sapiens
ctccaaaattagtactgtagaaaccagtatattttgaggcctgagaacattaaaagcattgctaggtttctgataatccatcatcatatcatttgtcagagcattatggttaaatgcaaggattctgaattcttgagtttgaaatttagctctgctgattacaagctgtataattttgcacaattttgtgtcttggtgctgcagtttcttcatctgtgaaatgggagtaataccacttacatgagacttgctgtgaggatggtatgagttagtatttcttgagcacatagcagaacctgactcagtactctaatagttattaaaaattttaaaagcgtaatgtgcaaagaaagtactgtagccttgggagttgatattgcagacataatcgtccacataataactttctgtgtgatgactgcattgttggtcatgttttcaggttgatccaactaatggaagaaataatggctgaaaaggaaaacaaaacaataatatttgtggagacaaagagacgctgtgatgatctgactcgaaggatgcgcagagatgggtgagtatagcaccaaggcaattaacctctggttttatagttaactggaaatttctaaattggtattccaaatgttgtgtaatatttcaataatgcctatccatgcagtttgctcttttaatgagcacagtcatctattcatgaagcctgacaaaccttacaaaaattgcatgatagcatttggctttaaagttcgattttctccactttaaaagatttttaaaatattggtcacttttcttctgatagttggccagctatgtgtatccatggagacaagagtcaaccagaaagagattgggtacttaatggtaagtttaaaactaagcattttctgttgattccccaccccctgcccataagtgaatgttcatgctctatttcagggataggcaaactttctgtaaagggccacatagtaagtatgcttggctttgtaaaccaaatggtggtctctgttatagccactcagcactgctgttttaggacaaaagctgta

SEQ ID NO: 29657 - DNA, 1194 bp, Homo sapiens
agcagacaggtggagtgcttatcacagtttaataggggagcaggcccaagaagctattctaagattgagggacttgcttggagtgtatcttccttcttgtccacaatcttccctttaattgaaacttaacttaatgtcatcctttgcctgcatgtctgttacacaaaaatagagacttgtgtctgttttgtttagtaactccagcacagcaccacttcaaacagtagccgatacatacttggtacctagtaacttggtacctaataactatttgttgaatgaaatgatgctaacttgtactgagtgctggctatgccagatacttttatagtacattacacattattaggtcattttctcagcagcctctgaaataagtggtattatttctactttgcataggaaactaaggtgtgtggaagttaaataattctcttcaaattatacagtaagtggcagaataaaaactcaaaccatgtctggatccagaatctgtgattgtaatccctaggatgtatttctctcaataaagggatttttaattttttgcctattgtagctatattcataaacagtatttattgttgggtagtaagggaggttttacacatttctccatacctttaaatcacagcaaataaaatggtctttttggaggtaggctggtagtatccctagaactccatcctttttgaatattcttatggcatgtacgatacgttgctttaaaaatactgatgaactaactaaaaattctgttcctagatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccagtaagtttacatgtgtgttttaatgtacagattattgaaccaagtagatatattggttagagtttattcatacgctactgttgccgttttacattttattctagtgtggtgatatttttcttaaaaaattttttggttaatttttttttttttttcctttttgtagagaccgggtttcgccatattccccaggctggtcttgaactccctagctcaagcaaactacctgcctcagcttttcaaagtgctaggattacaggcgtgagccactgcaccca

SEQ ID NO: 29658 - DNA, 1080 bp, Homo sapiens
ctacatttattcatagatttactctttcagtattttattacgtgcatgctggtaagtatgttacaaatatgacctcatacaaaggtaaaactttcataccagccgtatgaagtagggattatccactgcattttacgcagcagcaagcccaggtttagaaaggtttccgaagttctctgctgtagacactgggtaattaacagtagataagacacagtccctgttctcaagggagtcaccatctggtagagggaagacagatgtatcaacacattaaatgctgtaagtattggacagaggaaaaagagaaaagtgttgtgagggaaaaggaaaatgggcctagaggagtgcaattttttgtaacaagctttgtggaactattaatttgataatttgataggcgcttctattatgctgcctctgaacctttgcctcctgctcctctaaccactgggattgccagcctatttccaatatgccctctttctgcctggcaaacatcttgtcttttctaaactcagcccagggacatgacatctgtaatgtgtttctgtgtgactcccaggcttctgccttcttaacctctcaccttccagctcatttgagtgaatctttgtccaagaattgagagaaactttataggtaaagcatgcacatgttgtctgatttaatctaaaatagaaataagaaaacaaaaaataatactgcaactagggacacatttagtcactcccagttcatgagacaaggaatagtaaagttcattcctaccatagcaaaagtcaggatttaaatgtaaattaatttttttaattaaaaaattttaaattaggccaggcgtggtggctcacacctgtaatcccagcactttgggaggctgaagtgggcagatcacgaggtcaggagttcgagaccatcctggccaacatggtgaaaccccatctctactaaaaatacaaaaattagctggatgttgtggcgggcacctgtaatcccagctactcgggaggctgaggcagaagaatcgttggaacccaggtggcggaggttgcagtgagccaagaccatgctattgcactc

SEQ ID NO: 29659 - DNA, 1084 bp, Homo sapiens
ttttacctcctagaacagacctaacacaaagaagacacttaacaaatatttctggacttcgtgaatgaggtcatctatgtaaactcttggccctgtgcttagcatatgactgtgctctgtaaacgtcagttcccaaaaagtgcagatgacataggtgctgcagagggacagccatcacccagagaccaagaccaaaatattattcagtgtttgggtactgcctgtcacaatggcttgaaacaagcgtgtgttctttgtactgaaatacataaactcttctgacagttatttcaggaacctagttaagagattccatttactgcccccaaaatagaaataatcaaaaactctggaaccttgagcacagctgaagttttaatgggcaaaccaggatagagggagtaattgggttttgtggtggggatagagcctctctcatcaagagcagacacgttttcccatctgctcaatgaaagagctggctgtgttcaaaatatgcatttcaatggcagtagtctgtctgagagtccacaattcaggggaatgagttgcaattactttccatctctggtctcctgtctgcccttctcttgtttaagtgttagggatttgcacagtggaaatgcaaaagtatctaaccacagagctggcttctgctatgagacccagctataaattaggacacccacctattagagactgagtcatttgttcatttaataaatatttttaaagataaaaagttttaggaaatggaatctgagggagaaaatgatagggagagagaaaaccagggagatgaaaagagcagcaggcaggatattctctcctgcgtctctttgcacagtagctcaactctgtgtccccctttcccagctccccaggtcctaaacctggagaagtagtatatagttgagagaccagactatcaaattaggcatggactagaatcctagctcttaacctggccaacatggtgaaaccctgtctctactacaaacacaaaaattagatgggcgtggtgccatgcacctgtggtcccagctacttgggggactgaggcatctcttgaacccaggaggca

SEQ ID NO: 29660 - DNA, 1028 bp, Homo sapiens
ctcccctcccaggtcagtccccagcctgtgttctgaaccttggccctcagcttcccaagtagagatgcccttagcgcccctctttcctgcatcttcatttcctcccattctgtggggtcattcccatcactgaacagccgtgctttcatcatctcttatcttgactccacatccccatcttttgctccctttcactccagaacttattatttttttttttttttgagatggagtttcgctcctgtagcccaggctggagtgcaatggcatgatcttggctcactgcaacctccacctcccaggttcaagcgattcttctgcctcagcctcccgagtaggtgggattacaggcttgcaccaccatgcccagctaattttttttgtatttttagtagagacggggtttcaccatgttggccaggctagcctcgaactcctgatctcaggcaatccacctgcctcagcctcccaaagtgctgggattacaggcatgagccacatccagcccagaacttcttgaaagatgcctctgtacccccatctctgcctggctactcctgtcaggttcctgcccccggcagccactgcagctgctcttgccaacagcgcggggaccccactggcttggactgagtcactcctctaacctgtttggtgtggttggccactcccatcttcttgagacgctttgttctcttggcttctttgttgccaaacttttgacagtgttttccttcctcactggctgacccctctccatcttctctgccagctccctgtcctgtcagtctactctttcccaagcccccttccttactgtatctacatattctccctgggtggcctcatttggtctggtagcttcaaataccgcccatacgccagtgacccaccttcgccctggcctctcccggaactcgtacttgtctatccaccagccttctcagccacaccaggaggatttgaggaacctcaatccaggtgaggaaagcacctgactcctaaccctcagtgtcctctcttgcctg

SEQ ID NO: 29661 - DNA, 1056 bp, Homo sapiens
agggcacccagggcccagcagggcccctaaccccgcctcccaaagcagccgcttcgctccgatcccgtaccacgcggatcccacacccacgagcgggcccgcttcccgctctgcaccccgcgaggccctagtacctcctcatcgtcgtcctcctccagctcctcctcaggcttctccgcgtcgcctttcgggagcaattcgtccggggactggggttcccctgcaccggcagcagcgacggcggcagccatgactgtaggggacaccggaagcggaaaggaggtgagcgcagccgaacggcggacagagctgcttttccgggagccgaggcgcgagccgggcgagagcggcgccctctagccccgggtcctccagtgcccgcagcgggtccggcagccctggccttatccgggcgtcggggcttcggcgggcattagcagcagctgagaggcctgtgagaggttctggggcgccaccgcagtcattctgttcagcgggtatagggtgagctcagaaacttgcttgtttttctttttttcaaatgcgttgttttaattccaggtaatagagttcaggggagaacaaagatcaaagggctgactctggcaagattctgggggcttgttttactttaagttcacagctaaggtaggagtggctgagtgaaaacaactcaagagatgatgagccactgtatttttttttttaacaaaagtttattcttaaatttacaacaggctccaagacaacactttattcgagcataggtggccaaagatgtggccgggaatagagatgtttaaagacgaatggagtcaggcccaccatcaccgcaggcccaagggacagtggaacaggtcgctttttgtaagattttagctttttgttgttgttgttgttgttggttttgttttgagacggagtctcgctctgtcgcccagactggatggagtgcagtggtgtgatcccggctcactgcaagctccgcctcccaggttcaagcgattctcctgcctcagcatgcaccaccaaccacgccccgctaattttttgtat

SEQ ID NO: 29662 - DNA, 1033 bp, Homo sapiens
gggagggcgtctgggcctgcgctcacgtgacgggcggggaggtttgtgtaggggctgcgagccgggtgggcgcgggcccgggagcgcgaggctgactgtccggccccacccctcgcgggccagcccttcgccgcgcggaaccttccctcgggcaggggccggccccgccgctcacttcccgcgcccgctcgccgctgaccggagttgtctcctcctccgcagggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttc

SEQ ID NO: 29663 - DNA, 1127 bp, Homo sapiens
gtggggctgtggggatgtgaaggagggtgggtgacttgtggtcttggctcacagaagacagtgaaggaagaggctcgaaagtgacagagactgagccagtgtcctcgttccccgcaggctactcggatgtggaccagcagagttccagctcgcggctccgaagcgccgtctcacgggcgggctccttactctggatggtggccacttcgccaggtgggctgcaacccgtgcccagttacttccattcttggtgatagtgctttcttacccatctctctgcagttgggcatcctgcccatgcagagagactgtaggaccattggggaaaggtcattctagaataatcactgggagcccagagctgtggggacccccttgcgtggaagggaaggagtagctgcagagcaggacagagggtgtgggcaggtgggatccaaggacctgggtcccggtagggcaggacagaggcatactggcaggtgggggtggggtaggggcagggaggacggcagacgggacaaaggagcggtgcccccaaacaccatatggagccttcggcttgatggtcattcttccaggccggctcttcagacttctctactggtgggctggcaccacctggtaccgcctgaccacagctgcctccctccttgacgtcttcgttttaaccaggtgagcgagactccacccttgccaataaatcgcaaggccctggggtgaagggacgggtaaagtgtgtcaacctgtaatggtcgattctctgagggttttccccagtttccctggagcctttattagcgatcacggagtagcttccccaaagcccacccctgcctgacagaggatggactcagagtcaggttcttctccccgaattgatagcccttcgaggcaggattccagagcacagattatttcttcttggacacattctactaaacgccacactagtctagccgtgcctggctctcagacacacgatggctttcctcctgcagggtaggcccactgactccaggcaagaagtggggtttcccagaaagtccatcttccttcttgggcctgggacaatctaaccccccgagttccccactcatggtcagagccacaaagaggctctgcctgag

SEQ ID NO: 29664 - DNA, 1043 bp, Homo sapiens
caccgccagctgggagcaccgccacctgcggaaccatggggccatatttgcctttggggccacagcacctggcacttggcaagaggcagcaggggtgagctcaccctctgcaccaggcctgtcaagggccttacaattgaatcccacaagaactatggtactattactatctctgttttacagatgaggaaactgaggctcagaaagtttcagaagcttgtccagctcactcagctggcatttccacccaggcagtctggctccagggcctgcaccatgacacattatgctctcctgcctctcaataacagcaaagaataatagtaatgtgacaaccacgtactgcctcttatggttgaccacacttcatatctgttctttcattttatcattatttatatccccaaatgtaggtactattattacacccattttacagataaggtaactgagggccagaggagttaagcagcttgcccaaggtcgcagatctagtaagcaaggaactgaaaatgacgctggcctgtctaacgtgacagttcgtgtctgcaactacgacgccatgttgctgcggcacacatggatggatggatggatggatggatggatggatggatgatggatggatggatggatggatgagtgctctgcagccctgccagagaagctctcagggccctcttctctctctatagagcatctcagttcaggcatcagggaagctgccatctggaggatgagcaggcaatgggcagaggaggggtgggggcgggaagaatgttcttggagaaggaacagcatgtgtggaggccttagggtgagaaggagtttggggcagttgagcagcagaggactttcagtgggcgtgacctatgtcctgtcggggtaagggctgaagccaggaggacagggactttattggcagggagacggggctgtggaaggattttaagcaggagagcaacatggctggatttgcctctggccgctgtgtggagggtgggagtggaagctgtggcacagtccagcggagagtagccagg

SEQ ID NO: 29665 - DNA, 2907 bp, Homo sapiens
tggttgtttgcctgtggtgtgggtcttgtccgctcatcctgacagtaactcaggcaccagtatccaaagttaagttgttgctgttggcaaaaatgaaagttccttcctcttggtgaggttcagtgacttgttcagagttactggctttttgccgtgtgcttgacatcaatcaggccgcatggagctgcagttcctctgctgtgggaggagcgctggcagctggagctgagctgtgtctaccttctcctagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggtgagctttgcggtggcttgagttgctgtgcaaacctgggggagaagtggtttcaggcccagctgttcgttgatgaggctcagagtgagcgctgggtacagcgcccgaatcggacagtgtagaaccattctctactgccttccttctgagaacagccttgtggtcagaagtggctgggatagcggagggccaggggacaacttcttaacacgttcctggaccctttgctctttgtagcctactgataactgcaaaggggagcttggaattatgttagtcagtccctgtgaatgggggagcttaaactaatggatgccttaaaaagcacccattcagaattgagttcagggtgacacccccagagcctatccagcttgacaggggagacctgtgggtaatgcacatgaaataatcttatcactccctcagatgacccagccatggttggtaattgctgagtagcaggaaggggtcagtgggaggtgctgggcgctgaggtgaagtaatgtgtatccattccaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaaggtgaggttctgagagtggctccctgggggtgggaagaggcccccgtgatggggagtggggtttctgtgcctgtcagtgctgcttcactgactgtagcttatgcatcacgtggacatcagtggcttgcttctcatggtcagttctggcccatcttgatgatttgtaaggtgccatcctgtagagtggctgtggtggggctgactggtgtggctggggatactagtcttattggtccctgatgccaccaccaggggggtgacaggcctgtgttgtacagcaggatctttagttttagcccagccgccttacagaaaggaacctggagggccagccagctttttgctctgaccttgggatacgctgtgactgggactgaggcctcagctgccttctagcgtgctttgcaggtcagcacactggcatgtctgggttatttgtccctaatgccccagccttacacccttcttgttcattcagatttataagattggccagggctaccttatcaaggacggcaagctgatcaagaacaatgcctccactgactatgacctatctgacaagagcatcaaccctctggtaagtaatgggtgttctgctctgtgaggccatcccaggcctcgtgcttttggggataggctgcttcctaggggctgctagcaggatcgttaactgaagccaacacaacacctagctgtgtcccttgtaagtggcatgttgtcatctgagtccactcgtcggggttggctggtgagaagtggggtctcaggctcagctgttcagtgatgaggcctggaatgtgcgctgggcacagcgcccgagacagactgcggaaccgttccttgttgccttccttctgagaacagccctgtggtcagggagggcctgaacctggaggggtcatctgcacgacaatcccctcctgggcctgtgctgatccgatgctcgttttccagggtggctttgtccactatggtgaagtgaccaatgactttgtcatgctgaaaggctgtgtggtgggaaccaagaagcgggtgctcaccctccgcaaggtgaggcaggtcctgacttgtcatgggggggctcttgtagagggaggatccaaggccacagacgctggtggccctgtggtgggagaggaaaggaaggagagggtgttggcagtcctttcacactggctttgaagtcctgagatgaggaaattcccagtctggccttgctgggctgtttgctgctttgagtgtgtcctcatctgccggatggtgggggaggctgaattgatcgtgtggcttcccagatgcaggggcgctgtgaacagtgctgaggaaagcctggctcctcgtaatcctaaatcccttcccctcttggcccatagtccttgctggtgcagacgaagcggcgggctctggagaagattgaccttaagttcattgacaccacctccaagtttggccatggccgcttccagaccatggaggagaagaaagcattcatggtgagcacctctgcctgcccccctcgctgggtgtggtggcttgggcagccgcctgcctttggctccagccggggtaggggtggtcttgatgccttaggcctctcttgtggctgtggagactggcccagagtcttggtctcctctagagtgggcatctgctgtcacctgtcatcttctacctctgaccactgcctctctccccacagggaccactgaagaaagaccgaattgcaaaggaagaaggagcttaatgccaggaacagattttgcagttggtggggtctcaataaaa

SEQ ID NO: 29666 - DNA, 2543 bp, Homo sapiens
ggcgggatttgatggcgtgatggtatgtgttgtaatggcggccgtttcattgtcaccggcgtcggcacggctgaatccgcgacgcatcgccgccatcccgtcttggccggcgccgggggtttgctttaggggcacgggcgacccagcggggacttcagtctggcctattttctggaaagtcgagaggcttgtgaagagcgcttggaggactggctttgggcctgcaggtcggccagagagaggccgtaagggtgggagcaggcttggaggcccggcgtttttaaagccatgagtcatttctaagtttcgacctcaccaattctatcattagttgggattagggcccataacctgcttgtctgggtagaaggaccttgggtggaggttctcggcgccgttctcattgggaggtaaagaagcttgggggaggggagtgttgtggagtcctcctgaatatctggggccgctggtgcactccgaaggcctctggagctcgcagaaaccacagatgatgaacttattgacgggcggacagaaactgtgtgctgattgtcacgttctgatttggctctgcggagttctttggcctgtgtgtatcagtgtaattagtgtccgggcaccggaggcagcctatagcttaacattgctagctgctacccagcgtttgtcccgggagtccctttctttagcggtcaaaaccttgctaattggcatataaagctgcctgttaagcagtttttagtgccactacttagtgtatttttgtgtggttagataaaaaaaatgggtcgttttcttacaggttgagaggatttgaaataagattcagcttaaattttgtcgaatacaaaagcattcttgacacgtgcgagcctggaagagataatgacctttttattcggcttgctgggtgtctggtcaggattcttcagtattgctgagatttggaacttaagcagctgggaactagagaagggggcactgctttggtttgggtgctgacggtgatttttttcccacctagtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccagtatgtacagacatcctaaaagttgggggaataggagtggagggggagggaaattgtagagatggagtcaagctgttagcagagggcagacttttttttttaagcaggagttacacgttgtcagaactgctgcgacagcagaatgggaatgcttaacttgaaaactaatattccaaggctacagatggtcagcactgtttgctttaggtgcggtgtggggtattgatttcagagcatagtaaatttgccaggaaccttagcaaagagaagttaacactagtgtggggggttggagctgctgaggctggcataagaactgcctcattcatgtttttttcacctgaaagcttgaataatggccacttacctgtgtgtgttctacttagagatgtctaacagcactggttgctgagccatggagacattaatgttaggcagttgatactgactaatctctgagctcagagctattgttagggcactgaattttccagataaatagcaatcttgtctgcctccagaggtttctgtagaagagaattgaagctggacaggtatttggctgtctagggtcctgatattttttgtttgaataacataaatgtgctttgaatgagagataggcagtaaggacagccctgtgagtccgtactgcaggtgtggggcccagttgcccttccggcctaaatgggcactttgcattttcctagaaaacattacaccccttgcttgggctcctgccaagtctgactactgctttttttttgcagaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggtaagggaggaggccatgcagtccctagcttgggagcttgggagctggagagcagggagcagcgtgtgcatggtttctcagctctgtagcaggcagggagctgctgtcttgggtttagtttgcctctcgaacagaaaaatacctgggatcagacttggccagccatctggtttcagccggaagctaacaccctcattctgagtccaggctagtgggtggtggctgaggacccagttggttgaggagtccaactagaaaccaggagaggtagcagaataattaaacccctataggggtggcaagggcctctggccctgggtggaatgtcccatttccttcatcactgagtgggcttccccagggcagaaaggtttgtcccggagcaag

SEQ ID NO: 29667 - DNA, 1105 bp, Homo sapiens
cactttgctccaagctgcatcgtctcttgcctgaattattgcagaagcctagccggtctcctgccttccacatgcccctccccccgtaatcttgttctcaacagcaaccaaagtgatcgtgtaaaatcagaagtcattccttgtttttcctctgggtggctctcattgtagtcactaaaaggtggcggtcttagggtgcctgacaagggctatatgacctacccccacccccagccaaacttggtctcttcctgctacccactccccctactccagctgtttttgttgttgtttttggtttgttttttttttttttgagatggagtcttgctttgtcacccaggctggagtacagtggtgcagtctcatctcactccaacctctagcctcccgagttcaaacgatgctcctgcctcagcctcccgagtagctgggattacaggtgcccaccaccacacccagctaattttcgttatttttaatacagacggggtttcaccatgttggccacgctgatctcgaactcctgacctcaggtgacctgcctgcctcggcctcccaaagtgctgagattacaggtgtgagccaccgcacccagccattccagctgttttgtgtttttcaaacacatttgacacatttctgcttcagggcctttgcactgggtgttccctctacctagacaaatgctctttccccggatatccacagctctcttcgagtcatttcagtgagaccttctcattccctcctatttgaaattgcaccctccacccctggaattccccttttctgtttcctcttttgtttttctccatgaaatgtttgcgcttctaaaatactgggtcctttgtccttcatctctcactgaagcgaaagctccagagtagctcccttggtgagtagtattcaggacataattgttggaaaatgggggtgggggccaagagcctggggctttcagcaggacctgtgtggagaatgcatttgatggagaagagcccagccgctgtaataacctgggaagggaacgatgaggtctttggcagggccatgggccagggactgagaatggttccagggggagtgaatctgaaatggtgct

SEQ ID NO: 29668 - DNA, 1046 bp, Homo sapiens
tagagaataagtcttccactgtcatctgtgaagacttgcggcacctgctctaccaatctctgctgcagctgaggcagtacttctgcccactgcacgtggggtgatagagccagagcccacagtcactttaaaccatctcctggattgctcagcctcccctgggctggcacagagctgcccagccagaacaacaaggcagcagatggctaggtgaggacaagtctttttttttttttctttttcttcatttttttccagtctttacctttactatatataatgtcctctgaggcttcattgcctagtgtcctttggcttgtcttatcctatgctggtcttgatccactaatgttctgtggtttgaaaatgttggtgcagaggttaagagcacagactctatagagtcaggtccaggggaatatatatatattataattagccccgtttggtgggatggctctgtgactgttgagggactggtttagtttgcccagagtctcataaatgcagaaattaggacattggactttgaggaactagagctttgctaccatgtgtcaaaattcatattccatttggcagccattcaaaatgaatggaaaatgcccatgagatcatgcagtgttacaggtttttggggtttttttttggtttttggttttttttgtttgttttttgagacggagtttcgctcttgttgcccaggctggagtgcagtggcgcagtcttggctcactgcagcctccacctcacgagttcaagtgattctcctgcttcagcctcccaagtagctgggattacaggcgccagccaccacatctggctaatttttgtatttttagtagagacagggtttcaccacattggccaggctggtctcaaactcctgacctcaggtgatccacccaccttggcctcccaaagtgctgggattacaggcttgagccaccgtgcctggcccaatgttacatttcttaaagcaggatataaaatcatattcagtgtgattacagcgctgcaaagttaagcctattttctgcatggaa

SEQ ID NO: 29669 - DNA, 1049 bp, Homo sapiens
ttttgagactgcatctggctctgtcacccaggctggagtgcagtggcgcgatctcggctcactgcaagctccgcctcccgggttcacaccattctcctgcctcggcctcctgagtagctgggactacgggcacccgccaccatgcctggcaagttttttgtatttttagtagagacggggtttcaccgtgttagccaggatggtctcaatctcctgacctcgtgatccgcccgcctcagcctcccaaagtgctgggattacaggtgtgagccaccgcacccggccgccatgggatcttttctccaagttatgaattcaaaagaactaggtgctagaccagccctgtccaatagtatgttaagtgaagatagaactatttctataagactaaccattagccgcatgtgctgttgaacatacttgagttgaaaaactgaattttaatttttatttaattttaattaatttagatttaaataggcacatgtggctattctaattaaatagtcacatttggctagttgctactgtattagaaagtggagttttaggccaggcacagtggctcacatttgcagtcccagcacatggtgaggccaaggcaggaaggtctcttgagcccaggagtttgaaaccagctggggcaagatagacccccatctctccaaaaagtttttaaaaattagccaggcatgatatcacatgcttgtggccttagcaacttagtaggctgagacaggaggatggcttgagccttaaacccagaaggtcaaggttgcagtgagctgtgttcatgccactgcactccagcctggatgacagagcaagaccctgtctcaagataaatacacaaatatatacatacatgcatacgaacaaaagaaagagagtcttagaccttgctctgttacttaggagttagaagactttgggcaactcagtaacttttctgaactcccagtttcatatagttgggataataacccatcttaaaggttactcacagaattagttacccatggagtgataacttacccacagagtgagtt

SEQ ID NO: 29670 - DNA, 1045 bp, Homo sapiens
acaaaacaaagggtgtagctttgccaaatcccaccataaatcttagagaaccattccattttagagatagaggacaccttgtctactccagccactcctttgtagagattagtaatattgctggaaaccaggactcctgactcagcctggtgccctttcttgagaaaaagatttttggcttattataaagacagtagttatttgatgtagaaaatgtagaagatacagataaacaaaagggagaaagagaaaatagattgttctattccaaccacccagattggtgactgtgcttctactctctcctgtgcatatatagaaacatgtatatgtatgtgttacataattgtgtgaggacaacagctcaaatttactgagtgcttatagaatgggcactgttttaagtcctttacttaaaatgcatttattatggatcttgctggaaaccaggactcctgactcagcctggtgccctttcttgagaaaaagatttttggcttattataaagacagtagttatttaatgtagaaaatgtagaagatacagataaacaaaagggagaaagagaaaatagattgttctattccaaccacccagattggtgactgtgcttctactctctcctgtgcatatatagaaacatgtatatgtatgtgttacataattgtgtgaggacaacagctcaaatttactgagtgcttatagaatgggcactgttttaagtcctttacttaaaatgcatttattatggatctgaggtgaaactgttactttcatttgacagatgaggaaatggaggcatagagatgttaaatatctcaaggtcacagcagctgctaagtggtagagccaaaatttgaacccaagcaatctagctgtagagccttattattattattattattattaatttatttttttttttctgagactgagtctcattctgtggcccgggatggagtgcagtggtgcaatcttggctcactgcaacttccacctcccaggttcaagcgcttctccagcctcagcctcccgagtagctgg

SEQ ID NO: 29671 - DNA, 1052 bp, Homo sapiens
atcctcagttcagttttgaactttatttaccatttacatttaaagctgtgaaattaattttatataaatttaactgaatcttttgaattaatctatgaagtttcaggcagtttattattttttaagtatcctgggaatttttttttttttaaacttgagacagtcttgctctgttgcccaggctgaagtgcagtggcacgatctcagctcactgcaacctctgcctcctgggttcaagggattctcctgcctcagcctcctgagtagctgggattacaggcatgcgccaccatgcctggctaagtatttttagtagagatagggttttgccttgttggccaggctggtttccaactcctgacctcaagtgatccacctgccttggcctcccaaagtgttgggattacaggcgtgagccactgcgcccagccagtatcctgggaaacactgatgccttctttgcagtacagccttgataaagactatttgttgttgatcaataatatcggagtctcaagctaagtatatgtgataaaggacactccactctaaaaataacattataggctgggcacggtggctcacacttgtaatcccggtactttgagaagccgaggcgggcagatcacttgaggccaggggttcgagaccatcccagccaacttggcaaaacctttgtctctactaaaagtacaaaagttagctgcgcatagtggcacacgcctgtaatcatgcctggcccccagactacatttctgattttgttgacagttcataatgtggagaaattaattgtctggtgacatctgaaccacttaaaaagagtaaatggtgatacattatgggatgatcacacagttgtggtgaagcacaaatgaacagatttctagccttgttagttcagttctgcatctaaagtgaagaacctgcctttgtggtttctttagactcttcttgatgatacacagtacagcttggaggcctttaagcagaatagagcagagcagggaggcacaggttgttcagaagctttactagctgctggtttccct

SEQ ID NO: 29672 - DNA, 1027 bp, Homo sapiens
gcaagacctgcccaaacaggaagatgttgggaaatttttagtagcaaagctgttgccattagattactgaaagtatttgaagagttttctggagataaacttaggtattttgaatttccactaggagaaagcagtagcttctatcaggtataaacaaaaattcaggccgagaaacttagcttttcagttgtgtggtatgttgttatcagaaaactttgaccagctggatgagaaagagaagctcaccagaaagtttagaaactctcacttagggaaaatagccttaggctgaggcaaacctctttcggctatggggagaatttggctttttatcaatcctggattatcctaagagtaggtcataacagggatatttttgacaaatctttctttcaaatacttaatgatattggcattatattctgtgtacaaaatacttagttgacacaaacaagatatttgcccagtaagagttagaatggatgatcttttgtgcccaaaagtgatttccctaataggggaaggtgtgaaccaggaaatatttagaatgtgaccacctctgcttattttaatctttgtatcacagatgaggaaaagttgtatagttgtttgccagtatgaaatgataagctgagcaggcactggaccctggcaaaggaagaattgtatagttaaacaatttgtggcagctttgtgacttcctcgaaaattggaaataattactcagtactaaatacaaatacaagcattcctgcccactctaaaagatactgtctaccatcttttctttctgtgcaatgtattttctgctgttagcatggatgtttgagggttgagctgttgataccagcaccttgttaaaagctaccgtgaacacaaagcatatgataatcttagaaaccaagttcttttttttttttttttggtagaggcagagtctcgctatgttgcccaggctggtcctgagctcaagtgattctcctgttttggcctccaaaattgttgggattacaggtgtgagccacca

SEQ ID NO: 29673 - DNA, 1050 bp, Homo sapiens
aacttcacttttatgattaccacatgcttttttttttttttttttaagatggagtcttgctctgtcacccaggctggagtgcagtgatgcgatctcggctcactgcaagctccacctcctgggttcactccattctcctgcctcagcctcccaagtagctgggactacaggcgcccaccaccatgcccggctaattttttttgtatttttagtagagacagggtttcactgtgttagccaggatagtctcgatctcctaacttcgtgatctgcccacctcagcctcccaaagtgctgggattacagacgtgagccactgcgcctggcccacatgcattattttttaaaaagattttctttataacgacaaggaaaataatgctaaaaaaccactctgccatcaatgacaaaaaaaaaaaactccactttctttgccttgcactcgtcaagctaaagggcagtatcaggctgagctcatggtatcagaggtctggggcattaatctcatggcaaagtcgcataaatggctgatggtggcagtatggtgagtatagagggcctagaaaagaggactatgtgacaactacatagtgcaaacaaactcagtagtgaaatttttatagtctgtcataatttaaaagtatttgtgtgtgtgtgtgtgtgtgtgtgtgtatctttgaggcgaggtcttgctctgtcatctaggctagagtgcagtagtgtgatcatggttcactgcagactcaaccttcctggctcaagcaatcctcccatctcagcctcccgagtagctggaccacaggcgtgtaccgctgcaccccagtattttttttctcctcccctgccccaataagttttttattttttgtgggaatgagatcttggtgtgttgcccaagctggtctcaaactcctgagctcaagcagtcctcccacctctgcctcccaaggtattaggattacaggtgtgagccactgctcataatccccttagccttaggtatattgtttgattttcacaacaactttttgcagtgtctgtatcttcaca

SEQ ID NO: 29674 - DNA, 1055 bp, Homo sapiens
ttcccagcaactctaactttcccttagtgtttaagctcctgaaagaatagtttacagtcattgctttctctactttctcatatcccagagactcaactgctttatggcttctgtcactacctgtcttcagaaactgccattgccacagtaatttgtgttctttttgttgcagatcaaataagccctctttagtctttatgctacttgacctctttgcatcatttgacatggttggcttctccctcagacttgaaacttttcctccacggatatctacgacttacctttttccggctttttaaactctacctttccagcgactccctttgccattcagagcttttgctatctttctctgcctacctcttaaattttgttactctccagcattcagctctggaggaaagaggctggtaagaagattgttgtattttacagtaggtttttgcatggtcatttgtttgggaggtaatgataggagcagaaatgaaaaatctttgagaagattgtgaaattggaaagtgtggagttctagaacagaataaattctagagttagaggaggtgctttttcatgaatgggtgtaccgtgtgttgagagagtggagtgagaaatgtacttctttgatctgtttcacatagaagcatgtatcatatagaaattcagtggtggccgggtacggcggctcacgcctgtaatcccagcactttgggaggccgaggtgggtggaacacttgaggtcaggagctcaagaccagcctggccaacatggtgaaacccctcctctactaaaaaattagctgggcgtgatggcgggtgcctgtaatcccagctacttgggaggctgaggcaggagaatcgcttgaactggggagagggaggttgcagtgagctgagatcacaccactacactccagcctgggtgacaagagcaagactccatgtcaaaaaaaaagaaaaaaatggccgggcgtggtggctcacgcctgtaatcccagcactttgggaggccgaggtgggtggatcgcctgaggtcaggagtttgagaccagcct

SEQ ID NO: 29675 - DNA, 1044 bp, Homo sapiens
tttgacaattttaggaatcagaaggatggtgagggatggtccaagatccagagtaggtgatctgagactaggaatttatgaattatcaactgagtcaggtttgaaagcaatattattatttccttatatctgtaactcagcctctttcctctttctcaaactcttcctacttttcttctgttattctcttcctattcttgtaatctttgttgtttctcattgtcttcattcccatgttttccttctcgtgtacctaatggaaacccaaatgacatttccattatttttctttggtccctcgacccaacatgcaaaatcaaatttattatctccacagataaaattcctcctcttttccctatttctattagcagaatactgttgtaatgactgccctggcttaaaacctttagtaatttttgacatctgtctctcctccatccccaacaatcaaacagaaacacattctatcttatataaatcctgtcttcattcattattaacgcgacaaagatttgagttcctgttctgtgccaggtacattgtatggtcgttcccttctttgcatttaactaccccaattcaggatatcaacacattatactttgcctaatgaagtagctttgtaacctccccccacaaccgcatatttcttttttccaatccagtctaactccactgccatattaatttgcttgtacttgaaccatgtgattggctaaactgtattgcccttttagaacatagttcacattttctcacatctatgactttgttcatttaagttatgtctccagcttcctgagggcaagaactttgttttatttactgtaatcctcaatacccagacagcacctggcatgtagtgggtagtcaatatttgttgaccagattggtcttgaactcctgggctcaagggatcctccccgcttggcttcccaaagtgctgggattatgggtgtgagctactacacctggccctctctagaagctttttctgatcttctgtgtatttatacctgggacagaaccctctttcctttt

SEQ ID NO: 29676 - DNA, 1060 bp, Homo sapiens
gaaatgaagggggacagaaatgatcataatcacctttaactattgttttttgagatggagtctcgctctgtcacccaggctggagtgcaatagtgtgatcttggctcgctgcaacctccacctcctgggttcaagtgaatgtcctgcctcagcctcctgagtaactgggattacaggcacatgccaccacgcctcgctaattttttttttttttttttttaagtggagatggggtttcaccatgttggccaggctggtcttgaactcttgacctcaggtgatccaactaccttggcctcccaaagttctgggattacaggggtgcctttaactattttttaaaccaaccacataggagagcaagaccttgattctaggaggctacaagtcctagccctgctgtgactgcagccttactttctctttatcctgaatcaccacgattcttctgtttgtaatattggcagatggtggatgtggtgatcccaagttcattcttggcaacttattttgaaaaatctgctgttttattcttcctgctatactcccatatcccttagttaactcctgtattgaagtacttagcacacatgacttgaatagggattttgtcataatcatttgtgtttccttagcatctagcacatggtcacttggaaaatatttgttgacacatgatgatcactttccaatgctgagatggtgtgattttgtgatttctccaatgaccttgacctagattgtgatactagtggtagtcttgtataggtccctctctgtgttgttcttcttcgtaggtgctttgttctcaggctctggaccattctcttgttttgggacattccagggaacaggagagaaaaatttgcatttaaaacaaaaggagtatgttacatcgatgttcctcattgccaggatcactggaatgttccagttgctatcaggatgaattcactgttggtaacagatgccagggactcattatatttttgttattcttcctcatttactgagatttgaccccctacctctgattgtgatgggaaagggatttcagtct

SEQ ID NO: 29677 - DNA, 1062 bp, Homo sapiens
acgcctgtaatcccagcactttgggaggccgaggcgggcagatcacttgaggttaggagttcaagaccagcctggcccacgtggcgaaaccccatctctactaaaaatacaacaattagctgggcatggtggtggccatctgtaattccagctactcgggaggctgaggcaggagaatcacttgaactgaggagacagaggttgcagtgagctgagattatgccattgtactccagcctgggtgacagaaccctgtctcaaaagagaaaaaaaaaaaaaagaaaagaaaatataggaccttttacactgaaaattataaaacattgccaagagaagttaaagaagacctaaataagtggagatataccatctgcatgatttgaaagacccaatattgttaagctgtccagtcttccccaaataatctaaagattgtgtcttccccaaaatctcagcaggactttttggggagaaattgactttctgaatctaaaattcacatggaaatacaagggacctataatagccaaaacaatttacaagaggaagaacaaacaaaattacttgatttcaaaacttgttataaagcaagagtaatcaagacaatgcagtatttaccagtcattggaacaccataaagagtccagaaatagatacatacatatatagtcaattgattttcagcaatagcgcaaacataattcagaaggggaaagtatagtctttttaacagctattgctggaacaagtggatatttgtatgtaaagaaatgaacctcaatcccagtctcatatgatacataaaaattaatttgaaatggtttgtagacctaaacatacaaactaaaagcataaaacttataggagaaatcatgggactaaatctttgagaccttgacataggcagatttttttttttctagcacgtgtaaggagcactcaccataaaagtaaaaattgataaattgcactttattaaaattaaagccttctgttctttagaagacaccataagaaactaaaaaggtaagccacagacttgggaggaaatatttacacatg

SEQ ID NO: 29678 - DNA, 1044 bp, Homo sapiens
cctcttccaccttctggtggctactggctttccttggcttgtggcagcgtcacttcaatcttcaaggtcagcatctttaaatctctctgcacatctctttctcctgcactgtttttgtcatatctctgcctccctcttctcttgtaaggacatatgattggacttagagcccacctggataattctttttttttttgagatgggagtctcgctctgtcacccaggctggagtgtagtggcaccatctcggctcactgcaacctctgcctcccaggtttaagtgattctcctgcctcagcctcccgagtagctgggattacaggaggccaccatcatacctggctaatttttatactttttagtagaggcggggtttcaccatcttggccgggctggtcttgaactcctgacctcgtgatctacctgcctcagcctcccaaagtgctgggattacaggcgtgagccaccgcgcccggccccaaaattcttaatttaatcatgcctgcaaagactcctagccctttttgctgtaaaaggtaacattcacagattcccggtattaggctatggatatcttttgggccatttttcagcctatcatagtctcttctctgctcgtctgttccacaggcaaaatacacccatctcattccaacatccccaaaagtctcaacccattgcaacatcaactcaagcccgagatctcttctgtcaccaactctgaagtttaaagtctcattatctaaatcatctgttatctgttcccaaaatacactggtcagacatgtatagtgtaacagttatagataattccggtttcagaagggagaaaatgcaaggaataaatgggttactggtactaagtaatttcaaaatccagcagggaaaatttttattatgtttcaaagcctgtgagtaattttcttttactcgagactctgccctctgagtctctggctctagcttctgctttcatagttatccttcctttttcttgaagagaagcatatatttgcaactgagtagagtttttgcccacggtgt

SEQ ID NO: 29679 - DNA, 1033 bp, Homo sapiens
tatgtcctgggctcaggtgatcttcctgcttcagcctcctgagtagctggtaccggaggcatgtgccaccacacctagctaataattttaaggttttttgtagagatggagtctctttgtgttgcccattgtggttcaagagatcctctcgcctcatcctctcaaaagtggtgggattacagacgtgaaccaccatgcttggtgaatctttttgaagctgtatgtacttataagatagttgtgagaggtaaattcagttacctgaatgtaaagcatttaacccaaaataggtatttaatacatgttaattttcatagtactcaaaaattatcctttgtagcactaaccacagttacaattaaatatgtaattttaaaatgtttttcttataagctttgtgatgccagggagcatatctgtcttttctctgccctattctcagcatccagaatagtgccaggcgtgaagtatagtagatgctcaataaatatttgtcaaatgaatgaacacccctttcctgattctgtcctcccttggcttaaaggacagtatcggggttgggggaggggggagggatagcattgggagatatacctaatgctagatgacgagttagtgggtgcagtgcaccagcatggcacatgtatacatatgtaactaacctgcacaatgtgcacatgtaccctaaaacttaagtataataataataaaaaaaaaagacagtatcctgaacattttggcctgctttgagaatcaatcaccgtgttacataactttggtctattaaagattggagctgggtaaaggggagggcaatgaatagaggaataacaatgaaagagaacagaatggtattcaaagtaaattataagaacatagtactctggactttctaactctctctaatctggtatccagtccccaattctaccaaaacagttttcattgtgatcacagctggcttacatgttgctgaacatgttgagtttcccttagtttagtaaaatgataactcttctagttactcaggaaa

SEQ ID NO: 29680 - DNA, 1048 bp, Homo sapiens
tcatgccactgcactccaccctgggggacagagtgagacactttcaaaaaaaaaagtaagggttattttcttttttgtccattgtttatgtgatcatctttatgagaagaaatcacttgaactaaagcttctatgcaagagcctttcactctttaaatttgcactccaggttcatgctctaaggttgtggcattgaagggaaagaggttgtgggtttttattctattttatttacttattctgtgttatttatttattttcatttatgagacggagtcttcttgctctgttgcccaggctggagtgtagtggcacaatcttggctcactgcaatctctgcctccggggttcaagcgattcttgtgcctcagactcccaagtagctgggaattacaagcgcctgccaccatgcccgactaatttttgtgtttttagtagagatagggtttcaccatattggccaggctggtctcaaactcctgacctcaagtgatctgcctgcctcagcctcccaaagttatggattacaggcgtgagccaccctgccaggccttatttatttatttatttatttatttatttatttatttatttatttagagagagggccttgctatgttgcctgggctggttgtgaacttctggcctcaagcagtctacctgccttggcttcccaaagtgttgggattacaggtttgagccaacacacccctcctatttttattttttttttagggacaggtgtctcactctgttgcctaggctgatcttgatctcctgggctcaagtgatcctcccatcttggcctcttaaaatgttgggattacaggcatgagccactgagccttttattctattttatagattcattgaactatttaacattatcttgttgatacttcctttccgttcagatgtttttttggggggttaggagtcctggaatgggaacagggaaccaagaacataatgtatcatatgctagtcatttgagataaatttaaagatttcttttacccagtagaagttcataggatgttatggttca

SEQ ID NO: 29681 - DNA, 1038 bp, Homo sapiens
atcctgataaatcttctgatataccagttataagccccaggaagggagaaggaaactaacattccttgatgcccactacataaaagctaggctttgattgtgttgctttaggatagggaaataggctgcaactagttaaataactcatttagggatacagaagttaacagaaccaggacttgaatctctgacttaaaagtatggtatacggttccttttaacatgcttttgtagaggtaaatatgaaagaggttagaaagttctacccatattatcattattatcattttactacatctattgcaagttactttctgtgaaatgtttcatatttgatttagtcactaaggcgatataataaataaagcttatctttataagctttatatatggcaatataataaataaaggctatctttatttatatattttatacttataaatttggtgatatttcctaaaaagtatggcctgtgggaacattcagtaaaaatggagtacattgatatatacagattccatatgaagcactttactaactttgttaaacaggtataaactttctttgagagtgcagcttaaatacttatttaagtgtatttaaaaaacgatttgtagatttacagccatttaatttacaaagggaaatttagaatttttaagttgtattaacaaagatcgttgtattatatttcgagaaaacactgtggcaagctcatatactactgtaagctccccaggggtgaggatatttgtttttcttcccagcttcaaaggcagttcttgggacatagcaggtgctcagtaaatatttcttgaatataagatgaacatgaacaaatatatatttactccgtgttcttgtgtgtgtatatatattcacataaatgctagggttgatagttgcaattgacaaacataagaaacatttctttactgagaaaaagctttggtcaggaggttatatttcaggtttttgaaagagaaaagagaaaacattgatgggttatggatgaagtggtataggcttggggagta

SEQ ID NO: 29682 - DNA, 1050 bp, Homo sapiens
cagtccctgcccccaagggactggcaacagaaggaatccctatggtaagtaaagggacaaactgaaaaaccattaaagcaaagctcctcctataacaatagattctgcaattttataaaaaatcacaacttcttgttgcaggcaaactccaccccaccaaccccaggactggatcctgccccagtggtagcagagttcttgacttgcctctgacagagaaaatgacgagggggtgaggatccagtggtcctgaagataattaattttctcattgatacaatggagaaaacagaaattaatatattaaatatcacttttcagccaggtgctgtggttcatgcctgtaatcccagcactttgggaggccgaagcgggaggatcgcttgaacccaagagttcaagactagcttgggcaacatagtgagacccccatctctacaaaaaaaatacaaaaattagccaggcctggtggtgttcctatagtcccagctattcgggaggctgaggtgggaagattacttgagccctggaaatcatggctgcaataagccaagatcgtgtcactgcactccagcctgagcaacaaagagagatcctatcaaaaataaagaaagaaagaatatcacttttcagccaagttttcagaagatgttgagagtcttacagttgttagaatgaaagcagtagtagccattaaactgcgtgtaaggacagattgtattaaactgtgtataaggagagattgtatttattttatttattttattattatttttgagacggagtcttgctctgttgcccaggctgtagtgcagtggggtgatctcggctcactgcaagctctgcctcctgggttcatgccattctcctgcctcagcctcccgagtagctgggactagaggtgcccgccaccacacccagctaatttttttgtatttgttagtagagacggggtttcaccatgtagccaggatggtcttgatctcctgaccttgtgatccacctgcctcggcctcccaaagtgctgggattacagatgtgagccaccat

SEQ ID NO: 29683 - DNA, 1443 bp, Homo sapiens
atgcgtataagtatgggtaaaaaggcaagtcactagtttgtgatgaaaagtgaaattttcatggtaaaataccagaatgtatgtacttgtgtagtgcgtacttctaaatagagaaggcttataaaagtaaacagattaaggccaagtgcagtggctcacgcctgtaatcccagcactttgggaggccaaggtgggaggattgcttgagctccggagttcaagaccaatctcggcaacatagcgagaccccatctctataaataaaacaaaagtaaatgcattaaatggaaggttgacagtttatcataaacctacaaagatgtttgtaaaattttgttttagtcattttctttgaactcacatcattataccatcttcatttttgtatggagctggttcaattctaagtcctctagactttccctgcctatctttgttgttgttgttgttgttgtcgaagacagtaaaataagtgtttttcaagtctaaaaaaaaaagaagaaaagaaaactgtcaagaactgctattctgaaactctaagtctgttttatccctgcttaaaagctttcagtatctgttccttgcatgcagcttggcaccttcagtataccagactcctgctggtatacttttataggataaaagcctgacatatcttatctgctgtgatacaaattacctcaagcttgatctttactgatcttgactgcagacaccacagcacgctgagcccttgtaacaggtaggctactcgctaggatgcctgtgctcttccacttctagtaactgagttttacgcttaccaagagtgaactgtttattctcaaatctgcttatgccagttgcatctgttactgtagggaaagcattatggtatgggtgtacttccatgccaatctgtgagtctttgactgtaccaagccatgtagtaaccccattcctctacagcaactgtggtctgtctgacaacagtcttactgcttatttcatcttattaactcccattcatccctttattctcagctacctcttcttcaggaatctttccttgtttcctgtacccaccacccctaggttttattctgggttaggtgccctttctatgtgctccaacatggcatctacctctgtcttagtgtttattgtctaacaataagtctgcatattcttcttcatcttttgctagacagtaagctccttaaaggcagagattacatttttgttatttccacatccccagtgtcttagcacactgcctagtacatagaaggtacttattaaacgttgagtgaatgaattaaatttaaaatactgctcctcctggagtcttctccattttactaaatggcagccctggtcttccagttgctccaccaaaaatcttgaatatatcttcttctctctgaccccacctccaatccatgagcaaacctttcttcttat

SEQ ID NO: 29684 - DNA, 1032 bp, Homo sapiens
agagtatcacgactcaaagaactcaagtttgagatttgttcacttggggaaaaaaattagaatagttcctgtacagaaaaagacttgttttttacataaattacaacaaatggcaatctagtgggatcttctatacttgagaccagttatttgtaatactttgattttaatcattttagattagtttatatgtatttgcatttgaaagattataacttacagggactaactcatataactttccatgaaacttctaattcatggactatatgttgaaatcttttgctttttaaattgtccaaagcggtttatttgctgtgtctgccatcccattacccaccagatatataccacccctgtgttactctctctgtcctgttcatctttctaactcttagtgcaatttaggattacagcagactcccccatacctaacacagctggactggtatagtagggcagttagctttcattttttacttttttccacttgtctaaaatttttttttcagggctcatgaacaatttttttcttttttttttcagggctcaattttaaaaagtcagttaaagtaacacatataataaatagcctactaaccttaattgttgtattttaactttaaagttcactcttccacttttttttttttttttttttttgagattgtgtctcactctgttgcccaggctggagtgcagtggcataatcttggattgctgcaacctccacctcctgggttcaagcaattttcctacctcagccacctgagtagctgggattacaggcacccaccaccatgcccagctaattttttatatttttagtaaagatagggtttcaccatgttggccaggctggtctcaaactcctgacctcaggtgatctgcctgcctcggcctcccaaagtgctgggattacaggcgtgagccaccgcgcccagcctaaagtgttttcttgagtgtgtgagaagggggtaggattacagttgacacataggagagtctacgggtctgtgttgactgtgagca

SEQ ID NO: 29685 - DNA, 1025 bp, Homo sapiens
agggaaatgttttctttttcagtgtctgagagagacagaaagaggagttttcttctgaaaaattaaatacttctactaaagcatagtagaagcttgaacattgctaatcctaatagattaaaatattgtatgtattcgttcactaaaaatctgatttgatcgattgctaataataaacttttgttcatttaaaagttgtgactcccggccaggcacagtggctcacacctgtaatcccggcactttgggaggcctgaggcgggtggatcatgaggtcaggagatcgagaccatcctggctaacatggtgaaaccccgtctctactaaaaatacaaaaaacagtcgcgtggtggcaggcacttgtaatcccagctactcaggaggctgaggcaggagaatcgcttggacctgggaggcggaggttgcagtgagttgagatcgtgccactgcactctagcctgggcaacagaacaagactccatctcaaaaaaaaaaaaaaaaaagttgtgactcccagcctgggcaacaaagtgagacccccatctttacagaaaaatttaaaaattagccaaacatggtgatatacacctggagggtatgtgcttgtaaccccaactacttgagaagctgaggtgggaggatcacttgagcccaagagttcaaggctgccgtaaaccactgcactccagcctagatgacagagcaagatcctgtctcaaaaaaaaaaagttgtgacttaaactatgtttgtgatgctgtaatggcctttttcaaacttttcagggaagcgtgacagcaatgacagtgttttttcccctggatacagctagacttcgacttcagggtaagtagaaatcatactcctatttgtatggtgtcaggaagcaaacattttcgctagtaatttctttttttttttttttgagacggagtttcgcttttgtagcccaggctggagtgcgatggcatgatctcggctcactgcaaccttcgcctcctgggttcaagcgattctcctgcctccg

SEQ ID NO: 29686 - DNA, 1139 bp, Homo sapiens
aattttcttatttaagttgacctagctcctagttatttatcatttacatatatatatatatatatatatatatatatatatatatatgtaatatatttttttcttttttcttttttgagacagagtctcttttgcccaggctggagtgcagtggcatgatcgcggctcactgcaacctccatctccctggttcaagcaattcccctgcctcagcttcccaagtagctgggattacaggcatgtgccaccaggcccagctaatttttttgcatttttagtagagaggggatttcaccatgttggtcagggtggtatcaaactcctgacctcatgatctgcccaccttggcctcccagagtgctggaattgattacaggcgtgagccatcatgcctggcctttattcaaaatttttttttttttttttgaggcagactctcgctttgtcacccaggctggagtgcagtggcacgatcttggcttactgcaacctctacctcatgattaaaatactgtatgaagccaggtgcagtggctcacacctagtactcctgcactttgggaagttgaggccagagaatcacttgaggccaggagtttgaggtcagcctgggtaaatatagtgagactctgtctttacaaaaaataaaattatctgggtgtggtgacacacatctgtagtcctaaatacttggaatgctaaggcaggaaaattgcttgagcccaggagttcaaggttacagtgaactatgatctcgccactgcactggagcctagatgacatagcaagacactgtctctaaaataattaactaattaattagttaattttttttgtaaccattattagatcagcagtctgaaacttgattttatgcctgtaaatctataccagtgggtatgcatctggattgagaaccataaaccaaaatggaagtttcatgtatatagtttcatccctaaatatatgtttgtggtttttatataggaccttatgagtggaaaaacttgttgtttgcttgttttttttcattgataatttgtgtcattgtgttatcttggatgagcttaaagaattgttggcaaagagattgttcctatttaatttaaaacacaagcaaactactatttcaaagacaa

SEQ ID NO: 29687 - DNA, 1022 bp, Homo sapiens
ttgtttttctatatagtccttttatataaaaatctgttctcattattaatcattggagtagggaggaggcagtggtgggttttcagctaaccctcttgatccagtctttccagtgctactaaatttataaaactgttacttggtgttactcatttgaattttctttttttttgagaaggagtttccctcttgttgtccaggctggagtgcagtggcacgatcttggctcactgcaacctccgcctcccgggttcaagtgattctcttgcctcagcctcccaagtagctgggattacaggtgcccaccaccacgcctggctaagttttgtatttttagtagagggggagtttcaccatgttggccaggctggtctcgaactcctgacctcaggtgacccatctgcctcggcttcccaaagtgctgggattacaggcttgagccaacgtgcctggcctgatttgaattttcatatgccagttcttgaggtagtaatagaccaatgagctgtttgggctgactgttctctttatcttggtgtttcacttcaagatatccagataggtaggcaaggacttctatgtttaggaaccttcacgtgtctatttaaagctggcagaaaagagggatgaaggtggcccagtgtttgaagaggtagcttccaggctagactttttctgtctggagatgccctgtctatgcagtacccttcaaagaaatgcagtaccggccaggcacggtggctcacgcctgtaatcccagcattttgggaggccgaggcgggtggatcacctgaggtcaggagttcgagaccagcctggccaacatgatgaaaccccgtctccactaaaaatacaaaaaattagctgggcatggaggcgggcgcccttaatcccagctactcgggaggctgagacaggagaatcgcttgaatccaagaggtggaggttgcagtgagccgaaatcccgccattgccctccagtctgggcaacaagagcaagactccgtcttaaaaaaagaaaa

SEQ ID NO: 29688 - DNA, 1016 bp, Homo sapiens
gtgagaggaacagggcctgggctcagaagggggatataaggaaagcagaacccagtgtgcctgtgtcagtgtcgtctggagaaaaagctcttgatgatatctaatagctgttattcacatcaaaactctctaaggccctccacctattttctcgtttatgggaaatgaaacattcagagaaaggacttgcccagtcacctcagatggctcagctggaaactagaagtgagatccgacatagtggaaatgtgtagcatacggtgagccactttccaacttagccattaaaaaaaaaaaaaaaacaaaaactagcaaatgctggtgaggatactgagaaaagggaactcttgcacactgttgatgggaatgtaaattggtacagccattatggaaacattatggaggttcctcaaaaaattaaaaatagaactaccatatgatccagcaatcccattactgggtatatatccaaaggaaatgaaatcagcgtgtcaaagagacctctgcatatctgtgttaattgcagtgctattcacagtagaaaaaatgtggaatcaatgcttatctacagatgaatggataagaaaaatgtaaatataccaatgggaattttattcagctgtaaaacagaatgaaatcctgccatttgtggtgacatggatgaacctggacaataaatattatgttaagtgaagtaagccaggcacagaacaaacatcacatgatcttactcataagtagaatctaaaaaaattgattttatagaagtagagagtagaatagtggttaccaggggctagagatggtaggaaggagagggggaccaggagaggttagttaaagggtacaaagtttcatttaagtcaggtactgtggtggcacagggctgcagttccagctactcgggaatctgaggcaggaggatcgcctgaacccaggagttcaaggccaacttgggcaacacagggagaccccatctctttaaaagaagaaaaagttagacatgaataagttct

SEQ ID NO: 29689 - DNA, 1041 bp, Homo sapiens
aaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaa

SEQ ID NO: 29690 - DNA, 1024 bp, Homo sapiens
aaacccgggaggcagaggtggcagtcagccaagatggcaccactgcattctagcctgggcgacagagcaagactccgtctcaaaacaaacaaaaataaaaaacagtgttattactagaaaaaagttaatccaggaggtagcaaagtctgatttacagccttgtttttaaagagataattagaagctataacttatgtcttgttgcagtctggttagaattttcagactcttcagactactttgtgcttagtggcacccatattctttgaacctgtactttttgtggatgaaatactgtgtcagaatatttgggagtatgattagtgtctattcattttttattacaggtggctttcctgggggaatgcctggtaattttcccggaggaatgcctggaatgggagggggcatgcctggaatggctggaatgcctggactcaatgaaattcttagtgatccagaggttcttgcagccatgcaggtaagacttggaagaaaaactttggactttgtatcattaaggcaattctttcataattctgtgtggagacaaaggttactctcatagctattttttatttatcacagttaccaaatagctaattatgcaagagtgacatttattttctttatgcagagtgagtaacttaaatttttaaaactaggaaatacttagcaatcggcaattatatccagttgtccttttctttgtatcaaaattgtgcttttttcatcatacagttcaaatgacttaattcagcttgattttgatacttcaagcactcatctaaaccccatttaacttaactatcaccaaattacaggtctaaataagagatggaatttaggataataaacttactgacccagtaggacactttttaaatactaatgaaccctttcttttcaggatccagaagttatggtggctttccaggatgtggctcagaacccagcaaatatgtcaaaataccagagcaacccaaaggttatgaatctcatcagtaaattgtcagccaaattt

SEQ ID NO: 29691 - DNA, 1022 bp, Homo sapiens
actaccaagaataatgcccactgagaatccagtttggaaaaaatgtttgaagggggtatgaagtatatccttcagttcagtattgccatctactaggttattttacaattttttcatggtcttgcatggacaggttgcatggacagcacttatttcttcttctattatataatttatttccttttgtatcaaaggaggaagaagccagacgacagtcaggagctcagtatggctcttttccaggtatatttaaagaaaagttaaaactgttttgttctattatacagtgatattttaatataatacttaatatttattataaagtgatattctgattttgttctcttatacagtgatattcatgaagaacctaggtaaaagaaatgatggaattattaggcataaaaatgatgttttttgtacagtgtaaaaatagcgtatttttctttcaaatgtgatcagaaattgctagtgaggcaaatctttgaataccagaggacaggactaacacagagatagaagagacggaaaaggcacgcagaagatttattgagtacttcctgattacgacagtgtggaatttatataaagaccaggacaagacttaattttttgttttttaaacaactgtctccagttgtttaatggtaactagctttctcttaaggaaagtttttagaggctacgtatgcttatatgtcactggttagaacttagttgcatgatccgatgctagaaaatctagcctttattctgaaagagtatgtgcacagcaacagaaaacaaacctagaacaaatattgaggatgacctgctgtttgaagaaaaagcaagaaattaaatttagctcatagtttacttcctatgtaaaatataaataatcttattgtcagatatctttgttttagaaagtgactgctaatgttgggctagtactagagagaattttctgttatgtacattttatttagatttgacaagctttgggtcagtaatttcgttacgggtaggcactaattttt

SEQ ID NO: 29692 - DNA, 1014 bp, Homo sapiens
ataaagcaagaagaccttgtggaagttaagaagtttcaggctttccggccaggcgcggtggctcatgcctgtaatcccagcactttgggaggccgaggcaggtggatcatgaggtcaggagttcaagaccagcctggccaacgtagtgaaaccctgtctctactaaaagtacaaaaagttagccaggtgtggtggcatgcgcctacgtagtcccagctactcgggaggctgaggcaggagaatcacttgaacctgggaggtggaaggttgcagtgagccaagatcacgccacagcactccagcctgggtgacagagcgaggctgtcttaataaaacaaagaagtttcaatcttttaaaaataataatattgaatcccaaaagtagaacattccagcttttaaggatgatttttatctaaaattgttggttaaaataattttaatgtgtttacatggtaaatccttcattttgtgggaagttcagctgtcaagaatttactctcagagattttaagatagtgggaattgtattgaatttaattatttactgccagagagttcatttggttttctgttttcttcttaaaatagggcaaagttgtaactttgtcagcaaagtgtaaacaagctaaagtgacagttgaatatgaatctcttaaatgtattttattctctgaggaaataacatccagagcatttatttgatactagtgtctggtatacatatttacatttttccctcttaatccctatagcaatttgataatattaaatatttcttcctctcccattttatggatacagaaacttaaatatactgtggcatatacttggggtatgagttcccagtctctgccttcccacggcagacatccgtaataatactcttcctactgaattcagctgtccgtctgaaacctaaacactgtgtatctgatagaaactagcaggcaagaattgtcatgcacttagaaacctgtttgttaatctttgagcttaattgtttgagattat

SEQ ID NO: 29693 - DNA, 1021 bp, Homo sapiens
ggttatcaaattaagagaaatgtgaatgaagttttatgtggtcctatgtgagaaaagtctctacactggtcctacttgattgtgtaacataaaaaagcctgtagtgccaaagtctaagtggcagtttttggccagaaagtagcttgttctaagccttggaagcattaattgaaatttcgtacctatgagttggtgttttcttccattagttaactagaatttgggatgggagaaactaaatctagcttatgagtaaatcctcttttttttttaaagtttttattttttttgcaacaatttctagctcagaaaaattgcaggtatggtacaaaggaattttttctgaactagttgagagtaagctgccaacattataccccaacaccagtgagtgtgtacttcctacaaagtctttacaatgcaaatactaaacttaggaaactaatgctgatgcatttatgctatctaatcctcagatttatgtgttgcatttagttgccatgtcacgtagtctccattctgaaacagttcctcagtctttccttgactttcatgatcttaacagtttgaatgttattggcaagttattttatagactttcaatttgggtttgtctggccttcccttaggattggatttagcttaatacatttcttggcaggaatatcacttcccaaagttagtgtactgtaagttatactatgtctggatgtcactctaaatacattcctgacgctgcattttgaaacttaggaagaacacagtgtaagaaaccctgtgtcttcattaaaatttaactacaaaggactggtgattactgtgctcttttgcaaagtagtgtttccatagaaaagaattttgtggtgtctatatgcctgttccttatcattaaatcattttactttgctgaattgcagattaggatgttttggatcatataatctttatgtttgacatgggagctattccatattaagggtactgtgtaacattttcttctatcatattaaacataatggaa

SEQ ID NO: 29694 - DNA, 1028 bp, Homo sapiens
aatttttagctccccaccaattgtctaactactggaagacttacttatatgtgaaattctgagaccatttaatattactatgttaatagtaactttatgaatattggtaagaagtctattttgcaaactcctcaaccgggaaatgtcaggattaggaattgagggctaggttttagtcgttttctctattgaacagcttgatgatccaaaagccttaagatatttgtatgcttttatcctaattataggaaagaacctgcagttaataaattctttctaaaattccaggtaacgtagacaagtatcacaggaagaaaatagccggctccaagagctggctccactttacattaagtggatacaatgtttttgtttcattcttactagtgaggaagaggagacacagaagaacaaattaaaagcatgtgtaagaacagtgtcctcctgacttgtgctggagtgattgtgcctatgtagagaattccactttaaggtttgcaaaatatttgtcaggcactactatctcccaaacaaaaacaagaaatagtcatataccttattttaacataggtaattccagtttttctttctgattccacttacattctttagccatcctgagttggctgaagtatggggtgaagcatcatggcatatgtagggactttattctgaacttaaattgagatatttaatatagaagctttttctctttatttctgtatttaaactaagatttttataaactctgaggcctttgcgtttgtgtcagtttctctctctgccttcatcagtctgcagttcgagattgtggcagatggggctgaatgtggagacttctaggtccagacgtcttcctaggcctgatgctactgttagggttactcaagttgaaaacatgtgtttctcacaggcttagctgttgaagaacagtacatctgcctatttgctataattgctagcattgtttatagcttagttttatttgatataaggatttattagtttaaccttttaaattgcacaaa

SEQ ID NO: 29695 - DNA, 1047 bp, Homo sapiens
gattggactctagtgggccagtcctatgtggccactggcagccagtaaggattccctggcctatgtctgctggaagggcccttggagagcctggctgagggggccttcattctggccagctctgggctgtgtggcgttgggtgcctggctctctgagcctctcgcacctcccatccccacccacggtgtgcagaaggcagagggctaatgtctctcttgctgagtcgttgtgcaaattaacaaaaatgagtctggcaccaaaatggcccccacacttggaaaacaggccaagaggcatccaccgacctgctgacccctctttccccgcaggcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattg

SEQ ID NO: 29696 - DNA, 1045 bp, Homo sapiens
atttaaatgttttcttcagcaaacagtatcctaggagcattgctcatacgggccggaatgtcctggctgcccatcgaggctgtctgtagataccctttgcctgcttcagtgccaagtgaacatcgcagagatctgccttgtgtctccctgcacccctggctgcaggggagctcctgctgcctcctctggagctggtgggggcctcactgccatccttggatccctccctgccgtcagcctgctgtcctcagtgcactgggaggagggggtgcgctgtggttgtgttgagccttcataggtgtcctctggtgggcttagaatgggggttcttaatcccccccagtatgtggatagaattcaggggtctgtgaacatggatgaggaaaaaataacattattatttattactaatgtagctaaaatatgtagtgtgacctttgattataaatgtagacaataaacctcacagcattagaaaggcctgtgactacccacataacaaacaagcacatgtagtccctgaacccaaaaaaaaaaaaaattttattgaggcagggtctcgctctgttgcccaggctggagtacaacggtgcaatctcagcccactgcagttgaagcttcccaggctcaagtgatcctcccacctcagcctcccgattagctgggactacaggtgtgcaccaccatgcccacccagttaatttttgtattttagtagagatggggtttcaccatgttagccaggctggtctcaaactcctgacctcaggtaatccactcgccttggcctcctaaagtgctgggattataggcataagccactgcgcccagcttaaaatttttaaaaaaataaaaagaaaatcttgtgactttatccccagtggaaatcacaggtatttcatatgaagttatagttactgctgatatatagaaatatttctcactacatcaaaattacagtaatagtggacccacccctagatcttgttatttggtgcattaacaagaagtttgtatatcactacagcatgcgtttggagttttt

SEQ ID NO: 29697 - DNA, 1031 bp, Homo sapiens
aagttgtgcactggtgtgtccaggggaggagagggagtgtactgaactcttactggttgtcaggctctttctgctacattgtctccattatttgtcccagcagctctgtgaggtatcattgggcctattctaacaatgaggctcagagatcatttgcccaggagcaagctcccctgcactttccatgtttgtattgggcatccctttgtgccctgccctttctttctcaggaggggatgataggtaatgaggggccacagttagtgccagtcccaagatacagcctctgactctgacttaatatccggtgttgtccccacccttgcccttaacccccatgatcccaggcaggcctgggaatagctgcagctttccccagagctgaggctctggtggagctgcattaaaacaacctgggccctcttgggagatgctggttcatgcaaccagatgtacctgggagagggatggctgtctgtgtgtatacaggtattgcaaccacagaaaactaggaaccagagagcagaccctgtcttttcatcccttgtcaaggcttggctgccactgaccaaccctgaatcacctggcacctgcaagtgaaggcacctgcatcaagtgaggcctcctgggattctggcccaaccaggggaactggtctggacatgcctggttgtcatgttgtgtaggcagccttgttctcctctccaggtcggaggctgcttgagtccttgggtagctgggagcgtgctgatgcatgttcctaacatctccataaggtctaacgtttatagacttcctccctgtgcatttatcactttttttttttgagatggagtctctgtcacccaggctagagtgcagtggcacgatctcagctcactgcaaacctctgcctcacgggttcgagcagttctcctgcctcagcctcctgagtagctgggattacaggcgcccaccaccacacccggctaatttttgtatttttagtagagatagggttttgccatattggtcaggatgctctcgaactc

SEQ ID NO: 29698 - DNA, 1048 bp, Homo sapiens
cccgcagagccacctcccagcaggcccacgcccgcgggggccccgggctggcgccgctgtccctggaatcgatgtgagtcactgctgacgctttgcaggagcatgcatctcacctcagaaagtctctgacgttgctgcggagcggggagaggatgtttctctattagccctttgcttttgctctggcgctgatcctttgctgaccttggacaaatcaatttacgtttctgtgctccagtttcttggtttataaagtgagtgtggaggggtgcatctctgtctcgctctctcttggactgaggaatgggcccccgttcagctgagaagttctgtccctattctatctggaggcttcaccaccaccttttaccctcaaattgtcccatctcagaactgcaagagatgctggggtttcaggttaatttttttgttggtttttctttaaatttttttatctttttagagacggtctccttctgtcacccaggctggagtgtagtggaacgatcaccgctgaactgcagcgtcggcttcctgggctcaagcgatcctcccacctcaacctcccaagtcatggggactacagatgccatcacacctggctaatttttaaatttttctgtggagacagggtctcattctgttgcccaggcttgtctcgaaccctggtctaaagtgatcttcccgcctagcctcccaaaatgttggaattacaggtgtgagttattgcactgggctggtttctggttaatttattttttgaaacagggtctccagaagtacagcagcaagatctcagctcactgtagcctccacctacggggctcaagtgatcctcccaccttacatcccaggtagctgggactgcaggcacctgccaccacacccagctagtttttgtatttttagtggagacagggtttcggcatactgcccaggctggtttctaactcctgtgctcaatcgatccgcccacctcagcctccggaaatgctgggattgcaggagtgaaccattacacccgactctggttaattttttttttttt

SEQ ID NO: 29699 - DNA, 1005 bp, Homo sapiens
tccccttaccgggcatgcgtattgcggccagttgggccttcgcaaagtgctcagggaagtgtagtgtgcagggaaagtaggtcactcctgctatcgcctggtccggaggtgtttgaggactacaattcccagagtgcagagcgggccctcaccgcccgcctctccgcctacgtttgggttgagtcgagttttcctagctcctgaggaacatggagtgccctagaaagggtcttcatagccgaaaggggccttgttgtcagacctaaggttgaccggtctgtgtctagggggagatgatgagagactgggcgcggtgttgcagtcagtcagcaccagtcctggaagcctttcaatacacacccgcctgtctgggccgctgcctctgggaccagcgagttggggcggatcccgtgtctcaccaaggagaggagctgcctgcgtttggctctcactccccggacagcggcagggcactcgcatccacccggtctgtgacacctgctggcccctccacacttagttgagtcctgtagtccgtcattgtaggacagtttgcacatttaaggcttagaggtgtctgagtatctttttgggtttggggctcagtggattccatcaccattatccctccttttcctctttgaaacagaattttctttctgaaaaaccttccggccgggtgcggtggctcacgcctgtaatcccagcactttgggaggctgaggcgggcagcggataacctgaggtcgggagttcgagactagcctgaccaacttggagaaaccccgtctctgctaaaaatacaaaattagccgggcgtggtggcgcattcctgtaatcccagttactcgggaggctgaggcaggagaatcgcttgaacctgggaggcggaggttgcggtgagccgagatcgcgccattgcactccagcctgggcaacaaaaccgaaactccatctcaaaaaaaaaaaaaaaaaaatcttctggctaggcagtgactcacgcct

SEQ ID NO: 29700 - DNA, 1051 bp, Homo sapiens
aagggtgaaacttttcattgactttgctcacttcgggccggggcgcgggaaggtgcgggttgttggctgaggcaagccgtggctcgggcgacgcggggccaggagggcaggaccgtctgccggcgacagcccataccgtctgccgttgcgcgacacgaaccaccctccgatccgccatccccgcgtcgtcgccgctagtccgcccgcccgccctcgggccccccgctgccgagcccgacctcctaagagctgaaagaaattattgagagtcatagtccatagccccctgcttcgtcccccaaccctcaacgacgaaaaggacttcggtcccctggcccggcgacgcccgggaaggaaaggagagcgacctccgccccgcgctcaggccaccctggagggagaagccgccccgcggccggtagagcgccccgccgccgcggagacccgagtgagtgagttggggggcgtgcgggcggggggcccgccccgagacccagccggccggactacctcttccaccccgccccactcccgctttgctggactctccacgttgctgccgctccctccccgcctggccagcattttctttccccatccagcttccctccagaccccactttccccagctcctcttctcacgccatctgtgctcctggggtgcccaagagctcctttttctcccagttccaagagtggccctctcctgggtggggtgcatttcctcccttccccgcctcccccggttctttatatcctagctactcgctagatcttccttgttctccaaagaaacataactccccccaccgttaaataaatccgaggaaggaaggggatccaggccttgtttttctgcttcttttcccgtgtgcagggaaggggggtggtaattgttaatagactctatttctggctctgtggagcctgaagggtggagggtggacaccccctttggcgacgggacaggtcagtggagattgtccttgggccactgagccagagttcaccgtttcggctgagctctttatactcttaagtgttttaatgg

SEQ ID NO: 29701 - DNA, 1084 bp, Homo sapiens
agcatggtacttgtattttggtgctgtccctgtaagtcatccagaggtatcccctgtagggtgtctagcacatagtaggtgtttgttaattacttctggtctataagcagtgaaagcatgataaggtaacagcagtgaagaaaagtaacaaacagttcctaaactagatacaggatatctgtttaagccatttaagacagcattttcttgaatttttgcatgggtctagctagagttcttatgtagcgtaagcttgcaaccagagaatgcttaataaatgttaattgctgtctgactcctctgaatgtggtgtgtgaactgatacctttggatcctcatgcctcattctgtccctgagacttattctagatgtcacttcccctacttcacattatacacgaatgttctgaggacatttgagatggaatctagctcacattttcagcactagtttccaaggaacacaaagaagtccagtgacatgatccaggctctcagccttacagatcatcatgtagattaagtggccgaggctctttcctatgcagaaaccttcctacaaccaaggtaccccttgttattattgtcttcctgcaactttcataattgataagggaattagacaggtaagctaagctaggtattctcatttataatttttcaaagccacaagaataaccaggagacagggatgatgtctatggacattgctaccagaggactgatttgtaggttcttatggtgccacatcatgtaatccccttaatcttgattcctttattccttttgtttaccattttcctcagttcgcccaaccagaaaataagaaaaatagcactaacatttatgaagctcttaatatatgcaaggtacttagctgaacattgttttccaaaagttctgtgtgatacagatgaggatgctaaggcttagagatgttaagcaacttggttagcccaaggtcacgtggctaataagtgacagacccaggactagggcctaggtggtctgactctttttttttttgagacgcagtttctttcttgtcactcagactggagtgcaatggcacgatctcggctca

SEQ ID NO: 29702 - DNA, 1048 bp, Homo sapiens
cagcagcgacaaaaactcgcgcgagagcaagacgggcctggtgcaaggattgtaaactgacggaagcttagagaaccaatcacagcgacgtggaggcaggaacaatgggggttaaaggtcggacggaagttcccgaagcttccggtggccggcttagttaggagctatggctaaacatcatcctgatttgatcttttgccgcaagcaggctggtgttggtgagactgcgccctacccctggctgtctgggcaggggtggtattaggagctggggggtcgggggttcccgtctcttccttaggggcttgcctcgcaggcgccacgtttcccgcctctcaggcgcggggtgttgtaggagcgcgcaggtttgtggcctctgatgagaagagggcgggggtgcgcgtgctgggagccccaggcaggtatcggggggtggggtctgaaccaggtccagagaaactctgagcttgcccagggcgttggaggagattcaggagggtgcttggatgtaggtttggttcatatggaaatttgtaatgataaaatggctatccgcaggtctcactcactgcagtccttactcatgtccctacccccagctcgaggatgtacttctcctctttctcaaaacctttattctaattgtactttttaccatctttcatcttgcagccatcggaagactgtgtgaaaaatgtgagtggaacacaccgtcccaacaacccacccttcccactcccagttttctgtggaaccagcaaaagtgccacaaagagggctttgagtagatgtgcctggaagtatgtgaacactgaatgctgcactttagccaaaggcccctctaactccccactgccgcttgcacatttaacgctgtatctctctagttttcaacgggaagaatcgccagagtagcatgacccctccccaacacacagcactttgccagcaattatacaggcttatcatctccgaggtgcttttctaagctcttcacatatgttaattggtaaacttttgtatgtgttgaggggcttgagatggacac

SEQ ID NO: 29703 - DNA, 1048 bp, Homo sapiens
agggacatagtggtggccacaggtacccccctacctggtcctcctgggtctgtacctcagggcaaataactctccctctctgggtttcagtggcctcatcatgtggaaagggttgttatgagaatttacggagagactgtaggaaagggatttgtaagcagcagcccatttgttaaggggccaagggtgcttatctctgtttttagaaaagtagatccagtccataggagacaaacacccctcctgcccagtgggccaccttccagatgttctggatccaagcactacgggtagggcccaggaattcgcacttcatctgtttctaggaattcttcagtcatggaacaggaaaatgaagatacctggtcaagtgtcctgtgtggtggtcagcccatagtaaaggaataagcatcagtttggtttttttgttttgttttgttttggtttttttgacacagagtcttgctctgtcacccaggctggagggccgtggtgcgatctcggctcactgcaacctctgggttcatgcgatgctcctgcctcagtcacctgagtagctgggattacaggcatgcgccaccacgcccggctcatttttgtatttttagtagagacggggtttcaccatgttggtcaggctggtctcggactcctgacctcgtgatccaccgcctcggcctcccaaagtgctgggattacaggcgtgagccaccgcgccggccgtgttacagttcttaaaggtggcgtgtccggagtttgttccttctgacgttcggatgtgttcggagtttcttccttccggtggcttcgtggtcgcgctggatcaggagtgaagctgcagaccttcgcggtgagtgttacagctcttaaggctgccagtctggagttattcgttcctgctggttgtgttcgtggtctcactggcttcaggagtgaagctgcagaccttcgcagtgagtgttgcagtttataaaggcagtgtggacccaaagagcgaaagaacaaaccttccacgttgcggaaggggaccccagagggttgctactgc

SEQ ID NO: 29704 - DNA, 1050 bp, Homo sapiens
tagctgggattacaggtgcgtgccaccacgccaggctaatttttgtattttcagtagagacagggttttgccatgttggccaggctggtctggaactcctgacctcgggtgatccacctcccttggcctcccaaagtgctgggattacaggcgtgagccaccgctgcctggccagaaaatacctttgatatggaaagaataatgatgtgaggcctggcgcggtggctcacgcctgtaatcccagcactttgggaggccgaggcaggcagatcacttgaggtcaggacttcaagaccagcctggccaacatggtgaaaccccgtctctactaaaaatacaaaattagccgggcatggtggcgcatgcctgtagtcccagctactcgggaggctgaggcaggagaatcgcttgaacccgggaggcagagattgcgatgagccgagatcgtaccagtgcactccagcctgggcgacagagtgagactccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgacc

SEQ ID NO: 29705 - DNA, 1066 bp, Homo sapiens
tagcagggcagcagcataccaaagagatgtgctgcaggactccggaggcagcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatgacagaatggcagtgcctgattcttagtaagtatccggctaaaattggaatgaagacatacttagctttactagagtggtgatagctgcttaagactttttttttcttctttgtgaaagagtttcactcttgttgcctaggctggagtgcaatggcacgatctcggctcactgcagcctctgcctcctgggttcaagtgatgctcctgcctcagcccccaaagtagctgggattacaggcgtgcgtcaccacgcccagctaattttgtatttttagtagagacagggtttcaccatgttggccaggctggtcttgaactcctgacctcaggtaatctgcctgtctcagcctcgcaaagcgctgggattacaggtgtgagccaccacgcctggccacttgcttagacttttttttaccagaaggctatggaagagctgtctcctcctaccaggtagtttctaccttggcagttcaaaatgtcgtcttatacacactcaactggagcattgctatcactggaactggctttctcaacctccgtgctgttgacatttggggctggttaatttgttgtgaggactgccctgtgtgttgtatgtttagtagcatcactggcttctacccgctaggtggcaatagcagcacccccccacaaccaaaaaatgtttccggacattgtta

SEQ ID NO: 29706 - DNA, 1049 bp, Homo sapiens
ttgtgtgtttgagggttagggagcagggcagctgccccctgtgtctcaattgttgattagtattttgtgactcaggtaggaaaacttctggctcaatttgtctgatatttttatgtcccccccatagactgaggctgatgtgaatccaaaggcctatccccttgccgatgcccacctcaccaagaagctactggacctcgttcagcagtcatgtaactataagcagcttcggaaaggagccaatgagggtaaggcagccacaggatgctctgggggaatgttaaaggcacctgtttccatctggggcctctgatctgatttccagtttgggaggagggctagctgctctcgactacaaccagtgggaggactttggcattagatgctaaagctgatgggctaagaattttttttagacccaccaattgttaacattttgccacatttaccttctttttcactctataagtgaattttatttttgctgagccatttgaaagcagttgtggagactgtatagtggctgtatgacctcaccagagccatcagaaggaaagggatattaatgctttttagcatcccttatacggtggatacttaacattcatgaatttcatttggttcccagaaacattccctacccctctcccttttttttttggatgcaattattcaaaaacatggaacgtttcacgaatttgcatgtcatccttgtgcaggggtcatgctaatcttctctgtattgttccaattttagtatatgtactgctgaagcgagcactacctccctttgtaaaaaaggaaaaaaaaaaagctgtttttcagtagaataattatgtatgcatgatgcttctgcccagaggtgatataggatactctcactttattcattattatttttttaattttattttatttatttatttatttttttatttggagagttttgctcttgttgcccaagctggagtgccatggcaggatctcagcttactgcaacctccgcttcccgggttcaaatgattctcctgcctcaacctcccaagtag

SEQ ID NO: 29707 - DNA, 1056 bp, Homo sapiens
agtagctgggattacaggtgcctgccaccacacccagataatttttgtattcttagtagagacgggggtttcaccatgtcatccaggctggtcttgaactcctgacctcaagagagccacccaccttggcctcccaaagtgctgggattataggtgtgagccactgtgcctggactgccccagctaagtttttaaatatttttagagatgggggtctcactgtgtggcccaggctggtctcaaacttcaggcctcaatcagtccccagcctcagtttcccaagttggtgggattataggcctgagccactgcagccagttcagaatacactcttcaaacatggaacgtttttgaaaattggccataaagcaagccctgcaaattttaacattggtaatattacataccatttttgcctaacccaaaaggaaataagttaaaaattagtaacaaagtagtttgaaatgaaaaatataaactatcagagagatttaaaaattgtagtaggaattcaaaaatagaacagaacaataatgaaaataccacataccagagcataagtgacaagggcagaggggggaagaaacaaatgaaaggatataatgaaagtattacttggagcctaagatgctaatgctagggagaaacgggataaaaaggtagaaaaaaacactagcacaaaataaccccaaagaaagtagaaggaaagaaaaaaaacaaaaggagaaattgctgaaatagaaagtagagcatactgctgggtcttttcctttccgaagcccctctttctcaccagagagagctgttctttctctttcttttgcctattaaacctctgctcccggccaggcgcagtggctcacacctgtaatcccagcactttgggaggtcgaggcaggtagatcacctgaggtcaggagttcgagaccagcctggccaacatggcaaaacccagtctctactaaaaaatacaaaaattagcccggtgtggtgacgcgcacctgtaatcccagctactggtgggggctgaggtaggagaattgcttgaacccagga

SEQ ID NO: 29708 - DNA, 1066 bp, Homo sapiens
aggaggctcctttgtgtagaggccagggcaggcgtgtgaccttgaaccaggtggacatgaggtcccttgaactcccttctctctctggcttgttcccctgaagcactggccccccagtgctgggcttatttggccatcctgtgccagccccctggtcacccaccgtcacagtggaagctgctccctcctcttacaatggtgttccttgctctggggtctggggacaagaccatctctttccactcctggacgacactgtgcactcagtcagccgcctcctacctgccctcctgcacagggtcagaacctcctgacctggacttcgccctgggcagcttccttggaacttgttgcagcttagcatctttggaagggagcactggactaggagtcagaaggtggagttctgggtgctgttttcccactcttgggccctgggcatgttctgttctgtgcatcagatgttttctgcctgcctccccctgagctgccaccagagccacctgtagacccctgcttctcctgcccctcctgtcccttgccaggcctctggactcagtgcttcctgtcccaaggacctgttgtgtgcccagcttggaagacagtggccactcacatccaggtctctgcctggctatttgctccatgaacccatctcagatgcccctgcccccagggagccaggtgacagggtgaggtcaagtgacaagcagtaggtgtgggagaggtttggtggggtcaggcccacatgggcccagccatccactccccttccatctggagttgggggagtctgagctgctcctggccaccccatctgccccaccccatcttttcctggccaccccagctcccaccccatcttctcctggccaccccatctcccaccccatcttctcttgacaccccatctcccaccccatcttctcctggccaccccatctcccaccccatcttctcctggccaccccatcttctcctggccaccccatctcccccaccccatcttctcctggacacccccatctcccaccccatcttttgctacagccagggttagctcagc

SEQ ID NO: 29709 - DNA, 1048 bp, Homo sapiens
tgctctgtcgccaggctggagtacagtggcgcgatctcgcctcactgtaacctccgactccttggttcaagtgattctcctgcctcagcctcccgaatagctgggattacaggcacgcaccaccacagccagctaatttttgtatttttagtagagacgggatttcaccatgttggccaggatggtctcgatctcctgacctcgtgatccgccctgctcggcctcccaaagtgctgggattacaggcatgagccaccatgcccggccttgttttgtgttttggttttttttgagacagggtcttgctgtatcacgcaggctggagtgcaacgatgggtccccagctaattgcagcctgggctcaagcaatctttctgcttcagcctcctgagtaggtgggactacaggtgctccaccttgcccagctaattttttttttttttttttttttgagacagagtctcgctctgtcgcctaggctggagtgcagtgacgcaatttcggctcacttcaagctccgcctcctgggttcacaccattctcctgcctgagcctcctgagtagctgggactataggcgcccgccatcacgcccggctaattttttttgtatttttagtagagacggggtgtcaccgtattagccaggatggtctcgatctcctgacctcgtgatccgcccgcctcagcctcccaaagtgctaggattacaggcgtgagccaccgtggctggcctttttttttttttaaagacagggtctcggtatgttgcccaggccagtctcaaactcctggcctcaggcagtcctccccgaagggctgggattataggcaggaggcgccgggcctggcctctatttctttaatacctgccctcagagccgtcctgcttttaaactgatgcaaatggcagcagtgaataatcaattcatgggttcgcttgctttgggatttagtacaagattattttaagaaataacaaaggagaaaagattgagctggattttgctgattctcaggtatctgtaccccagggtcaaccctgagat

SEQ ID NO: 29710 - DNA, 1043 bp, Homo sapiens
ctgctgggcctggcactggtcctggcgctggtcctggtgggtctggtgagctggaggcggcgacagcggcggcttcgcggcgcgtcctccgcagaggcccccgacggagacaaggacggtgagttccgtgtgtaggggaaccagtctgagcggggcgcaggggctggggtgtcgggacggtctagggggagatgcatggcccctgagggggagagaagggctttaaggggaaacggagacagagtggaaaagagtttgcgctgaggagctcaggctggggagggagacatagtcctgcccctgagaccctggtcggagccaggaacagctctgccctgacagaccccagtgtgaggaagagacaggttgcaggaagggggccccgtctgagggaggagtctgtcctgccctttgggagtctaacggagcttggttcccccataaatccctgaagagtttgccagactgagccccagctccccaactccctgccctgccagctccccactggccaggcctctggactcagggtcagccaggtgccacccctccccaccctgcattgggcttcatttgacggaggactgcccctccagaggagtcttctaggggagggagggaaggctgtgactgagtacggagcctctaccccctctgcctgcagccccagagcccctggacaaggtcatcattctgtctccgggaatctctgatgccacagctcctgcctggcctcctcctggggaagacccaggaaccaccccacctggccacagtgtccctgtgccagccacagagctgggctccactgaactggtgaccaccaagacggccggccctgagcaacaatagcagggagccggcaggaggtggcccctgccctccctctggacccccagccaggggcttggaaatcaaattcagctcttcactccagcatgcacatgccctctttctgggaccaggctaactctgcagaagcacagacactacagaccacagcattcagcccccatggagtttggtgtgcttgcctttggctt

SEQ ID NO: 29711 - DNA, 1399 bp, Homo sapiens
ggtctgggtggcatgtgtggcatttaaccccatgctctctgctgagccctgagctcccagagttccctccagccctggccctggggagggggtagcatgtgaccaggagggcggaggggcttgtgtgtgtttctgagacgcagtctgagagagacacgggtgacagacagttggggaccccaaacactggggagcagagatagacaggaggggcccgcagtgagacacagaggtgagcaggagaggacacatagccctggagaaaaggagcaggtgtgggcgggcttccctccactgcagtcacagttccctcactcataggcagatcttcctgggtcctccctgcacaaagccccagtggctccctcgtgtcccccagccacagtccaagctccctaatgtgctagataaggccccagtccagcctttcggtcccagcactccctggacttcctgtttgggcctccaagcctttgctcccctttggccttcacccccatctgctccctagacctcagtccatctggcaaacacttcaccatcgccctctccatgaagccttccggcccaccttccaggatgacgtgagctggtgcccttgctgcgaggctgtcttcccccatcagcacaagtgtgagattccctcagggcagacccacatgctacttgggcctggtacaagtgtctgatgtcaggctgggcactgtggcttcacacctataatcccagcactttgggaggccgaggagggcggatcacctgaggtcaggagttcgagaccagcctggccaaatggtgaaaccccacctctactaaaaatacaaaaattagccgggcatggtggtgcatgcctgtaatcccagttactcgggaggctgaggcaggagaatcgcttgaatctgggaggcagaggttgcagtgagccgagattgcaccactgcacagagccagactctttttcaaaaaaaaaaaaaaaaaaagcaggtgtctgatatccccaaccagctctgtccaggaagggcaggaagagaggaggagacaggtgggttgggggagatggcaggggagcactcggggtcatggagaggctttggctagacggagcagaggaaccactcagggtctgtgtcctggctgcggggtccatccccctccctacccaagaggaggctctggtctgcccccagacacctcccagcacccagcagagggcccacccaggcggtgctggttgaggggctgaattggggaaccacaggtagaaagagaggccaggccgggtgcggtggctcacgcctgtaatcctagcactttgggaggccgaggcaggtggatcacgaggtcaggagttcaaaaccagtctgaccaagatggtgaaaccccgtctctactaaaaata

SEQ ID NO: 29712 - DNA, 1066 bp, Homo sapiens
atgtgaggccaggcacctgcacacaacacagacacgaatcccgcaggccttttgtcccggcacctggcccagcacatagggagcgcccagcaaacatttgtgtcacatgagtgggtgtctcatttgtgtctgctgctcttagcagctggcctccctctctggccaaggtaagggaccctggaactctgacagtgggctccagccctcccactctctctggccttgagagcagtctcctcgagtctctgctgggggtcagagcagccagtgcttctgctgtgaaacgcagacctggggcaggcggaccccctcctcctaactcctgtaaattctcccgactctggcctcactgggccaccctctccagggacaggttccccgttcctgggttcccacaagcctcagtctgcccacatggctggcacaagggctaaatgagctgcctggtactcagtcaggcctctgcagccctcactaatgggtaataccagcaccaacatggatggacgtgtatgtgggtggcagggttatggctcagtcttctggctttgtccccacctctctgcctcacagagaggccttccctgccctggctcccctccagggtcctgtcccccatccctgtaccgtacacccacgctcacccacacctgcccccacccccacatcaccatacacccacgctcacccacacctgcccccagccccacttctcctttgcagctcccctccgcccacaccttcctgcctgggagctgctggcccatgtacaggggatggagagggtgggccagcgcccaccagtcagggctggctgactggggttctttgtgaaccttcagggtctcccaagctggaaacctgggggtcggccttgctcccctcactccatggccagccgctgcatcatcccctgccctgggccacctgccctggacgtgggccacagtgccagagagagggacccttgcaggtacagctcagaatctccctcctacccagacacccccaggttctgtactgccccgggactggtgccctgcccatccgcagcccggatgctccc

SEQ ID NO: 29713 - DNA, 1048 bp, Homo sapiens
cccaaaacagctcctggtgcctggtaggtgctaagtgagtgagtggcgagtgacggggaggcatccgcgcaggggtcggcctctgcgttcacaagggccttcctgcgtggtaccctgaataaggcctgggaggttggccctgggggcccccgttcctctcccccttgcctaccctggccttacagcctccctctacttcacacacctggcccccaagaggtgggggctttgctccctgtggctaaagggctgtggtctgccctctagtctcacatggagggcccatgtcctctatcccggggccatgctgagagtggctggggtgccctggccagaccctgtggagtgcaggagcgcgcgtgtgtgcgcacgtgtgcatggagtggcgggctggatgacaggcagctccagcccatgaagacccaggcaaggatttgtgactgcttcatggaagggcgtgacctgccctcccctggtgtgggttcggggaggaacgggatctggggactcccaggcctctgcctctgggtcacactgctctggactcgccaggactttgtgctgattccgtggccactctgccctctcccaatgaaccgaggcccacggcactgcatcctttcccctggccccagcaagaggtactctgtagcattgtacttgtttgtgggggcttttaaatacaggagaagggaaaggaaataaccacaaggggtggtcctggcgctgtcatgagacaaaatggagccaagagagctgactcgaagccctgcaggcccaacccagccagcagagccatctccactgctgaccccattcctggaacacgggaaaagctgtttgtgtgtacacctacacgagggggcaaaggcacagaaccaggcagtgaagaaaggctcccaagggaaaacagagactccctctggggaccgtggggaaacgccctttgtcactcatagacttctgtattgtttgcaggtttttcctgagcacgtgttcaggtactactgcataattacaacgaaaactgattttgaagtacagagtg

SEQ ID NO: 29714 - DNA, 1055 bp, Homo sapiens
tctttggcggggctgatggaatgggtgtccaagcaggggaggaaggcggtgtggatgcagcctgcctgatctgggatgtcactttttgctggcgaccaggaggagaggccttcccccacaccccctcccccccatgcccgcatggggcacctctctcaggtccctgtgccacattttccttgccacctggtaccatttaacaagagaagtggcatcgcattctccagccaagagtctgggaaccttccaagcactggggaacacagtgctgtcactgccgccagctcccagctgagcttggcaggggccctggaaccaggaggcctcccctctagagttgggggctggcctgcccctgcctcacagcagagctgagccacacttaaatggcaggcaggtgccctcagacctgctgtccctggaaggcgggggatgggtggccagagagtggggttgcttcacgccatctggagacccagtgacattgtccaggagacagtttggctgagggaagtaatggaagatcagtgtgtgccggaattggggcttggtactgaggtaaggtggagggagatgggagaggctgggcttggctgcttgcttggtggcgtgacctcaggcaggtcactcaccctcggcaagcctcagttcctcagctgtagcgtggcgccaggctaaccgatgcctttcttcctagctagttgaggactggcaatgaagaagccactattttatgtatttatttagagatggggtcttgctatgctgcccaggctggtctcaaattgctggcctcaagcccattattttgaacataaagctttaaacaaatgtcagatgcctcagggtggccatggtcatgacgtggtcattgcaggatgttgaaggcgggcaagaaccccctaggcctacaggctgggaatgggggggcgaaggctactggaagcggcgcctcttcagctgggcctggaagctgccccgtccgtgctcttataagctggaaggaaggtggtgtttgggccccactcttagaggagtagagcttactcggagtc

SEQ ID NO: 29715 - DNA, 1050 bp, Homo sapiens
ctgttctctgctctccccgcaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatcactggtctcattcaccactttgactttgtagatgaggaaactgactcagaacaattaagagtagggcagggtgggccaggtgcagaggctcacgcctgtaatcccagcactttgggaggccgaggtgggtggatcacttgaagtcaggaattcgagaccatcctggccaacatggtgtatccctgtctctacaaaaatacaaaaattagccagatgtggtggtgggcgcctgtagtcccagctactcaggaggctgaggcaggagaatcacttgaacccgggaggcggaggttgcagtgagctgagactgtgccactgcactccagcctgggcaacacagtgagactccacctcaaaaaaaaaaaaaaaaaaaagcgagaccagcctggccaacatagtgaaaccctgtctctactaaaaatacaaaaattagccaggcatggtgatgcaggcctgtagtctcaactactcgggaggctgaagcaggagaatcacttgaacctgggaggcggaggtggtgttgaaccgagattacaccactgcactccagcctgggcaacagagcgaga

SEQ ID NO: 29716 - DNA, 2750 bp, Homo sapiens
gaaacctgtttattggttttgagatacatttcgaagagttgtgtttctgctctgttctgggtcttgtgcctgttaccgaaagcaaagtgatgaaatgcagggagaaccgagtcagcacatgatctgtgaccaccaatccatcaccactgtctagaccagggtcccttatcctggtgtcagggcactcctctggtctaagggcagaattcagaggatagcagtctgtggctgtcgccagtagaaatggggatgttttcatatcacattaggattgggcaggtctcatcactgtctcatgtggcagcagccattaggcctgccccttgctcgatgcatcgatcatgatacacacttgactctatcacgcatttgatttcctagttgatgactactttttgagcccctgaccagatcagcactctgatctcacagatgggaccctgaggcctgggcacacctgaagtgcctgccccgccaggctttcctcccagagagaacaggcgacttgctcagggtcagacagctcgtgagtgaggggtagagccagctgttctgctgtcctagcctgctgaccgtgtgactttgaataggtcactttgtctgccacgaagcatctctaaaggggagtcacgatctttgctccatagttcaggtgctggtgggggacagtggtgcctactcaccctgtgacaagtggtgtaattctgtctgtggccatgaggtggcaggccaggccaggtcctgggttctctcttggcctgggcaggaagcaggaggtcccagcctggttcccgccgcagcaggagctgcagaaatgcctgctcaggacataggcctgcatccctcagatggagcacccagggtttgaactggcctccttcttcatgctggtgttgtcctcttcagaacactcttctgcataattgagtttaagccccaccatatatcttgaggcctttgcgtggcaggaattaccggccccgttccattgatgaggaaacacaggaaggtatgtgattggcccagtgaaataattgcctaggtctgctggtagggctctgtgctgggccctgggaacacaaatgagtcagatattggccctgccctctcagaatctcatgaaataagcagacatgtaacataagcaacagcagaaggatttgctgagctctgggagcctggtggtagaattaggtcatttcttcttggatgtcatgagcaaagtcatgattgtggtcagacctgggcatttgggtcacgtctctggagtgatgtggattggaggaagcctggccagaggcaggaggctgggtcgaggctgctgcaggaggcaggttgtggaacccaagcctcagcagcctagagatagatttcaggaacaaaggccaccaaacttagaggacttattaaaaaaatacttcctgagtttctgtggtaccgaccactgttctaggctccagggacacagcacagaacaaaagagtcaaaaaccccagcttcctgctgggcacggtagctcacacctgtaatcctagggaggccgaggtggaaggatcacctgaggtcaggagtttgagaccagcctggccaacatggtgaaacccagtctttactaaaaatacagaaattagctgggcatggtggcacacacctgtaatcccagctactcagggggctgaagcacaagaatcgcttgaacctgggaggcagagattgcagtgagccaagatggtgccactgcactccagcctgggtgacaaagcgagactctgtctcaaaacaaaacaaaaaaagccccagctttgttctagtcaaggaaacaaatggggtaaatgacgtgctggaaagtggaggcgtggcgtgtcaggtggtggtaaacaggcaagagttaggcagggtaaccagggaacgcccctgcaaacaggacttctaaataaataaagacctgaaggaagtaggcaggcaggccacggagatacctcgtggaaggaggaacagcaagtgcatgggccgagtgtgggacttgcctggtgtgctcaaggtctggcaggcaggcctgggtggctgcagcacaatagcaaagggcgggttggggtggagaaatcaggaatggtggggctggatcagtggagcctggtggggagctgctggagggcttggggccagggagggatgtggcctgacttgggttttaaatggacccctctggctgccgggaggagagtggactgaagggaaactagggcagaaatagagagacaggtctggaggctctttctttctttctttctttctttctttttctttctttctttctttctttctttctttctttctttttctttctttctttctttctttttctttctttttctttctttttctttctttttctttcttttttgagacagacactgggcagcatcgtgttcttccagcggacgtgtctagaacatctgtgcccgggcctagagcagtcttgtccctctctggccccacagctcccctgggcccattcctttttgatggcaccttcttatctgtggtgagggccacccgctgcccctccctccttcctatccctgtatcttctgctccctggtcttgagcatctggggcccgagctgcctgggcattggttggaagtagccctgattcagagctcagctctggagtcactagctgggtgaccctagacagtttgttcgacctagccagccttgttaagccttcatttcctcttgagcagg

SEQ ID NO: 29717 - DNA, 1017 bp, Homo sapiens
gggtacacaggtgtgaagtgaggatgatgtgctttcatctggagtgcatcttatatgccaggctctagcacgtgctgccctgcttttgcttttgctgagtttctgcatactcagttataactaagtcttatgtgtatgtatttgtgagtccactctcctgctggggtgtaagtgattgtgaggccaagcgtatgtccgtctctttaactggtgcatccttgtgtcctctgggagtcagaatgcctgatttccccttaactctctgatttcagatcttgtctcgtcccaccccaagctagggtacccagcaggcaatagggatgtttgttgggtaggtgggtagatggttggatgcatatgtagggaattctgccccaactggatcctgttggtgtttctcacaaggtgaaactaaccacgaggggtaggaaagtagcctttttgttgttgttgttgttgtcgttattgttttagataaggtcttgctctgttgcccaggctggattgcagtggtgtactcatggctcactgcagacttgagctcctgggctcaagtgaacctcccacctcagcctactgagtaactaggactacaagcatgcaccaccgcacctagctaagtatttatttatttatttactttttttttttttttgagatggagtcttgctctgttgtccaggctggaatgcagtggcgcgatctcggctcactgcaagctctgcctcccgagttcacgccattctcctgcctcagcctcccaagtagctgggactaccggcacccaccaccacgcccagctaattttttgtattttttagtagagacggggtttcaccgtgttagccaggatggtctcaatctcctgacctcgtgatccgcccgcctcggcttcccaaagtgctgggattacaggcatgagccactgcacccggccactgtttatttactttttaatatagcgatgaggtcttgctgtgttccccacactggttttgaactcctggcctcaagcga

SEQ ID NO: 29718 - DNA, 1064 bp, Homo sapiens
atgcctctaatcccagcactctgggaggccaaggtgggtggatcgcctgaggtcaggagttcgagaccagcctggccaacatagtgaaaccctgtctctactaaaaatacaaaaaattagctgggcatggtggtacacacctgtagtcccacctactcgagaggctggggcacaagaatcgctggaaccaggtggaggttgcagtgagccaggatcacaccactgtactccagcctgggtgacagagccagactccatctcaaaaaaaagaggaaaaaaaaatacaagttggttcctgtttaaagagcttcaagaagttctcagaaagtattcctcaagacagtccctggagaggctgtatgtgaaggcctacaaagacagacctttacctctacaaagaccctttacctctccaggttggaacaaagccatctgcactgacttggggtgtgtaaaataataaattgagatgattttccttactaaaaagactgaccggtttatagaatgagaataagatggtaatttagttgtatatcctaatacctagatttaaatccttgctccacttacagctgtgcaatcttgagcaccctacttaatctctctgtgcttctacttcctctataatggggataatgtattataatattctacttcctttatagtggggataatagttcctacctcatgggattatcgctcaggaattaagtgagctaatttatgtaaagcactgagaatggcacctgaataagtagttactcaggcccaggcttttctacatggtggtttttgccacctagcttgggagccctcagacatttaaaaagctgtgggaaatcagtctctccctctaaatgggcttcccatccctcccctgaccccagccttttaaagaccaggtttaggtttcctgaacaattaagcagaaaatgcagagttcccatataccctctcttcactcactgtttcccctattgttaacatcctgcattaatgtggcagatttgttataattgatagtactgatacattattagcaaacgttcataatttacatt

SEQ ID NO: 29719 - DNA, 1030 bp, Homo sapiens
gtgaacgcagagcacaggagggattgagaccccgttctgtgtcagctgtagatgctgaatgttgtccccctcctcctgcgcatcccagggctggctggcaaggtcctacgctcccaaaaggctttcctgacccagctggatgagctgctgaccgagcacagaatgatctgggacccagcctagccaccccgagacctgactgaggccttcctggcagagaaggagaaggtgagagtggctgacacggtagggaccaggggtggtgggttgagcgtccgggaggaatgaggcaggcaaaaggtgggtccattggatcacttggcaagtggcacctgggctgacaggtgcagaatgtggaggtcatttgggggctttcccgttctgtcccctgagtaccctctcagccctgctcaggccaaggggaaccctgagagcagcttcaatgatgagaacctgcgcatggtggtggctgacctgttctttgccgggatggtgaccacctcgatcacgctggcctggggcctcctgctcatgatcctacgcccggatgtgcagcgtgagcccagctggggcccagtgcagggggcaagggaggaagggtacaggtgggggcccctgagcttagctgggacacccgggactccaagcacaggcttggccaggttcctgtaagcctaacctcctccaacacaggaggcaggagagtgtcagggctggtcccctgggtgctgacccattgtggggacgcgtgtctgtccaggccgtgtccaacagatcgacaacgtgatagggcaggtgtggtgaccagagatgggtgaccaggctcgcatgccctgcaccactgccgtgattcacgaggtgcagcgctttggggacatcgtccccctgggtgtgacccatatgacatcccgtgacatcgaagtacagggcttccgcatccctaaggtaggcctggcaccctcctcaccccagctcagcaccagcccctggtgatagccccagcatggccactgccaggtgggcccagtct

SEQ ID NO: 29720 - DNA, 1049 bp, Homo sapiens
gctcagcatacacattggatgtggactcctaacaccgctgtgtgacttgaaccttgttatgtgatctctgagcctcagtctctgtgccttggggaccataaaaccacctccttagggggctgtgggaggattaatgagctagagcacacagtctgaccagcagtttctggcacataagtgcccgatcaatggaagccacaggtgcacaatgattggaaaaggccacaggcattgttattaaatgttttcctcatgctgccatatcttgaattacaggcctctggctggtaaggagggcactcgggaggacactgcccacattgcaggcatgcctgtccctgcccttcacacccccatcatgattcatgatgactgcttggggagggcctgacacctcaaaaggccaagagtgcatacaggtaatgtataaagggccaccatgtaacaagcacccagaccatcctgctgtccctgcaccttgattctctcacagtcccaaatagaacagtgctgccatgtaggacaggaacattcattcagctgaggccagtttgggagaccacaagccagatctgagaagtccccagataggcatgggtcttgctctctctgtcagttgagtagcttcaaaacttctgttgggccaggtggctcatgcctctatttccaacactttgggaggccaaggcaggaggatcacttgaagccaggagttccagaccagcgtgggcaacatagtgaggacccatctcaacaaaaaaattagccgagcgtaatgatgtgcacctgtagttccagctactcgggacgctaaaataggatctcttgattgagcacaggagtttgagtgagctatgatcacagctctgcactccagcctgggcaacagagcaagatcttgtctctaaaaaatatatatatatttttaaattttaaataaactgttctccctgccttttgttccccagatccagtcttcatccagacctgaaaagacccaggctccagctgctggcctcctgctgcccctcaggccacctgcacaggaa

SEQ ID NO: 29721 - DNA, 1349 bp, Homo sapiens
tggaatgtgtcctagaagacctggttaaggaaagagcttaagtgttttttgtttttgtcctggaattgcatctgtgtttgagaaaaagaaagttcaggccctgggcctggtggacaaatctcctggggattttgttcatctgttcctctctagtcattcttgggccttccttcctagctgtcagggcccttgactctttttttttttttttttggagacggattctcactttgtcgcccaggctggagtacaggggcacgatctcggctcactgcaacctccatctctggggttcaggcgattctcccgcctcagccctcccgagtagctgggactacaggtgtgcaccaccacgcccagctaatttttgtattttttgtagagatggggtttcaccatgttgcccaggctggccttgaactcctgacatcaagtgatcttcccgccttgacctctcaaagtgccgggattacaggcgtgagccacggcgcccggccaactcttgaacagaacaatgagcttcatccttctgggttgaagcacagtgatgaagtggcctcacccattgaagagagtcgtctcaggtccattgaggttgaaccattccattcagctcttggagggagaggatggactcactgcatccagtcctgtccatctgaaatgttttttatgtgctgttcccacaaggcatatagcttttcctggtttcccagttcagcagtgacattgagggtggtcaccgtccttcatttgtggtagaagccctggtgactggggatagaatcacacctctgactaaaggaggactcatcttgggccccatgctggggacagagagccaccattattgggtgccctgacaaggcagggaacagacagcgaatgtgcgtgtgtgtctgcctcctagtgcgccatgttctgacagagtgatatgataggtgctgtgtgactaagatcagactactccatgtctctgtacttcggtttcttctgtaaaaacaggaatagcagtgccaaccttttgagattccattgggaaatgtctctaagtgccagcacagcacactggctctcagcccgttgatctgccatgcctagctgtgggtttctcttgggagttggaggggtcaaggcagcagattggaccctgcagctgtctcttatagcaaaaaatacccaaggcttggggttaaaagatgccgcccctgcctcccagcctgtgaggtatctggtacctgaccctcgccaggagtgcggaggggaaaagtccttctgcaggcccgtggttgcccactgtctctttgtgccaagggggttgccttgctggcttgtgtcattggttggca

SEQ ID NO: 29722 - DNA, 1025 bp, Homo sapiens
cttgtgagtggacacaacaggcttttaggtctctttcttgggcagggcatctcttgccagtagcccctgctctttcccccgtctcagaaagggttccagtcaaaggtctcttctttttaatttactacatttctgtaaagcttatggtgtgttttcctttgaaaacaacagaactcttgggttttgttattagaaatcttttttttccagtattatgaaggattcctttttgcagaagtacaaaggaaagaaaaatcctcaaagatttagtagactctagcatctgatttaattttactcttaaaaatctcgaggctgggcatggtggctcatacctgtaatgccagcactttgggaggctgaggcagaaggatcgcctaagcccaggagttcaagaccagcctgggcaacagtgagaccctgtgtctacattaaaaaaaaaaaaaaaaattagccgtgcgtggtggtacatgcctttagtcccatctactcaggaggctgagctgggaggatcacttgatcaaacctggaggttgaggctgcagtgagccatgatcgtgccgctacattccagcctgggccacagtgagaccctgtctcaaaaaaagaaaaaaaattcttgtgattgagttgtgcttgctgtgagtttgtgtgggattattgtggtcacggccctcttggcaggcatctgtgaaaacaggatgataggacttggggtctctagaagctgcaggcctctgagctccatgctgctccttcaccctccctgcgtcactgaggcatgaagggaaataggttgtaaagaaaagaaaaaccaaaatgtaccttgtggcacttgctgctacaggatggggcaggaggactagttgtctcagaaatattcattgaggggtcatttctctcaaatgggaggacttctgtgtcgacctcaggagtttgactcacacagctacgctagacgtgtcccttccggcaccaccatgtgcctgaccaccttctggaacgtgccctcctccttgttacca

SEQ ID NO: 29723 - DNA, 1030 bp, Homo sapiens
acaggctatgatgttccaggtctggccaaatataaaagggtctttttgatttgttttaggataccgggacctgaaaagttttcatgtgtatgttcattgcttattactattgcacttgaaatctgtgggtgcacaggctgctagtctggatctcagtttaaatttaacaaggataagtaccgtggctgcctcctgccatggtgcctgggagctctctgagaatgtgttatcaatatttattaacattctgccaccgcgttttgcaccagtgacctggctgtcggtctccaggagctgtggtgtgcagagtgaactcattaattagatttccttgccctgatccatgcactacccttgtgtgagagctcagctcacctggaggcagatgtgtccttgctgccatccaggatgctgtcatcatgttacaagttggaatgaatcatttttcctccaaggattaaaagcatcctcatgggattttaccttcctctgaagcatttagtgtggattatgtgatttgtgttggaggcttctgtgtctccgtgggtcgtggggcaaaggtgacagtggggctcttgggcctggccacctttctgtctcagacacctgggcattctctgtacagagaagaaaatacgcgtctagattttaaagtgtttttacaaggaggctttggcttgagcctgagaaatggggttagcctagaatcaaggatttttaaaatagcatttattggtgatatcgtgggaatatagaaaagataaaatttaaatcagctgtatcttcttacccaaagagaattattgttacatattcatagatttcctttcagtctttttttttttttttttttttttttttttgagacggagtctcgctctgtcaccaggctggagtgcagtggtgtgatctcggctcactgcaacctccgactctctggttcaagtgattctcctgcctcagcctcccaagtagttttttttttttttaagacagttttgcttgcctaggctatagtgcagtgatgtga

SEQ ID NO: 29724 - DNA, 1065 bp, Homo sapiens
atattatttgtagcataggaggatgataatgcaaatagctactccaggtaaaaagtatagaataaaaatttaattagaaattgtactggcctgggtattgatttttgggtagaagggaaaaccttacacatggaagatactatagataagtatttatattctatctttggcacctggcacctagaaagtacttttcaaatgttggatagttgagtgaatgaagggggctaacaggcgtcatggtatggtatgaagaaagttgaacttggggttcagaagaaaaagaggtaaagttctaagttctcttactagctatgtgatctttagcaggtcactttgctttagcctcttgtttcttctacaagaaaaacagatgtcgaagacagacccagagttccttctttattgatctcctgatgtcacaatttgcctagtgaaattgtaggtttcactaggcaaattgagggagaaatctgttgcattaaagaacctaaggccaggtgcggtggctgatgcctgtaatcccagcactttgagaggctgaggtgggcagatcacctgagatcaggagttcaagactagcctggccaacatggtgaaacctcatctctactaaaaatacaaagattagctgggcgtggtggcaggtgcctgtaatcccatctactcgggaggctgaggcaggggaatcgcttgaacccgggaggtggaggttgcggtgagccgagatcatgccattgcactccagagcgacaagagcgaaactccatcaaaaaaaaaaaaaaagaacctaaaaggaaaatgaacaatcacttgagagtcttgggaaatccccgtgtattagttttctatcattgtcataacaccttaccacaaacttgttaatacagttctgcttacagttctgtaggttcaaagtccaacacaggtgtcttactgggctggaattgaggtgtgggctgggctttggaaaagtccagagtcttaggggagaacatgcttccttgccttttaaaaattctgcagctgccgccctgtcccttctcccatcttccaggccagcag

SEQ ID NO: 29725 - DNA, 1026 bp, Homo sapiens
gacagaaggcaaaagggagggactaaaatctaccttgcatgttaagtaaaagcattaacattctagtgagatgacaaagttttgatagcgattatctaaagcgaaagaaaagaatctgcctggtagtaaagttgggtttttttggtttggttttgttttttttttgagactgagtcttcctctatcccccaggctggaccgcaatggcacaatttcggctcactgaaaccttcgcctcccaggttcaagcaattctcctgcctcagcctcctgagtagctgaagttgcaggcacctgccaccatgcctggctaatttttgtatttttagtagagacggggtttcaccatgttggcgaggctgatctcgaactcctgacctcaactgatccgtctgcctcagcctcccgaagtgttgggattacaggcatgagccaccgcgcctggtctaaagttgtttttttaagtaaactttttaacatgtcagcactaaaaggcccaaaataattaagaattctgagtttgtgtggtgtatccacagaatgattcaggacaaatacttccctatagcattccacctcctcccctaaaacagtgaatatactgagaatatgtgaactccagagggcttgtattagtccgtaaagaaatacctgaggctgggtgatgtatgaagaaaagaggttgaattggctcacagttctggaagctgtataggaagcatgatgcctgcatctgctcagcttctggggaggcctcaggaaacttacagtcatggagggaggtagagggggagcaggaaggcttcttgcatggcaggagcaagacagagtgaggtgcgaggtgttgcacactttcaaacaaccaggtcttgtgagaactcagtatcacaggaatagcacccacatgatccagccacctcccaccaggccctgcctccagcattgggtgctacagttcaacctgagatttggtgaagtcacagatccaaaccatatcagggatctattgtatttgaaggatttagc

SEQ ID NO: 29726 - DNA, 1050 bp, Homo sapiens
aaatctcttaccagcttgggatttttatttcatttggttccttttcttgcatgtttttgttcttacatgtcacatgattattcctccaaattaaagtgcctatgcccatgtgatggacagaaaatgaaataggtaatttggaagatttgtatagacttctaaaatcgtttttcattttttgaaatgtataatgcttatgaagcatattattatatttcaagtttcttgggccacatcttttctaacgcacactttccagttaggatatttattctttggatctgtttcataacttatcctggggcagatcatcaacatcatcatcttcatttctttctctcctctattgaatgttctgtttcctgaatcccatttcttcctcattcttaaagtgagccttcatttaagggcgtgcatcatcctttagtagttttgtgagaaagggtgtgtgggagtgtaaaaatgttgagatcctatatatctgagcatgactttatcctagcctcatgcttaattgagagttggctaggtgtggaattctagattggaagtgatttttctctcactgtcttgcagtcgttcttcctggtttgtccactagcttccagtgctgcagttgagaagactgccattctaatttttcatcccttgatgcatgttctgtttttcttctggaaagtttgaggatcttctccttttccctagggtcttgagatgtcaaaatgataggtcttgactaggtcatttcatggttgtgttggctactctatgagatcttatgtacgctgatgtctttcagttcaggcaatttgtcatgtggtagttctttgaaaatttccttccctctattttctctgctctctttataattcctgttaatataaggcattttacctcctggattgatccgctgtttttatcttttctcctctgttttatgttttatctcattatctttttgttctgatttctctatgctttcttcagctttatcatctaatcttttttgtatgtgggttttgttttggttttgttttgttttgttttgtt

SEQ ID NO: 29727 - DNA, 1026 bp, Homo sapiens
gagccaacatatttgttgtaaaggctatgaaccagaaggttgtatcagtctacaatattcactttttaagtcacttctgtagaacagactattaattttttctttctagttagtgattttaagtgaggaaattgaagagaggtgtcttgaagagatgcggaggaaccagtcaagtaggagacaggtcaaggcttgtggaagtagagattggtagtggtttaaatgagcatggtgctggacctgcctgagctcttgtagcttcgtgaatagtaacctttcttccccagtccctggtctagtgtcttcccaactactgccagaaaatcttctgaaaggtagctcttgtcgtatccttttcatttgtgtactgagttaaatttagacaccttgccttggtcttcagggttccatggtaggaccctgccctgcctctctaaccacatctcctggtttccccagttgtatcctctgctgcagctcggtgtccccagaggtgcctttatttccaggtctgggtccgtgtcctcttttctgttctccatcttatcttttttttttttttttttgagatggagtctcgctctatcacccaggctggagtgcagtggcaccatctcggctcactgcaagctccgcctcccgggttcatgccattctcctgcctcagcctcctgagtagctgggattacaggcgcctgccaccacgccaagcaaattcttatatttttagtagagatgggatttcaccatgttgaccaggctggtctctaactcctgacctcaggtgatccacctgcctcggcctcccaaagtgctgggatcacaggtatgagccaccgcgtgcagcctgttctccatcttttgagatagttatatttcaaggcctttctcaaatgttacttttctccatgaaatctaacattcccttaactggatgtttccttcatgacgtttgtaattttctggtgcacctttaatctttgctttttgctttttattatacctttcttttttcctttttttttt

SEQ ID NO: 29728 - DNA, 1066 bp, Homo sapiens
ttagaccagtgacttgtaaattatttcagagccctcacattttatttaaaaaatatgcatgtagcactagctgtatagttaggtggcagtgtgctaagtgttatatcaaaacagaataagatggaagaaaggcggcaggggggcactctcatctcttccgtgctgggctcccccaggtctgcagaggcattttgggaaacaggtggcctggctggggtagaagtgagggtcatcctcttctcaactccagccagagcagctcatcatctctcttatcttttgggtatatcaacataagatttttgctgaaaaaagacttgcagaatattttcaaacaccatttcactaggctctaaggtccttatagtcagggctgtgttttgcttttatagccccatcatctgcattgttgcctgccagtgcattgagaaagaatgtaccattttgcctctgagcctctgctctctaatacttctccctccttcccatctctagccgtatattagagttaaaatagaatgtgtctgtttcatcgcaaatttgtatattcttaggtgatcaccatgtcttattaatctatgtctttgtgtcctgttcacataattctattaaagtaatgttgaatttggatttgttgtagaaaacttgcaaagctcttctaagagtaactaaaatcagtaaagaataggggaaaaaatccagagaaaatataagcaggaaaaccatagcagacagggtcagatggaatattagcggtttaggtgaagaacccagagaaccgcctgccctgtaaggaatgctgggtatttctcctggagggttttattttaatttttgagacaggatgttgcactgtcacccaggctggagtgtggtgatacagtcatggcgcactgcagccttgagttcctggactcaaatgatcttccttcctcggcctcctgagtatctgcgactacaggcacatgccaccacaccctgctaattttattttcttttgtagagattggggtctctctatgttgaccaggctgattttgaactcctggcctcaagcaatcttctt

SEQ ID NO: 29729 - DNA, 1051 bp, Homo sapiens
atctgtggtctcggctacttgggaggctgaggtgggcgtattgcatctgcgagctgtgattgtgcctcacaaaaaccatatacatatatgtatctctcatgaatttgttccctctcatctcaagaaccataccctcttatctgaactgtattattagtttcctgtttttcctaccccctatttttgccttcctcccaaaccattttttccacttatcagctaaagtgatctcttaaaaattcaaattggattatgtcaattgccttcctaaaatgctccagtggtctttcattgctttcatatggtggccaacagggtcatatctaacctttgcctccttctgaaaccatttgacctggtctccttcttgctctctaagctacaggtttgttcaccttccctcttgtttcttgaactcctcaagctcatttctaccttaggacctttacacttggctccttcctgtgtctggaacactctgcttctcaaatctttgagttgtttctgtttgtcattcaggttcaacctaaatgtgaccttctctgaaaggttttctctgaccctccctgtctaaagtagtgccccattacatcaccctgccttgttttgttcatagcttttatcatagtctgaatttattctttaaaacatttttaaattaattaatttatttttaaaaaatagagacaagggtctcactttgcccaggctggtcttgaactcctggcttcaagcgatcctcctgggattacaggcatgagcctccatgaacagcctgaatttatcttgtccttttgtttatctcccttttcctctcagggttaagcatgcctccttcactgctatataggcagcagtatttgatacacagtgggccaaatgtgttaagtgacattattgaggatagtggtggtaggatgagagctgttgaaagtggacttggtgagggaggaggtgccaaggagaggcaaaacttgttttgggaaactaggtgatggcattgccattcattaaaatagaaaacaactgaggaagcgaatattggaatagg

SEQ ID NO: 29730 - DNA, 1071 bp, Homo sapiens
gtagagatggggattcgccatcttggccaggccagtctcgaactcctgatctcaggtgaggtcaggaggttatcagcctgcctcagcctcccaaagtgctggggttacagatatgagccactgcacctggccaactttttaaaactctgtaagataaaatggaatgtaattgaaatgatcacacttaattggagttggactttttctcatgagtccaacctacctttcatataggcaggaaaaaatgctggcatttgtataaaaaacaagcttttgtgctagactctgtccaaggcattttaaattgtgttacaatatccacccagctgaccttagagatagatgacctttcctttccctgagagctggtagagctaatgaggctcaaggcttagatataaccctcctgctgttggctccagagcctgtgctgtactaggtttgttgcctgctcaaggcacaaatcagtcagtggtaagtgcggccctggaatccatatcttcctgctgtgcccctctttttttttttttttaattttaaagctatgatgaacctgaaatctagatttaggtgaaatactggaaagggtggtttttgtgactgcttatggttttgtgaccccctgggagttccctaaacttttaccttgcccatacttggtcagttttgccagtgtacttgagatttaatctgtgaaaaaatttctcttttcatacttaattccgtcattctgtcctgagctgaaaactttggtatcagcttaaagagtaacataatacgtaaagggctatctcttcctgactagtttacaatgcactagaatcattttgtatggtgactgctctcactcagttcgactgggtgggactcaaaagatatatttaccaaagacagttctttccacagtatgccttaagccttcttactcatggggactttgtgttcaaggcaccttagtactcattcattctgtctggggctttgtctctgctgtcttcattttctttttgtggaggtaaaaaagtaacaagataaagcaaaacaataaaaccattgaagtaaaacggtaca

SEQ ID NO: 29731 - DNA, 1060 bp, Homo sapiens
agggcggggaggcgggggatgttcagagcagtgcccaggagggtggccgggagaggaggggcccgagggggctgctcggggagcgcggcagcagcaggggcgtgaagggcagggccccgggtcacagtcccaggggccgagtgcccgcccccgtcccctccggtccagatccagccgcgcccccgtcccctccggtccagatccagccgccgtgcgcagccagcccgggtgtgagggtgcagagcggcggggggttggggctggctgctccctctccccccctccactatttccaggcatgttcttccacctccagcaggccatttgtcagtggtgatgcgggacaaaggaggggcagtgggtggtctgctgcgagttgggcgatgggcacggagcgagggccgagagaaacgccaacaatgaagaggcagatcgagggctttgctcattcaggctgtcgagggagccgtcattttgtgttagcgtgtgtgtgtctgaggtgggaggaggaagagagcggagaatgacaggagaaggattatgacattgtgttgtctctgtttgtggtaaatgcaaatttggcaccagtggtttcccgggaaaaggagcagcaagtaacccaggccgaggccctggcccagacccacggagggagcccgtgctgggcggcgtggggctttatttggccctccctttttttctatctggcgtgtgcttcttgcatttattttacagtgaagagctggagacagacaggccggcgaggcaggaggagccggccccctcctcccaggcatggcagcccctcctcagctcaccccggaggaggcctgggcagctctcccaacccccaggcgctgtcccagctctccggcctccctcccaggtctctgcccccagccagggtcaccgttccatcattctcttagcctgggcagcctgaggtctctgaaggctacttctgcccgcagctgcttcccaagcgtgaccagagaccgagaacctgggaccgaggctgggatggggctttgcagaacgaaggccagggctgggcgctccc

SEQ ID NO: 29732 - DNA, 1046 bp, Homo sapiens
tgttggccaggatggtctcgatttcctgacctcgtgatctgcctgcctcggcctcccaacgttctgggattacaggcgtgagccaccgcgcctggccatgcctggctaatttttgtatttttagtagacggggttttaccgtgttggccaggctggtcttgaactcctggcctcaagtaattcacccacgttggcctcccagaatgctgggattacaggagtgagccaccacgccaggccagcactctgatctcttaataggaaaaggtcctgttctcctgggagctcaagagggctttctgtagggtgcccagcacatacaactggcctgcctcctctttgcccagggtgctggacttgccgaaagctcttctggtgaaggaattcaaccattgcactttttcgctcaattgcttcactccctgtctgttgaacatttccaaatctgatttgcaggacttttttttcttttcttttctttttttttggctagtgaggctttagacttccatgcaactcaccacgcccagaaatggatgctggaccaattgtctttactccccctttcccatgcaagcaatgtaacggcctttgaaagggggctggtttgtggttttccagcagtagaatggtctgtggtcttgagcagctaaatttgaaaccgggcttttcaggaggatcaactgagctctgaaacagctgggcacagtgcaaggtggcaggggtcagggacaggcaggtggggctccttgggcttggctgtgctttcactgctgactcctcagtgccgggaacagtaagagctcacacagccctgcttgaatgaatgcatgcatacgtgatgggatggatctgtgctatgatgagatgcagtagagtatgttggttaaaagcctaggctctagaactggacagcctggagtggaactctagctctgctctttgttagtggtgtgactgggtaactcagttccgttctctgggcctcagtttgctcatctgtgaaatggttgaactagatgattccagcattcctcccagctcag

SEQ ID NO: 29733 - DNA, 1050 bp, Homo sapiens
tcggcctcccaaagtgctgggattacaggcgtgagccaccacgcccagccttgtctttatatctttactcctgctgttccctctgcctggatgcctttcttgtctcctccacctggggctacctctggttcatctgccactctaatgatgcctcctctgggtagtcctctctgaccagccctgtcccaggatggtagatgtcttatgtgcccccctctctggccccctaggcttccctcattcatggcactgtccacaccttcctgaagccaccagcttcagtgaggaagtctcactcagtgttggccccatggccagcccaggactttgcccagaggtagaaccagtgaaagtttgttgagtgaataggcaagggagtggatgttgctcttcctgcctatgtccagcccattccacctgcctgggctgccctcctttcctctcttaccctgtgtgcctggcctggataccccagcttcaagctgcctgtccttcagagagtccttcctctctgagcctgtcctcacctgcagcccacctgccatgaggaccccagatggagcccactgtggtgcctctcctgcacccccagcatggtgtgtgagcaccctggggctcccactggcttctcccacttttcattgcttcaggcccccattaggtggctggtgattgctgacagactgaactgttccagaacctcccctgtcaggactgccctggggaaatctctagaggtgtccacagcctcctgtctgccccctccctgcttgggtctcctcagaccattccttgattccaggtttctgaaaaattgtgtgaaaactggctttgtgtcatcagatccaatttcctgccacctcttacttttaaaggaggcacagccagtttaaaacaaaaacatcctgctgtggtgtgagctgaagactttgggccaggaggctgggctgtgagggccttccgctctgccacctcccctcattcagccgctcccctcctccctgggtcggggctggagggaggggttctggagcccaggttttcgtgccc

SEQ ID NO: 29734 - DNA, 1031 bp, Homo sapiens
atcagatattcacagaggtgaaagtaacgtcgcagctgacataagggctgtgaagactgaaggaagtcagggaggcttcctggaggagggggcccagagctatgatgggaaggaggtaggaattaaatgagtaagcaggaaacagtgtgcaaggctaagagaaagcctgtgcaaagcccctgcggtagggagtgctatactttgaggccggggaaggcaacctgtgttttttgagcaagaggatctgagggcaggggtgtggtgcctgatgagctgggccctctgggagcggtcacatgagatgtcagacatggacttttggattctgtgaatctggaatgtccttagagccccaggcctagaagtctcagggttcacagcccagctccacctcttcctctgcattcagtctcgggtaaggagggtgccatctctgagcctcggttttctcatctataaaatgggctcactgtcccatcaaagcctgcatgtgaggacttattgtgggaatgtgtgtgaagtgtctgtgcgaggtgccctggcccgaagcttccgcacaggaaatgagtgagccgtgtctcctgtcccatttcctggggttcccactcaccctttgggcccagctgcaggttggtggagaggcctgtgccctgcacctctggcttctatctcattggcaggttgggggagggggagttcatggccaaggtcagaggtgccttccctcagcagggttttctgagggccatggcaggtgcccactgctccaccttctgatccttcagcatgaggcctctccccacctggggatgtcttcaggaagggttacatctagcaccattcttagctcctgcgccaagggcattgccgtggcccctctatatcagtgccagcctccagactcagccctggggtaaaccctggcttagctctgtgggcacccagtgcctccgccccctcccctccaagctgggatatagcccctcgcctcatcgttgccgcgagggttagagtctcttggagaagtgcct

SEQ ID NO: 29735 - DNA, 1050 bp, Homo sapiens
ggttgccaccagtctgatttcccaaggccacccaaggtcccagggaggagggtgagatgttcaggctctggacagggaaccaggcctctccctgcttccagctgcccatggtgtgaggggcacctggccatgcagcccctctgacaccaagggtaccattatgttgagtcacctttatctggtggctcatctggaaccttgtgagcctgttcccacaggagtctgctaaactccagccccaggcaggggccacccgttggcctgggttcccactgcgcttgtgcctatggtcctgtgtcccagtggcacctggaggagccatcgtggtgggccggtgctcctcctagagggaagccctaggccaggcctggcacatagtgggtgagcaggttgggcacctggaagcttgggctaggcctgccttctatcgccttcctctgtgtgtggctgtgggcagtgagttacaggcttagtacctactgcgtggagcagtaggcatactgtgtgttctggtctctgaattgctctccactttgtggcgaggggcaagctggctcacaggggcctgatatgagggtttttacacctttacccctttgcctctgaggcaggtggggaccactggttccttaccgaaactgaggctcaaagagggccaaggtgtggtggaagccagatacttttctgcttctgtgtgacttgcgttcatggtgcagtggctgtcagccaggcttgtgcacagccctggtgcaccgtcctctaaagcctctgcacagcgagacagctcctgccactgtctacacacagccctggtgcaccatcctctaaagcttctgcacagcgaggcagctcctgccactgtctacacacagccctggtgcaccatcctctaaagcctctgcacagtgaggcacctcctgccactgtctacacacagccctggtgcaccatcccctaaagcctctgcacagcgaggcagctcctgccactgcacacagactgggtgcaccgtcctctaaagcctctgcacagtggggcagctcctgccat

SEQ ID NO: 29736 - DNA, 1046 bp, Homo sapiens
gggactccagcccaatttaatacgagatgtgttgaaataaactgtcatctggactttgatatattaagattgccctttgaaagtcacgtgttgagaggcagatgatgaagaggtgcctattgttgccgcctcgtgccgtgcccagcccgtcccgcctggcagcctccgtcgcaggagctggcaacatggctgtctgcctccgcctttcccgagcaggcaggaatcactaacgcgttagcagtttcattaagcctctcgccagcctccccgcctccctcccgggcctcctcggtaattattttcccagcccttccactcgcagcccctgagcgagctcttcgggattggccgagtggcccctgcaggccgggctgccgggagggacggggctctgctgaggccccctgggcacccccctcccgactctgcgctgccatttaagctttgtgtccccctgaggcctccgtgaaaatgcagatctgctgcctgccaggggtgatggttaacccgttattacacacccagcacgtgtagtttcctctgtgcagccgacctccattcagacgaaaagtttctccggccctcttctggggctgtcacggagcgggcactggggacccagctgcgaggggatttctcatgctgcagaaccgtgaacatccagggcggtgggggatctcaggggacgcgtggagaccgaggcgggagttgtgtacagagtaggacctgggcccagagggttttcttcctgggacgcatgcccccactggacccaggtggggcccagtaccccctccctctggccacagtgactggtggagaaaggggcatgtggcccatctgagcccgtcaaaggcttccctggaactgtgactgaaggttgagtatgcagggcctgagaccccctcccaggcccattctggatttggactcagctgtgattgttgaaactgaagggtgtgaatatgaggccaccggccaccctcttccacagctgcatttaggatggaggattgcggataaggtcatcacatggaaggaggcag

SEQ ID NO: 29737 - DNA, 1028 bp, Homo sapiens
ttaattccaattaaaaacaaaaaatactatggtgtcacgcaagcctggcttcaggctgggttgggcccgtgggcctagagtttctgatctctggtggccgtggggatgcgggtgggggtggcgcaggccggttagaaggggggtcggtgagggaggaacggtgggcgggaggggggggcggccggtgggctggtgggggttttctgaaggcgtggggtggggagagccggtggagtgggggctggcctcacccccagcagcggcaccgtgcgtggggggctgggcgcgggtgggcgggggctggaggcagagccccccctaccccagcccggcgcgccgcggccgcccgccgcctccatccgggcctctccccacctcccgcccgcccgcccccgcccgcgcccctcccccgccggcgcgcacggctcccgccgcccctcctccgcccgcccgcccgccctccgcccgctctccccggctccctcccggtctctcttaagtgccatcgaggggcgccgggaattgcagccagtaaatcgcgtcccaccactcagcggcggggccaccgcagcggcgccgcccgcgcccgccgggagcccgcgccgcccgggcgcctctccagggcccgcgaggcccgccccccacccggcgcggcgctgcgcagggcctgcccccgggccggccggggcgcgcggggcccgcgctggaggcgaggacgcggcggccgcggggcgcacggcccggagcgcgcggcccgcgcccccgcgcgccctgctcgcgcccgcgccccgcgctccggagcccggccccgctgcccgggctctcctgcgggaccgatgccggccctccggccgccagggtaaggggacagcgcgggcgcggcggggggcggggggtgggcgccagcccctggggcccgatgcccgcccagcatccgcgtctggcacgtgggggcgtctcaagttccctctggaggccagacaggtggcgaggacgcgggggtgtgaggctcaaaggctggcacttat

SEQ ID NO: 29738 - DNA, 1032 bp, Homo sapiens
agagtgagactccatctcaaaaaaaaaaaaaaagtgtgactattagctgggcatgatggcatgcgcctgtagtgccacctactcaggtggctgaggtgggaggatcatttgagcccaggagtttgaggctgcagtgagctatgactgagcctgagcaacagaatgagaccctgtctctcaaaaaatgtgggactgtctctggcagttgggtcacctaattgtgcctggccccaagaaggaggggtgggtacttgaggatggtaaagaacctccccaccaaaggtctctgtttcttaaattctgattacatgtgtccccaggcctctagggactgatcactggagcatgaggcctgatagatcctggtggtcacttgttgggcctgggggcagaccaggggtctttcccagtgcatgagaagagatgggtgaggtgggaccagagtgggcgacagtggctggacaccagctgcctgagccccgccttacctctttgagggtggatttcattgtgtctatcatgaacgacagggactccttgtcagagtaattctctcttggatcaaaatatccgtggactgctctggaaagtgaggagttgggggttgttggggttcatcttagaaccgcctcccagcggtgcccccatcctgccctgggttcaggcctctgaggagaaaccaaagcctgggctaccccaactcccacagctgggtcccttgaccctgggttggatttgaggctcagttaatctcagctcacgctcagctggcacaagccaggcgcaagcaagtgctgaaggcacagccttgctggggcgcagggagttcaggacttggtcacagtcagccctgaacagcagagctgggatctgaacaggcgctggagcccacacttgctctgagagagaatttatgtcttcacaatcctcccattgaaagtctacaatcctggccgggtatggtggctcacgcctgtaatcccagcactttgggaggctgaggcgggtggatcacgaggtcaggagatgaga

SEQ ID NO: 29739 - DNA, 1060 bp, Homo sapiens
tgtacatgtccataatttaaaagtaggaaagtataagaaaataaaaagtgcctctaattctatccaaacacaactgttaattttttttttttttttttttttttacaaaaactaagctaagggaattgctggatttatttatttatttatttatttaatttatttatttattttgagacagagtctccctctgttgctcaggctggagcacagcgttcacaactcactgcaacctccgcttcccgggttcaagtgattctcctgccgcagcctcccaagcagctggaattacaggcgcccaccaccatgcccggctcatttttgtattgttagtatagacaaggtttcaccatgttggccaggctggtctcgaactgctgacctgaagtaatccgcccccttcagcctcccaacgtgctgggattacatgcgtgagccaccgcccctggccaagggaattgctggatttgttttcaaaaaagaaaccctaatttgtaaaagattcctctaaacttagagaaaaaaagaagcatgtagaagagggggtgtgagttctgaccttttttgaagtgcagcatgtgtgcctggaagggccccagtggcaagtgtccagctcgctgcatcccagagacagaacatagctgtgtagtcagcgcccaggtggagacacagcagcacatcccagaacccccgctgcctccaccacagacaaccaccatcccaactgtcatagcatagggtcactactgctgattcaggtagtaaaacttgtcataggaaatcagaataacagcaagaatgtccccacctgtctccagtgagagagcaggaatatgccgggcacagtggctcacgcctgtaatcccagcattttgggaggccgaggcgggcggatcacctgaggtcaggagttcaagaccagcctggccaacgtggcagaaccctgtctcttctcaaaatacaaaaattagccacgtgtggtggtggtgggcgcttgtaatcccagctgctcgggagactgaggcatgagaatcacttgcaacccgaaggtggaggttgc

SEQ ID NO: 29740 - DNA, 1046 bp, Homo sapiens
cacgcttcccttgggtgagcccgcctctgtccacactctcacccaggacaaacccatttccgtccacacccgctcgtccaggtgagcccatccccttctcatcgcctctgctcctagtccatcccccatcagctcttacctgggctgttataggccctcctactcggttgccctccttctcctcttgcccctgcttctgttctccacccacgtgccagaatgttcttttaaggacatttagattcgatcatgtctgccgcgcccacgataggcgccacacctactgcattccctccagtggctttatcaggtagcttctaaaacaaaaaccagacttcttaacctgtgtgggccacgtggtctggctggtgccgacctaaagctctttctgttcctctgagggaacatgctttttcccccctctgggtttttgcacgtgctgtgccggtttgttgcacagtggcgttctggcctgagctttaatgttgcttcctcaaagaggccatccgtgatggcctatggaaagaagacctctgccaccccatcaccctgtaatgtttctttcacaattgatacaagtttgctgtatgcttgttaattgtcttctccgttattgcaactgagcttcctgagttcagggaccgcagctctacgccaaccggtactgtgacggaggtgtgagaaaaatagaagcagttcctagctttatgaggattacagtcatgggtgtgccagcgattaaccaaagaatctcatcaatatagcctccagactgttaagagaagctgtgaaggcacaggcagtgggatctgagctggcaggaggggcggaggtgatgctaaggctctcctgaggaagcgaggtttgagctaaacctgaggtgagcgggagggaagagggtgacacgccaggtagagaggccagcatgtgtgaggccctggtgtacccgggggaacagagaatccaaggtgctgggggaagatggtacgagaagaggtcacagtgacaggcagggtctcacggggcttccagccatggttaggatt

SEQ ID NO: 29741 - DNA, 1050 bp, Homo sapiens
ctgcttcctggaccactgctctgaagcaggccccgccatgagtctcttctagagcaccatgtatttccttcattacatctagagaatgtctaaccactcatgtgcctgttcacctgtgtatcatctgcttctcttccaagaatctaggcctctgcccagactcttccttactcaactccagggggcgccatttgtgcacagcagcccctggagttgtggtgcgggaggtctggccccactgagagagggacagtcggctcttgctcactgcagcctcactgagccgggcctgtagcaggcccttacaaaagatttcctgggccaggcacagtagctcacacctgtagtcccagctactcaggaggctgaggtgggacgatctctggagcccgggaggtggaggctgcagtgagccatgatggtgccaccgcactccagcctaggtgacagagcgagaccttgtctcataagaaaaaagaacgaaagaaaaaaaattcctgggtaaaaagcaaagtacacaaatcgcttgtgccagaagctgctctgaaaccaagacataccagctccacctctccattgtgaaaagcctctcccaagtcactcagcccctgggacgtcctcacagcctgcctctggcgctgggcacccaccccagatccagcagagcatggccgtgacattcaccaacatttagtccaagacacctgaccaaactctcccagagcgtggctttctgggatgtgcagtaactgtatggcctcacccgggttgcttggcaatgctgagccttggtttctcctgctctaaatgggatgagggtgaggcaggagggggattcagtgagatgctgtttgcaaagcgcttagtatcctgcctggtctaaggcaagtccttgacatcctcggtaagaatagtgacaaatataaaatggccttggacagtagagtcccttacctgtggccaccttcgtggttcctctttgcaggagaagctccccgcactcctcactcaagtggctattgctcttcagtaacctggggggagacagaa

SEQ ID NO: 29742 - DNA, 1034 bp, Homo sapiens
actgtgctgctctgatctggggactccaagggcaggagctctcagcattttctctatccctagttctcagcacgtggagtacagaggagaagcttcataaatgcagctgagtggattaattccgggaagctcccgtaaggaccagctcccctaagttacacccgatactcctgcaccattgtgaatataaaattgccatgaacacacacacacacacacacacacacacacacacaaattgctatgaacacacacacaccagtgaaaactcactgccctgtttccaccctggccctccagctattttctgcttctcagactaaaatgacctgaagtgccttccctgaaacaggggttcccatactgttcccaaggcctgcgtgttctcatatgtcagctgccacatctcacagcagggtgtgaccaagctttttgggcctgcacacaggaggggcttcctgggcacaaggtgaacaggcaaacttgaccctgtctctactaaaaatatgaaaattagactgggcacagtcactcacgcctgtaatcccaccattttgggaagctgaggcaggtggatcgcctgaggtcagaagttcgagaccagtttggcaaacgtggtgaaaccccatctctactaaaattacaacaaattagctgggcatggtgtcaggcgcctgtaatcccagctactcaggaggctgaggcaggagaattgcttgaacccgggaggcagaagttgcaggcagccaaactcgggccaccgcactccaccctggatgacagagtaagacttggtctctaaataaataaataaatagaaggtaggtgctttgcttcagcagcacatatactgctaaattggaacaacaaagagatgattagcgtggcccctgtgcaagcgtgatacgaaaattgtgaaatgttcctttgcaagaaaaaaaaaaaaattcacatcacctgaggtcaggagttcgaaaccagcctgcccaacatggcaaaaccctgtctctatgaaaaatacaaaaaattaaccc

SEQ ID NO: 29743 - DNA, 1323 bp, Homo sapiens
tgatagatcctggtggtcacttgttgggcctgggggcagacccagggtcttcccagtgcatgagaagagatgggtgaggtgggaccagagtgggcgacagtggctggacaccagctgcctgagccccgtcttacctctttgagggtggatttcatcgtgtctatcatgaacgacagggactccttctcagagtaattctgtcttgaatcaaaatatccgtggactgctctggaaagtgaggagttgggggttgttggggttcatcttagaaccgcctcccagcggtgcccccatcctgccctgggttcaggcctctgaggagaaaccaaagcctgggctaccccaactcccacagctgggtcccttgaccctgggttggatttgaggctcagttaatctcagctcatgctcagctggcacaagccaggcacaagtgaatgctgaaggcacagcctttctggggcacagggagttcaggacttggtcacagtcagccctgaaaagcagagctgggatctgaacaggcgctggagcccatacttgctctgagagagaatttatgtcttcacaatcctcccgttgatagtctacaattctgtggtttttaatacattgagttgtgagaccatcgtcacaattacaggacattttcatcgcccccaaagaaatcgcgaacctctgagcttacgcggacacacacacaccccaccccaccccccgccccccgcccccaacaggcttccggtcctgagcaaccatgacctggctttgtctctgcagtgtgccctatttggacttgacttgaacgtgaatgcagccatacaacacgtagacggttgtgtctgaattcgtccacttagcgcgatgttttaaaggctcatccatgctggagcccgtgtcagtgcttcgtttctttttatggcttaaaaatcgtctatggtgggccacgcacggtggctcacgcctgtaatcccaacactgggaggccgaggcgggcggatcatgaggtcaggagatggagagcagcctggccaacatggcgaaacctcgtctctactaaaaatacaaaaataagccaggcctggtggcgggcgcctgtagtcccagctactcgggaggctgaggcaggagaatcgtttgaatccaggagacagaggttgcagtcagccgagactgggctcactggttatggagccttacctgggcatgccccccgctgacacctgtggaaaggcatgggacagccccggcccatcccctgctgcccgagccctcccctcctctgaccttcctccttccatgaccctgctgccaggggggctt

SEQ ID NO: 29744 - DNA, 1065 bp, Homo sapiens
atgaattatgtgatttggataagttcttaaactgtgttcaaggaataagaaatatttcttagggttttgtaacctaataagtttgggaactactgggctaaacagagttacatctgtttcactttcgggcttctcagattgtgtaatatgctaatggatgttaccatccagaaggaacatgcagtgtttcctaaacttaaaaccacaattagccaggtgtggtggcatgcacctatagtcccagttacttggggggccgaggtgggaggatcgcttgagcctggaagatcgagactagtgagccatcatcatgccactgcacttcagcctgggtgacagagtgagattctgtctcaaaaaaaccccacaaaaccctagaacatacagcactgcctgcgtctccattttctcatcagtaaataagaaaaacacagcctgggccacatagcaagacctggtctctacaaaaaattttaaaaatgagccaggcatggtggtacacgcctgtagtcctagctccttaggaggctgtggcaggagaactgcttgagcctaggagatggaggctgatgtgagctgtgattgagtttgctgcgaggtggaatgagatgaaggggtatggaaagtgttacacccagtgcctagctcatgacagatgcccagtaaatggtgggtcccctccccatctaaggaaaaactgacaagaatttttgactcttctctgctctccacaggcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgc

SEQ ID NO: 29745 - DNA, 1115 bp, Homo sapiens
gtgcgaggcccggccggctattttgcaggcatcaccccgatgctgcaggtgatccgcgccatcatgaaggaccctgatgaccacactgtgtgccacctgctctttgccaaccaggtcagtgggcatccccatgatggggaaactcagcttaccctgagaggggacttcgggcctggtcaggtgctgttccaggggtctgcacagctctgctgagattctggggatgaccgggatggggggccctgaatgttctgtgcactggcggccttggcagcagcacggcgggcaggctttgtggtgcagcgcctgtgtctggctgagggggctgccttgcggggagctccctgagcaccccctcccctggctgcttcctccaaaactcagaactcccttcaccatgagcacggtgtggaacccactggtagagtgggaagaatgctggcctggacatggaggggcccatcttacaaatgaccagacatttgcacgaagcccctgagctacagggtgtcagggcaggatttgaatgttggtgtctctggctcctgattcatatccttgtccacgagcccactgcctgcctgcccgccctggcctgctgtgtggtcttggacgagctactttccctctctgagcttcactccctcatctgtagaatgagctgatgaaactgggttgttgcaaggtcttttcaggttagtgttttgtgactgatgacgtagatttgggggagaagatgcttgcctgaggtccttggatgtgggtccttgccccaccctgcctccccgcagctgcagaaaactgccgcaaggccaaccaagatggccttgccaggcccaggggagaaagagccagaaattctaagctggctggtgtggagggagagagggcagcagtgagacttggtggtgctggttcagagtctgtggaggccgtcagaccgtctgtcacctgtacaggccatctttgcagctggtagcgagggcagtgtggtcgcctcatctcatacctccgaacacaggctccgggaggggcttgactgtgcatgtctcgtgggaagtgctgaaaccaggatgcaaaccagggttttatttatttatttattttgatacaaa

SEQ ID NO: 29746 - DNA, 1050 bp, Homo sapiens
gagggtgtataaacaagctctgaaacagctttcttgagagccagtgttttatatgaactttggcttctcagcctctctagttgaactaccagtatgggcttcacacactttttattttgaaataatttcaaattactggccgggcgaggtggctcacgcctgtaatcccagcactttgggaggctgaggcgggcggatcacgaggtcaggagatcgagaccatcctggctaacgcagtgaaaccccgtctctactaaaaataccaaaaattaactgggcttggtggcgaacgcctgtagtcccagctactcgggaggctgaggcaggagaatggtgtgaacccaggaggcagagcttgcagtgagctgagatcgtgccactgcactccagcctgggcaacagagcgagactccatctcaaaaaaaataataatttcaaagttactgtaaaagaacatttatgggctggacgcaggggcttatacctgcaatcctagaacttggaaggctgaggctggctgttggcttgagctcagaagtttgagattagcctgggcaacatggtgaaaccgcatctctacaaaaaatacaaaaaaattaccaaggcctggtggtacgtgcctgtagccccagttacttcggggactgggctgggaggattgcttgggtacaagaggtcaaggctatagtgagctgagatcacgccactgcattccagcctgggtgatagagtgaaaccctgtctcaaaaaaaaaaaaagagctcttatgtactcttcacccagatgtacctaatgttattatttgctacatttgctttatttctctctatacagtatatatctaatgtatgttaaatatattagatactacatgtgtgcatatccatacagtggacccttgaatggtatgggggttaggggctgacctgtatagttgacagtccacgtataggctgggtgcagtggctcatgcctgtaatcccagtactgtgggaggctgaggcgggtggatcacttgaggtcaggagttcgatgagaccagcctggcca

SEQ ID NO: 29747 - DNA, 1101 bp, Homo sapiens
caacatgatgaaactccgtctctacaaaaaatacaaaaattagctcggtatggtggtacgcgcttctagtccagctacttgggaggctgaggcagagaatcgctcgaacccagaagcagagtgagactctgtctcaaaaaaaaaaaaaagaaagaaatgttaatgaactcatcatagtgaagtcttgctaagctgtaagactcaagtggaagtggggaggtttacgtctttcctctcatcctgaattgctagtgtgcctctgactatttggatgatggtttcctaaaatgtgctgaatgtattttgcagaaatttaaacttctgcaagtgtaacatttcgccatcatttcgaaagtagaattgccccttgctgttcccacagtccataaaatctgccttgcttcaaagttgacattcaagttcagttttaaaatagtgtcatggggcttggaaaagagactcttagagtggcctttgctgacagctggctagaagcagcaccaggagagagatgccgctctccctccctcactccgacggcctccgcactggccatcgtggctgaggtgttgtatgttgatcagtctgcctgtgacctgcctcccatgcagaacatgagctttgtgctgtcccgcaggacctggccttggcagtggcattcagtaactgttggaaagaaagagcctgggggtcaaacactttcaaatgacagctcttcagtgattctttttgcaaaactgcccacaatctttggagcctaacatttccttttccttgtcttctctagtatgagaccagggcccgcctagagaggctgtcggcaagttcctccataagctcggctgatctgttcgaggagccgaggaagcagccagcaggtagggggcactgaacaagagctggtctctgtcatgtctacggtatgaacacatttcatctggataggactgtttccttttccaagatattttagcaaccattattcgatgctctgatctctgctataagtcaggtagagcagaagttactattccaggcttcacacgtaaggagaccaagtcatgaaattaaagcaacatcccatcattgcctggcaagtca

SEQ ID NO: 29748 - DNA, 1116 bp, Homo sapiens
taaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgcatatggaagtcccttcgccatcatctgtcttcatgcccacttcacttggcgggggtggcctccctggggcttactagctttggagctgggcaagatccagggcacaggacccctgcccaaaaggccacggcccactgcccctgccaaactggaggttggggatttgaggcacctgagccccttggggttcccttctccccgagacctgctgctgtttgacctgggcttccacatggtgcgggcatcggctggcgcctctctattgccccagcccaaacagcaggacaagactgacatcacccataactctcctatgagcacattttcctgagcacctactgtgtgctctccactttttacttacatt

SEQ ID NO: 29749 - DNA, 1058 bp, Homo sapiens
taagatggcaggtgatatttcatcgcctacagcactctcagattcagcacgtgaagagacagtgaatcactttaaggacttcagaggcagcgacattttttagccaaggtgtttctttgggccattttcctcctatgcctctccgggtgtgttcccgtcctttctcaagggtttatggtttgccccttaagtgtagattgaggatgtcagattgaaatcttgctctttaaactgtatccagaggttcttcaactctctttggaatgtgtgagccagagagcctcagggaaacagtgggacagaagtggaagctgcatgtgccatgacatccccaacctgggctccgcctgaggactacctggaaacccaaacatctggacatgagggctcggctcagtggagtatgggaccatgacatgacgttttacagccattaaaaatgactgaggccgggcacggtggctcacgcctgtaattgtagcactttgggaggctgaggcaggcggatcacctgaggtctggaattcgagaccagcctgaccaacatggcgaaaccccatctctactaaaaatacaaaattagccagacgtggtggtgcatgcttctaatcccagctactcgggaggctgaggcaggagaatcgcttgaacctgggaggcagaggttgcagtgagccaagatcacgccattgcactccaacttgggcaagaagagcaaaactcagtctcaaaaataactaactaaataactaaataactaaataaataaataaataaaagactggggccaggcgtggtggctcacgcctgtaatcccagcactttgggaggccaagatgggtggatcacttgaggccagaagtttgagaccagcctggccaacatggcgaaaccctgtctctactaaaaatatttttaaaaattagctgggcatggtggcgggcacctgtcgtcccagctactcgggaagctgagacatgaaagttgcttgaactcgggggcagaggttgcagttagctaagatcgtgccactgtgctccagtctgggcaacagagcg

SEQ ID NO: 29750 - DNA, 1049 bp, Homo sapiens
gaaagtgtgtgagttaggctgcatgtcacagagaccctcaaaataatagtggcttaaagagaagtttattcctctcatctgcagagtccagaggtggcatggctggtgggcacaccacactgtcagagacctagacttcctctgtctcgttttgtgcatggctctgttcccaagtcacctcatggttcgcgatgagaaaagcatggcattcatatttaacacggcgaactttgtgctaggattgggacacaaaaataaactccatgtggttcctgccctcaaggatcttaggtctcttgggagagacagatgcctggatgaccgccctccatctgaggttgattggaaggagccctgtgtgagaggaacacaggcaggcaggccaggcagcagagctgacatttgggaataaaggaagtctttatgaaagaggtggcatctgatcttgatcttaaagaataattagtatcttgacactcatctgggaggctgtttgagggagaaggatactgtgaagggaggtacgaagacctgaaagggcagggctctgtttggagccccgggtggcgggtcactctcctgccttgtccgagttgaagtagaccatcattctggagcagacgtcacacaattggaaagatgtccccagctgtgtgattagtatgacatccattctaaaaggtgaacaaaagaacctggaaagaaaccagacaggatcgttttggagttctgagatactcattcttttgcctgtactttggaagcaggatcaagccattcgtaggcacgccactcccactgaacatttcacaatccactgagcccagtgctgtcactgtgtttcagttctcagaagctattgacagcatcttcaatgagaagtcctgggacccagagtcagagcactttttactggttttgcaagatacaaatattaattgctgttgactttccctttaaattttagcctctgtatgtgggcaggacttgtagcatagatgagaccttgtgttaccaacattgtaagtaatttatgtgatgtggacgtg

SEQ ID NO: 29751 - DNA, 1024 bp, Homo sapiens
aagtgaggataggttttctgttctctttaacgttgagtttccatgggaaaacattaaacgttttcattttagctttgaaaatttagggttattaataccacctgtgttccttacaattgggggttttgtgacattttctgggctgttttggaagagagggattgtgtaagtgaatataccctggttgttaaccataataataacaacgtgatctctgcatggctctgttaaattaaaaaatgtaactattaatagtgtgtgaaatagttctcagcctagccagcagctggaagattacacattatgagaaactcatcaagtttaaaccacatggggatttctgtgtagaaatataccagttcctccttccttcctcgctgttcctgtttcagggcagccatcggctttgtggagccctctgaaccctggctggttccattgacgctgactgtgttcctccactaccttcccatcacctaaggtctcttctgtctcggacacctcctgcctctcccactctgcacctgccccattcccatccaaggttcaccttggtgtcgctggcttggaagccatttcctcacttccctgggtggaaagcagctacttcagtcctccaacaatcccaaggagtggtaggcagtgttagttttgttttctggatgaggaaactaaggttcaggaaggttaagtaacgtgcccctggttacccagctggtttgcagcaaggctgggattcattcattgctgcttctcacatatcattgcctcgtgtaagccaggtgctgtgcccagccgtgggatacaactgtgaacaaggcaggtgtgagttaggtgtctgcctccctcaacaccttgagctgtttgagcaggcaggcgtctggaataggcatgcagtgaacactgagcgaatgaatgagtgaatgaaagaattcctgtcaacattctactcttgttggactcgggttggcatgctgcctcccttagcatccagcctgtcactcttcagagtcacgcacacgtg

SEQ ID NO: 29752 - DNA, 1027 bp, Homo sapiens
gtctctagaagtcagggactttatcttgcacgctgccatctcctgttcctggaacatcgcaggtgctcaagatgtgttaattagcgaagaagcaaatgactagaggatgcagtgataatgacctttcgttcaccctgagaactaggctggccagggagtgtctctccctcttgtaggtaaggaaacaggctggcaggaagtgactgcatagagttaggcagactgtaaaagccagagcgggcacaagaatccaggtctcctgactccatccttccattgtgtgttctagtcccacccaactttgaaagcaaaagttgttatatatttctgttaaaaacgttgccctgtgggagtgcttcccattccctctgtggggttggctccactggaatggggaggggaggagctgtggagttgcatcgttctggttcagttaggcctgctctaactgcgtcacttccaatcattcttctttcaaatctttagactcttgtacatcttcttacactactgtttgaattctcatgttaatatcaaatttgaaaaagtgtcatttttgtcctttttaaagtaagtttttctgttttaaacctctggaacatcaactgagtatttaggttggggaagtgttcagcctccatctccacattcccagggtgcttgccaaccagaggctaaaaaaatattgctgtaaaaatcagtccaaggcaagtctggatctgtcagctgatgtgttcccattgcataagataaacgagttttggggacacatctaattacacgctgttagctccagctcttcattaagttgcataggtgagctaagagctgatgggctgcgctgggacgggtgaccttggggcctgtcctacctttgctgctgattctgatagcccaggtggttgtcagctggagcaagcggtctgaatgccaccaggatggctggtcatcagcttgtttcctttgacctataaagatgttggggaaaacatggttattttaagggttactatatgaatctgcatat

SEQ ID NO: 29753 - DNA, 1034 bp, Homo sapiens
cgggaggctgaggcaggagaattgcttgaacctgggaggcagagattgtagtgagccgagatcgctccactgcactccagccggggcgacagagcgagactccatctcaaaaaaaaaaaaataaataaataggccgggtgtggtggctcaacgtctataatcccagcactttgggaggccaaggtgggcggatcacgaggtcaggagactgagaccatcctggccaatgtgaaaacccgtctctactaaaaatacaaaacaaattagccaggcgtggtggtgcgcgcctaaagtcccagctaatcaggaggctgaggcaggagaatcgcttgaaccaaggaggcagaggctgctgcagtgagccaagatcatgccactgcactccagcctgggtgacagaatgagactctgtctcaaaaaaaagataaacttaaaaataaaaaataaataaataaaataaaataataaataaataaataaatttcttcaacaggagagtcattaagatacctggtttgctgtgctgctgaaaacagaattatgctctgtcattccttgactcattcattctagttgtgtttattatgtgcctgttacgtatcagtggtaggaacacgggcaaacaaggcaaaatcctggtgcataaggaacctacattctcgtgagtggagagagaaaagataatttggcaggtgaggttgagtgttaagaaaataaaacagagttagggctggagtatcagggctgggggaaggctttcttaagaagagggtaatgtttgagcaaatatctgatgctgggaggcagcagatcctacagatgtgggaggcaggtattcccggcagaggggaggcaggtgcaaaggtaagccgagtctggtgcatctggagaaccacatggaggtcactgtagccagagtccagggtgtggggattggaaggagcgagactggcgctggaagcaggggctagaatcacatgggaccttgtaatcagggtggggagtatcaataactgtgacagttgacaatagct

SEQ ID NO: 29754 - DNA, 1044 bp, Homo sapiens
atactattatttagggatctagcaaccttattgatctttaaaaggcttaagttcagaaaaagtttattgttgcccttttcttgctctgtgttttggtgtctgcccttctgtctgtctggcatctgtgcgagtcatgcgtcagggcatgttggggagatggaggccagtgtggctgggttgagttataaactggaagcaaggttgggagcccagaatccaaaccaggttcagactgggagaatatctgaaatccctgcagcagcaaagaaggttcctatattcacggtccctgaaggaattttgctgggtccccaggttctctgggagcattgatgtgtctcactctcatggtaccaaagactttctgtttttattcatcaacttcctgtatttccttctgctccctccttaacctggggttggctctagtttcaaagttaattctcaaatccaaacctcagacttaaaggctggtaactgcccttggatatgtttggggctggctcctgagaaacctcttttccaggaaagctctggcctgttagattttgctctgtaattttactgccttgctcacctaacggtggtcactggtgttctgagacacgtgggtggaactcagcaatgtttcttcacttgtatttttgtttgtttgttttttgagacagagtcttgccctgtcgcccaggctggggtgcagtggtgtgatctcagctcactgcatcctccacctcacgggttcagatgattctcctgcctcactctgcctcccgagtgaagtaatagctgggaccacaggcatgcgccaccatgcctggctaatttttgttgacctgtatttggatcttatatttacatgagaatttcatgcaaatagattctttccccctagaaatggactcagacatttttgcatgcaattcaatgtattcataaatccccattcatttttatttatttatttattatttattgtttttttttttgagacggagtctcgctgtcgcccaggctggagtgcagtggcgccatctcagctcactg

SEQ ID NO: 29755 - DNA, 1031 bp, Homo sapiens
acttgatccatcagtaaacctaagctcagagagattcagtggccttcagagggtcaccatcagagctggtgctctgcctaccgaagcccacactcatttcacctcctctggctggctggaataagtaagttgtgaatcactctcagatgtgaacatctttaaaagataattaatctttctcccccacctctgagaaacatagacatgagggagattatgtgtgtcctttgcttaagacggcatctatgtctgtaactaacttggtttcaataatctgaaagtttacaaccatttacacagcagggagataagggcacaaaagggagagctgctggggtgcggtcaaggccgtgggtgactcgctggtacacccaccccatgatgcatcccacgtgggacaggaggaagattccagaggccctggcttaggagtgcctcatcttcggcagatgcattttaaaaggcatcttatgctgttaaagagcaggtagacaagggagaagaaattgtgtttctgtagaggactgcactttgtaaaattgcgaaaggtcttcacattttgtcaacgttgtgatatcacataagagcatttgctcaggtatattagagcagatatttgttttgttttgttttattttgagacagagtcttgctctgtcgcccaggctggagtgcagtggcgcgatctcggctcactgcaagctccgcctcctgggttcacaccattctcctgcctcagcctcccaagtagctgggactacaggtgcccgccaccacgcccagctaattttttgtatttttagtagagacggggtttcaccgtgttagccaggatggtctctatctcctgacgtgatccgcctgccttggcctcccgaagtgctgggattacaggcgtgagccaccgcgcccagccgatatttgtttttatgcttgggataatcatcacttttgtgtcaaatgacttcttttttgctttctttaaatcttttaaaaattgaaggttcaacatagaaaacaatgttctgagt

SEQ ID NO: 29756 - DNA, 1029 bp, Homo sapiens
tggttgagaatgcagtagctgtgtgggttctgcttctctttcttttttcttttttgagacggaattttgctcttgtcgcccaggctggagtacaatggtgcgatttcggctcactgcaccctccacctcccaggttccagtgagtctcctgcctcagcctcccaagtagctgggattataggcatgcgccatcatgccgggctaatttttgtatttttggtagagatggggttttaccatgttggccaggctggtctcaaactcctgacctcaaacggcccgcctgcctctgcctcccaaagtgctgggatttcaggcatgagccaccgtgcctggctgtttctctttccatatggtttatgcttacagatccttgaggttaatatgtcactttcactgttagttcctacagaagaaaggtaattttgcaataaggttttggaggttaggaacatggttttggagtcatacagcccttgggtgtgggttcgagctccatcactaggtgactgtgcggcttttggccaaatgtttcaatgtctccaaaacttgagtgtcttagtcagttggggctgctataacaaagatgcggtggcttgtaaacaacagaaatttccttcttacagttctgtaggctgcaagtctgagatcagggtaccagcatggttgggttctgaggagggtcctttttcatgttgcggattgctgacttcttatagcttcacatgacagaaagaaggcgagagagctctcaggtactttttataaaggcatgagtggctgagtgcagtggcttatgcctgtaatctcaacacttttggaggctgaggcaggaggatcacttgatgccaggagttcatggccagcctgggtaacatagtgagaccctatctcaacaaaaactaaaaaaaaaaaattgtaaggacactagtcccattcatgagggccctgcctaattagcttccaaaggccctacttcctaatgccatcaaactgaggggtagaatttcaacatatgaattttgaggg

SEQ ID NO: 29757 - DNA, 1033 bp, Homo sapiens
acgtgtggctgtcattcccaggcatgtctttggttcttttcagcaggagtatgttcctgaccattcaagctgctgttttgcttacttaggttttttgttttgttttgtttttttgagagacaatgtctcacgctgtcacccaggctggagtgcggaggcatgatctgggctcactgcaacctcaatctcctgggcccaagccatccttctgcctcagccccctaaagtagctgggactacgggcacgtgcctccacgcccggctaatttttttgtatttttagtagagacggggtttcgccatgttgcccaggcttgtctgaaactcctggactcaagcgctccgcctgcctcagcctcctaaagtgctgggattacaggcgtgagccaccatgcccggcctcctacttaggtttttatgtaaatatcatcttattcaacggatccttctgcagcttgctttgttggctgagtggcgtgttttgaggttttgaggttcgggcttgttgctaactgtggcggcgattggtcatctgaggtcttcactaatgataaatcatggcgcgtgaacatgcgtggaggcacctggccatgcccatgtccgaggagtcctctaggaggacttggagaaagggccctgccatgcactggtgactataccagcacacactccccacaggggccgagtggtcctgttgcttctgtctgtcttatccttgcctgtgttgaagcctactccctaggacccagaccccccagcagggccccaggacattgttggaagtcgccctcaggttctgagcccctcccttctgtactgtgggggtcatcccgggagtcctctcctggagctctgtgcctggggaggtacgtccagcatggcatggatggcgggcttccataggggcctttcctggcttgttcttttctgggagaaacctgagccgactgccaccttcctcgggtgtgttttgggtaaagtcttgaggccagaaagatcttgcatccctcaagcactcttgagctggtgctga

SEQ ID NO: 29758 - DNA, 1047 bp, Homo sapiens
gagccagtttttctctgtgtaatcctgattggactaggaaccttcctgctggaaacgtgcagtgagtggcacctccttatgctacagtgtaacagagagtttcctctgcccctcacttctgccatatgctttccgaggaccactctggtcccaggcctgtgctgggtggaagggaccttggtttgttcatgaggacaaaaaggttcccatgggctgcgtggaaggagcacagtgggaatgaccagctcctgcccagccagcctccacggcagcacgccctccctcgggcggtcactcgcccgtctgagacctgttctccatctgggaaggggatggtgagacaccatctggctcccacagtattggaaggatgggaggtggcatgagaaatatgcctggcacacagagggtggtcgccaccgtgccacgtcccctgcccaggccgccttgcctgctgttgccctactaaggggcagccagtgtttttccgtgacccttccccagccgttaaggacagagctgaatcactgctttaccattcacaaacttgcagctcttcctgagtgaagcctcctgctgctactggcccaggtgtggaggaggccgccagcagcagcagcacctgccagcgctgtgggcccttacacccctggccatcagccctcctgcctcaccttaggccggctgccctggaaaggatggggaaacttgaagatacatacatatatatatatatatatatatatatatatatatatatatatatatatatataatttttttctttttttaattgagacggagtcttgctctgtcacacaggctggagtgcagtggcatgatctcggctcactgcaagctctgcctcccgggttcaaatgattctcctgcctcagcctcccgagtagctgggattacagacgtgcgccaccacacccagctaatttttgtatttttagtagagatggggcttcaccatgttggtcaggctgatctcgaattcctgacctcgtgatccgcccgctttggcctcccgaagtgttggga

SEQ ID NO: 29759 - DNA, 1022 bp, Homo sapiens
gtagtactattttactaagtgattttgtttatattagatttgaaacttcatataaatgcattgctgccattttcaattcaacattaagtacctaatccatgcagtgttatagaaaaaatgtttaaagtaatgttttttgttgttacttttaaatccagatttggacttaaagccaccactaaaatcaattggaagcaatttctaacatcatttcatgagcctcaggggttgcaagttagcagtaaaggtcccctgacaaaaagaaataggtatgtaaaaaaaaaaaaaaaaacaaattttagttacacatatcataatatgtaaaatatcagagaatatctgtgctactttttctgcatttattgaatgatcgattagtctccattgaataattgccaacttttatatagtgatttactgcttacaaatttttcttattgaaaactgccttaaactataaggttggtataattgttatgtcaatttctagatgagaaacataagatgatacaatctgaactccatcacctgctcagagtgtggtggagacagctatggaccacaaaggctccaggcacacaggccgccacggcaagcactgctccctagctctaagcatatccttgtaacattgtaggtaaacgtgtatttgttaggtgttacatggaaaggaacaatatatgttgatttgttttccagccactgagtggcccagatatcatgggtcatggagattatttgtctatcattatttctgttttcgttttaatatctattataacctcagatttgcaataccaaatatcttgtgatggggccccaaaatgttttttaaaaaatttaataatatgaaattttagaatttagctttctgctctgagaagtattttatgttgatgcgtatcctgtattcattgccctctatgaatcttaaagaaaaaaacaggctttataatcttggcacgttcattgaaagtgctgtgctctactgtaaagtaaaatataccatggagttaattccc

SEQ ID NO: 29760 - DNA, 1065 bp, Homo sapiens
ctcttctttgtaggggcccttttaggcttgggctctggctttggaggagcaggtttagcagacaagcttgcagatctctgtgatttgtccttcatcttggttttatctttttttttttttgagatagagtcttgctctgtcacccaggttgaagtgcagtggcatgatctaggctcactgcaacctctgcctcctgggttcaagcaattctcctgcttcagcctccctgagtagctgggattacaggcactccccaccatgcctggctaatttttcatagttttagtagagatagggtttcgccatgttggtcaggctggtcttgaactcctgacctcaggtgatccacccgccttggcctccaaagtgctgggattacaggcgtgagccacccagctggttttatcttctttcatgtcctattcaacctttctcttgggcatggtgatgatggcagtgggatgtcggtgctggttgcaggatgtagcagcacacagcctcttgtcagttcaggggacatctcacctctttttcacactgcttgataatctttgatttgtagtctattttatctgatacaagtaaagctattcctgctcttattttggttttcatttgcatggaatatcctttccatcccttcactttcagtctatacgagtctttataggtgaagtgggtttcttataggcagcatattgttgggtgttgtttcttaatccattcagccactctatgctttttaattggagaaccgagtcaatgaacattcagtgttattgttgatgagtaagaacttactgttgccattttgttgcttttttctgtttgttttaagtcgtcccttccttcctttcttactgtcttcccttgtggttgattttctctggtaatatgttttagtccattgctttttaggtttttgcattatagttaccatgaggcttacagaaacatcttatagatataacaaattattttaaaaagatgacagctcatcttaggtcagaaaaaagaatataaacaaacaagaaatgaaaaaactctacactaattctatctgtt

SEQ ID NO: 29761 - DNA, 1033 bp, Homo sapiens
ttcagtttgttctgtgcacctgaggcgctcagccgtgggaggaccattttgcgagtgtagccctgtttcactcggatcaggttggcacggccgcctgcgtgtctgtccacctcatccctccgtgtatctgagggagtaaaggtgaggtctttattgcttcactgcctaattttctcacccacattcgctgaagcgatggagagtcgggggccagtagccagccaaccccgtggggaccggggttgtctgtcatttatgtggctggaaagcacccaaagtggtggtcaggagggtcgctgctgtggaaggggtctccgttcttggtgctgtatttgaaacgggtgtagagagaagcttgtgtttttgtttgtaatggggagaagcgtggccaggcaggtggcacgtggcatcgcatggtgggctcggcagcaccttgcctgtgtttctgtgagggaggctgctttctgtgaaatttcatttatatttttctatttttagtactgtatggatgttactgagcactacacatgatccttctgtgcttgcttgcatctttaataaagacatgttcccggcgttgcgtcgagcgtttctgcttgtgggggtagaggggtccctgcagcggtgctgtcggtgcttgggacaatatgactgtgggccccgttgacaccccattccctggggttgacagcagagggaaacaggcccgtgttgggctttgatgaagcagaattcagactttccaggggttcacttctccccattatttcactcaaattcagactttccagggggtcagttcccccactatttcctcattcacctctgatcacttctataaatggggtggaggagaaagggtaaaagcatgggagatgcgggtgcacctgtgggtccaggtgtcgggacctcccagtctctgcctgggagccctgtgttcagcgttgcgcactgtggtgcccgaggccggcccctccaactgtgcttccccactgggaattccaaagcctgtcttcctgatttcctgtggaag

SEQ ID NO: 29762 - DNA, 1040 bp, Homo sapiens
atattatgacaaaagactgtaataagggctggggggataatgagccaggagccatagatggaaaccagcacatatcataatgtagcatgcttccatgtaattcccaccagacccagttaatagctctagaccccggaatcgcctttgtgtcttctctgaatcagtaaccaacccaaaatataaacactgttctcacttctgtcactatagttgagttttgcccatccttgaacctcatgccaatgggacatacaggattgtaccctggagcgccttggggtgggaggactccgtcacatcctgtctgtggggcttggccatgctgtgtctgcagttccgtcacatcctatctgtggggcttggccgtgctatgtctgcagttcattcttttttgttgctgtgtagtacaccatggtgactgtcacaacttactcattctattgctgatgggtatttgtgtttccaagtgactttatgaatgatgtggccaagactgttctagaacctgcgtactggtggacaagcactggcttcccttgggtgtctccccaggatagttcctggatcatgggctatgtgtatatagcttcagtagatactgggcagacgtcatttcctcatcttggctagcgggtcattcccccgacccatcattcctgcgtaaactgccaagttcagcctcaggttgggccgagtcacccacctgttacagcccctgagccacttccataacaggggctgggttctgttctgttctgttctcctaacagccctgtgaagcatcctggcccctctgagaatcagagccgactggcccatgacccagcacgggggattcaggctgagaccgtgcggggcgcgctcctcttcccagactcagtcgccctgggccccacctggggctcttgagccccttcttgggcagcaggtgttgacccgagcacagggccgggcgcgtgggcctcctctgagcaccccgcgctggggcttctcccctccaggcaccagcttgctgcaggaggtggtctacttggtgagcc

SEQ ID NO: 29763 - DNA, 1045 bp, Homo sapiens
ggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccggtgagccccgcgccgaccgcgcccgccacgccatgccccagccctgcagcgcggccgcgtagacgccgcgcccgcgcccggggcttctgctgggccgggtggtcgcccttggcctccgcccctgccgtgcccaccgctctcccgatgctcggatccctgcggggcggggtggggtggggtgggggtgggaaggggcttggttctcatctggggaaaccaaggtcagagaccttcgggagcggccccttccgtggagatggagcctatttggccggcgctgcaggaggatgggcccagggccgccacccatccctgcttctccctttacctggctggctgtgtgaccttggacaggtcactcaacctctctgttcctgaatcctgcccaacctttgatgagtgcaaagtcctggtgttcacctgggaagggagataacatgggcgtcagggctttcagcgtggaaacgtaacgtccctcctttccagcctgggctccgggtgggggatgggaccagtccccgcctggagtgccttgcttgtacattctcttgtttcagggctgcctccatcaccgaggcaggacctggggcattcacatttcccagcattagctgacgtcactttcacaataacagctgtgtgagctagtggtggtcattcccactttacagtctaggcacagaggctcagagaggggaagaggctggtccaaggtcactcagctggtgagtggctgacctgggaattaaagctaggctggtctgtttccagacctgaggtaggagattgtatagtaccccatctgaggtttttagggaaaggaggtagcagctttcctgttctgtaaacatgccctgggatttccttgttgccactgtatt

SEQ ID NO: 29764 - DNA, 1106 bp, Homo sapiens
tgccccttcccagttgcttgtgtcttgactcagcccaaaacccaaagcactttccgtatggaagaagatggtgggttgtggctggcctctggtgagactccactgccccacagtgctggctagttcagctcttcctgcaaaagcaaagccttcccctctagggacgagctgctgccagggcctccctgggcatgagcaccacctgggagtgcagcccttcctccatcacctgcaggtccacaggccaggggtcgagccccggacagcctggacatcggctggagctgggccaaagagggggtcacagggggagggcggcggcctggcagaatcttaggcagaactaggaaaagatcaggagacatctctcctgaaattcaaacaattggacaatctgttctggatcgatttagaagcagtggagtggaaaaaaattagaaaatatagtgtgaaagctattttctctccctctcagctcacttgggcagagggatgagctggagtttatttgcggactgtccaaggccctggccagggcctcgcacctcctccctgccccctgatccacggcctggcccacttatccccaatgcctgctgccttctcctccatgcccagttctgggctggcaatagggggtctcagaggggcagcatccctgttggttccaggaaccaacagtgtataggaactcagacatggacatggctaagatcggacgtttgtgttccaacaggcaccctgagggaggtccttctgtccctctctcccacactgccagacaaggcctctccatgccaaggttaaggtgtctctgcctagttcactcctatacccccagggttcaggccatagaatcagggctggcacatagtaggtgctcagtaaaagtttcttgcctgaatgatggaaggaagaaagggacgggggaaggaaggaaggaaactgaggctttaaatgaagtgacccattcacagtcacatggtctgttagagatggaggtgggattggaatcagatccatcaccctcgagacctgatttccacccaccccgccgcccatccctggggccaggagctaggtctgagacatttaggggcctccca

SEQ ID NO: 29765 - DNA, 1035 bp, Homo sapiens
tggtcccctcctgaggagacctgaggcacacggtcagggaaggggtagagggggcacctggggcagtgaggcagcacctccaactcatgggcagaaccaggcccagggatgggagtgctctgcccaaggcccttggagccccaacctgatggggagaccctcacctgctcaccgtagccctatcctgggcactttgccaacatcaccttgtttaattctcataactttctgtgagaagagacaggttgccattctcactaggagctcagagaggcaaagggacttccccaagggcacgcagccactatgttgcaaagccaggatttggacctggtggcttctgttctttctgctggggaggctgaatacactttgtggtcaggaggggtgctggtgtggggcctcagggtcaccacactcctgtgtccacccttcaccaccatgtggttttgcccagcctcctgcctcctgtctgcctcggtttccttctctgtaaaatgtgttcacagcaggccctcctgcaggagtctgaacccaggagggaccatgcagagtgctccgaagggccggccctctccactccttggttgttctttgactcctctttggggaggagagacacctggggaaggtgtggggcctgcaggagccacagaggagctgcgctggggttggtcccgcttccctgcatcttaacaaccaggggctggtttctgctgcctgctgcttcctcagaagggggtgggtgccaggcaggcatgggccggccacttgtccggtgcatgtcatgggtttattcactcctgagatagtacccagggcccgtcctcacaggctcacagtctgcagggactcgtgaacacagtcacctgttctggctccagactctagccctgtgtaagataatgcacaggtgtgggtgatgacagaggatggggagcaattctgccagtaggaaaggggctgagcatcaaggggaccctcccagaggaggcagcatccaaggaggtggagtctgagatgaccaggttgaca

SEQ ID NO: 29766 - DNA, 1034 bp, Homo sapiens
aacttttcagttataaattgatgaatatctttgtgcacaggctgtttcccaatgtcaagttattagggtagactccaggaggtgggattcttcaactaaagaatatgaaaacctttgaggcttttactacatattgacaaaatggtttccggaaatatttgtatccccttacactgccaccagcaaggataaacatgtccatcttgcccgtattgggaattatcatctggctaaatatttgctaatttgataatgaaaaaatagcatcgtgtttcagttggcatttcactgacttctagcacggttgaacatctttcatgtggagcgattgtatttcctcctttgtggattgtcagtgtcctttgctctatcttctggggtcagataaatttgtatgagctcggtatatattaaagatattaacctggtgtgtgtcatatttgctacagctgtttctgggtttttgtgtgttttatcttattggaattttgacatacatagtcgatctgtctccacagcactgtgtctgctagacaagaacacaaggcaggcaggtggattttgtctgttttgttcatggccgtagcactagcacctatgacaatgcctggcacgtgataggtactcagtacacttctgttgaattagttactccagtggatctgcaacgccttgggatccacggcacgtgataagcactcagtacacgtttgttgagttagttactctgatggatctgcaacacattgggatccacacatggatccagcagtccgcgctccagctcacaggccgaggctctcacactccagagctcgcaggccgaggctctcacactccagagctcgcaggccgaggctctcacacattttgtctcagggtccccttgcactataagaactcattgagggcctcaaacagcttttgcttatataggttttctctatcaatatttaccatattatacatttaaacagaattttaaaataattatttggaaaataaaaacactgttaaacaacattttaaataaa

SEQ ID NO: 29767 - DNA, 1044 bp, Homo sapiens
gcacaacaggataagcgtccaggagccacgggctcccaccccgagcatatcacatggtgccgaattgcactgaacacgcgtgtgtgcatcgcacgcggccacgaccacagacacgcatgcacacacgcagaggtgcagagcgaggaggccggcaaatcccgcagctgccacggtccctcctgtcattctcacgactccgggagaaactgtgctgtatgatacagatctattttaatacacttaccactgggtgaacaagatttttatattcttttattgatgaacaaagtgaaccgtgtgaggcacacgtcttctatattggctactctgtgccaagtatgcattaccgcgtggcttgcgatgtccatgtcttcagcttccttttctgttggtttggttttcttcgcggatggattgagttacatgttttaacagtgtaatgggaggatctgaaaggttggacccgggaggggtagctgccgatgtgtcttgagattgttaggttttttttggaccaaggaggaccgtccagtgggtagtgaggatagagaaaaagtgtttgtcttaaatacgccaatgtagttttccttctttacaatgtattaaactcgatcgatgatttcaaagccctgtggttttggtgtccttgcgttgcggagaggcccccgggagtgcccagggcagccaggtgggcgttggaggggctggaaatcagggtcttctcccatcctgaggagggagggatggagggagggaaacagggagagagctcagtgccctccactcactcacccccgattcccagtcctcagaggcggcgggtgaccctttagggctaggattgagggtggaaagtcttggaaacccagcaggtctgtcactgtgcagagcccaaggtggtgccctctgctccctcatgggttcctgcctctcagcctggcaacatcaccgctgtctctctcccccagcagcgggtacaggcgctcctgcagccacgctgagcttacaccttgccctacaagaggtggggaatcagcccccctg

SEQ ID NO: 29768 - DNA, 1053 bp, Homo sapiens
tcatgatcctaagcccagggctcccaggccgtgtacatcccacgccccactccgcaccaggcacgtgcgggacgctgaacacggctggcctgttcaccccacacaagcacacagaggtgggatcgtgtcccctttaggatttacaaaccacaggctcacagcaccttgcccaaggttgtagctgcaactcagcttgagccagccgggccgtgacctcacatccccagcctttctgccatccttcagatgcctcctgatttcagccataacagaaaatggcacctacagcaatacatagagaatggggacccaggaagcaactcggagcagaggcggaggctgggggtgggcggggccactgtcagactgaggttcccaggctgcctcagctgccctggggtttctcacagtaagggtgaggttgcggcacggacatgcttcctagcaggctcctcacatctgcaatgctctaaaacgcgtgacatgtatgtacctacaggtgtcaaggtgatgggcagtggaagctcagggatgtgaggtggcagtgtccactgcagggcggtggccatcaccccacgctgatcgccactgagtctcacggctgactgtgcttccccttctctcagggatgtgaggtagcagtgtccactgcagggcggtggccatcaccccactctgatcaccactgagtctcacggttgactgtgcttccccttccttctccccctgtcgtcacggcggctgcacagtagcggggggcaggaattacaaggttcattttacagacgaggaagctgaggctcagagggaaaccacatgtacggtcacggagctgcatgctaacttcagacagaacctgggcttctggctcccgacccagggcgctgtctgctccctcctgtcccagggcctacagcctgccttaggacagagctgcagccctctctggggccagccattgtcctggcctcagctagcatctgaatgagtctggctgccctcaaatcagtacacgccctgcaaagggcagtcggagcaaggtcccagccccgc

SEQ ID NO: 29769 - DNA, 1079 bp, Homo sapiens
ctgaccacatacctgtcccttcttcccaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtgagtgcccaccagcaggctccggaaagggtgtgcggccgcatacaggaggccgagagcaatcatttgggaagggccaaatgaacaagcccaggcaggatgaatgaccaggaggcagaatgatcaagtggacaaatgaatgaatgggacggaaacagaggagcaaatgaatgaatggagtatgaacacatgattaagggagtgaattagtgcatgaacaaatgaatgaatatgcgatccagagacaatacggctgcatgaattaataccagtggaaaaggagtgattggtcaatgaatgaattcattcaaatgattaaccaattaatgacatgtgtggctgaatgagtgactagaagagatactgattctctgtttctgctggtggagttggacggtcaagggctgtttttaccccactgcccaagtgcacaatctcccataatttctgccaagttttaaaactaaaactaaggtcctcccgctgctcccctccgagctcctggtggttgtgctgtttgaggccttcggggctgcctcatctctgccgtcccctgtctgtggcctctttctctctgttccccatttggggtctgccaggccgcccctctcttgcttatggctggggtaccttctgcttccccagcctggatgttgacggccgaccctcatgtgagctggtgctgttgcacccagtgca

SEQ ID NO: 29770 - DNA, 1081 bp, Homo sapiens
gagatgatggagtagactggacataagcaacacatttagggtgtcactgtccccatcacccacccgcagatgggactgtctagttgcaggaaaacaagctcagatttcccacttatgctatgttatggtgagtcgtgtaattatttcattatctattacaatgtaataataacagaaataaactacacaataaatgtaatgtgcttgaatcatcccaaaaccatctccctcccaggtccgtggaaaaaccatcttccacggagctggtctctgtgccaaaaaggttggagaccactgatgtaaggtacaaaacaggcagcatcacgtccgaacgggacagcagtggggaggagggacaacagcggggaggagggacaacagcggggaggaggctctggcgccctgtgctctggatcctgaactcagcggtcattgtctgggtgtggatgcaggaggagttcctccagctgtacccttaagacctgcgcacatcgctgtttgtaagtcgtatctggataagtaaaaaagaaaaggaagcacaccaagcagagccgaagtgacaaactgaaacatatctgagcttccgggagccagggccacaccctggtcatcagccctgtgcttggagacccagactccacctgacccctatcctcaggcctttcatggatggcagtggcaagagcaggtacgaaagcagaattcacactctggtccccacagggtccgcgtggaaggtgtgacatgacagagaggcagaatttggtgcctgtgctgccgagcggggctgcggtgagtgctctgggcccagcctgtcccaggagatgcacccagcacacctggagggcccagagcccttccctctgccaggccattcatgggagctgcgtggctgagaggttctatagggcagggggctgggccctggcgctggccaggatttaaggcccagcgggcacttcctaagttagcatccatggctgtcagtcacctgcccatgcgtcggtctgcttaaaaacaaaggcagcagagccctgccttgcgagatcattttaaatgagatcatgaacgtgaacagaat

SEQ ID NO: 29771 - DNA, 1033 bp, Homo sapiens
ctttctgagaaatgcatcattaggcaattttgttgttgtgtagacgtcctagagtatacttacacaaacctagctggatagcctactacacacctagtctgtgtggtatagcctatgctcctaggctacaaacctgtacatgttgctgcattgaatactgcaggcaactgtaatacagcggtaagtatttgtgtatttaaacatagaaaaggtgcagtaaaagtaaagtattataatctcaagtgagcaccatcatatataacgctgttatgcagcacatgactgtatataccctgaccaagtgagatttgtcttgggaatgcaagcgtacttcaacatataaaaatcaatatcatacaccacattaatagaataaagggaaaaaactatatgattatctcaattgatgcagaaaaagcatttgataaaaaaactaacagcttttcatgataaaaacagacagcaaactaataatagaagggaattttatcaacttgataaaaggtatgaaaaactcaaaaagaacagtatactgagtgttttcaccctaagatcaagaacaagacaaggaagggcactcttgttacttctctgcaacactgtactgggatttgtagccaggacaattagacaagaaaaagaaataaaaggcaagatttcaatgggaaagaatagacttttcaacaaatgatgctgggacaactggatatccacaggagaaacaatgaagttgagcccccacctcccaccatatacaaaaattaactcaaatgaatcaattaaatgtaagagctagaatcatagacgtcttagaagaaagcataggcatagatcttcattgccttgaattaggttatgatctcttacttataacaccaaaagcacaagcaataaaagaaaaaatgaattagacttcatcaaaactcaaaacttttgtacttcttaagataccattcaagaaagtgaaaagataaccaaaagaatgagagaaaatatttgcaaatcatatatctgataagggatatatatatat

SEQ ID NO: 29772 - DNA, 1030 bp, Homo sapiens
aatgtagtcactttttgaggtactgggggttaggtcttcaacataagaatttgagggaaataaaactgagcccatagcagggtaataggaaaggctttaccaagttaaagctgggattggaaataccccatttctgtgattaaaaaatgtacctttgacatttctgaaatcagtatatttctgaccttcagggtacagtttaaaaaggcatactgccctggttttaccattagtggttgaaaggatggacagtacagacttctactgggaaagaggtcttagtgttagatgcatcagcttcttgggtcaggggcaagatttttctctaagttgcctatcggaattgaatctgccttgcctgagcctctcctttcagactttcttccctctccccagccatcagtgacctttcagtcttcatcccaggtcctctttcttcctctgcctcagagcctagttaattgcttctattcagtgaaattagagttcaagagtctgggactgggattccttctcagagaatgcaggagtagaaggcaaacacatctgacttcttgcttacgtcatagaacattacaggatgctgtggactgaattgtgtcccccacgaattcgtatgttgaaaccctaactcctagtgtgattgaatttagagtaagaaagtaattaaggttaaatgatgtcatatggcatgtgaaaacacagccagaagctggccatctgcatactaccaggaactgacttgccagcctccaggactgtgagaaaataaactgttgcttaagccatcagtctatggtgttttgttaaagcagtccaagctaactaacacacagaggtacgagtccctctgaaaattgtcagtgttccttcagttctctttgggtcaacttcagtctaagaataggtcttaggccagtcaagctgtacccctgacactgaggatggttccactaattcgccatcccctaattcaggagggggaaggatagatacgtgaacaaaattgagatccttttgagaaggaaga

SEQ ID NO: 29773 - DNA, 1053 bp, Homo sapiens
gagcactcctcgggacaccgagtggcctcagggctgggttcagagctcctcccgcagggggagcctcagaagtggaggcagctgctgatgggtgagtttacaacttcttatcctgcctaaggcgagtaggcgtttttattccgtttccagtccttgagctcagcagatcaaaataacagtgaccctgcaaccccacagagcccgcgacacgctcgctttcttccccgccctgcccctttagtccccgctctggaaggccaggcagtttaggtgtaaataggtatcttttatggtttccaaatgaattatttgtgtgagagtaattaaatctgtaagaaaacctgttgagattcttcactatgaattatgacttctacaacatgtattttagcaaaaacacgatgctggcctccactggatagctcagtatgctgattgccagtgatagttctgtacgcgttaccaacagcgtctttattaaccctcttccacatccagtggaaatcattgctaggcggtatttgttggttggctgttagctttgctttatgatttcatgtttcttttaaaggttgttttgcatgttgaatattaaattttttttttctgtgtcttcctctaatctttttctgtaatgggaatttcagggtaaatacagatattatagcaaagcaataatttaatgattgaaacttaatttgcccccagtgattcctgaaactttttttggagctttcacacaaactacttttttgaactagagtgtgttggaggcagagaaaaatcaccctgtgtgctggctttgcctgccgtgagccagtgaggagtccgagaagaggtgggcaggtcagtgatgggtttggccagagatgccatatttgcagtattaaatcatttcaagatgcatttcaaggcctggcacggctcacgcctgtaatcccagtgctttgggaggccgaggcgggcagatcacttgaggtcaggagttcgagaccagcctggccaacatatggtgaaacccccatctctactaaaaatacaaaaattaaccgg

SEQ ID NO: 29774 - DNA, 1004 bp, Homo sapiens
cccgctaagggttctgtgggattggggaagccctggtgcatagctgcagctcctgtgcagccccagccccgctcttctgtcttctggaggcccttgtccctctggacctctgatccctcctgcatgcggtgctgggctaggcagggccaagcgggacttgtaaacaatacgtcatctaatatcataacccctgtcaggtaggagttagcccgtgtcttacagggatgaagcagaggctcagagggttgagtagaccttccctcggtcatttccagcagcttgggtctggtgcactcagcttcctaagagggcagagctcactgcctatcacccaaacccggctgtcctgcccaccctcccagcgtcctgagagcagccaccaggtcccctggtgagtcagcctagtgaaggtcctgccacccgggtgggcacccgggctgttctgcagctgaagtagaagcgtgttttgactggatgtgatttcccactttccaggtgatgcccgcctctgggcctttatggctgtggctgctgtgctgaggggagctttcccacccaggcctaccgactccttggaagtggggctgcatgccctgcgtggcctgtgctggggaactcggcctagcacctgtgcttacccgttccacttgaacctcagcctccactccttagaacacctcgcctgcctcagtctgcccaccctgtaccacaccgtgtccagagcacagaaccctggggaactttaaaacaaaatgcccattccttcccccgacctgggcatctgagtgaaagtcctcctggggggccctggagtctgtggtgtaattcattcgttccctctgtctgggtgtgtcagcctgagttggtggccactgggctgtctgtttaccacccctgcccccatgtgatagatggggccactgaggctcagaagcaggagggactggctgtgatgccttcctccaccttcctgatctggcctgctcccagccacctgtccttgg

SEQ ID NO: 29775 - DNA, 1046 bp, Homo sapiens
gaacctggggatacccagggtcagggagcgtcacctgagctgttgggacgccatgtggccctgccctgtctgtccctccatctctatgtcagcctgccttgcagggccgagttggtagcacgtcctcccccacagctctgttgctggacaaaggccctggtggctgggggcctctgctggcctggcttctgcctggggctgcatgccacaggggttctgaagtccccgggaagaggcagggtcctgactggcagtggactgctgtgcatgacccattgctgaggctgcagccgcctgggcttttctgtgcagctcctatctccggtgggggccttgctggtgtgggactgtcacgttgcagaacaggaaagggctggggctctgcctccactgccctgcggtgggaacccctgtgtgtgcctgtgggcatgcatgtgagtgtgtgtgagcatgtgagtgcgtgcatgtgagtgtgtgtgagcacgtgagccatgtatgttggaggctggaggtactttctcaggtttggttggaatctgatggggtggaaagggcttggcgaggagccttagctgtgcccaccctttctggtcctgaccctactttgatggctgccctgcctgaattcttcagcttgacccctcccctcccctccacctccatgccagcaccccttcaaagcttccccctctgctttttccatctgctataactcttcatgtatttttggtttttctgaacatctgacatttttttacctagatggaaactccatgagggcagggatctgttttgttcattcttataaccccactgcctaaagaatggcccacgctggcagtttattagatggatgagtgggtggagggacaggtgggcagctgagtgcaggtgagtaggtggaagggtggatagatggatgaatgatggatagttgggtgggtgggttgatgcatgatgggtggttggatggatggatggctgtgtgatgggtggttggatggatggatggatgtgtgatgggtggttggatggatggatggatg

SEQ ID NO: 29776 - DNA, 1104 bp, Homo sapiens
ttggctgggccctgtcccctctaggtaggacccaccaccaggctcatcctcatcttgggtcctggaggcctcctgagctgccaccaacgtccttctaaagagagccaagtccctggcccacgccttggcttggaaggaccctgggtttgttttgagggggttggaaacgccctgcagggggagtcgagatggggttctgtacccaggttggtgctggggctgtagggaccctcatgtcctggtgatcagcagggctgaccgccccctaagtgccagctgtgtgtacccccagtgccagggaccaggtgttgtggtatccagagtcctgtggttgcccctcccctaccagtcttggcaaccaggacttcccgagtccactcgggcccaggagacgctgtgtttgtttggcacactgggtcctcatgccgctgtcttcccggtgccataagagccctggcaaacaaggagtgttttatctcccgtggctccaggtctgtgtaggctccaggagatgctgggaggctttggggtgcagcttcctcaggagattgaccctggaagagggttcctgctgactggctggtttcctcggtgtgttctgggcctcgttctcctaggactgctgtgataagtgatcacaaaccggggcgctgaaaataacagacatgccttccctcagttctgcagctggaaggccgaaatcaaggtgttggcagggccggctgcgcttcctggaggctctaggaggagcccccctgcctccccggcgcctggtggctgcaggccttggcttgcggctgcctggctccaggctctgcctccctgtgcaccagcccttccccttgcttctcatctccctctgcgctcattttacgataattcatgttgtgattgcatcgagcccacctgctaatcggattgcctcatctcaagatccttaacttaattgcacttttgccatataagtaaaattccttcttttgctatataaggtaacattcccagattttaggaattactatgtggacacttccttttgggggccaccgtgtagcccattacagggtgggttatttcctagtctctcctccatcgtcggtgttg

SEQ ID NO: 29777 - DNA, 1046 bp, Homo sapiens
gcatcctcccgggggctggcaccccacagagagttacccagcccccacgagagtccacagtgctgccatggggtacctgtcctggaagctgaagcccgggggttcctcctttttcttcttatcttaaaacagcattggccaggtgccgtggctcaaggctgtaatcccagcactttgggaggctgaggcgggtggatcatgaggtcaggagatcgagaccatcctggccaacatggtgaaaccctgtctctactaaaatacaaaaaattagcctggcgtggtggcccacgtctgtagccccagctacttgggaggctgaggcagggaaatcgcttgaactcgggaggtggaggttgcagtgagccgattgtgccactgcactccagcctggtgacagagcaagactccgtctcaaaaaaaaaaaaaagccaataaaacaaaacaaaacaaaaaaacaggctcgttggccactcagcgtctccccacaggagttcccggcactccccaacaaggggtttcttgtggtcagacgtttggattcctgttcaggaaacgaatgccttcagattgttctgtgaggacttgaagcaaagcagagacaacagaaggttcctgataaactccaggtgtttgatccctgtcgaagtcccggctggtgccttcactgtggcgggtgggcctgtgtgggcttctcccatgatatttagctcatggtataaacagatggcgactttggctctacccaagccatactcagcatctttaaggtgggggagtttggtgtctccagggtcggaaggtggcttcctgctcttggaaggagaagtagttccacgtcttagaaacctgttcatttctgacttcattcgacagcttggtttgaaggaaatggttcttgaaatgccctttagaatcgctttctccttttgtacaatgtcacgccaaaataagacaaatttttactaagaatcaattcttaactctttttgccttttaaaaaaattgaggtgaaactcacatacgataaaattaccactttaaaatga

SEQ ID NO: 29778 - DNA, 1047 bp, Homo sapiens
catggggattgtgcaggggacaggatgtgtccctcagagctgcgggccttgtttggaggcttacgcgtgtcccaagcacagggggcaggcctgtaagaggggaatcatgtagcaaggaggctggcccagagcaggggtgattgagaagtgggcgcgggaccgcctgggtctgtgtgcttcccaccaccgcggtgcctgttcagtctgtgcctgcatcgtctcagtgaaatcttacaggatccccatggtaagggcagagaaactgaggctagagagcttgtagcgacaggaagagccaggcgcagactctggggtctgtgtgctctaatcgtggtgctgacagccatcttcggtcccctctgtctgtcagtggcgaggccctggggcacagagctggaggtttctgaggacggaagctcagtgcaagtgactgcgttgcctgaaacgggacggctgagagttacctgcacatggtgcctgattgtgggggtgggcgacagtggcagccgtgctgcaggactgtgggaggggctgaggctggagaaggggctccttggagccttctctgggtccttgtggggtctcttatggtagagctgtcacaagaagctgtagagtgaaggactggtgggcaccaggtgcagggaggcaggcatgtcactggtcagagctggaggctcttatttggggagcctggggagggagataccagatgaggagcctgctcagagcaggggctgacgcacctgttgaggggccttccagctcagagaagctgcattgtactagccggggagtcgcctttctcctgccctgtattcttccctccctccctccttccaactatccatccacccatcaagatttttctttctttttattttatttatttatttatttatttatttatttatttgagacagagtctcactctggcacccaggctggagtgcagtggtgcaatctcagcccactgcaacctccgcctcacaagttcaagcgattctcgtgcctctgccccttgggtatctggactacaggtgcccg

SEQ ID NO: 29779 - DNA, 1025 bp, Homo sapiens
gaacaacccagtggggtcggtggtggcaaagattcgtgctaacgaccctgatgaaggccctaatgcccagatcatgtatcagattgtggaaggggacatgcggcatttcttccagctggacctgctcaacggggacctgcgtgccatggtggagctggactttgaggtccggcgggagtatgtgctggtggtgcaggccacgtcggctccgctggtgagccgagccacggtgcacatccttctcgtggaccagaatgacaacccgcctgtgctgcccgacttccagatcctcttcaacaactatgtcaccaacaagtccaacagtttccccaccggcgtgatcggctgcatcccggcccatgaccccgacgtgtcagacagcctcaactacaccttcgtgcagggcaacgagctgcgcctgttgctgctggaccccgccacgggcgaactgcagctcagccgcgacctggacaacaaccggccgctggaggcgctcatggaggtgtctgtgtctggtgagtggccgtcggggtgggaggagtagctcctgatgggcctcctggagagcctcaggaacccgccaagggctccgcctggcatgccggggcgcaattgggccgggcccgggcaactctgcaaggatttgttgccgccggttggatgctgggggtgggcgcccggcctaggcccagcgagggggagaggcaccgcgccgcttccgtcagcattttcctgggagcaggcctgcggttctcccaagttcaagaccggggatcagcgccttcctcagcaggctagtggctcctgagtacagctattaaaaagtggcctccaggtgatctgggtcacaggatttgcttggagatgctctttcgtcagccagccacagggctctctgggaagatcagaggtcactgccccttcccagtgccaattaattccagggtgggaccgttggaattgtcagatgggtccctgagtcaccctataatgcagccggtgttcccttggtctggcttttctgt

SEQ ID NO: 29780 - DNA, 1033 bp, Homo sapiens
actgtggtgtctcacgagaattctgtcacgagaatttatctctgtcagcaaaagaatatgaaagtgcccccaattcccaccttccgccctttgcaagatgttcccacagcatctgtccacctgggtcaggtgtgttttctcccgcggatgctgtggcatgtccacacaccacgtgctgtgcggggatgctgcttggtgccggcaatttgagactaaccctcagagggcagttccttctgcttctagaggaccgtccgcattcttctgtgtgccagccctcggtggtcccactgccgtccacatgacctgccctcagatgagcaggcgccagctctccaaccggtggacgctggcaagtgtttcctgagcccccgcagggagctgctctccgtttgctcagattcttggcccggttctttatctcctaattagaaatgagagtatcgaagactagggcgtaatgccgatgacacaccgaggtgaggagagcaggagaaggggtaagtgctgctaggctggaggcgtctcactgtggagttctctcactgtggagtcctcagcttaacacagggacaatggcctgaaggaggaaggaggcagagcctccatcttgagcccagccttctttttcttttttttttgagatggagttttgctgtctttcgcccaggctggagtgcagtggcgcaatcttggctcactgcaagccccgcctccctggttcatgccattctcctgcctcagcctcctgagtagctggggctacaggtgcccgccaccacacccggctaattttttgtgtatttttagtagagtcggggtttcaccatgttagccagggtggtctcgatctcctgacctcgtgatccgcccaccttagcctcccaaagtgcagggattacaggtgtgagccaccccgccctgctgagcccagcctttttggcaagaaaggaagccatcatttatcggacatttttgtgcttgaaactttttcaccctttatcttattccagtttctaatcccctatggggt

SEQ ID NO: 29781 - DNA, 1029 bp, Homo sapiens
tccacagctggcgggggggcggggttggtcagaggaggttcacacagctggaaggggcaggggtggttcggcgaggggggcgtgggggtggtctgaggaggctcacacagctggggtggggaggcgggggggggtgccagtgacaggtggggttgtttatgggtgtgagcctcacaatgacctcagcgggtccttctcgtgcagatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggtgagttgagaggccttagactccggggaccggctggggtggttgggggccgtgggctcggtgacctgagtgtccctgtggtgagcagcgtctttgtctgctgggccctggcacagctaaagtcggaggtgagtgctccgctgtttgcctggtggagaagggcactgcccagccccctcgccgggactgtgggacgggcactgagcaccgggtctgtctctgcccgatggcttcctctccctctcgcctgagccccattggtctggactgtctcttccctactccttacccatgtgtccgctccagtgttgggggtccctctgctgtgctcccggacccctgtactgcaggacatggcccctgcccgggcctggcctctggccctgttcttagagccttctgtcccagcatcatccagctctgctcagacatccaccccatcacaggaggctccccctgtgccctgagctgcttttccccagagcgtctgggaccctcatgtgccagggtttagaccccaagatccctctgtgcaggacacgctggcagcacatgcctctgggaggagctgtggccccggctgtgccctgcgcacgtggcccgggcaggtgcttcctggttccccgtggagctggctgcacttgggacctggcgcaggggctcggggcca

SEQ ID NO: 29782 - DNA, 1036 bp, Homo sapiens
agatggttatgagtcccacatggggcatcctagctgggccgagagctggaggtgtggaggaggggttgtggaccatggttggggagggcctgctgcaaggcagggacgtctgcacgtctcagggctcctgccagacaggagtggtggttctgagggttgcaccagaagcaggagatgggggtttacggtgcccgttagatagctgtggagaaggtgggctgtaggtggttgggggaaggggggtctcccggaggtgctgggaggagactccttcaggctccatctctgctggccgggtgctgttgcacccatagaggccaagactggggttgaccactggccttggccctgcagaggccattgggattgcagtgagcagttgaatgtcgtaatcagggcgagagctcggggcgggggggggaggctaggaggtggaagaggaggcaggaagtgaagtgaggccccaggccctgtgccccagacaccagctgcgtcaggacgctgcaggctcagtgctgaatcccctcctgctgctgtacaggcaccagggatgctcatgagcagcctttcagcagcccttctccgcattgcccagttccctccggccagtgttcccaggtgtttcacaaacaccttttccttaagcctgttggcgacattgaacaggagggagggagttttgtcacctcgcatgtgcccctgccttgggatccagcattcccacatgacagctgtgctccctgcggctgacacgggaggctttttgttgaggtgaggcttcccccttgtatttgaattggctgtgaggtgctctaaggcgccgagtgtcatttaaaatcagaggcacctcgcagccgaaagcactgctgcccggcgtcatggcccagccttgggagaactttcttcagcctcaaaacattgctctgagtcctgttaagttgtgtagttttgtattttcaaaacaactttttgaatgacaatagtaaccatacatacttcaaacggttttaggaaagtttgcaggtttaatgaaatg

SEQ ID NO: 29783 - DNA, 1050 bp, Homo sapiens
gggctgaggaccccgcacggttattgggtcacaggactgaggacctcgcatggttgaggacctcgcatggttggagctgcttggccctccgctgtggtgagcgtggctcctcataacacccaacgcttagcaggagcctttggagaccatttttgttgctttgtagctctggaatcattttatttttattttttttctggggccattgtaaggaaaacacaatgtgactgagacacaggtggcctcgaatcacctgttacacccaatgttcacaatgactcaattgatgaaaagggcgtttcctgtgagctgatgggaaggtgggtggagaagcaagtggcctgaaagtccactccgaggtgaggcgggtggggtcctgcccctcagagaagttgggggtctctggagaggtggggcgggcggggtcctgcccctcagagaagatgggggtctgtggagaggcgagtgccagactggaatggggaagtcattagggaagacagccacaagcaagcttgttggttggtatagaaatgtgacttacgatacttataataggatgaaaaccaagaatcagacatttaaaaacccagcatgaacgttctcatcagtaaagcctctccatcatttttcttaaatataaccacaatattttcacacctgaaaagagtaattcctcaatggcaaatacacagtctcacttaaactgtaatttaacagtctgtgtgttgtgtttatattttgcttccacttgaagcagcttgaacaaggctgtagccgttgagtgccaggcccctgagactttagtgtctgaaggaaggagatgcctcctgggctgcactgttggccccggtctgccccttgtacaggccctcccgcaggctctgccgtagccgcgactcagtctgccgagtgcagaggttcgggctgttgctgtgagctggccctgccagggctgacttccccggggctgcgtgtcagctgggtgggggccacgccacagctgggattccagcctgtctgatgagcctgtgggacggatctgcagct

SEQ ID NO: 29784 - DNA, 1063 bp, Homo sapiens
ctagagtacatcccttgtgttcttaattctcgtttttatttaacgtatttgtttttaaattataaaagtgatacatttcattgtaaaatactgaaagtgcagtgggcaagaggccctgtgcagacagtaccctgggctgtggcagcatccgcccggcaccctccagcgtgctttagctgaaggagctggggtcgggaaggtccctgcagtacttgggtcttatgtctgtaccgtctgcgtgtctgtgtgtggctctcagataggatgggcttgtgggttatatggaataataaatatagagtcaactaatatcctgttttagtttgtaaatgattctttttcctccctaaaattaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacggtaagaactggcgccgtgtccggaggaggtggaagacgctctttctagcagactctgtcctgctctgtgttgccagctccctatcagcatggtccgggagccactagcatgcaaccgcatacatcatttacattttctagtagcctcactgaaaaatggaaaagaagcaggtggaatttactttaataatatgtcttattttactcagtgtatggaagagttgatttcaacatgggatcggtaaacgttactgaggatatataagcttttcaccttctttgccatctgatgtgtattttacgctcagcacctgtcacttcagactggctgcgttttgggtgcccaccaagaggactgtgtggctgtggctccctatggggtggccggtctcgac

SEQ ID NO: 29785 - DNA, 1085 bp, Homo sapiens
gtctttgcttagttttcttatctgaggtctgtttccccttaactcttctgtccgagttgagtgggggtgctcatcgcctcagctgggaagctgctcttccatgctcttcctcactctaattttggggttttcagcctcttgctcacatgagctccctcagcctcccaagtagttggggtcacagacgcacacctctgcatctggctcttaagtttttaaagcattttcatcaaagcctttttgctcacaacttgtgggctgttgacatttccagaagccctgactctggagaagatggtggcttgttgtgatgaggtcagaattttttctcacatctcatgggtcagaagaaataaaaacaaacagaatctttctttctttcttttttaagagatagggctggctgggtgtggtggctcatgtctgtaatcccagtacttcgggaggctgaggccaggagttcgagaccagcctggccaacatagcaaaaccccatcttcactgaaaacataaaaattagctgggtgtgggccgggagcggtggcttatgcctgtcatcccagcacttgggacgccgaggtggacagaaacctgaggtcaggagttttgagaccagcctggccagcacggtgaaaccttgtctctgctaaaaatacaaaaattagctgggtgtggcaacgggcgcctgtagtcccagctactagggaggctgaggcaggagaatcgcttgaacccgggaggcggaggttgcagtgagctgaaattgcgtcactgcactccagcctgggcaatagagtgagactccatctcaaaaaaaaaaaaaaaaaagactcactgaaccagaagagttaagtgttgtgctattgactgcacatggtttgcctcagtcccaagtggtaaaaacagactgctcccaaaacagcaggccatgaggtgaccaggtccagcccagcccagcctgcagaggaggagccctgtggggctgtgatcagagcccagcgtcccagtgcacctgccgatgccctctccagcctctggcttccttccgttggctgtccttggagggctgtgcttcgtgggcaggc

SEQ ID NO: 29786 - DNA, 1026 bp, Homo sapiens
cctgaacattttccttatgtccagcttcagccttgctgtggtattttaaaactggaattacatatatatatatatatatattttttttggagacgaagtctcattccgtcacccaggctggagtgcagtggcgcgatctcggctcactacaacctccgcctcccgtgttcaagcgattctcctgcctcaagccttccaagtagctgggattacaggcacctgtcaccacgcctggctaatttttgtatttttagtagagacgaggtttcaccatcttggctaggctggtcttgaactcctgacctcatgatccacctgcttcggcctcccaaagtgctgggattacaggcgtgagccactgcacctggcctaaaactggaattttaaatttttaaccagattgacaacctcttcattagcaactttagactgttgacttatgttggattactgatctattttggatttgtttccatgatcctttttttccctttttctttatttttcctctgagactgagtcttgctatgttgcccaggctggagtgcagtggtgtgatctcggctcactgtaatgtcttcctcccgggttcaagcagttctcctgcctcagtctcctgaatagctaggattacgggcgtgtgccatcatgcctggctaatttttttgtatttttagtagagatggggtttcaccatgttggccaggctggtcttgaactcctgacctcatgatctgcctgcctcggcttccaaaagtgctgggattacaggcggaagccactgcgcccggctcactttttcttctgatgtattgactcagatggttttgctgttttggagtcgggggcatttttcctcctctactcatttggaaggtgcacattccatttaactctctgtattcaagttttttcagtattttactgtggtcacgtacacataacataaaatgtaccatcttaatcattgtaagtgtatagctcaggggcatgaagcactttgatattgctgttgctgtgcagcca

SEQ ID NO: 29787 - DNA, 1722 bp, Homo sapiens
gttctgccgcccgtgggggaattttgtcagcttcactgagacacttagtaccctccccttacctgtggttttgctttccatggtgtcagttgcccatggtcagccatagtctgaaagtattaaatgggaaattccagcagtaagcagttcataagttttcagttgtgcaccattctgagcagcgtgatcacagtctccctgtcgtgtcctgcctgccgggagcgtgaatctaacctttgtccagtgcacccacgccgtgcagctgcctgcaccttaacccgcttagtagcaggtaccaacatccaggctggcgctcggtcctgttccaagtttcaggcagccgctggaggtcttggaaccatcccccttggttaaggggggactcttgtcattcacacaccatgaaatttacccatgtgaagtgtacagttgagtggattttagttcacagagttgtgcatttatcaccaccaccaattttagaaatttttatcacctccaaaggaaaccctgtgcctcttagccattaccccaacttcccaccttctcatcctcccccagccctggcagccacccatctgcatcctgtctccgtgtatttgcctgttgtgggcatttcatagaaatgtgtttttttgttcttttatgaaatgtgttttttttgttctttcactgagcatgtttccaaggtccatccatcgtgccccctgggtcggtgtgccattccttttcacggctgcgtaatgttcattgtatggataggccacgtttaaaaaaatctgttcatcttttgatggatgtttgtttttttcctactttggagctattatgaacaatgctgctctgaacatttgtgtaacagtttttaggtagtgtgtttttatttctcttgggtatattctaggagtggagttgctgggtcatgtggtaatgctgtttagtattttgaggaagtgccagattgttttccaaggcagctgtacccctgtatattctcaggcgctgtccttttgatgatacccattccatggtgcaggggcagcgatcgctcgggggttttgctttgcagttccacagtggctgaagatgttgcctggccatttgcatattttctttggagaaatgtctgttcagatctttgccatgttttcattggttagctgacttcttactgttgtcataagagttctctgttctgggtactagactccctattagatacatgacttgcaaatactttctcttcattctgtgggtcatcttattgttttattcagtgttctttgaagcacaaacatttacaagttggatggagtccagtttatctgctttctcttcggttgcttgtgcttttggtgtcacatgtaagaagcctttgcctaaccaagggtcttttaataggagttttatttatttttatatgtgcacatatatatatattttaagagctggggtctcactgtgttgcccaggctgttctgaaactcctgggctcaagcaattttctcgccttggcatcccaaagtgctgggattacaagtgtgagtcaccgcgtctggccactgttttcctatatatgataatttctacctttacctgatagcagtctagaagcatgtggggcttgcttgcttgctcgctcgctttctttctttctctttctttcttttttaaccaaattaattttttaaactcttgatatccattgcttgtgctgtgggc

SEQ ID NO: 29788 - DNA, 1076 bp, Homo sapiens
cagagagttcactcagacctgctgggagtgggcttggccgcgcgggtggcactctgacctacacagtcacttgggattgtttgaaaatatatttttaggctgggcgcagtggctcatgcctgtaatctcagcactttgggaggctgaggcgggcagatcacgaggtcaggagttcaagactagcctggccaacatagtgaaagcctgtctctactaaaaatacagaaattagatgggcatggtggcgtgcacctgtagtcccagctacttgggaggctgaggcaggagaatcacttgaacccaggaggcggaggttgcagtgagccgagatcatggcactgcactccagcctgggtgacacagcgagactctgtctcaaaaatatatatatattttaaaatctcatctaaattttaaattggcatcttgggtagaatttcacagacaattcttgaggcagtatcttaaccacttttacgggttactgactctgttttatttggtggtgaactctttgttatgacttggtgaagttgaacagcaggttatgctcctagtatgttttgtaggtagattaattttattgtcattacgttctgcctatgatgtgtaaccattcttttttcaggctgaataactataaaaagtcttggctgtacaaagcggggtctctgcttgtgatcggacacctcgtggtgaatgccgcctactcagccacggccctgtatgtgtcccatttcaactacccaggtggcgtcgcaatgcagaggctgcaccagctggtgcccccccagacaggtgggtgctgggggcactgcctggggactgctgtggctccgactgcagggctgggctctgacggcaggcctggttttcctagacgtccttctgcacattgacgtggcagccgcccagacaggtgtgtctcggtttctccaagtcaacagcgcctggaggtaggatccacacacagcacggccctcccagaggccatgtgagggccccttgggggcgggggacagggcgatgtgggggccctgggcaggaccaccagctctcatcccacaggtacgaca

SEQ ID NO: 29789 - DNA, 1050 bp, Homo sapiens
tcctgaacaaaagctccaactggggggtatccttcagtgtccgtgcaggagggcgatgggtgggacctgcagccacatctcctgggcctccatgggcagtggaagcagctgcttctcccttctctgcagcgtggctgcagggtcaggatggagcccctccctcccacttgctcctgggaaatgctggccatgggaggtgaggtcctggctgccctctctcagccaggaaacagcctgagggctggaaacagccctgccccagattaccccagcctctcctctgctcctcggacaatctgcttttttttttttttttttgagactgagtctcgctctgtcgcccaggctggagtacagtggtatgatcttggctcactgcaacctccacctccctggttcaagcaattctcctgcctcagcctcatgagtagctgggactataggcgcacgccaccacacctggctaatttttgtatttttagtagaggtggggttttaccatgttggtcaggctgatcttgaactcttgaactcaggtgatccacctgccttggcctcccaaagtgctgggattacaggtgtgagccaccacgcccggcccggacaatctgcatttaaaaagtgctttcttaggaattatgtcaaacatacacgcatagatggaacagcataacgaatcccaacatgtgtgtcacccgtgaccgtctgttttttgttttttggttttttttttttttttttttgagacagagtctcactctgtcgccaggttggagtacagtggcatgatctcggctcactgcaacctccaactccctggttcaagtgattctcctgcctcagcctcctgagtagctgggattacaggcacatgccaccatgcccagctaatttttgtatttgtagtagagacagggtttcaccatgttggccaggatggtctcgatctctttacctcgtgatctacccaccttggcctcccgaagtgctgggattacagacatgagccactgcgcccggccgaccatctgtttttaacagtgaagaaaa

SEQ ID NO: 29790 - DNA, 1076 bp, Homo sapiens
gacgtggctcccacccggccacggtggaacacccatggacacgtgtccgatgccagcatcagcttgggggagtctgtgtcagacatggctcccgcccggccacggtggaacacccatggacacgtgtctgatgccagcatcagcttgggggagtctgtgtcagacatggctcccacccggccacggtggaacacccacggacatgtgtctgacaccagcatcagggttggggagaacgtatcggacgtggctcccatccggtcacggtgcaacacccatggacacgtgtccgacgccagcatcagcttgggggagcctgtgtcggatgtggtttccacccggccacggtggaacacccatgtacccatccctccgccccacatggtgctgggggctctctcaccagaagctgagcccaacacacccaggccccaacagagcccccctggccacacgtcccagtcagcgctcagcctgggagcacagagcactgtgctggactgtgggccacggctgcctgtagaagtggggccatctctgtcctcccccagctcgggctgcggggaggggagcatcagcgtgggggagaacgtgtcagacgtggctcccacccaaccatggtggcccaacaccccgggagacagtgtctctgaagaactaggtcagagtagggtggctggtggtcaggagtgggactgtgggacgcacagagcctgggaggtaggcgggcagtggggttggtggcatgtgaagttcccctcaggcctccttgtcagccaggacctgggctgctgtgggggacatgggaggggctgcttgagccagggccggctcggctctgtacccgccacaggcactcggccctgatgccctcgtgtccacttgtgtccacacaggccctgggaggagcggggacactgaggacctctctccaaattggcctctcaactcacaggttaggtggatgcagcctgggggtcccacagcaggcagggagggctctgtccctctaggttgtcacgcgggtgggtcccacatgcgattttcctttttttggcacaagctggttgtgggga

SEQ ID NO: 29791 - DNA, 1235 bp, Homo sapiens
acagggcgtttttttttttttttttttttttggaaacagagtcttgctctgtcacccaggctggagtgcagtggcacaatctcggctcactgtaacctccgcctcccaggttcaagcaattctcctgcctcagcctcctgagtagctggggttacaggcatccgccaccacatccagctagttttttgtatttttagtacagacggggtttaaccatgttggccaggctggtctcaaactcctgacctcaggtgatccacctgcctcggcctcccaaagtgctgggattacaggcgcgagccaccgcgctcggctgagacagggcatttgtccagcacagcatctgcgtctgtctccctgtgctgttatcaacctgtcctgtgctgtcatcaggctgtcccaggctgagtagtgctggatccttcaaggggctgtttggggttttggagagagcccctcacgggaggggctggccgcttcctgctcagccccacgcgatgctgtaggtcccaaccttagatctctttatggagcgagtgagggatgtgtgtggaggggtgcgcgtgcctgtgtgcacgtgtgtccgtgtatgcatttatgcatgagtacgtgttcatgcatgtatgtcagtcgatactgtcctgttaacacatggagaaaaccaggcctagacactacgtctctggcctgtggcagccaaattagagctggccagtccaggtttgagcccagttgcctgctggtgagaagctcaaaatcatggggcacgatcggtgaagcaggctttgaattcagcaaataaagcgtttgtgttggttttgcttcatgtgcttttttgcattagttttcagttctcaggtttgtacctgtagaaggggaagaggcctaacttcttagaggcctggggccctcggcctcctgctcaccccttgcttcaggccacacaggatctcattctggtatttgtccagcagatgttgctgagccctggctggacgctgactcaccagggtctcccagcctggcaggtagaagggcctgcctggtgctgccctgtaggtgctgtgagggcccagagctatcagcccctggtagggggagacgggggcgggggcccactggggcctctgttatggagaaccatcctggcctgaggggtgccaggtagatggggtggggtgactcttgtggccgtgtcctctctggtgtgtggcttcaggcaggcactggtcgac

SEQ ID NO: 29792 - DNA, 1076 bp, Homo sapiens
caccgtccaaaaataacctttctgtgggtatgtgtgccagggctgggccacactgccagtgggtatgtgtgccagggctgggccacactgccagtgggcagagccaggccctttggacagtggggcatgacaatgacagctgcagagggggtttcctgcccagagggttgtgccactcttggggggtgccccagcccgtgtcctctgctgcattctcaaccctatgtggcccccccaggtgatcgggctgctggacgtattcactcctgatgagaccctggatgacttcacggacttgtgagtgccgacctgggctggccgctgggcacgaggggtgttgggcagctctgggcactggcttcaggttctaggttggcaatggggttctcttcctgcagcctgagtgggggatgcacaccgcccaccccctccccataccactgtccaccccacgccctcccccacatggtcctgggacccacgggcactggcacagctgggcagagctggggctgctgcctctctccacgcctggcacctgggccctctccagcaccggaggtgtgaaccttggacctgaccatttgttaacaggaaggtcccgtgctcgggaccctggcaccaagtgtgtggccggtaactggagctgctgaccttttccagcgggtgggggagaagcggtagggaggacccaccctgcccctgccctgcagccgaccaccctgggactcacaccctgtcggccaagagtgaagggccaggccgaggaaggcctggagagggtagcaggcgcctcccgcctgacttgcagaggtcaagtcagtggcctctgggaaggtgctaaataccattctcctgtgtctgtctccaccggcccagccgacccctctgacccagatgccttgccgcgcccccatcgcccccaggcacctccctcatttctggcacaaagttgtgaagttgaaacctgactgcctccctcccctgcctgtgaagactcgagtcctgctgcctctaccatggagcctcagcccctagcctggcacgcagggcgcttcagcggagggttcaaaaac

SEQ ID NO: 29793 - DNA, 1071 bp, Homo sapiens
cgattttcccgccgctgcctcctgagtagctgggactacaggcatgtgccacaacgcacggctagtatttttagtagagacggggtttcaccatgttgggcaggctggtctcgaacccctgacctcaggtgatctgcctgcctcagcctcccaaagtgctaggattacaggcctgagccactgcgcccggcccatagttttcttgatgaaagtgtcaggagttcggggcaggggaagctacccaggggtactctgagcagccccagcctggcccccttggccaggcatcactgggttttgtccccaacaggattctcccagcaacaagctgctgtacgccaaggagatctccacctacaagaagatggtggaggagtaagtctgcctgccctccaggccaggcccccatgcccaccctcgaccccctgcggggaggttcaggccttggtttcccccaccaccccctttgtggtccctgccgcccacactgtatgatgctcccacccctgcagttactacaaggggatccggcagatggtgcaggtcagcgaccaggacatgaacacacacctggcagagatttcccgggtaaggagaccaccagggacgcacccacagccctccccgctcccactaccccatgctgagcctggccctgagctgcagggcaggggtaatgtggtgctgagggggagagagggtggggcgggacctcgaggtgggctcggccatgtgaagtgagccacagctgcgtgtggggagtatgagctgctcctgcttggagccaggccctgcccacagcgccccctccctgcggctgcacccacggccgtgcccacagcgccccctccctgcggctgcaccctcggccgtgcccacagcgccccctccctgcggctccatccacggccgtgtccacagcgccccctccctgcggctgcacccacggccgtgcccacagcgccccctccctgcggctccacccacagccctgctcacagcacccgtccctgtgggtccatccacagccgtgcgtcacacagggagacactgagatggttggatgtgcac

SEQ ID NO: 29794 - DNA, 1501 bp, Homo sapiens
ggcaggggaggctgatgtagggatcactggccaggatggagcagggtccctagcgtgagagggacggaccaccctgaggaagagctcagaggcagaagggccctgtctctgccacttgtgtctgagcccccaagatgcagttgagtctggtagggagggaaagagagaggaccacgcatgtcctgggtccacctgtggggccttggatcttcctcctattgggagaccctcagctcagcctggtcctcagcagctcacccatcacaccacacatccccctcatccacccggacccaggcacagaccccacaccgagacgtgctcagttacacacacgcatgtggacacagcctgtccaggctgcagatgtgggggcctctgcctctgagacctggtggatttggagttgctcatggctccccaggtccccttgttgcctccgctgtgcgcacatcagaggctgtgccctgggcgtgacatgggccgagcgaggagctgtgggtgattgctggcttccactgtttcaccagggcagggggcctggaggtggtcagggaggctcaggccgcctgggggctctggcgggcagttgtaaacagcatgtgcacttgctgggctatgcacagggcacccctcgctctcacctgagcctctggtttcccgtgtccttcacctctgccccatgggtgagccacctgttccaacgtccaggggtctgtctgtcagcctgagcctgtgcgctggggccggtgcgtcccgaccacctggagctccttggggtcacaggtcagggggcatgaatgtgagcacttgagagcctttctgggggcgtcaactccttgcctcggggataggcctgccggtgttttcagcacctccgggagggatcctgtagcaggcgatggcagtgccttggccccagtggtcagtcagggtggacttgaggagggctgagaagtggtctccggcgagacctcgaggatggcgggggtgtgaagcaggaaggggcggagctccaggttcctcagttcgtggagtggcgtgaccctctctcccatgttctgacgtttggggcagggactggagagggatttgatcgggggtcctctgggtcggggctcccctgacccttctctcttcccacagggtgcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagc

SEQ ID NO: 29795 - DNA, 1824 bp, Homo sapiens
cggggcctgtcggggaagaccatagaccacagagcaaggccagtccctcaggggctgggttagggagggtgtctcggggtctaaaggatgggcaggggctttccagggagcacagtgaacatggacgtgggaatgtcgtgaggcagcgttctctgagtgggcacagctgtaaagatttccacacccactcaacctcaaggcagccctctgaggtgggcgccataatgacccccaggttacatatggggaaactgaggcacagagcagctttctgaatggcccacatgagccagctagaacgtgacagagctggggtgtgaactcactggtctggctctggacttcaggcctcgaggtccctgggtgcagcagcgtcaggtgtgaccacagccacctaaggaagaaactcctttttctggggtagctaagcgggaatcttgtgagcaggagatggagcctggctcagtgttgagggcaagatggatggaggtgggagaagccagaggccgggcagaggaggtagacttgggccaggaagggccccagactgagggtggagggatcatggtgttattctctgggaggggaaatccatggccgttctccacggtgagggccagggaagaggacggcagaaagcctcctccaggagagtggagtatgggtcttgcctctggcttcctgagtggatcgatcactcaggggaggttgttcgagggcgtgcgggatgggcgggacagaagccagcctcccctgaccttggctgcccccgcccacgcctggggcctgggcccgtggaggctggagcctgggggtgtgctgcagggagtgggcatggggcacacaggccggtgtggcgtcccttcaagatggcaggtctgggggtaccgtgccaccgccatggctgccacctccgtcgggagctgcagtctccagtccccgcgggtcccagctttctcaggagacccggtgctgccctgtgctttggctcctgagtttgccagaggagcagccttttgcccttttcacaaaggtgctgttgagtctcaggtcgaaaggatgccctctgccccccgaaacctcatcctctccccagccctttggccgggttaacccttacctgtgcagcagggtagcacagtccatgcacagctgtggagctcacctcccttcccgccgcccccctgctggtgtcactgcatgtccaaccccgggtcccgctgcacagggcacatgaggatcccggtggggtgggaggagagtggggcctggccctgcgggaggaggtgctttgctggcacacaacctggccaggctgcagtggactctggggcctgagcaggattcagtagctgaaccttggttgtaggggtggctattgagggcctggagagtcacatcttgaggcagagtggagcctaccttcttttctttctttcttttcttttcctttttttttttttttttttttttgagacagagtcttgctctttccccaggctggagtgcaatggtgtgatctcagctctctgcagcctcaggtgatccgcccgcctcagcctcccaaagtgctgggattacaggcgtgagccaccgtgcctggctcagcttcttatttagacaagcaatatgtaaatataatcttaaacttgtgttttgctttaatcttagagtcagggtctcgctctgttgcccacaatcatagttcactgcagcctagacctcctgggctcaagctactctgccttagcctcctcagtacccgggacttcaggctgtaccaccacacgcggccagttcacggtctagttcaagttccttgaa

SEQ ID NO: 29796 - DNA, 1035 bp, Homo sapiens
cccaccccacgcagggcctgtgtccaccccaatcctttgagccctggagggccgcacagccctaggacctctgccttctccaccgcccatgtcctaggtgctcatgccaccccctcctgccctcccaggcctaggcccgagctctcctcgttcttcatggcggctgctgcctggatccccatcttggcccctgccgggccgctgcccatgcacctcctctggcccctgccctctctggttcccgtgccagagcccacagcctggcctggccaagagcagcccccaagctgggcctgccctcccactgggcctgactgctttgtgctggtttgattttagcattaagaatggtcagtctggctgggtgtggtggctcacgcctgtaattccagcactttgggaggccaaggcgggtggattgcctgagctcaggagttcgaaaccggtctgggcaacacggtgaagccccatctctactgaaatacagaaaattagctgggcatagtggcgtgcacctgtagtcccagctactggagaggctgaggcaggataattgcttcaacctgggaggcaggggttgcagtgagccaagatcatgcccctacactccagcctgggtgacagagtgagacctgtctcagaaaaaagaaaagaatggcccagtctgtttgcttgaaaatactgaaaggcagagaactcccaattttagtccccactggaaccaccccgcagtgcagccaagacttggggcggtctcagaaccaaggctggcaggagtttgggggcctggcagcccccactcttggcctcatctggagtagggctctgtccttcccccttacatgcctcttgtttacctttacccagtgggaggggcgggggccagactcagcccgtgcaaggggcctgggggctgctggtcagaaaaaaaaaacaaaagggacctcaggagagggccacaggtgcccagccagcaagcagctcctgctgcctcccaggctgtctaggttgtagaggggaggcccagcatccctg

SEQ ID NO: 29797 - DNA, 1031 bp, Homo sapiens
gctccgcccgggcctgccgcgctggggcccggggacctgcggcggctgcggctccgcggagggctcccggggcctgggccccgtccgtcggtccatccggcgaggcccgggccgctgccgccccactcccttcccggtgttgactcgggggacgggcccggcggcgggggctgcgcgtccctccggagccgcgtcggatccctcctccgcgcctgcctctcactcttcagccgccgagctccgtgcgccgagcggagatggtctcgcggtgcgggcgctccgggccggccccaggctcagcggcacaggagcctggatttgcccgagctcccgggggccgtccccgcaccccctggggcctgcttggcgcggggggaccagggcggagagcacccgcacctggcgagaccccactgcctgggcctcctcgcggttcccagagtggcgtctgggtggacaccccgagacacagaaagtctcagaagcgggggcgcgagccctgcctgtcccctgctgaccctgcccctccgcaccctgctcctgcaggaagcccctgccctgccagcgcccctggtcgggctattcggcagatctggggagcccgcctccccctgtcatctgggggtctcagagcccggacgccctggggcttcctgccaggcccttgatttctcttcccgaagctccctgggaaaggaagaaaggggtccgtctgcccactgtgggctgtggcagagtcaggacagggggtgagggtgagggtgagggtgagggtgagggtgagggtgagggtgagggtgggccccaaacccggcagatcccggcggcctggagggctccctgtgccccaccttccctggacccccccgccctccccacttaatgtctgacttcggcccttgcttggaggttcggcgcagcctgtgaggctttaaagttgagcttcctcaggagccctttgcgggtgggagagcgaggctgccgggaagtgggggctctcagcctgccccatgcccagatgaccctggcac

SEQ ID NO: 29798 - DNA, 1027 bp, Homo sapiens
gcagagactcggcctctggggagctgagcgggttccctccacccccaaccgtggtggaaagacaagctcgctggggcggggtgggggtctggtctccacctgcccctcccactcagccactgaggacaaggtggggcccaggcttctgggagggggagctggcacaaaaggaagtcctggggttgatgtgtttgagcgttaggcgaagtggttccccccatcccccaaacggaaaaatgtcagtatttgctaagctgtagagacctgatgccgtgatgtggcctgttccgcctccacccattacacggggataacgctggggggtggcgggcccacaaaagaggtgctggaggagactctcccacccctggccgggccggggctttggggccggaaggttcacagtacgcggtttgtccgaacgtcacggcttttattgggagttgggggtttggggtgccctgtcaggtgatcagaacattaaaaatggactcaacgtaaaataatcttctggacccttctaggacgacatggccgtgaccggtagtgctagaaaccagtcttcgagcccctagtgccacaccatgtccccccacctgcatacctgtggtctccccctgccaggcaccctgtgctgggcacagggacatccctgccaggcctagagggccttgtgtttttaaggcagtcaaatcttgcagcctggttcagtgccagctccaagggctattgggtagctgcaagggtcaattatgcattcctgtgagtcaggtttttccaacccaggcccttgactctgccctgagcttgcagctggatacaaagtgcaaaaaagcttggctccttctgtattctttaaaaacaaaacaacaacaaaaaaaaaactgtaaaaacagcctccatgtccacgcccttcctggcccatcaggtcctggtggcatctcagggtcctgccccccccacccccacccccaccccggctcctgcaggccgaccttattgctgtgctctgggcttgggggcggct

SEQ ID NO: 29799 - DNA, 1586 bp, Homo sapiens
ggctgctttcccaagaccctgaggctctggtgtggggatgctccctggagtctggagggtgtgaggcgcccttcactgtctcctttctgggcgtcgtcttcttgggcctgcagccccccatcaaaggcttctttgtggccccctggccagtgctctgggcttaggtcagttctggggacagggtgcctggtcttacctcctgggctgggacagcaagggggggacgactgctggggcctgggcttggctgggccatgacggtcagcctggccctggttctgctggaaatgcaggtcctacgagggcactctgtacaagaagggggccttcatgaagccttggaaggcccgctggttcgtgctggacaagaccaagcaccaggtgagtgatcaggtggtgggggggactcacgggggagggggctccgctgactctgtggcctcctccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgagccttggccggggcttgggagaggggaggggctctgcggtgtgggggctgcggagtcagtaacccgcccttccccaggtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccacgctcctgtgcctgccttccccactccccggctgcctgctctcggcctacccagagggtcccatctgcccctatccaggcccacctggcgggaggttggcatctttctcgtgagcctctcctggtgcctgggtccacccagctcggcctgcatgtccctgggagtgactttgctctgggggcggatcgagcaggaggcttcactggggacttgcttgattccctccacgcctcagggctggtctaggggccggcacggctggagaggaagcccccatccctacccaggggatgcagaagctgacctcacagaggcttgggggtgaaagggtgggtggtcatttgaccccagaaggctgttgcaggtccagaggacacttgaggtggacgtcagtttctggctagacccgagctgaagggatggaggccggaggcgggggggggggggggacagtgggctcccaggggaatgcaggttgaccacatctgg

SEQ ID NO: 29800 - DNA, 1059 bp, Homo sapiens
aatatactgaagcccatcaaatgaatttttttttaatttcttgagacagggtcttgctctgttgcccaggctggagtgcagtggcacagtcatggctcactgcagcccgaacctcccaggctcaaacaatcatcctgcttcattcagcctcttgagttgccaagactactggcgtgggccacgtgccggctactttttttttttttttttttttttttttgtagagatggggtctccctatgtcacccaggcaggtctcaaactcctgggctcaagcagtcctctcaccttggcctcctaaagtgctgggattacaggcatgagccaccacacccggccccatctaatgaatttaacgctttttattgtagagattccccatctgataaaccattatgtccatcttttcttttaaatcttgaaacataacttaaaaatatatataaagatggggtcttgccatgttgcccaagctgttctcacactccttgggtcaagcgattctccctcctcggcctcccgaagtgctgggcttacaggcgggagccactgtgccctgcctgtgttgtctttctttaagcttagagtcttgggttttattctcgcaggtaggtaatgagcttgtgcgtcagcttggtctgtttgaagcttgtttctaagctttgtttgggcagctctccagcacctctagagaagctccagggatagagcagcccaaggcgtgtggcctctccagggcttcagttggagttttgtgtctttgtgtcttcggtaaggtcttgccacactggctttttggaagtccagtatcttttagcattcctctagaatttgggttcagctcatagttttgtttttttttttttgaggcagagtctcactttgtctcccaggctggagtgcagtggcgcactctcggctcactgcagcctccacttcccatgttcaagcaattctcctgcctcagcctcccgagtagctgggattacaggtgcccgccaccatgcccagctaatttttgtatttttagtagagacagggttttgccatgtttaccag

SEQ ID NO: 29801 - DNA, 1050 bp, Homo sapiens
tgacctttttacaaggatacactgggccctggttggcgtccaaagcaggctggtgctgcgtcctcactgtgagctgggcgcctgcagtgtggcagccgtcagaggacacagggcgtgttgggctggcattgtgcttggcctgtagtgaccacttggtggacgaggggacattgcctctctcagtcccaccctcgggccttgcagaagcaggtgagcctgggcagggccaggcgcccagagaccctctgtggaccccaggcatctcccagccctttgggctgccagtcctccctgtgccttcaggccacgtcgtctggaccgtaaacctcagcctgggactcagatctgcctgtgtcctggactgagctgctctccgtccttttggactgggctcaggctctgagcccaccctctcccctcttcgggaagcctccaggtcgcctcttctccaggccacacctcttgggcacctcctgttgctgtgccctggacagaggcgtctacatgctcatgtgtggagcgttctgagctgtgcccatcacaagccctggccccctgagtggaggacaaagggccaggatgtggagggagggactcagagacagacttgctctaagctggtttgagtgggaagaaaggaagtgttagaggagagcccgggatccccaccgcatagcccttctgctgccacggagtgctctgcggcctgccctgccctggcagagaggcccacaccaggatggctcttcccactttcctgcgatcagggacttggggctgacccctgctgtctccaggctccctgggggcttggtggaaccctctgacctgtaggcacccccaagctgggcacgcccaggcctggggctaggcctgagccttctctctgctgtgccctcagttcccagccccagagccagggtcaccacgctgtccaaccccatggcggcctcggcctccagacggaccgcaccccgaggtaccgtaccgagcctgcgcaggcccgcctccccttacttggtgctggcggcctctagtgtgcactgagtt

SEQ ID NO: 29802 - DNA, 1048 bp, Homo sapiens
tttgtccctcctcctctcacctttgctgactctcgtgggcctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcaggtggaggggtgggggtggagtcctgggtggtctctggatgctgacattggccagggaggatcagggcaggcggagtggccccgtgatgaccacgtgtgcccggcctgtgcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcaggtgagggccggccagggctggcccgggtggtggacacgtgactgggtgtcttccctgcccgctgtgggcctgggccacggcttctggtcatgtaaggaatgtggagggggagactccgggcagagggacgggccacagggctggggggtggctggggggccccgtggctgagctggaagcgcctcctgctgggagccatgggctggctcctcttgccctgcttggggcgtgagcctggaggcgggtggggtcgccagccaccttcacgcctctgcctcctctcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggtacctcctgcgtcctgccctgtgcctgccctgccctatctcaccctcccctccctcagctccg

SEQ ID NO: 29803 - DNA, 1083 bp, Homo sapiens
gttttgccagcccagcgggtggcagctgtgtcccgagaggaatccaccgaccttctttgttgctgtcctcaccgacatcaactccgagcgccactactgcgcctgcttgaccttctgggagccagcggagccttcacaggtcagcttggggcctctgggtacagcatgaatgaagctgcatccttgggccgtggccaactccccctgcccccgtctccccctgacccccagcaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcagggtgaggccggcagccggggcggcgaggcacgacgagggtgcttccatcggctgtcccaccactccccgctctggtcattgcagaacagccttggcctcatctatgccatccacgtggagggcctgaatgtgtgcctggagaacgtgattgggaacctgctgacgtgcactgtgcccctggctgggggctcgcaggtgagttttggaggcagctggtatctgcacagccacaggccctcctgctggggccctggtaggtatttggagcccagccagagccacacacagctggaggccttggatgctccctcttgcgtcctcgtgccaccattgcccccaacagtcctggcctgcttacctggccctcgcacctgtgctctgggcctgtgtcgttcagcctctctgtccactcctttgatggtgtgtgcctgtctctggatgttgatgtcagcttgtttgtctgctccctgccctgtgcctgggtgtgttggagtgtctaaccgtgtctttctgcccgtctgtcctgtgcagctggactctgttgaggaaggagcggtatggattctttgtttcttccgcccacctaggccccatccctacccccaagtcaaaagcagccactcctgtcctgagttttctctgcagctgcttgggacaacagaggcagggcatggcgtttccctcttgccat

SEQ ID NO: 29804 - DNA, 1048 bp, Homo sapiens
ggagtttcgctcttgttgcccaggctggagtgcagtggcacgatctcgactcactacaacctctgcctcctgggttcaagcgattctcgtacctcagctcctgagtagctgggacaacaggcgcccgccatcacgcccggctaattttttgtatttttagtagaggcagggttttaccatgttggccaggctggtctcgaattcctgacctcaggtgatccacctgcctcagcctcccaacgtgcagggattataggtgtgagccaccgcacccagccataaaaaataatttttatgaaaagtataagtaggccctcaattactgtaattgaagtgaattagattcagttctggaccttcatttaggaaccagtgtcttcatctgtttttgtttttttcttttttttcccatgagatagggtctcactatgttgcccaggctggtctcgaactcctgagcttaagtgatcctcccacctcgactttccaaagtgctaggatttcaggcgtgagccaccgtgcccggccaggaaccagtgtctgttgaacacccaccatagacttggccctgtgctggggattcagtggtaaacaaggtcctattcctgcccatgtcgaattcactgctgggtgaggcaggtgtggtcaggggacagagcagctggcaggaaaccaggaggcttttgggataatccacttaccaagtacaggcatgggttgcttaatgaaggggatacattctgagaagtgcattgttaggcgattttgttgtgcaaagattctagagtgcatttacacaaaggtagatggtgcagcctactacagacctgggctatgctgcttaccctgttgctcctaggccgcatgcctttacaacatgttaccatactgaatactgtaggcaactgtaatacaatgggaagtctttgtgtatctaaacttgtctaaacatagaaaaggtatagtaaaaatgttatataaaagattaaaaatggcacccttatggccaggtgcagtggctcacgcctgtgatcccagcaccttggga

SEQ ID NO: 29805 - DNA, 1048 bp, Homo sapiens; identical to SEQ ID NO: 29804

SEQ ID NO: 29806 - DNA, 1048 bp, Homo sapiens; identical to SEQ ID NO: 29804

SEQ ID NO: 29807 - DNA, 1310 bp, Homo sapiens
gaacctcaccccattcccccagggaacatcttgctgctctcagagccagaaaatgctgacagcctcatgctggtggacttcgagtacagcagttataactataggtgaggctggaaagatggcttcccatagatctgttcccatagggctcttgaaaacaggccagctgcccagggcatttggggactgaatgtccaccttattctcccaggggctttgacattgggaaccatttttgtgagtgggtttatgattatactcacgaggaatggcctttctacaaagcaaggcccacagactaccccactcaagaacagcaggtatgtgggccagaggctggggagcaggacccatcctgtgaggaaggagggaggtggagtctggaaggaatggccggaaaggatgttacctgggaaatactccacagtctccccaattcctgactcttggccattgatcgtagttgcattttattcgtcattacctggcagaggcaaagaaaggtgagaccctctcccaagaggagcagagaaaactggaagaagatttgctggtagaagtcagtcggtgaggaaggaggggcagggtggggtagggcagagcagaggaaagagggattggggaagaggcagatttatcaagctgcagggaaggtggctgtggagagtggagttaggacagtgggggagaagttaaaactgtagggattggccaacctgggtgaggggatccaagcagtgctagacatgctcttgaatgcccctccttttcctgccctccccccaggtatgctctggcatcccatttcttctggggtctgtggtccatcctccaggcatccatgtccaccatagaatttggttacttggtaagtgaccctggggatgggaatgctagctggggggctggggagcagcagcagccacactcttccaggaggcctggggagtcccgggtggctgtgggcagcctgaggtggatgtagaatgctggtcccacgtcttctcaccactgtgtggggtgggtttccttccctaggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgagtaggtccccatggctggcaggccagagccccgtgctgtgtatgtaacacaa

SEQ ID NO: 29808 - DNA, 1075 bp, Homo sapiens
aaaactttttttgcttggaaccaccacaaagatttatgaaaaatgtttaaatgaaaaagaaatgtgcagtgagaattatgaaaatggattgttccctaaggtttatgagcacatacatgccattctaagtgtattacacatattagctcattcgatcatcacaaagtcactcagggaaccactgttactgtcctcatttaacaagcggtaacttaacttgtccggggtcactatggccagtcagtagagaagctggtagtcatgttacccaagcggggccagtgtgaatcctgttctgagatagtacgtgtcttaaaatgaggagaatggccaggcacggtggcccacgcctgtaatcccagcactctgggaggccgaggccggtggatcacgaggtcaggagatcgagaccatcctggttaacacggtgaatccccgtctctactgaaaatacaaaaacgtagctgggcgtggtggtggatgcctgtagtcccagctgcttgggaggctgaggcaggagaatggcgtgaacctgggaggcaggggttgcagtgagccgagatcgcgccactgcactccagcctgggcaacagagcgagactccgtctcaaaaaaaaaaaaaaaaaaaatgaggagactggttccactcttgggatctataggagaactgtgaactcaggagctgctggtgaccgagtggtagccttgagaagaaagccacactaccacactacggccggcatctggggcctaccatcctgaacgcaccttacatccaaagctaagcaggctcgagaagaaagtcacactggaagaaatagagattgggagacagggaaggttctgaaggggtttgagtttctaattttagtccctgaaatctgatagcacttctgcagtttggtttcaaggaacaatacatttcccagagaagttcaagagctggacttggagcaaatgcccagctcagccaccaaatacccaggtggcctaggaaagcttcctagccttcctatgtctccgtgtgtgctcagctaagctggggactatagtacaaactgtttcatttcctcat

SEQ ID NO: 29809 - DNA, 1045 bp, Homo sapiens
aattaaaaagccagaagatgcagttctaattacatgccttaactagaagtaggatatttgcagcttatcaagttttatgtaaatttgttcctttggcacaatttgcctatataagcagtattagttcagtataaaatgtttattagttattgaaactggctctagtgtaatttctgtgttttaatacatagtcccaagttttgtgggatccctagagagaactgtgtggtgtctatgttttgaataaacaggttttttgaataatagtaacttacatatctatagtctcttatctgaagcccttggggtcaaaagtagtttagaattttagattttagaacggtagtatgctactagtgctgtgtgctatgtgacattccaatagaatcttgggcaatggccaagcatgttgacatttcttagtgcttgaatgggataaagatcataaagagcatctttttcagctgaggtcaggttgggctgacagtgtgtttggttttccagagcgttttgcatattggaactgcagataagggattatggacctgtaatattaaatataatagctgacatgtattgtgtttattccaagccagacatggtactttacttgtattatctcatttaatctttgcaactctttgaagaaggtgatagtattaattttgttttacagatgaggaagagtttcagagaagttaagaaacttgcctaaggatacatacacctagtaagaaagtggtagagttacatctcaactaagtcgaattagacaccaaatctggtgtgcacaataactagttatcctcctcgtattcagtgtctctgatttgcagcccatagactcagtcttacatcaacataaagggaattaatacgaagggtatcaggtgatggagtatcaggcccaggggataattgggggaaagaatgagtctcagtagcaacacttctttgatagtctttcttggccatttccattagaataaatatacttctagtagcagtaagattcagatgagagagaatacttgagcttgtgttg

SEQ ID NO: 29810 - DNA, 1090 bp, Homo sapiens
aggtgatggattcttttacagccagtgtttgtgcatcactgataattcattcccttcactttgcagcactgataattcattcccttccatttgcagactatagaaatttaagtttcagagaagcttagtaatttacttaaggtcacatagctagataataatgaaacttgaactttaaatgtaacttactgacccccaagatattgctgtttccctattattaggtgcttatttaaccggagaattgccatgtgttttttgtaacaattacattttttttttctttttgagatggtgtcttactctgtcacccaggctggagtgcagtggcgtcatctcagctcactgcaacctccacctcccaagttcgagattctcctggcttagcctcccaagtagctgggagtacaggtgcatgccaccaagcctggctaattattttttttttttttgcatttttagtggagatggggtttcaccatgttggccaggctggttttgaactcctgacctcaagttgtctgcccgcctcagcctccgaaagtgctgggattacaggcgtgagtctctctgcctggccacaattacaatttaatattaaaatatatacatatgtgtatttctatacatgtgtgttgacttttacacagtatttaacattttcaggtgtgtaaaatgaaagcattaggactaaatgatcacatagtgactatttggctcttttagagagaatgtgaatcactacctaccatttcactgatgcacactgtttaaaagatactatgctaggtgttacagttagaccctgagaaatggggtgctactatgatgttgttatgatagccatgcatgtgaataatatccagattctgcttggcccagatacctctccttcctatcatatttctgggagaaatagatgcttaaaaagggaaaagaaagcaaagtagagcatgttatatatacctgggtctttggccaaggtacaacagtataatgtcatgggccatgagaaaggctctattttctctaagttaattagagaaaatgtacctgctccagtacgttcctgaatagatgtatccttata

SEQ ID NO: 29811 - DNA, 1095 bp, Homo sapiens
taatctatggggactgggagaacttttatgtctagccggaggattgtatatgtaccaatcagcactgtgtctagctcgggttttgtggatgcaccaatcagcactgtgtatctaggatatctggtggggactgggagaacttttatgtctagctagaggactgtaaatgcaccaatcagcactctgtgtctagctcagggattgtaaacacaccaatcagcaccctatcaaaacagaccaatcaactctctataaaatggaccaatcatcaggatgtgggtggggtcagataagggaataaaagcaggctgcccgatccctgcagtggcaaccgggtctggtccccttccacattgtggaagctttgttcttttgctctttgcaataaatcttgccgctgctcactctttgggtctgcactgcccttaagagctatgtccttaagagctgtaacagtcaccgggaaggtctgcagtttcactcctgaggccagcgagaccacgaacccaccgggaggaatgagcaactctggacgggaggaatgaacaactccggacacaccatcttttaagaactgtaacactcaccgtgagggtctgcagcttcattcttgaagtcagcgagaccaagaacccaccaattctggacacaccgtctctactaaaaacacaaaaacaaaattagccgggtgtggtggcgggcgcctgtggtcccagctactcgggaggctgaggcaggagaatggcgggaacccgggaggcggagcttgcagtgagccaagatggcgccaccgcactccagcctgggcgacagagcgagactccgtctcaaaaaaaacaaaaacaaaacaaacaaacaaaaaaaacataaaggagtcctcacttgatgacaatgatgacagcttatatatttagagcacatatgaaatactaggtactttcctaatccttataaacacattttcttatgacgtaacctaaagtaggttccaacatctcataacatctcttcatcttgttgattaaaaacacgtaagttcagagtggttacataagcttcccaatatctcagtgtaaatctgtagcagagatggga

SEQ ID NO: 29812 - DNA, 1050 bp, Homo sapiens
ttgagctgttgtaaaaattgaatttgaataaaagtggcttgaacagcatgaaccaatggccagggctaatgtgaaccaaagtgaacttaaaatcatgaatacctgaaaaggggaattgaagtttccacactgagcttgagaccatggagcctgatggtcccataatttccagagtgggaaatacagtttccctgagtaggcagtaagtctcaaggcagagaaaaaccacagactgtgaagtacagaagcatcttactggtgaggacagagtatgttctcattagatttggtggagaggaactgtgcaagagagagaagactcaaaatagatggttgtctacatgagcacaggcattttcagagcttgagatttggagggaaaatgatcacaaaacagtacagaatgcttaacatctggtaagatgaagcaaaagacggactctggtacctctgagtagcaaacagtcccagggctgtccttgccaagtaatcagttctctggaaaaaagtaagtgtgcaaaaaggcctgctaatgaaatctgaagtaacggcaagtggttttgatggctatatggtccctaaacaaaaggctggcctcatgccttcttacaaaactgaactgacctttgtgagtgatgattcctggtgaacccttagctatatttttaaataactgttagtgtttttctgactactgcaagtatatgatcttgtgcaagatgtgatcttgttttaagagggatttatggatttttctgttcagaaataggattagttaaggtccagtgattttttttaaacaaatgcttaatttgtatctacttggttgagtaaatagtgttcttttgagtttcgatttctttttttttcagggtcccgaacccctttatttgtacttagcagaaacgattgccttctgtagaggagtatcttcccaatgtagttaaatttgatttttattttccattcaaatatttagaaatttcaacttataccttacaatattaaacatttttgtagtcagtcaccacaaatctcagagaggtattt

SEQ ID NO: 29813 - DNA, 1148 bp, Homo sapiens
atgctgcttatccaagaccaccgtttgagaaccactatcctaaaataggaaatctgtcctacacagagggcttttgttgttgtttttaaaaattgaacatagtctccctaccaaaacatctgattttggatcaaaaagcactctgaatccgaagtacccctgtatgagagaaagagcaggcatcagagattccaaccatggctgaaggccccatttcaacaagagagtgaataggaataaagcacacagaatgtcttgacagactaccatgtgaggcttgagctaaagtgctgcatggcatgactctggtagttaaagccaactgaggggagacattgaaagctgataaatattatgataaatattatgatcatcccttacatcaattcccccaaagaaatgcagtgagtcagagtttaaaatattactctagaatgcagcctaaggcatcactgagcattaatactttatatacaatcctataaccaaaatatctgaatcttctgtaaaactgctgtgaagagatgatccatcttgaagtccttagtccttttcataaaaatatttccaataaatttctcataaaatgtagaacttctctcttaaaagaagaaaagtttgcatcttctagtaaagaggcaaagtttttcatcagtcagtaagaaatatgttatttttctctttgcccagtctgggattaatttaactctattgtattaattctagtgagattgttttctacccttcccctgtttgaattgagtcatattgtaaatgtatttactactttatgtcttttaccattatctaccccaagttctttgaatttgtgaatgaataaataaatgaagtaactatttttccccctccaccaccttctggcaaaattgattgcatttggggagcctaatctaaggagtattaattagactgacattcaagatttggtagtggggggtgattcatcaagatagtcaaaagggaagccccagaccctttttccccaatggaccagttgccattgaaagaaataaaaccagttaagagatttctgcactccagtcaagtgtaaagccaatagcattaaagcactgtagaaaaatttatggcactcgcttgctggagcacctcccactccccacagcgta

SEQ ID NO: 29814 - DNA, 1029 bp, Homo sapiens
tttgaggaattcagactactctgttaaggcactgcagtcttgttttggtttgctgcctttacaagaatgctgttttttttttcatctagtataagtgccaattcaggaattgcatttgatgaccattcggaatgtcttgagtcagtaatttggaagtgaggtggagaccttgaagttttagttcttgctaacctcaaaaaggctacttatattttattcgatcctgggttttcttatctgggaaaagaaagaggaggtggagaaatgaccagttgctttctaaggtcccttctagacctaactaattatatgttgttttcattaagcagatgtatgggatagtaccaataaaaatgaaaaacagattttgcttgtgatatgccaatatagaggtaataccctgtgaagattttgtcttgtaggttttatgggagaattgtagacaaacctggtgaccatgatcctgagactttggaagcaattgcagaaaatgcaaaaggcttggctggaatatcaggagaaaggatttgggtggaactgaaaaaaattcttgttggtaaccatgtaaatcatttgattcaccttatctatgatcttgatgtggctccttatataggtgagagcaagttataaagtgtttgaatttttggcagtgaaatatctggtttcaaatttcataaggaaaaaatgtttgactcatttggttgaagaattcttggagaaatggagtattttaaaataagacaaagtttgggttatggggtaagttttgtcgtgagtagggaagagctcaaagacagcttgtggtgcttgtagagtagtctctagtcagacctaggtttgaaggaagctcagccccttatctagtctttgcaacttgggttagtttctaacccaaaaaagcggtttaaaagtaatgtagcctctatctaataggaaagctaaaaggattcagtgagttaatacatgtaaagctcttttagaagagtgacttgtacacagaaattgttcagtaaacgttgtaattca

SEQ ID NO: 29815 - DNA, 1044 bp, Homo sapiens
tctgatgagactttatggtttgtaaggcatgactccccaggtgccttgggtaggaatttgggcaagataagaaaaaatcagagtttagtcctcaaagagtagaataagatattaatgtcagaaattattattgttccccagactacctttggcaatttatagttaataatacagttagctggcccaatattaaacagtggtccctgaaaacttaggactaagcattgctgagttcctggtcaaaaacactgatttaaaaaaccactgttctagtccattcttaattcaacaaatatttattgagagctaaatatatgcaaggtggtgggttgggctgcaaagaatacaacaaacagaaaaacgcactctaccctcaaggtgtttacaactgtcacgattagcttcaatattcctgccgtgcgtgtgtgtgtgcgtttgagactattctataaatctgtttccaatcttgagtcatatttttctttgccatatccaagaacaatctgtaaaactatgtgcccgacgtatttttttaattaactcactttaagcgttaaattatttaaaaataaattatataagtatctcccttagaatcattgtaatcattaatgtccataaaatcatgaggttttctatttctcaaagtgtatattaaaataaatacgtctatttttaaaaggggagaaaggagtgacaagaggaagctttgtgattgattgttacatctacagttggtgggcataaatgaaaattgggagattaaaacccagtcccacagtgttctaactatctctgtatatgcacagctcccaataaagttagagttacaaaaataagacaggatgccttcctaagagagcttattgtctttcttaccaagaagatcaaacatgcttgaaacatttaagtgacaagcctaaaagtgcattcaactcgttttcttccatgtattcatggaacacaaaaccagtcttataaaaggtcaaaacagcttgcttgctccaaaccctgccttcacaggcatatgcacacataagaatt

SEQ ID NO: 29816 - DNA, 1084 bp, Homo sapiens
gctgggaccaaggggagggatatgcgtccggaaggcattgcttgggtccagcgtgagctcttatcttgttctatatacgggccttgggagctgggagatgaacctgggagagattctaatgtactgtacgaagttaactagtggctatttgttttttacaaatacatgcacataatttaaaattttgttttttaaatcgacatatatttatggtgtacaacatgatgttttagaatatgcatgtatagtggaatggctaaattgagttaattcatatatacattacctcacatgcttattattttttttggtgagaacatttaaaaactactcttagtgagtttcaaatatacggtgtattgttatttgctgtagtcactgtgttgtacagtagatctctggaacttattcctcctaactgaaatctgtatcccttggccaacctctcaatcctccaccccagcccctggtgaccactgttccactctctgtttctaggagttcaatctttttagattccacatataagcaagatcatgtggtattcgtctttctgtgcctggcttatttcacttagcataatgtcctccgggttcattcatgttgtcacaaatgaaccagggactgtttgaatacagggttagaatgttaaaaataaataggactatagcaggggaagtcggaggagacatgtttttctggcacgactgtaaaggtgcctggtgcttggatgtatgtatggtggctgatttgaagtgactgttttgagataacggtaatagtctgacagaagctatttggaaggaagcaaactccttttacagcctggcctggttctacaggtggtcacgtgacagtgacttgatttgttgagtgcttttctccctaaattaaaaataaaggtttctgggttgtgagatgcttcgtccttgtgggaaaatctggttcaaaacaagctctgctgcaggctttgggaatgtaggtcaggacttccttaattccatgtgctaaaccagaggtcccctgcacccaggtgaggggcctaggcagctctgcctttgcaggctgcctcagtgctggaaag

SEQ ID NO: 29817 - DNA, 1051 bp, Homo sapiens
gggaaaaggagctcctggtgcaggtacgaatccagaaaaatagagtgatacagtgatcccccaagaacccactagccttaacagtattccacattttaccatttttgtttcatctgtcttttttcttttttttttgctggtatcttaaaaaattcaaataccatgccatttgaccccggatacttccaaacgcatctcaggaaaaaggacatctacttagataaccacaataccattatcatacctaacaaaactaacaattccttattaccatattgaattttgtttgattgaaaaaatactttttaattttattagtagtagtattatttagagatggggtcttgctatgttgcctaggctggtctcaaactcctgggtgcaaatgatcctcctgccttagcctcctgagtagttaactacagcatgtgcaactgtgcccacctgaaaaagttgttttttttttttaatagttaatacattcaagtcaggttccaaacaaagccccctcttgtgtatgggtgttatgtctctctagtctcttctgagtcttttaatcttgaatagtcctcttttcctttttatcatgccattgacttactgaataatatttgatgttaaaaatgtgtgcatgcattaatttgattaaaaattttcaagaagttttaattggcttttaaaattttaatggttaaaaagtatagacaactttatatattttaaaagtcttatgttctctgtaagggtatttttataaaaacttgtttttaatgactaaatttaaacatctcaaatgcaggaacctttacatatcagttattctgggcacaattctttgcatgccaagatgagtaaaaatgattattctccagtattttttagtctaatcagagagggcagtttgtggacatgcctgccaaagcattttgccacatggaagtaattacttttaaagctaatagttaatggattccttactaggagccagccattttattaagtgttttaaattatttttatccataccacacactgtgggagaatccatata

SEQ ID NO: 29818 - DNA, 1153 bp, Homo sapiens
aaatattagttatgtaattttgatgataatttcttattaatatcaataaatatttctaaatacttgttactaaatggctgaatatgtatatatgtataacatatattatacagcttaaacattgaaaataatagattagaggaagtatgatatagattctgtaacctgatcaagagctatcttcatggaaattaattttctacctgcaggttaaataactctgaaattggtttctggctttgcttagagaaaggaaatattggttaatcaatcacaagttgagtgtatccatctttggtggtttccctttaaacaaaaagcctgttacggatcttgcttcctttccgtaggaaagttcattttagaaagtatattgagtcagggtttttgtttattttaatgatagagaattgaaaattggcattatcagatggcatgatgggttctttctggtgctgtttgaatcagggttagacagagactttgtgggactgttctccttcattgcattttctttatagttccatcccccaaagattccaggcatattatatctgtattgcacaattagatctaactgtattttgaatgttaaattcagccttaaaaaaaacctttattagccaggtgcggtggctcacgcctgtaatcccagcactttgggaggccgagacgggtggatcacgaagtcaggagatcgagaccatcctggctaacacggtgaaaccctgtctctactaaaaatacaaaaaattagctgggcgtagtggcaggagcctgtagtcccagctacccgggaggctgaggcaggagaatggcgtgaacccgggaggcggagcttgcagtgagccgagatcatgccactccactccatcctgggcaacagagccagactccgtctcaaaaaaaaaccaaaaaacctttattattattttttaaagcatatatggttcacgtgcccttgatggaggatattaacattaagtattcaggagtgaggaggaaggttaagttttaggttcgataaggattgtctggcttttggttcaaacaagtggtttttaactcatccagccattccttatgacccacattaccctctcaaagtgggggcaggacaggagaaccccacagatcccccaccttttgtttt

SEQ ID NO: 29819 - DNA, 1081 bp, Homo sapiens
catggaggcaggccagagacctatctccctctggaagaggtgatggccactggactgggaaaggttgctgggaggctaagcagagacaaggggagaacggaaggaagaacgtgagtgagatccctacatgatgtcagctgctcaatctttctttttggttctagcagcaatcctgggaaaagtgaccctgtgttggaataaagggtgagggaatacaggaggcaaaagaagagggtgtccaagggtttgtacccaaaccaggggaaacaaccagaaacaggaaataggaaccaagctaattttccatagtaaaaaacaaatttttttttgttaattctcttaaatccaaagcaggcaacttcactcttttcagtgttaggcccagagttgacattcaatacttactgaaatggagtcttgttttatagactccatttatggagccaggagtgagtgatttagtgttccaattgttaaattaattgccaggatgctgaagcttacactagaggctaaggtgctatgggcagacttcatatgccccatggaagtctgctgttgttaaaatgactgttgaaatctaagccaaatacttggctcacttagtgcttaaggtaattgatgcagctgataccaggccccgccagtgtgtggtggcttggcagagtcaagatggtatgttaatgtaaccaatctgtttccatttccacttgaatctttagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggttagtgattcagaatggaatttcagccatagaatgggacctggctctaaggaaaatggggagagcaaacagtatcttctagaaaaagggtgaaaatggttttgaggattattgcaccagggcatcatcctggcagttactctttttgagcaagtgaataattgatagagcccagattccttctgggttggatcttgtttccttccatctgggagtgtct

SEQ ID NO: 29820 - DNA, 1052 bp, Homo sapiens
agatgacctttttcttgaagattttggagtcactatagcatagtgtcatcctcaccagctctgagcatttataatataattgtgtagctacctgagtactttttacttaacataatttagtctgatttatggacatgtcatcctaacctgttaatgagcaaaggcagcatatcttattcatgtgtatatttttcatagggctctgcccaggggaagagtgcatagaagcccttaaacaaatgattggccctgcagtaatccccccagaaaagctcagttttcattattaacagtgttgttttgcgtgtgtgcaagggtggaagggaattgttcttagttggcaacagtctgcccaccacactcgagcatgctcccaaagcctatgtgtctgttgcagccacagcaatttgtttcaaaggctctgtgttgaaaaccccaggccttagaacccagagaactacagtgtgtggagtggtccttaatgttgatctaaacttagatcatgcgtgaggttttgcaactggctctgatcttcattaggttttggtgtcatgagtggggtgcagtttctggtcagttacagtgttcacaatctatggattttcctttgcagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaaggtaaatgttcctcagtcttcagtcagctggatcatgaacaccagaagagtccttgttatccttcattgttttcattacttctgtgctctaaaatgcattatgatgggagctttcagaagaaatgccagcctggttatgatgtaattcttcctcagtgacctgagctgaagccctgctgctcagaaggatcttcctgtttaataaagaacattcctcttggtcgagcttagggttttattggcaagggatccatgaata

SEQ ID NO: 29821 - DNA, 1001 bp, Homo sapiens
ggtgacctgacatagcccttggcagatcaagggaagagggaaaaaaaatttcctttccctgcgggaacttgaattttggtgccatcctagttttggtgatagccttttttaataagcaaatttttattaaccttgatctacatttaagttttcacagtaatttatatgctgcatacccttttttgaataattttagcactgtttgcctttgctctagtgccaactaaactgagaatctgtgttagtctatagatgatgatttgaaaggccatgctattggagctatttaatctgaataagtggtgaattcattatgagcactttgcctgagagaatctagatgctgcaccctgggcatgttgcagttaaaagaccaaatatttgattcccagcaaagaaacagcagcccatttttctagtatagtcaaatgcaggagactaaattcttcttgaaaattagaaatttgagcagcattaagaaggaaggttggtaaagaagaccaaacagtaacttaagtacacaacagtaacaatatgaaactaacataagtgcccatcaacaaatgaatggataaagaaaatgtggtatatagacacagtggaatactatttggccataaaaaaggaatgaaatcctgtcatttgcagcaacatggatggatctggaggccattatctgaagtgaaataagccaagcacaaaaagacaaatattgcatgttctcatttatatgtgggggctaaaaaaaacaaaaaacaaaattgatcacgtggcaagtggaaagatagataacagagactgggaagagtgagttaggggaaaaaggaaaggaggaagagaaatgggttcaagggcacaaacatccagttaggtagaaggaatatgtttgatagcagagtagaatgactataattaacaaaaatgtgtggtgcttgggtgatggacgccctagataccttgactggatcactaggcactatatacatgtaacacaatttcat

SEQ ID NO: 29822 - DNA, 1025 bp, Homo sapiens
gtattttggataagggatagtaaacctgtactaagaatagcagaatgccgccgggcgcggtggctcatgcctgtaatcccagcactttgggaggccgagatgggcggatcaccaggtcaggagatcgagaccatcctggctaacgcggtgaaaccccgtctctactacaaaaaatcagctgggcgtggtggtgggcgcctgtagtcccagctacggcaggagaatggcgtgaacccgggaggcagagcttgcagtgagcccagtggctgctgcactccagcctgggtgacagagcgagactctgtctcaaacaaacaaacaaacaaacaaacaaacaaaaagaatagcagaatgtgtatcatagactcagactattttacatagcagttggcagccacatactgaattaagagcacctgcatggtgggagttgagtgaatacaagtgtgagcaatgaaatgaatgagacaagccaccagttacacaaataggccttaacattgtggaatgtgttaacatcttaactttgtgtcttcacatatcaagatgataaacttctgtgactttttcttgcataaacgtgtgctcttaatatcttttctttttaaaggtgctagtgcttggaaacaagagagatcttcctaatgccttggatgagaaacagctaattgaaaaaatgtatgtcttgaatatgctattttaataatttgcttctaaattaccatattttgcccacttgttatgttattcctaatgatcatagccattttttttaggtagataaaagttggcctatcagagaagtgaatcctaacattttaggattgctacgatgatttcttcagtatagtaataaaactaatgagtaaaattgaacaaagtgataagtatgacagctgttctaagcacagacttatccttttaattcttctcataggaatctgtctgctattcaggatagagaaatttgctgctattcaatttcttgcaaagaaaaggataatataggtaagaaatgactggta

SEQ ID NO: 29823 - DNA, 1055 bp, Homo sapiens
caatatgttagcactctattggaattatatgcccaaaatacccttcatttactcaatgcccatattaacttcttagaactgccataacaaagtaccacaaacaaggtggcttagaacagcagaaacttaagtcattcaaaattctagaggctggaagtccaaaatcaagttgtcagcagggtcgtgttctctctgaaggctgtagaagatccctccttgcctctctctagcttgtggtggttgccagcaatccttggcattccttcacttgtagatataccactccagtctctgcctcacattcatgcttctcccctgtagttgtctctgtgtcagtgtattatgttttcctaaggacgcaagtcactggattaggtagggcccacctaatccagtatgaccttatcttaactaataacttgcagagaccctatttccagtaaaagtcacattctgaggttctggatggacatgactttttagggggacattaaacattctagcatagtatggttacagaataagtatgtatggctcaactttagtttcttaactaatttggtttgagatgatttgataaatgaatgtattggaacaaaatgtaataaatagtaccagaatagtatatctataaagtttatgctgatattttttctttagcttttgtattccagtctatccttccctaactcaccttccaccccgcctgcaaacatggctttatttatttttatttttttaagatggagtctcactctgtcgccgtggctggagtgcagtggcaagatcttagctcacagcaacctccacttcccgggttcaagtgattcttgtgcctcagcctcctgagtagctgggattacagttgcccactaccacgcctggctaatttttgtatttttagtagagacagggtttcatcatgttggccatgctggtcttgaactcctgacctcaggtgatgcacctgcctcagcctcccaaagtgcttagattgacaggcatgagccaccacgcccagccacaaatatgctttattcagtttaaagtgtgga

SEQ ID NO: 29824 - DNA, 1088 bp, Homo sapiens
tttaagaaatgaatgaattatttggctcacttaactagaggggactttatacctataaatgtattttctttcttagttttttttttggggggggggataaacttcatttaattgtggtcttttttttgttgtcagcctacatcatgctttgatgttttttctttttaaatcaacatcattaaagtttgaaaaatatcataaaatcccaccagctattttaaatttatttttgccactagttcctacccatatgtctatgcatgttttacatagttgcaatcatagtatgtgtacatattttggatcttaatttgtgcttttccactagtgctcttggtattacaagaagggagagagcacttccaataagtgcctttattcctgctcacagactgtttctcagattaccttttatcaggtggactgaagttgaaaacagtttaacggggaattgtgataacactttcatttgagaatatgacggtttggagagtgagttgatgacattttaatgtttttcttaatgaaccttaaaagcgcttctggagaaccttaagaatcccttcccagcaaagtgaggtggtggttgatttaacttgctggtctttgtggtatcatgtgtgctgttggcctttatttcaggatgaaggctgccgatgagtgttttggtttggttatgcattggtttggttatgcgtaagttaaggtcaggttgctttgagacagatgtgttattggaaagagggttttagaagtattgaggaggtggggatggcattagggaagggttgtgccctgagctgggtaggcccgttggttggtaaacctttgttgtctttgaggaggccaaagaagccttgcatggacgcctcacacttgccacttacaaacagtggaaaacttaattttttgtactctccttcctttaactcctctcaggctttgcttttttttaaatattttttaaaaaaatttatttttaatttttgaggatacacagtaggtgtatatatttatagggtacatgagatattttggcacaggcatgcaatttgtaataatcacatcatggaaaattgggtatccaa

SEQ ID NO: 29825 - DNA, 1056 bp, Homo sapiens
gtgacaccatctaactgtttgaagatgattttcctttatttgctcagttcttcttttgattcctttcctttgagctgcgattctacattttaaccttatttgaggattgagtactgttgtgtattcacctgcatttccctttgtcttgtctctccagattatcaatcccttgaacgcagggactgtttcttatgttatctctgtgcctacaccacaccaggtagatttctgaacagctgttacaggttaagtatacatgggaatttaaatttaaaaacacatatgtttgattttgttagctacataatcaaaaattttctatcaaaggccatggttttctccatcttttctgttttgaggtgaactttaaaaatttacagtggggtgaatgccatgaacatttgtacctggtgaagtaagtggagcgtttagttgtgcggttcagccagctggttacagggaaaggtattgagttcttgctggatgaacttaaaggtatcaggttaggctggagattgacaagaatatctacaaagaacaaatccagagtctgagctgcatagtgggctggcataaatggagtcataataatttcatgctgttaggccagtagagttttatggtgtttttttttcttccttcatcctcactcccacttcccccttattttggcaccttttgaaagaggatgtagcaattatttggtaagaaagaattaaaagtgttctaatgagtaaataccccagatcttagagaggatttgtctgactagagtggagagaagaaaccccacagttactgcaagtaatttttttttttttttttactgtggcagctcattaatttttagtgactgggcattgtaaaaaatattttaaaactgggtctattttagttatagattacaaggcaaagcacaataaaacatagaaaggagttcagtgctcacagtgagtaccttccttccatgggcctgtgcaggtggatagaatgacacatgccgcagatctgggtgtgactcaggagaggggagttacatgtggttctcctgattac

SEQ ID NO: 29826 - DNA, 1052 bp, Homo sapiens
ctttccactctggtacaagtgtgtctccacagttctgtgacttgattctacttatggacaccatagaaagtgttactttgggggtagaaagacctttgctgtattaattcacccataattagttcctgaataaataagagttgctggcaattatagtttctgatgggtgtttacttttattgtcttctcttttgaaataaagtctttttgttgaattttaattttctttttcagttcaaatctgaacatcaatgatgtactagggaactactcattgactcttgttgatgcattggatacacttgcagtaagtgttcacctttttttaaaaaaatgaattaagatgttttagagttgattatccctagttccctccagcagtgggaattccagggagcctgataagtcaaaatgtatcattagctttgataactgttatttattttaatgaccttaatggggagaacaagaaaagtgttgaaggttaaatgaggggaaatgtgattccattaaaaaaaggagaaggaatgtacgattgattttagggaacctatttttttttaaccagtttctatcttattccctaaaagaacccataatgaagctcattaatattgataattatagtcgttgctattccaggagtaaaagagagaagatctaagggttggcaggtaccctgaaatgtcatctagccactggctcccccaggagcaagttggagccctagcgcccatccttatgtggggctccctagaaacccttctcttttatttgccacttcctgttttgtggacactccatgcctgagctgccaacgtgggtgctggcattactgcctcatcctgtggttttgctcattgactctggagaactagaggcctttgagcagatatgcagaagcaccttgaaggcagtgtggcactcagtacatggtgccatgtctgtgtgcttcatctgcttcaccttttgccattaaagcagtttccaggggactgtattccagcatagtgttgttttaaaatcttcttagttaaggtgatttttacaac

SEQ ID NO: 29827 - DNA, 1099 bp, Homo sapiens
atgttttctgaaattctgggcggactaaggaccccagggatgtggctttcagtcctggccacgaagcagttgctgcgatgccttttagcttccctggatctgccatttctttataaagtgagtgaggatgttaaattatgtcactggtcttcacctgagggtgattttgctcctcagggaacattggaacagcgtctggagacgtttttgattttcacagctgaggcgtaggagttgccactggcacctagtgggagaggcaaggggtgctgctgaccgtcctgcagtgtacaggcagcttccacaacagttacttccaaacgtcagtagttcacaggctgagaaaccctggattaagtcatccagtcacatttcctgagagagcaacatatgagtttttaattttccctcgtttttgtctttctagtgcaatcgtgtacctgatgagaggaggtactccctgcccttaaagagcatctacatgcgacagattgaccagatggttggtttgatttgatctgctctctgtgaggcctcatcttgaaccagaccttaacgaccaaacccagaccatgccaaagtccagtctgaaatgaaaggggacagaagtcttgctgtccatggtggtgtaggaatttctgtgcaacacctcaccacgtctggttaatccttgcacacttcagtgtttctctcctgttcaataaaatgccctgttaaggatataatttgaagtgagaagatacatggaaattgccctcttatgacatgttgatgttataagcacaatagatggggcatctttggattgatgttcacagctttatacttcagaacctaagtctcttcactttgctggcacctgctatactggagtattgctatgtctttaaaaaattttttttattatattttatttttttgagacagggtcttgatatttttttgggacagggttacctgggctcaagtgatccttctgcctcagcctcccgagtagctgggattacaggtgagcaccactgtacctggctagctacttctttgttagaggattgagaatgaaatttctgcaaaagggcccatggttcatttggtatcc

SEQ ID NO: 29828 - DNA, 1035 bp, Homo sapiens
ttgagtgagtcttcacataggctgttttcttttctctaggctctgtgatcctctaccttatgatataatagtcgatccaatgtgtggaactggggcaataccaatagaggtaatcatatttctttagcttttagataagagtgatacatccagaatattctagacctaatgggcaaattagacataatgaaatctccatggttggatcagtggacccaagagttttaaaacaattaacaatagaaagtggaacttttttgtaaagaatgtaactacttatttcaaagagccatgtgccactggcctagatacattgttagtgacatctattcactagattacagaggaagctgagaattacaaactgccgatgagtcctctttgtgtaacagacaagctggtagacttgaatgggaaaagataattgaaggcataagcataaactggaggaaggcaattttcttctctgtaatccacttaagttcctagagggaataagtatagttgtaaaaaggggaaacttatgaacattacttggattttttaggaagtctaacaagcttaataccaaatgctcttagttttcaaaattaccatgatattgagaggactcataaaaactgtgtaaagcaaagcaagaaatggaaaggcattttctaaatggagaatatttcacagtagattccccttgaataatcagtatcatctatatgtttttaaagaatttagaagagggagctcccagtaaaatcactgaagtttgtgtgaaacatagtagttcttccatatagtatactgacagccaatttgaataaactgcagggagacacagcagattatatgattgggtagaaactggacagatgagcaagtccaaagcaagcccacaaggggagaaataatccaaactgtaattagaaaatggtatctgttctgggagttaaaatccaagactgaaatcatagaagtctacatgtgactgtgttccgtgaaagctagagaaattactgtggcttaaagagactgcacagtaaa

SEQ ID NO: 29829 - DNA, 1049 bp, Homo sapiens
ggagtctaggactaattccagaaataaaaatacttctggtctacaaatgtgactgcgctgtctctgttaacaccaacatatcctaggatttcctgaaacattttcattcatgatctccagacagatttgtgatactgtggtcataactagctacatagttatgcatttctgcaaagggaaagaatgtcagtaactagctacataccattctgttaaattattaatgatatttattaatgtttcatcatgcctatttcgctgttctgggcactttaagattaaacctggtattaagtgcagcatactcaactagatgtagacttcacttcatagaattttaaatctgatggcaactatatgcaatacgcatttatttttgtgtgtgtttgtaggaaaatttgtagatgtaacaagcaaaacaaagatttttctgaatttccaactctaccataacagaatttcaggcattttccaagaaatggcatgatagcagctgggttgcatgttgtacttagaacactgttgatggagtatatctgttgtgagcctggtttctgtgtatgtgtccaattcagtgataggagaagaaagcctgtaattacatttgcataaagtggttggctgctaaagagatgtaattccattattccaaacttttaattcatattttaaaatataaaaactagtatatatatcaaggaatattttaggaaatcttgtagttacctgtaagtgtctaactgtgtattcaatcagtaaccaatatggaaattgcagagtttcttcatcagaagatatgagtttaaattttatatttggcatgcacagcaatatattaaatgctgtgcttaactagaaagtattgtgcagtgtgatggccttttaacctccacaatatacattttatttttattccctagacttgcacatgaagtgcatatgttcatatttacccgtttggagatgggtaagatacaaccagcatagctccatctccatggccatctttgatttcatgcaactttcctttttcctgtccccctcccacc

SEQ ID NO: 29830 - DNA, 1624 bp, Homo sapiens
agttaatgagaagagcgtgtattccactcataattatgggaccactcagaggcatgggtgtcgaggactgccttatgctgtgagtatgcatttgtttctctccagaacagtgatcttcctggagtgtaatccattcttatacattgtgactttcttgaaatgtttatatgcagcatgacgaagttgccccttttgcacttccctgactccagcggacgtctagccctgcatcattgttcttgtttttatgtcccagttgaccttggcattttgttttatcactttcctggttgaagccaaaaaacaaagggtactactttcttctttctttccatatgtaccatactttaggggagagaggggccagtgtttggacactgttgatttaaaaaatcttattttcaggatcataattacggagcccctcctcctccgacacctcctgcttctccccctgtccagacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggtaagatcctgttccatctaaatttaagtctgggttgctgggattagggtttcttacaagtagggaaaagctcaaagtattctttcttgtgtttgttaatgtagatgattccttagtgctccttggctcgaattctctgcactaggtgagaattgctgacaacaaggaatgagagattgatgttaaagctattgaatttgatatgaaatttaatgtcctggaaacatttggtaggtgggagggagggggtagcatatgcagagacacttcgcccatgtgtgctatgatgtgatgcatgctgttggaaggactactttaagtttattttccctctttaggggaatgagcagggggaaggttattagacttcatcggcggaagcaggacaacatatcaggtgagcggaagatgggttaggtccacaatttgacataaaaatattctgtgatctgaatgttcattttaagaacccctcttggccaggcgcagtggcttacgcctgtaatctcaccacttagggaggccaaagcgggcggatcacctgaggtcgggagtttgagaccagcctgaccaacatggagaaaccccatctctactgaaaatccaaaatagccaggtgtggtggcgcatgcctgtaatcccagctacttgggaggctgaggcaggagaatcgcttgaacccgggaggcggaagttgccatgagctgagattgcgccagtgcactccagcctgggcaacaagagcaaaactccctctcaaaaaaaaaaaaaaaaaaaaaagaacccctcttacaagttcccatggtcccccagccagctcttttcacagaaagagatagaagtcctctcaagaccactgtatagttctctcattgtaaacgaaatgtgttgagaacagtttagtcctgtagcaaagtattccttgtgaacacaaaaaatatggattcctgttttaaaaattagccagtctcaaattgttatagattgagtcagcgaagcttagggactga

SEQ ID NO: 29831 - DNA, 1026 bp, Homo sapiens
tctttgttgtggaagggactgttctgtgctttcaagatgtgaacaggatccctggtgtctacccactagatgccggtaacactcatacactcagttgagattatcaaaaatgtcttcagatattaccaaatgtcacctgggtgcaaaatttccctcaattgagaaccactactctaaacccaactgaggtagagtctctaatgccttgaaggatgggacagcagagtaaacacacagtgagattagcgaacaatggctaatactgtgacagaggcttccagaatacagtacacttatcaagtgtaagtttaacaattgccacttaaagctgggaatattgtttggacactgccagtccccctagtctgtaagctccattaagcctaaggttttgcactattcttttgcgcaactgctactgatgtcaagcaggcgatactctgattgtcagtatgttggctttaggtgtttctttagatccctttgtttattgttcagtcttttggactctagtaagaaatgtggagacaatagtgttgattttttttcttctatactcctgttccttgcagaaaggatagtagacaataatcagtcagcaacagtgatgcaaaagtggtaaaagaaagtgttatgataagcatcagtgttttctgtgccattcatagaaagtatatttaattttattgtacctgtttgcaagtttaatgtggacatggattttcaagtagctttggtactacagtgtcttttccttctaatcatcactagcatgacatcatcactgtcagtgtttgttttgttttctgatggcacttaagtcttgaacaccgtggaggagaacatgtattgggcttatgctttgtctctgtagctcaggcactgtctgcctaggaagctgttcctgagttgtagtaatcttttctcaatactgtcaccatagagggcaatggttttcctagaggagtatagcaaagtacctcctagacattttctatattctccctacctactcctctcccctca

SEQ ID NO: 29832 - DNA, 1029 bp, Homo sapiens
agtgataaatttgaggtctctactgttcatttgtatgaagattttcttatgaacttgatgtcagtcctttgattagaaaattgatttttatgactttaaaatggtcataaaatcacagtgatgggatgaaactatgatccagattaatttcttactttataaatggagaaactgagcttccccatttaaagaagttattcaaggtctcacctctcattggtaacaaaagcatgatagaaaccagatcctctgactcccagtccattactcttttatgccacatcaattgccaagtgataaattttctctggaaccccagcttgtcccacccccattcccaaccctctatttatgcatggactttactaacctccctgaatttgttttctacagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcaggtaagcaccaaagggttgaggactctctaagtagctgaaattttaagaacccaggaagagggtaatggattggaattactgttccttccaaatgtacaaggccatggaataacagattagccaggtgttgatcatatgtaaccaaaagtaggttatattaactggaaactacctggatacatatttttaaactacctttattaataaaaaaatagatgaattgaggctgtgtgcagtgcagtggctcactcctataatacaacactttggcaagaagccaaggtggaaggattgcttgaggccagcagttcaagaccagcctgtacaacatagtgagaccctctctttacaaaaaaaaaaaattaaaagccgttgtgatgatacacacctgta

SEQ ID NO: 29833 - DNA, 1044 bp, Homo sapiens
tcaagaccagcctagacaacatggcaaaaccccgtctctgccgaaaataaaaaaattagctgggcgtgtagtcccagctactcaggaggctgaggtaggaggatcacttgagcccaggaaacagagattaccgagagctgtgatgcaccactgcactccagcctagatgacagagcgagattccgtctccaataaaaagaaaaacaaaagtatttataggactctctaatgtctctgtttaacttattcagagacaatatcagaggaagttactgtactgatattttaagagggtgaatggataatgtaactgaatttcaagggtactgagacaggcattttggttgtttctttggagcagtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggtaatcgcccctggtcaaatgatgatgctatggcatcaatcctccaaaggaagaggaacccgggttgccgcatggtttaagtaggggagctatagtaacacttagtgccctttatatcaatgtgggtttattgtgttcatacatttctttctgttttacaaagtcaaaaacatcctttgctggttttgcaccagagaataggggttagttatcatctgtgtttaccatgtggcctcacatgagttaacagtttaaagcactagagattgttatagagagttttaagctaccagaataaaacagattgattttttctcagagcttgagtacagctgaatattgcctctatcttaaaggaagtagacaatccagaagaaaaaccagaagaagagaaagaagaggttatagatgaccaggagaacctagctca

SEQ ID NO: 29834 - DNA, 1029 bp, Homo sapiens
caatcagtaaactgggaaaatacatttgtaattttattgacaaggggtcaacattcttactatttaaagagcccttacagatgaagaaaaagaccccaacacctcagtagaatgcaggctgaagaacatgagccagcagttctcacaggactaaatataaactacacatatatagatattcttttgatttaataatcctacatgtagccatttgttctaatagcaaaaaatgaaaaaaaagttggttaaattttgataatactaatgttgtgcagtcattaaacctgaactgtagatttctattcattgtcataaaatgttgaccatgtatttctgagtgaaaatagttactgagtagtttaggtaaggcaagagtcagtgaagcaatgtctcgataaaaatttaccaggatattagcatgcgtttatttgtggatatgattttcaggttgtgtatgtgctgtataaccttggtaattttttgagtaaaggtgaaaaataataataataaaagatggatagatttgaccacataaaatttggaaactatatatgcaggaaaaagagaaaaagtaggcaaatgacttggctttctttggcctgtaaacttcttaagggcagacatcaggtctcttgttgaatacagtatcataataagtactcagtaaatatatgttgaatgaatgccttgtacattgatttgcacgtggcagatttcacctgtatcttataactcctttctacaactaacttcatcacttaacataattgactttgatagttatagtgttggacctagcagtacagagatctgtaagattccattgtttaagacccttgaaatattaaatatataaaagttattccgaatataagccatgaattacatgtttgtttctgttttatacctaggcactttttaaaaggaggaaagaaaatttagtatctggaacaaaaggaagatgtgaatatacttccaatctaggaatattaaaaatcctgagatatcagaaaggaaaaatatgcatct

SEQ ID NO: 29835 - DNA, 1050 bp, Homo sapiens
accacccactgtccatgccaagtaaaattcacagccaaaaccctgctttgctgaagcagcctcatttcccctacctcagcatgtgcctgccacctaggccacagttattcagagtctacattaggcaccctctccttacctcagccctagcacccctgagtcattgtcacactaccaccttcactctcttcacgtgttcccatttacatctttccattaagcactcactgctcagtctctgttatgggactgctgcctcacctgaaagtcccaaggtaaagtcctaccctctgtaggatacagggacctaagtatacacatacatgctttttctgctctgttgccaaaagtacaatggattttacaaaataacattaataggggtggctcaggtctaattagattatgccaagaaccaactctagcctgtgagctagggattccatcaatcacatttcctgtaactgtcattcaagaggaactggccatctccctaaccatgtcagcccccagcacactaatgtctccccctggatagcactgggagggcctgaggcatataagagaataaagaaatgtgacaagcagaagaggcattggatgaaggaacaaggtccatgtaaggaggaataaggggtagggtgcccctcaataacaaatactgtaggttgctaaactctcatctaaaatacaaagacgtataacactaaaatttcaccagtctaactctttccttgtatgtgcttgagatgtttacttacagcatgaaacattataaccaatttatccttaaatgctttcagagataccaggaagcattttaacaagtcattctgtccattgagatgagttctgcagttaaatatttcccctatgcattcttattcaacttccccgcccccgaaaaaagttatggctaacatctatgcttgcttttattttttgttttgttttgcttcttgacttcgagtagatgaataataacaagatgcttttccctcctctagaacatatcctcccctgagagttcccctgcgcataggcccgagt

SEQ ID NO: 29836 - DNA, 1050 bp, Homo sapiens
caagtagtttagtagatattcataagtttctgctatgtgttccgcactactctcagacaagtgagacatagtctctgccaaatccagtgaaagacaggctgttttagtacaacttggtgaatgttgtaaatattcagcaaatgtaaatgcctgtatgtgccatatacttgctaggcaattgagaggttagaacagtgaaaaagaaattttacctattatttagtgtgtcccaagttcgaggcactgtattaagctctttaaatgtgttttatcctcacagtaagcctataagataggcaattttctattttgcacatgaggaaactaaggcaagttgagtaactttcccgtggtcacacagctagtaaatggaaggaccaggatactacccagtttgagagagaaggctggagtgagaggcagcaggttactgatttaactgaatctcaaacaataagtaggagtcagccaaccaacaattgagggtgaggtatgttacagtagagggagtagaacaggtaattaggtggcactccattggccaggcagcaggcatgcagtatggtgcaaacagttggatgttgttgtatcaggtggaaggccgggggagccaggaggaaagtgcagagagtgctgggctgggccaggccatagagagcttgctaatgggttgggactccacttccaagtaatgcctgatcaagaagtcacaaagccaaaaatatgcttttgtataagtggttctcaactaggggtgtttgagaatgagtaggagtgttttgaattgtcccagtgacttgcatttattgagcagggccagggatgctgaatgtcctgtataggggacagtcccatgtaatggccaaacatctgtagtatcctcattgaaatgaaacctagtggtttttttatattttcattataatgatattaccagaatttattaacttctttccaaaattatttctagaaaatgcatatgcaaaactgtctatatttttgttccatttggacagaaaaatgagaaccctaaggggatagaaggaggag

SEQ ID NO: 29837 - DNA, 1043 bp, Homo sapiens
agtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagattttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggt

SEQ ID NO: 29838 - DNA, 1022 bp, Homo sapiens
accaatttctgagtcacccaccccttatcaggaagaaagatgagtatattatcagcaagggctttggtcagacctgggtttccgtcgtagctttgcagtcctagctgtctgacttggaaaaatcacttcctttctgagctcagttattttatcctgtttttaaagggggaaaaatgattcaggcccccctcccgtaagtttgggttaaaatgaaataatgggttgggcatggtggctcatgtctgtaatccagcactttgggaggccaaggtcagagaatcgtttgaacccaggaattcaagactaggctgagcaccatagtgagaccttgccaatacaaaagatagattagatagatagattggatggatggatggatggatggatggattgggatggactgggatggactgggatggatggagtaaatactcatagtagataccttttcacgaatgctcagtaaactgtagctgtggttaaggacttggccttagtcatttgtccgagagcctgtaggctctgtcatggcactaggcagctgcgtaaaaggccaggcctccatcccgacctgtgtattcttgcctgggttgagccagctcggtttgtgtgagtattcttgtacccccttccagaaaggactagctaaaagacacctgctctgagttggccatcagcagggcatcgggggagttgggagccggtaggaactgcagctctgggtgctgtgaagagggccctgagccgcatccaactaaggaagtgaaatgttgctgagctcccaccctcctaggcagaggtctgagccgctgggatgtggacaggtgacctctgaagcgttgttcagctccgccaccatccagtttgagggttgcttggtcccatgttctctccagtcctgtagtgggagagcagagggggtggagcttggatccctctgtttgctgctcagggcaaaagactttgggctcttgttgaagctggttaagttacctgtgttcttagactgactggaaggcttt

SEQ ID NO: 29839 - DNA, 1034 bp, Homo sapiens
tccatcaagtgccggatgaaatctttggctaaacccccaagacaaaagcaaagataatgacagcatggtactgcctgtgtactccccaagagcatacccactccctcaggtctggcctggcatcaagacaaagaggccaaatcagtccatgccccaccccacccaacctatgctcttcttcaggccctcccaccccgtgccttccagctctttcctttctctcttaagaaaaacatatggccgggcacagtggctcatgtctgtaatcccagcactttgggaggccaatgcaggtggatcacgaggtcaggagttcaagaccagcctggccaagatggtgaaaccttgtttctactaaaaatacaaaaaaaattagccgggcatggtggtgggcgcctgtaatcccagctacttgggaggctgaggcagagaattgctcgaacccgggagacagaggttgcagtgagccgagattgtgccactgcactccagcctgggcaacagagcgagactgcgtctcaaaaaagaaagaaaaaaaaaaaaaagttgttcttgactaatctcagtgcattcacactgatgataaacgatagtagcttcacaggtttgcttcttaatagggggcacaaaaggaggatgaaaatgtttatggtggtgttttagacattagggtgtcaataggggagaggtattttcaaatagactatgtttgaagattgaacaaatgaatgcctagtttctcactctgggagccaagcagaaggaagtacccaagcagaaggaagaaggggtagggtgtctggtctcgaagacagctctttgtgtggtgctggaaaatccgacagaaggaaggcaggagggagaccgcccccaaagcaggtgagggaggaaccagaggcagggcccaggggaaaaaagcaaagccccaaataccagagtcagagatgtcgtcccagtaaggagagtcaaactcgtactcggccttcaaaatctgttcaaagagtttggcatcattctcgtcatagaagggaggg

SEQ ID NO: 29840 - DNA, 1051 bp, Homo sapiens
ctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagttaactgattaaagaggatttgctagggtattctttccacatctgtttgctttctctgggagaataagaagtcataagtcaaagaaaagcatctctcgtggtgaaatttcaatcctcagggataattagttactgtagtaacctcatcactggtttccagtcttgtccctctccaatttaccctccaagctgtggccagagtgactatcctgaattgcacacctgccaaaaagtcttaagtgtctcccggtggcctatgggacaatatccagcctccctggcctggcttccaaaaccctacacaaactgtcccactttcatctccagcccctttttccactctccccccagcctgtgattttaagctccatcacactctacctctctccacatagaaccatgcctctaagcctttgtttatgctattccttctgcctggaatgtccttcttcctctctgacaagtgcacacctacccatccttcagtccccagctctaatgccccattctccaggaagttttcccccaggcagaaggcacagctctctctgggctccacaaagccctcaatcccaaccttaattggagcacagcacacaccctgttgtcattttctgtaggtctgtctcttgcacatgtctgggatcaacttgaagggcagagaccaggtttga

SEQ ID NO: 29841 - DNA, 1055 bp, Homo sapiens
gtctcgatctcctgacctcatgatccatccacctcagcctcccaaagtgctgggattacaggcgtcagccaccgtgaccagcctgaaacaggagcaagttctaaactcaggctctagagtcagaaaaggtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggtaagtactgtggttacctccactctcccacccatttatcctccacccatccgcccttccacctatctgcccttctacctatctattcatccacgcacctactggttcatccacacatctgtgtatgattcacatctacccatctatccatccatccaccagccatccatccactcatccacccacgtattcacccactctctgatctaccgattcacccacccacccttccactcatccttccatcctcccacctgtcacccattgttaatctcgtcattcatctacctgatgtcagctccatactccccatccatctatccactccctgcctacctatccttccacagatccacctacccatctatctacctgctattccattctcccatctactacctatctgttcttcaggccatccactcatccattcttctgtcccaggtacttagacacttgtcttcccatccgtttgttagttgatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaac

SEQ ID NO: 29842 - DNA, 1031 bp, Homo sapiens
ttactggcatgagccaccgcgccaagccctctaaatgtcttttattgctgatttgttcttgtttttgtttttaggccagcacatagtaaaggcttataccttgcactgtttttttttgtctcttttcatctaggccagccccagtgccttttgaccccatagttttgatcttttgaggggccaggcgggttgttttgtagaactgtcccacattctggatttatctgattgtttccttatggtgtgatttaccttggtcttctgttagctgattgtctcaggaactagaagttaggtcaaatagtttgatgaggttaaacatttttcccaagagcacttcagaggtgatgccgcgtacctcatgtggcatcacaaggcacatcctgtgagagtgtctcacagttagtgctgctgagtttgactgtgggttacagtggtggctaccagattctctccattataagctacatctcccctttgcaattaatttttctgtaaggtgctgtgttggctctgtccagattacacattttcctgtcatcctttcatctaattgttttgataccagttttgattattgcctattttattagagttgcaaaatggcaaatgtctaattctgttgttccttctgcatttattagctgagattcttctgtaaagatgaactttccctcatcatctggggctacttgggagtgctgatagctacatttttatttgatttttttttttttttttttttagacagagtctcactctgccacccaggctggagtgcagtggtgctagctcggctcactgcaacctccgcctcccggattcaagtgattctcctcagatcccgagtagctgggattacaggcgcccaccatggccggctaatttttgtgtttttagtagagatggggtttcgccatgttggccaggctggtctccaattcctgacctcagctgatccgcctgtcttggcctcccagagagccaccgcgcccggcaatagctgcattttttttttttttttttttttg

SEQ ID NO: 29843 - DNA, 1047 bp, Homo sapiens
gacacctgaggctcttgtcacatgatcaggtggccatgccctatcagtgggaatacccgtatttgctgagcattttgccctctctcttgggccttctctcctttccccgcaacaacattagctacctggtgctctccatgatcagcatgggactcttttccatcgctccactcatttatggcagcatggagatgttccctgctgcacagcagctctaccgccatggcaaggcctaccgtttcctctttggtttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccaggccaaagttctggaaagctccttttgccatctgctgaggtggcaaaactataatttattcctggttggctagaactgggtgaccaacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcaggctgtggtctcctctgcaaagcattttaattaaaaacctcaataaagatggccctgcccacactgtgccttgtgtttggggcttgatagagtgtgaaaggtgtgttgcttgaaaggtgtggccttagacactaggagatgatgggtagaagctccttgagaaacctagcagtggccatagagaagtagactgggtatggggaacctaagtcatagttgtaacctacagctgattggtaagaactatgggccagac

SEQ ID NO: 29844 - DNA, 1035 bp, Homo sapiens
gtgaggcctggtgataaggcctgatttggccgagaagcaggggggtgcatgctggggcccatgtcctggttgtgctccttccaaacccaggtctgctaagaacttgccgggggacttgcgctccactttgagcctcagtttacccttctgccaaatggggaaagggcattggtcagatggccttttgggtcttatgtccaagctgggttgaatcacagattcaggcatgggggaatgggaacagcacttatgacactatctcagcacctcctccccacctccctccaccctgcccctgcctcaggcagcaggaggccccggacctcttccagtggctgtgctcagattccctgaagctctgctgccccgcaggcaccttcgggccctcctgccttcgtgagtttttaagttgctcttggggatgggaggggaccaccgagtccagggatccagtcctggctctgtccctagttcgctgtgtgaactcaggctactcagataaacttctctggacctcagttcttgcctgcctgacagggctggggagatgggcaaatcagtggggaaaggcttggagaaagcacaggggctagactgagtcatatgcagtatagttatcatcatgtactaaagaaatgatagacttcccagccccttcatttcccatgccagatcggactatggtaccttcctggggaggggcgggtgctgacctggagcctccatgatcgccatccatcctcacacacagtcctggcacaagagctgaacttactaccagcctcttttagagcagtctttcctgaagctacagataaagagctagctacaaagatggcaaattcagtctttgtaaaagaaaatattggctgggcgcggtggctcacacctgtaatcccaacactttgggaggctgcggtgggtggatcatgaggtcaggagatcgagaccatcgtggctatcatggtgaaacaccgtctctactaaaaaatacaaaaaattagccgggcatggtggcgggcgcctctagtccca

SEQ ID NO: 29845 - DNA, 1038 bp, Homo sapiens
taatctcttaagtccgggccgcggtcggcgttcttctctggggctccgcgccccaagcctcggcttcctcatctgccctgagatgggatagtccccacaggtacctttctgcgtcgttaaaatgaggaaatgagaaaggcttttaccctcacccccttcccgatgaactagtccaggcagtcggcctcatctcacgtctgttgggcttctcgggaagccaaatggtatcgcacgtgttaaaggcgggtgtctggaagccgaaagtcctgactaactgagaatgttgactaatccggatagcattgagaagaggaaatggagctattcaacagattcattgatctatataagctgctataagttacatttactctttctgtgtagtacctcacagaattctgaaattttggatatgacattctacgacattgcatttagctattctcacaactctatttttcaaaatgtccaacgtttaaaattttttcttcctcagtctttcaggagattgtcatggttgagagactggactgtacctacccactatgaatgagcagaacaccatagctaatattaactttctgcaggtaatctctgagcttcgggagaagttggatcctgcagcattgtgttttgccatcactgttgcaggctttccaagtaaagttaaaaagtaaaggacaagcaaggtaaagagctcatggataattgccacccttttcctcacataggatgtcacagttctctgacatcccacagtcagagttggagcttaatacttacaactacaaataatggtactattatgatatttacatctagtattatatcgtttttcaaattacgtatatgtatgtggctatgtatgtgttcatatgttttcttagccattcagatcaatcccaggcagactacagtgcaagtttattagccatcttatacatgaggttgtcatttactccagggtacatggctactaagcaggaattcacatcttgtaagttcttttctggtaggtagaagagtaatttttttcct

SEQ ID NO: 29846 - DNA, 1048 bp, Homo sapiens
cacccaggctggagtgcaggcagtggcgcaatctcagctcactgcaagctccacctcctgggttcatgccattcttctacctcagcctcccgagtagctgggactacaggcgcctgccaccacgcccggctaattttttgtatttttagtagagatggggtttcacgttgttagccaggatggtctggatctcctgaccttatgatccacctcagcctcccaaagtcctgggattacaggtgtgagccaccgtgccgggcctttctctttttttttttttttttttttttttaagagactaagtcttgctctgtcaccgaaggtggagtgcggtgacagcatcatagttcattgcagtctcaaacacccgggttcaagcgatccccccacctcagtctttggagtagctgggactacaggcaagcaccaccaggcctggctaattctgttagttagttagttagttattttgagagagtttcgctcttttgcctaggctatagtgaagtgccacaatctcggttcactgcaacctctggcccctgggttgaagcaaatctcctgcctcagcctccctagtagctgggattataggtgcctgccaccatgcctggctaatttttgtatttttagcagagatgggatttcaccatattggccaggctagtctcaaactcctgactcaggtgatccacccacctgcctcagcctcccaaagtgctaggattacaggtgtgagccaccacgcctggccaattcttttatttatttatttatttatttattttttgagacggagtctcgctgtcgcccaggctgtagtgcagtggcacgatctcggctcactgcaagctccgcctcccgggttcacgccattctcctgcctcggcctcctgagtagttgggactataggcgcccaccacctcgcctggctaattttttgtatttttagtagagacggggtttcaccatgttagccaggatggtctcgatctcctgacctcgtgatctgcccgccttggcctcccaaagtgctgggattacagg

SEQ ID NO: 29847 - DNA, 1147 bp, Homo sapiens
gaaactgttcaactttagatcatcaggcactacttagattctcataaggaatgtgcagcctagatcctgcgcatgtgcagttcacaatggggtttgcgctcccgtgagaatctaatgcagccgctaatctgacaggaggcggatctcagtggtaatgaccacttgaccacccctcacctcctgctgtgcagcttggttcctagcagaccacagactccgtgatccaggagttggggacccctgatctacctttttcttttttttttaaattttgtaattaaaaagtcttttttagacagagtctcgctgtgtcacccaggctggagtgcagtggcacaatctcggctcattgcaacctgcacctcccgggttcgagtcgttgacctgcctcagcctcctgagtagctgggattgcaggcagttgccaccacgactggccaatttttttttgtattttttagtagaaatggggtttcaccgtgttggccaggctggtctcgaactcctaacctcaggtgatatgtgtacctcagcctcccaaagtactgggattacaggtgtgagcccccacgcccagcctggcttatcctttttgatgactataatatttcaaaaattaaaattactccatcataatttactgaaccctttccagattgatgggcatttatagtctttccaacttttcacaaagtaatttttctagtaatagtgaaaatacatactggagttggcaagtgattgaatcttttaataaatgtgaagatgttcaaagttacttctgtagtagtatcactttaatgtatattggaatgtattcctaagagataccagtggttaatagttgtggcactttatttctttaaaaaatatttctgggttttgtgaaaagtgtagatactaccaggggagtgtgtggaacaaatgagcatcatccattgtgtgttttaattagaggaaaagctgctgtttcattgtagcaaatgtactgattggttaactgtttttctattattgcatatttattgacctggtgatgcttttcatcatctatagcaccaatactcagacaaagaagtacattgaaagggtgctaagaaataagattcgatcaggctgcattcaagaacagctgctccagagtaca

SEQ ID NO: 29848 - DNA, 1371 bp, Homo sapiens
tccccaataaagcattatacccagcttactactaaatgtaagattttttaaaattatggtatcaataaggaagctatgtttattaactggttatttactctgggtccattaatgtctatatattgcattattgatagagcatgatcacttcttttaaaaaagtcagtttagttagcattgaaccttatagaccaacttcaaattataaccaaggtggaacatccctggggggtcgtgtgattgcatgaggaaaccgggatttagaagatctggcctccaatcccaaatcgagcagataggaatgtactattaggcttataacttaacttctttgagcttaacagtcaattaatatccaaatgtggactcccattgatcctgagagaaaactcagaatggtgaaggattattctgtgtaaaacaaagattaagatttcttaagttaaaatgagagttggggaagagaagtctgatctgacattccaaaaggataagcaactcttaggttgtgtactgtttcctacagcttcttttctctctctactcttccccactcaaggttcttaaggatatgtgttcatccattatgtcgctggctcagagtttgcttcactctctagactagagtagaatttcatttggcagtctcctatacaaataatgtgtttatgttttttgacacatactgccagcaggtatgttgaaatacttattttggcaaggagggaacagaggaaggaagaatcatctaatgcttattttttgttggttggaacttactgaagggaaagtagctctgaactgggtctcaggaaagctcaattttactcccagccttgatgaaatgaagagatttgactggtggatctaactctgtgttctgaactctaaaattctcttgtctgaaattaagatacagatttggtctatttcaaaacatgagacactttttttttttcaagacagagtttcgttcttgttgcccaggctggagtacagtggcgcaatctcggctcactgcaaccttcgcctcccggattcaagcagttttcctgtctcagcctcctgagtggctgggattacaggcgcgtgccactatgcccagctaattttttgtgtttttagtagagacagggtttcaccatgttggccatcctggtctcgaactcctgagctcaggtgattcacctgcctcgccctcccaaagtgctgcaattacaggcatgagccaccgtgcctggccgagacacattttaatagcatatatccagagagagaggactgtatttgtggaaaatgtttatgaaagcaagtaaagcacagtgtcttattttgtatttgtacatatattcttcctattagcaatgttaa

SEQ ID NO: 29849 - DNA, 1033 bp, Homo sapiens
ttgtagcatgcatcagaacttcattccctactacagctttagtaattccattctttgtttttgttgttttgttttgttttgttgagacggagtctcactctggcccccacgctggagcgcagtggcacgatatcagcttaccgcaacctctgcctcctgggttcaagcaattctcttgcctcagcctcctgagtagctgtgattacaggcgtgcaccaccacacccagctaatttttgtatttttagtcgagttggggtttcatcatgttggccaggctggtctcaaacggctgacctcaggtaatccaccctcctcggcctcccaaagtgctgggactacaggcgtgagccactgcgcccggcccccattctttgtttataccacattttttttatccattcatccattgatggacacttgagttgtttccaccttttggccatttgaataatgttgctatgagtattggtttacaaatatttgtttgagtccctgttttcggttctttagggtatataagagtggaattgctggatcatgtgatgaacatatgtttaccattttgaggaaccaccaccgctttccatagcagctgcataattttacattcctaccaccaatgcacgtggtctccaatttctccatattcttgctaacatttattttcctttcttaaaaaatgttttatggccgggcgcagtggctcacacctgtaatcccaggactttgggaggccgaggcgggcagatcacgaggtcaggagattgagaccatcctggctaacatggtgaaaccccgtctctactaaaaatacaaaaaattagctaggcgtggtggtgtgcgcctgtagtaccagctacttgggaggctgaggcaggagagtggtatgaacccgggaggcagagcttgcagtgagccgagattgcgccactgcactccagccggggcaacagagcgagactctgtctcaaataataataataataataataataataataataataataattttgcttttaatgaattaa

SEQ ID NO: 29850 - DNA, 1034 bp, Homo sapiens
gtctcactctgtcacacaagttggagtgcagtggtatgatcctggctcactgcaacctccacttccgaggctcaagcgatcctctcatgtcagccttctgagtagctgggaccacaggtgcgcaccatggtgccccgctaattttttgcaattttggtagacataaggtttcgtcatgttacccagactggtctcgaacttttgagcttaggagatctaaccacctctgcctctgaaagtgctggtgttacaggcacgagccactgtgctcagccctttgcccgtttttaaattgggtttttgtcattgttgaggtataggagttatttatatattctggatattgatcccttatcagacatatgatttgcaaacatgttctcccattctatgggttttcactcccttgatagtgtcctttgatgtacaaaagtatttagtttcgataaagtcaaatttatctttttttttttttttggagatggagtctagctctgtcaccaggctggagtgcagtggtacgatctcgactctctgcaatctctaccttgcgggttcagacaattctcctgcctcagcctcccgtgtagctgggactatgggcctgtgccacaacgcccaactaatttttgtatttttagtagagacaggttttcacatgttggccaggatggtcttgatctcttgacctcgtgatctgcctacctcagcctcccaaagtgctgtgattacaggcatgagccaccacatctggccttattttttatgttattttattatttttttgatctgtgattttcttaattattttgagtcgtatgatcacacatagttttaaagtgtgtattctaatcattttaagttggcaaaagcaccattcccaatcacaaatacgcagcagttttatgttttcgaatggttctttaaagacaatcctgaatcataacttagtttgagttagagtgtaaagaattcaagagtgaagtttaacttgttactattttaaaagcatgtgaccttatagatcatgtata

SEQ ID NO: 29851 - DNA, 1069 bp, Homo sapiens
ttctccaaatactccaccagtgtatcctctccccaggtgatgcctttgttcttattggtgtctgtgtaagagaatccaacagcctgacctgtcttccgcccgaagagaccttggagattaggcctagtcttgtgcttgcctcccttttccacggtgtggcactgggcacacttctgaacaaaaatcttgcttttctcaacatcacttgtatttaattctctttttagtccctggggccacgaaggttgccactccaaagccggacaacccactctttactttttttgttgttgttgcttgtccttttggttgttatgcttaagataccattgccgaatccaaggtcatgaaggttttctcttattttcttaaatttaggtctttgatccactttgagttaatgtttgtgtatagtgtattttaaggatttagcttcattcttttgcatatggatatccagtttttccagttccatttgttgaaaagatggtcctttcaccactgaaattattttggcacccttgtcaaaaatcaatttgtcggccgggcatggtggctcacgcctgtattcccagcactttggggggccgaggtgggcggatcacgaggtcaggagatcgagaccatcctggctaacacagtgaaaccctgtctctgctaaaaatacaaaaaaaaaaaaaaaaaaaaaaattagccgggtgtggtggtgggcgcctgtagtcccagctactcaggagtctgaggcaggagaatggcgtgaacctgggaggtggagcttgcagtgagccgagattgtgccactgcactccagcctggatgacagagcaagactccgtctcaaaaaaaaaaacaatttgtcacatatatgaaggcttatctttgaactctgtattcagtttcattggtctatgtgtctgtccttctgccagtaccacactgttttgactactgtagctttgtattagtattgaaatcagggctgggtgctgtggctaacgcctgtaattccagcactatgagagaccgaggcgggcagatcacgagttcaggagactgagaccatcctggc

SEQ ID NO: 29852 - DNA, 1028 bp, Homo sapiens
gacacccacgcaaccaatacaccaccatggcctcatgagggaggagaaggcctagaccatgttcaggcagattctgtcggccatgcagtagtgccatagcaaattgcgcagagacctgaacccagaaaacatcatccttgatgaggacggtaacgttaagatcgcagacttcggctttggtaccacattccatgatgggcagaagctgacagccctttgtagcacttaacccctacatggccctggaacgtttcctaggccagggctaccaatgtgccaccatggatattcagagcctcagagtaattttataccacatggtggctggggttctgcccttctgctcatgcagcattagggtcctctcagcaaaaatttaaagtggaagctatttttccccagtctacttttcctgaggtcttaaaagcctcattaaaaaactattaacagtagaccccagggagcagaccacactagaagaagttatgagggacccgtgggtgaacagtggtcaggagttgcctctgacaacatgaagaacaaatcctggaccacctgaatcccaaaacaacccagcttttggtggccatgggattccaggctgagaacctatctgtggcaatcaaagaaaaattattcagttatcccatggccacctaccttgttttggaacaaacaaaacagaagaagcggtccactatcagaccacagacccttcctcctggggatcccacttgtcctctctacattgaagtttccaccttccctctttcactgaagcgggctcatagcattcagcagaagactgtgggtgccaagtctgggcagggcctttgcccttgggagtcctgttttagacccagctccaccacgtggccctggcctcttctctgccctgtctgtgcttgcagccatggtgcccagtctggccccaccaggagacaccagaacgactgtccatgtgtctactccttggcaccttccccgcatggtgggtagatgggcagggaggggtgggaatctgtgta

SEQ ID NO: 29853 - DNA, 1066 bp, Homo sapiens
aggttagttacctatgtatacatgtgacatgctggtgcgctgcacccactaactcgtcatctagcactaggtatatctcccaatgctatccctcccccctccccccacccctgcaattttgttttttaaagagcctgggctcttgctattgtgccccgggctggccttgaactcctggtctcaagggatgctcccaccacagcctgctgagtagctgggactgcaggcacgtgtcactgtgctcagctttttttttttttcccccctttggtagaaaaactattatttgtaatcttatgttatggagaatagtttgacaacagattcatctcttcctttagccctctccaaccttccagctagaaccccaccccaaagaacacaggcaaagatacatcagcatcaataatttattgcaaactccctaatatcacatgctagtatgcttgcgaattcactcacgaatgttctgggatgggggccagaaggtagagagcaccatgaaagtacagcctgtgaggccggactgctgaggggcagacttcatgccaatggagggacagacttcaggaccagtctggatgggctaagctaccttgggcaggaaggagctgggccaggccaggagcctgaggttctcctttggccaacccatcccaggtttccagcccctcctcctcactcagggtcctgtgtggtgagggaggtgtcgggaggttagcggctctacagctgccaggcttgtggccactaccagttgagcgtggggcccctagtctagtccttcactggggaaagctagggcttgggctttcactgcagtatcttcagacaggtcgggatgagggatgaggccttgcccttggggggatgcccgtcctctgtggcatcgaggagctgctgcaggtaacaggaggtgaagcagcacgtggcccgtggcttgcatgctgaaaagggcccagtggagagcttccctgggtggaatgagagggcacgcaagtcaaaaccacgaagtaggttgggcgtagtggctcatgcctgtaatcctaacactttgggaggccgt

SEQ ID NO: 29854 - DNA, 1209 bp, Homo sapiens
tagccagttgagaatttaggctctaaatgtaagataatagctctgtttcacatttattgcccgtctatttttgatgaagctgtggtattaacaactaaaagattctaatttggggaaaaatctaaaattttgtttttccctaaattataagtgggaagatggagtaagagaagtgatttttttctaattttatctaacagttcagtacaaagttgaggtagtgacatgaaaacctattaagtttctgtgcttttaatttttaggttcgccagttggtgatggataagttgtcgtctattagattggaggatttacctgtgataataaagttcattcttcattccgtaacagccatggatacacttgaggtatgctcttatatcccatcacacctagataaagcaacttaagtgccaattgctcttctctgtccccagactaactgagaatactgactaatccggatagcattcagaggagagaatggagctattcaacagattcattgatctatataagctgctataagttacatttactcttcctgtgtagtacctcacagaattctgaaattttgggtatgatgttctatgacattgcattggctattctcataactctatttttcaaaatgtccaacatttaaatttttttcttcctcagtctttcaggagattgtcatggtagagagactggactgtgcctacccactatgaatgagcagaaaaccatagctaatatttactttctgcaggtaatttctgagcttcgggagaagttggatctgcagcattgtgttttgccatcacggttacaggcttcccaagtaaagttgaaaagtaaaggacgagcaaggtaaagagctcatcctcacacaggatgtcacaattttctgacatcccactgtcagagttagagcttaatactactacaaataatgatactattatgacatttacatctagtattatattgtttttcaaattacatatatgtatgtgagtatgtatgtgtttatatattttcttagccattcagatcaatcccagacagacgacagtgcaagtttattagccatcttatacatgaggttgtcatttgctccagggtacatggcaggaactccgatcttgtaagttcttttctggtacgtagaagagtaatttttttcctctctgctacttgtagttcctcaggaaatcaagaaag

SEQ ID NO: 29855 - DNA, 1051 bp, Homo sapiens
agctgggactacaggcacctgccaccacgcccggctaattttttgtatttttagtggaaatggggcttcatcatgttagccaggatggtctcaatctcctgacctcatgatctgcccgcctcggcctcccaaagtgctgggattataggcgtgagccaccatgcctagcatggcttattcttcctgatgactgtgtaatattccaaaaattaaaattactccatcataatttattgaacctttcctgtattgatgtattgatgggcatttatagtctttccaacttttcacaaagtaattttccttttttttttttttttttgagacaaagtcttgctctgtcacctaggctcgagtgcagtggctcgatctcggctcactgcaacctctgtcacccgggttcaagcgattctcctgtctcagcttcccaagtaggtgggattacaggtgtgtgctactttgcccggctaatttgtgtatttttagtagagacagggtttcagcatcttggccaggctggtcttgaactcctgacgtcgtaatccacccatctcggcctcccaaagtgctgggattacaggcgtgagccaccgtgcctggcctagtaattttcctagtaatactgaaaatacatactgtagttggcaacaaatacacgctggagttggcaagtgattgaatctttcttttaataaatgtcaagatgttcagagttacttctgtagtaatatcactttcatgcatattgctctgtattctttttttttttttttgagaatggaatctcgctctctcacccaggctggagtgcagtggcgcgatctcggctcactgtaagctctgcctcccgggttcacgccattctcctgcctcagcctccccagcagctgggactataggtgcatgctgccacacccggctaattttttgtatttttagtagagacggggtttcaccgtgttagtcaggatggtctcgatctcctgaccttgtgatctgcccgccttggcctcccaaagtgctgggattacagatgtgagccactgtgcct

SEQ ID NO: 29856 - DNA, 1030 bp, Homo sapiens
agctggagaattcttcaaagaggcaatgtgagtgattgctgaaggatgggaatgactgacaagagaaagtatgggaagtgcgttctaggcagagaagagtttgagcagaagcaaactggtgcccaagtcaatggtgtgactgaggaatgagaagcaaacaagcatgactggagaataggatatatatggagaggaatgattggaggcaaggctggtaagacataggacaggcccatgttgcaaagagtctcaaataacatgctaaagagtttcaactttattttttagacaataaggagctattactagtttttacatacagttgacctaatctactcagcattgagagataactcagtaggctatatgatgggtggattggagactgctgaaatggtctaagggagtgagagtaagggccagattttggtcacgggaatgtagaagaaattatggcttaagagacaatttggtgttagaattaacatgacttggtgactgttaagaatatgtggcggtccgggtgcggtggctcatgcttgtaatcccagcactttgggaggccaaggcgggcaaatcacgaggtcaggagatcaagaccatcctgcctaacacggtgaaaccccgtctctactaaaaatacaaaaattagccgggcatcgtggcggtcgcctgtagtcccagctactcaagaggctgaggcaggagaatggcgtgaacccaggaggcggagcttgcagtgagccaagataacaccactgcactccagtctgggcgacagagcaagactctgtctcaaaaaaaaaaaaaaaaaaaaaggcttagaagagcacagacattttgagaaggttaaagtttaagtggcagatgaaagcaaatgtccatagaaggaaaatgagaaacctggaagattaataatgtgagcttaaaggatgtcaggtagcaaaagcccaggaatgagtttcaagagtgagggattggccgggcacagtgactcatgcttgtaataccagcactttgggaggccgag

SEQ ID NO: 29857 - DNA, 1049 bp, Homo sapiens
ggatgatatggcaaggaatagggtaaagacataacttttggtagaatattgttttcactgaaaaaaaagggaaaggtggaggtaaagaataccgagaactgggaggtgcattagaatgactaagcagtagatgattaaagcccaggattgtggttcagagtgaagaggataaagaaaactttatgtttcctgatagttagttcctagtctctgataataagagatttagaaagttgtaagaattttcccagtttatatccagtctatcaaacctttgggctctgagcatagcttttagaacttgagctttgagcttttaagggagctaaaaagttttagatacctggctatctatgtgtgtctcttttacagggattttaattttttgaattttaagggaaaaatgttagctgctagcctcattgttggcatcattttttccacagggcattttagattatctggataacatatcccctcagcaaatacgaaaactcttctatgttctcagcacactggcatttagcaaacagaatgaagccagcagccacatccaggtaagaggcaatatgttgggaaagatttttttttttttgagacagagtctagctctgtctcctagactggagtgcagttggcacgatctcagctcattgcaacctctgcctcctgggttcaagcgattctcctgcctcagcctcccaagtggctgggactacaggcacgtgccaccatacccagctaatttttgtattctccatcaaaaagtgggcgaaggacatgaacagacacttctcaaaagaagacatttatgcagccaaaaaacacatgaaaaagtgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctaga

SEQ ID NO: 29858 - DNA, 1124 bp, Homo sapiens
agtgtagtggcacaatcttggctcactgcaacctccacctccgggattcaagtaatcctcctatctcagcctcctgagtagctaggaccacaggcatgtgccaccgcactcagctaatttttgtattttttgtaaagaagagtttcagcatgttgcccaggcttctacatttttttgtttgtttgtttttcaattataatagggaggcagggcacagtggctcacgcctttaaccccaacactttgggagtccaagatgggtggattgcttgagctcaggagtttgagaccagcctggttaatgtggttaaaccccatctctataaaaaatacaaaaactagccatgtttgttggcatgtgcctgtggtctcagatactcaggaggctgaggtgagaggatcacttgagcccaggaattcaaggctgcagtgagctgtgatcgtgccactgcactccagcctgggtgacagagcagaaccttgcctcaaaaaaaaaattataagaaggagtctattgccctacatttgtcaacctaaatgatttctacttttatgtgacctttatctgattagttatgatagggctatatgtctcaatcaaacactgttcctactctacaaaagccaatctctcagtcattggaagatggagcaagatttttatccctctgtcagaatacagtcttaggttaacaactcatttctcccatctgctcctacctggtgacacaggtttgacttgactccattgcgaacccttagtttctgagacgctatccagcagtttcttcactcataactctgcatttattatagaacaaaggaagccggaatattggattctcacatctccaacagagatctgcccaagaaattgttcattgtgtttttcaactgctgaccccaatgtgtaaccacctggagaacattcacaactattttcaggtcagaagcctagacttagaagctgctaagcaaatatgaggtttcatttttggctgagaaaaaggaaaatgaggacaattactgaagcaactgtcctaaaatcatttttatttttagtgtttagctgctgagaatcacggtgtagttgatggaccaggagtgaaagttcaggagtacca

SEQ ID NO: 29859 - DNA, 1053 bp, Homo sapiens
gttatcctcagatagagctcccctctactctatgctctcactcctaagctgagcaagttccctgtccatcgactgtatctgtggtaggtaagtctgcctaattctggggcttagttaacaggcctatttgatttttgtattaagttacattctccaaataaaccttttggacccttcccaatttgttttttatatatataaataagaaaataaaacccttgggctggatgagactattctgcctcaggggcctttcagtgagatacctcagctagaggtaacagtgtgtctctcttcttcagtatgggcgtctctttgtggaagcatttctgaagcaatgtatgccgctcctagacttcagttttagaaaacaccgggtaagagctaagagcagagaacaaagatatgcactgaagagttgctcagaagatatgtccttggtgactcctgggtggggctgggagtgttctacctgggctcctctggtccacttcagctgtagccagagatccccaaattggactgaatattccaaagtaggctgaactcctcaggcccactctggatcaaacccacctttctatttcttctccagatctgacagtggtcttccttttagcttgattttattgtgctactgcactctcaggtcctcatgtatcagtgtgtcatttgcttattcctttatgcttctgtaggtatactctcagaaatgattttaaaaaaaaaaaagctcatttgtgtcataaaaccctttgctgtggtaatgaacagtcttgacagttttttagccaatggcatccagggctagagtgatgaattaaggatagaatcacattatttcctatacatatttagcaagttgaacaaaatactcaccatatttggttggtccctcacagccctgaaagagaaagggaaggtggtattttatcctaatgttgcagatgggaaaactgagacatggtaacctatgtaaaactaaaatgcaggtcttataactctcagattgatacaagggacagaaatgggagagttgagaataagaggtag

SEQ ID NO: 29860 - DNA, 1057 bp, Homo sapiens
tttttgagatggagtctcactcttgtcacccaggctggagtgcagtggcgccatctcggctcactgcaacctctgcctcctgggttcacgtaatcctcctgagtagctgggattacaggcgcctgccaccacgctggccaatttttgtacttttagtagagacagtgtttcgtcatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttggaaagccaaggtaagaggattgcttgagcccagaacttcaagatgagcctgggctcatagtgagaacccatctatacaaaaaatttttaaaaattagcatggcggcacacatctgtaatcctagctacttggcaggctg

SEQ ID NO: 29861 - DNA, 1315 bp, Homo sapiens
aaaaattcaaatcagagtgaagtgaatgagacactccagttttccttctactccgaatttcaactgattttagctcctcctttcaacattcaacaaatagtctttttttttttttttttttttttttttttgagatggagtctcactctgttgcccaggctggagtgcagtggtgcgatctctgctcactacaagctctgcctcccgagttcaagtgattctcctggctcaccctcctgagtagctgggattacaggcgcctgccaccatgcctggctaattttgtgtttttagtggagacggggtttcaccatgttgtccaggatggtcttgatctcctgaccttgtgatccacccacctcagcctcccaaagtgctgggattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctgaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagtttttttttttttttttttttttaaagctgttttttaatacattaaatggtgctgagtaaaggaaataggcagggtgtgttgtgtggtgtttt

SEQ ID NO: 29862 - DNA, 1956 bp, Homo sapiens
atctcggctcactgcaagctccgcctcccgggttcacgccattctccttcctcagcctccccagcagctgggactacaggtgcacgccaccatgtccggctaatttttttgtatttttagtagagatggggtttcaccatgttagccaggatggtctcgatctcttgacctcgtgatccgcctgcataggcctcccaaagtgctgggattacaggcgtgaaccaccgcgcctggcctgcctggctaattttttgtgttttgtaaagacaagagtctccctatgttgaccaggctggtctcaatctcctggggtcaggcagtcctcccaccttggcctcccaaagtgctgggatcacaggcatgagctactgtgcctggccttgctctgtaaactttgagggttacacagttgactttgttcccttctcccaccagcctttaacacatctttctctgtgccaggtcacagaatattctgaggggaaggtgttagactggtcattttagaatcggtagagatccctgctggctgacctcacatcgttcccttcttacctccaggacagttggagatgtttcatgttagctgatgatcttcatttactcttcacagaggagactaactgtgtgacgagcaccttcatgtagtaaagattatttttactatgacatctaaatgtctacattcaatttagagttgaaagaatggaagggaaaatttgagcatgtatgataaggcttggtcaactatgattctcgatgtttgatctatagactatcacataatcccaaaagtgtcgtgaagtaggtggtattatctccacatatccattagtaaataccttcatatcaattaacaaatatttaagcacctactctgtgtaggcactgggcagatgagattcagaaaggttaaataagctgaccaaggccatgcagctggtaaatggccgagctgtggggtaatatcagattagtccaacttcaaagccagtgttctctgcactgctgcctctgggagcacctgctctgttctagcctggcatcagatgtaggggtggcaagacgaaggtgccagggtccctcccttgcggagctctctgcagggtgagttagcccaggcacagtaaagcactgggtattgaggctcttgagtgatagagcttttgcacatcccctttcctgcatctccacttggcacatgtctagtgcacacgtggaacaccaggcttggggctgttgttgccaaggacaatcgggccatgcttcacagactgagaagtcactcaccacggggcagtgagtggagagctgtaacagggatgggtttggagtacccaagggtcaggggaatgagcgactgaccatcaggaaggtcctcacagaagaggtgacatctgagtcttactgatggacaaggagggggacaggacatttcgggcatagggagcaatacatgcccaaaatgtcaggaaatgctgcttgtctggagtgcttggggcactgctggccctcccttctctcatccgtgctctcctgcgttccctggacacttgcgtgtttggaggaaggcaggagatgaggctagacaggaaggctggggccagtctgtgaagggttcctgatgagctcaggggtagggattattctgtaggcaaatgtggagccctggaagggttctaaactaaggctgaagtggtggggtttgcattttagagctcctctggcacgctgcagagaaagggtaggagggagaagacagggagctggtgaggagctgttgaaatccttcaggctactggtgatagggctggagcaacatctccacttatctttccttctttcctttggagatgcacagttcaccaagcagtgcttccaggaagaacgaactctcccctttatgaagtcaggtggtttgtctcttaccttctgcccatggtctacctacttctt

SEQ ID NO: 29863 - DNA, 1050 bp, Homo sapiens
tcttggttcactgcaacccctgcctcccaggttcaagcgattctcccgcctcagacccctgaattgctgggactataggcgcatgccaccatgcctgtctaatttttgtatttttagaagggacggggtttcattttggccaggctggtctcgaactcctgacctcaggtgatctatccgcctcggcctcccaaagtgctgggattacaggcgtgagccaccgcgcctggctcaagtttatcttctaacgtttatgttgattttttttttttggtcttttttttttttttcctgtgcgtggtttttttttttttttattgctgccaatttttttttcttttttgtctttttgagacagagtctcactctgtggcccaggctgaaatacagtggtgtgatctcagctcactgccacctctgcctcctgggttcaagcaattctcctgtttcagcctcctgagcagctgggattacaggcatggaccaccatgcctggctaatttttgtatgtttagcagagacaggatttcaccatgctggtcaggctggtcttgaactcctgacctcaggtgatccacctgcctcggcctcccaaagtgctaggattacaggcatgagctaccacgcccggccagaactttaaaaattaaaaattttagctgggcgtggggctcatgcctgtaatcccagcactttgggaggctgaggcaggtggatcatgaagtcaggagatcgagaccatcctggctaacacggtgaaaccccgtctctactaaaaatccaaaaaaattagccaggtatggtggcgtgcacctgtagtcccaggtgctggggaggctgaggcaggataatggcgtgaacctgagaggtggagcttgcagtgagctgagattgcaccactgcactccagcctgggcaacagagcaagactccgtctcaaaaaaaaaaaaaaaaaaaaaaaagtttttgtcatccaggttggagtgcagtggcatggtcatagctcattgcacctttatttttctgtggtccccttggtttaacttttcc

SEQ ID NO: 29864 - DNA, 1030 bp, Homo sapiens
gtctcgatctcctgacctcgtgatccacctgcctcggcctcccaaagtgctaggattacaggcgtgagccaccgcgcccggccagctggagactttcttgagtatctatgtggctctctgtaaaattaaactgcatataagaattcttaaagttcggccgggcatggtggctcacttctgtaatcccagcactttgggaggccagggcggacagatcacttgaggttaggagttcgagaccaagctggccaacatggtgaaaccctatttctactaaaaatacaaaaactagctgggtggggtggcacgcgcctgtagtcccagctattcgggaggcttaagctgaagaatcacttgaacccgggaggtggaggttgcagtgagccaagatcgcagcactgtaccccagcctgggtgacagagcgagactctgtctttcccctccccccgcctccccccagaaaagaattcttaaagttctacagccttagagtgttaagtaattttactgtctgggaactcagatgcactgcttctttctgacctatgtaggtactttcttttcttttttttttgttttttttttgtttccagctcaaggctgtaggaggaagaaaaatctagtccctgggggtactgatgaatcagttggatggtgggcgttggactgtgaattcctgatgcctctgggtaaactctggaggaaattctgtttcattacttgcactcagccctcctattttgtactaaggtattcttgaatacaagtgcaccggccaaaaaagtaaacttacgcataaaaagaaaggctctcttccttccaagaatgctgaacacctttgaagtctctgttgctgcctcatcttttagatacaatcattgattatgtatttttggcatcgtcctgaactttgtttcatttccttcacagttgaatgtgcagttggctttgtccactcagtgatggtccttgtgactgttcttggcttttctgttgtttttccatctttctataggaagcttgagaccg

SEQ ID NO: 29865 - DNA, 1033 bp, Homo sapiens
tggtggggtggggtggttaggataacgcagcaggaattataagcaatatgactttatttagttcctttggaaacaaaaccccccaaataatgcctgaacccaaaggtacataaaaatgacccaaaatagatttgaacatcacttgtagtttcttcctcgtaacatgagtgctttcagctggacagtagattacaaagcatctccgatcacgttaaggcagatgatcaatctgtggctgcatctgtaactcctcctgggaaaataatcctgttggagttgggggctcttcccagttgtctggttagttggcccaggaaggggcagtcctggagctggcgggtggggagccaggccccacctgtcttgtcactgctcgttctgctggccctctgtcactgatgctgatacggagccctggcccttgttgacatcactgatgcacacccactgcccatcaactgactccttccacagggtcacctgcgagtcagtgcacaagcagattatcacgggtctgtgcccttccctctgctgtcccctaaatatgagcctcatcctcatcaagaaccactgcccagaggcttgtgggtgaacagagcatgtccctcctccactgaaatctcaccaaaatgagagtccaggaataaaaactcacagaaaaaaaggagtaacaataacagcagctgtggatgatgatgtcaacacaggatactgttttcagcaaactgtgacagagctacagcgagaggatatggggtggcggggagcagggttcgcaaagtgtggtccccagaccagagcagagcatcggtcacctgggagcttgctacaactgcagattcttggggcctggaacaactgattaggaagctctgggggtggggctggcaatctgttttaacaggtttaacaacactgcagtttgaaaactactgtggtagaggaaggtaacagttcaatatgttgtttctacactgaagtaaactgtataagaaatagctaagagctgaaaaggtttgcccctggagagaaa

SEQ ID NO: 29866 - DNA, 1016 bp, Homo sapiens
ttatcctgtatgtagaatctagaaaagtcaaactcacagaagcagagagtagaatggtggttcccagggactgggtgggcagggttggagagattgggtcaaaggatataagatgtcagtgccacaggtggaatgagttcacgtctatcgtacagcatggtgacataggcaataacatgcaatacaatcaatcatgtgtacttgaaaatcgctaagagaataattttaagtgttcttgccacaaaaaaaccaaggcaatgcatatgttatttagcctgatttagccattccatagtgtttatggatttcaaaacatcatgtctaaaccacaaatatatagaatttttgtcaattaaaagttaaaaaataaaataatttggagcatattttttaaaaagtgagggctttgggatcatacagatctgggattgagtctttcaggtatcagctgagtgatcccccagggccttgtcttcttcctctgtgaagtggagatgataatagtaccagcctatggtgttgttgtgagaactcagggagatgaacagcctggaagtgcccagtaaagagagggaggcccatgaggattccaagggctgggtttctgctgctgagataatgcaagagaatccactcaccttttttaaaacttaatttttttaatttgagagagtgcattttattgattaaaaaagagagttggtaatgctactttttgtagaaatacgaagacaacatgaagttaggactaatgagtcttgggaacttggtactttttttttctaatcttattttatttaagttacaggatatatgtgcaggacatatgcaccatggaatactatgcaaccataagaaggactgagatcatgtcctttgcagggacatggatggagctggaagccattatcctcagcaaactaacacagggacagaaaaccaaacacctcatgttcttgcttataagtgggaactgagcaatgagaacacatggacacagggaggaaaacaacaca

SEQ ID NO: 29867 - DNA, 1067 bp, Homo sapiens
atgactttttgactttacgatggtgagaaagcgatacacattcagtggaaattatactttgtggacccatacagccattcggtttttcactttcagtacagtattcaataaattacctgagatattcaacactttattatggaacaggctttgtgttaagatgattttgcccaactctaggctaatgtaagtgttctgggcacgtttaagggaggctagactaagctatgtctggcaggttagacgtattaaatagagttttgatttatgatatttttttcaatttatgatgagtttatcaggacatggtaagttgaggagcatctgtatagtataagaacaaaaggcgcaaacagtgaatggctctaattagggaggtgaaagatgatacagaactagcgaaggacacaggggttgtcagaggaaaaccagaaaagtgttagagaaaccaaagaaggcaatgctttctggagggaaagagaaactaacagtgtcagaagcacagaggtcaatgcgagggccactgtgtttgttgattaagtcattgtggtccttaagaattcagtttgagaaagagggtggagctgaaaccaagatgagggcctttaagattattgagaattgaaaaaggctacagtgttttttctgctttattgtacctcagcagtatcaagatggggaattttaggaaggtgaagaagtcttataggtctttctggcttttgaaagtggcaatggtcaactattaggatatttaaaataaagtgtccctagaattttttttaatctcagaaaatcaatactttttttccctttatctcaatccagttgcaaaatttgaaagcacgatgtacatccacaatgattttagtatttgtatctttaaaaatgtatgtgttggtgtttcttgttccctttggagctttcttgctccatcgtaaactgcttgtggttacctgtcaaaagaaataaaatcctaataatctctctcttgttttggcaaactaacttattttggagccagtaagatatgacgaggaaactactggaaatgtacaagcattaaa

SEQ ID NO: 29868 - DNA, 1064 bp, Homo sapiens
ctctaggtttttctagctctactacagctcagaataattttgataccttactctttttttttgtttgtttgtttgagatggagtctcgcactgttgcctgggctggagcgcagtggcgcaatcttggcttactgcaacctctgccttcctggttcaagcgattctcctggtcagcctcccgagtagctgggactataggtgcccgccaccatgcctggctaattttttgtatttttagtagagacagagacgaggtttcactatgttggccaggttggtcttgaatgcgtgacctgcttcggcctcccaaactgctgggattataggtgtgagccactgtgcccagccaataccttactctctattagtgctaaagttatttccgttttccctcctgatgtattttaccctctatgttttaatttttattcccagaactaccctgtagttcaggcccctcatatcacactcctggacacttagaatcttgtttccatgttgtgcaacactactgtagaagaatctcccttgaactacccacatttagtgtatcattcattgaccaagagcataatggtgtcttccttctggctccaagctgcctttcctgccttatcttccattattttcctcataaagcattgctccagctaatcttatctatttttctccagaatctccatccccttcccgtcagatacatctaaaactttttttgtatctttgtttttcctcgtgttgtatcatcttcctaaaacatgttctacttgtgaaaaccctaagaaattctctctgtcttattgaaattctatctccactgtgaagcattatcatggtgtggccatatatgatctatccctatctgaagtcactgcatttattccctgatcctcatttgcaggtccagtaccttgtacaagtttctttttgtgccatattagactgtaagctccaagagggcagggcccaagtcttatgaatttgtgtctgcatagtgtctagtacttgtctgaggccctcaataaaattcttttgagtgaatgaaagagtaccgtaaatgtctt

SEQ ID NO: 29869 - DNA, 1001 bp, Homo sapiens
tgctgcttggtgcacagaaagccaatcactgagacaagtgtggccaagaaacaaggctttaaatctggtgctgcagccaaggagataggagctcagtctcaaatccatctccctgactgactaaaactagggctttatatagcagggaggaaacataacaatatgtaagaaaataaaaactagagaggggtaaggaagcatctggtgctgtgatctgatgagttccagttatttgattctttttttttttttttttagtaggcctgaaggtcctttcctgagggaaggaactcagataaaacaaatatgagtttcaagctttaacagcagaagggtcaatttccatgtttatccaaaaacaactatctgtgggactcttgggttggtttcacttttttttgttggatgatcttggcactcttgtcaaaaattgagactgtatctgtgaggattgtttctgcgctctctattctgtttcgttggtctatgaatatgtcttgtctttatgcggtactatgctgaactttgtagctttgtactatagtaaatttgattactgtagctttgtagtaagtttggaaatcaggaagtgtgagtcctccagctttgctcctcttcttcaagattgttttggcaattaagtgtctcttaagattacatatgaattttaggatggctttttttttatttctgcaaaaaacaccgttggatttgtatagagatcacaatgaatctgtagatttccttgggtaggatcttaacaatactaattcttccaattcatgaatatggggtgtgtttccatttatttatgatggggtgtatttccatttatttatgatgtctttaatttcagcattgttttataatttttattgtataagtctttcacctgaagttaattcctaagtattatattctttttgatgctattgtaaataaacttatagtttctttttttagattgttcattattagtgcatagaaacgtaactggtttt

SEQ ID NO: 29870 - DNA, 1026 bp, Homo sapiens
ctgtctacttccccatgagatccacctggcactcctactagtcttaaaccattatctcccttgaaaaatgagttctggctcactccttactactaaggctgaggggcaaaggagattatataaatgaaagcaccatgcatgtttgaggtggtttccttttcttcgttgttgttttttgagacagggtctcaccttgtcacccaggctggagtgcagtggcacaatcttggctcactgcagcctcaaccttccaagctcaagtgatcctcccaacctcatcctcctgagtagctggggccacaggcatgtgtcactatgtctggctaattttttgtatcttagtagagacagggttttgccatgttgcccaggctggtcttgaactcctgggctcaaatgatccacctgcctcagcctcccaaagtgttgggattacaggcctgagtgggattacaggtctgagtcactgcacctggccgaggaggtttgtattattacttgtgaatggaggaataacttgagctttagaaaagttaaagtgacaaagatcaagaaaatttccccccctgcttttttctcttatattttaatatttccaaatgagctataacatatgcagaaaaaagcttaaaacattttatatagagaacaagtatgaattaaacacccaggtcaaaaaatactctcgttgcccttcacccatctcatattttactttctgaccacaggcctagaagtaactagtaactagaaacagtaaacttttcctgtacaacttcagtctggtatatgggtcttaaacaatataattctatttgcctgactttgaatttttcaaacagaattatgctataatatgtagattctttcgtgtcttgttttgcccaatattgtaaaggttacccatttgctgtgcggctaaagttcattttcgttgctatgtagtgtttcataattggatatattgaaatttctcctctacggtagcatttctagtctcagattataatgaagtgtgctgtttgg

SEQ ID NO: 29871 - DNA, 1049 bp, Homo sapiens
tatgtggttttctaatcccgttgtcccagttagatgcaaagcttctggaggacaagggccacacctttccccctttgtgccctcaaacactaacaggcgctttgccatagtacttggaaaaatatatattagttgaatgataggacaaaaaagcggttgtagatggaaaacgcattaactgctgagaacacgttttcattttgagttgtctataagagtttaaggggcagggaagccctggagttgaagtaaattcaacagcatcaagttttgtgtttggccctcaataaactagtctctctgtacccctggcagggggtgggaggagtcctgggggagctcccttccaaatcttacagggtggtctgtttcttctttggataataatgatgtaatggctagtctcttgagaacttgctgtgttccatacattgtactaagcatttatttggattatctcattaaatcttcacaatcactttatttaacagatggagaaattaaggcacatggaacctaagtgttcaaggtcatggagccagtaagtgttagagccaagtcgtttggctccagagcctgtgttcttaactactactttgtagtgtctttcttacatattagttgggcctgtgtattgctagttgaattcctcttcccagtggcaggccttcacgtgtttgaccatggttttcatgttctccaaacctcagttctctagatttgtactttggtaggtcatcattttccacagatcctacctctttaggtcagaaaatcttgccagtttataaagattctctgggactaactcccacaaagcaaggtcacaagagatcaatgtacaaatgaagcagttcagtgagttttgtctaccattctccataagtacatgggagacaactgatgattggaaggtttggtgttcacctcatggagctgtgatatctcactcaccacacagatctgctcttctgagggaccatcttgccaatttccagagagttgcagggatattaaatttttgcacattaagcttcctctttccaagc

SEQ ID NO: 29872 - DNA, 1088 bp, Homo sapiens
caccccagccccactcaaatataatccccataaaggcaaagacattatatgtcttatttactgctttatatgtcttgcctaacaaagtaactggtacattattgttacttaatatttttacctttgaatttttttgccaaaataatacagaattagaaagaattcctcccccagtgtcatggctaaatttatatacagtagctgacttggaaactgggcagagttgttttgcgtttggaaatactggtgttcttacagttgagtttctatttccaaaagatgcttactcagcctttgatggcacagtttgacttgtgacatcagaaggttgacaggcagaagtctgagtcagaaattcagctatagaagagcgtgactttcatccctgctcgccctttgaggtatggctggacacagctcagaaaggtcttggatttcaatttgtctaggaaggtatttagcaaattatttttaccatttggattttggtaccaatcacccgaggaatctgcagtctctgcgtaagtgaagaatgagaatggaaggggtaagtggagctagtgggagagcacaggccagcccgccacttccctggaagaactgatggctttttccaaggcctggatcatgcctcgcctatcctcctccccactccatgtccccagtccatcctctgacttttatttacttaccaccttggaagtcataagattctgaagttttccacagctgctgggacttaggcactgggccactgaggacaagctgacaggtcagtgtttgggctctggatttcacatcattcattagccctctcgatccccacagagagggacgttcatgctatgaactgtgtcatggagaaaacacagccctagaaagaggaactcttgatcccccactacttcattctttcaagccctgtgacctgttcctctaaatgcctgtgggaccacaggtgggcttgggatggggatgcttcctgaatgcccagggactgtacgcaaaatgttacgtgtgtgtattatgggcagccagggaggctcggtttcatcagactctcaacagataccatctttggtctaaaa

SEQ ID NO: 29873 - DNA, 1029 bp, Homo sapiens
gttgcaagagattaccatatttgtgtgaatttcaagaagtcaaaggccgtggcaataaagtattttcattttatagagtttttcttggaaaggccacacaccatatgacagcagagtgcttaaaacccagagcctggtgccagcacaaaatccaaacatcgtaaagttacttccaaagcccagatattgaccgatcccctctcttggagcagtgcatctttcaactagtccaagtccaccagcccagaatcaccctcccagcctcagatttcaagttggaagcccaaagtaaggcatgttttctaaaaaggaaaggaaaagctattggatagcaattgtcaagagtcaaaaaataaataaataaaaataagaataaaataaaatcatccccaatggaggagctttagcaaaagaaaagggagacatgccattggtcactgctgcatgtatgcattgtccctcggttggtttttaataaacccagctaacctccctccaccaaattgcctgtatctctccttctccacttagggctgtgtaccattactagaatatgaaatagtgatttgaaggggtcatttgttcaggttttccaggcttctgcactgcctgccctggaatcaattttttttttttttttgagatggagtctccctctgtcgcccaggctggagtgcagtggcacaatctcggcttactgcaagtcccgtctctggggttcacgacattctcctgcctcagcctcccaagtagctgggactacaggtgcccgccaccatgctcagctaattttttttttgtatttttagtagagacggggtttcactgtgttagccagcatggtctcgatctcctgacctcgagatccacctgccttggcctcccaaagtgctgggattacaggcatgagccaccgcacccggcctggaatcaatttttaaaacctgtctgggtgtgggtggcttatgcctgtaatgccagcactttgggaggctgaggtgggaagatcgcttgaggccagaaggagtt

SEQ ID NO: 29874 - DNA, 1139 bp, Homo sapiens
ggtgccgatgaaatagcctgtactttataaagtatgttgtaaatgttgctgacataattttgtgtcctgtaggaaatgcttccttgggtgtttgtattatagcccaatccaagtcatccctgagaacatccccaggttgtaaggattagtcagaagtcatgatgactgttctatataaatatttggcctattaactaaaattagtacctttccatttcttctctttcttgggcggggcagcgggggagtgcaggggaggggaaatagggaacgttcaattgtgttttaagtaatgctcataaaattcttagccaaagatgatcttgccctccaccttggtgacccaccgcatacggggtacatctatctggcctgtctctaggcctagacagaagaaacagggaggattattgttaacttttaccacatgtatgacttgttcccggacaacccattcttcctttaggcagaggtgatatgcactgaagtgtttgatttagagtgatggaaaagtctgtgctgccattcctcagggagtcctaaacgttgatttgcctttgggagggccaggcttcacgaaaacctgatttacggtgttgctctgggcctgatttcctttgcacactctggaggaagtgctctggtgatgttggcactgagcaagcaacaaaggttttaaaatgtcggccctggaaacaaaactgtaccttgtgatgttagaataattataccacacttgatctctgattacggccaaaacagcagttgctaaatccagctaacatggaaaaactagaaaaagtgaggggaaatcagccaaatgcatagcaagggatggggaaagcggacctggactggacacagaatcttctgtttccacttgtctggtaataactgcaacacttcatggtccccagccccagcgcccaccccttgtctagagccattgcgctctgcatgttgacactagctgtgggaactctgtgatttaaagttgagttgaaagaactgcttttatcatttcaagtatgtagccccaggccaaaacagacaaaacaattttttaaagtctcagttcaaaagcagcttgaaatattctctgttccatcaaaaggaaccccaaatctctccactgttct

SEQ ID NO: 29875 - DNA, 1010 bp, Homo sapiens
ggcccaccctgaccatgtgggcagagatagcttgtaaggctcacagttatgtcccccaggtcatcaagggccagaggctggatgtgggtgctccgagattacagctgaatcctcccctccatacccgtgtccttcagggactccccaacagcagtggcaatggccagagagccaggttctgcctgcacggttcaggccatggctcatggcagcattacaatgcctgttgagcttcccaaagcagaaaggtccactgcccaccccggggagcagtgagcgggtccctgtgggtcgcactgcgcacacgcctctgttccagcccctgctgctgcccaacagcacaatcctctcttctcatgtccatttccccaattagactgggagctccctgtggccgtgacagtgtccacacacacgtctctggctgcccacagctctgctctgcagagggctgggtaaatggtgagcgctcgtaaaacgttgaaatgaacagcagtgataacttggcctcgggttccatcagacacatcagcgatctctcctccagactaaaactgagcgtgctgagaacaaaaactgcatcttgcttgactggcttctggtaccccctggcacacagcaggggtctgtgccattttgttaaatggatgaatcaaacaaacaggattaccatgtcaggctctgaggcaagatgggcaactgttctcagcttcaccaggattcccaagcaccagaaccacctctcccaactcccagggcctaccccacccacagtttcaacagaccccatcagacacggacaccaggcagtgccacttggagggaagccccggtgaggccacagggacacagaggctcttgcagctgaatgcacagagcccggaggcaccccctcggggcacggcaccatcctctctgtcagtcttagcaaatgctgactactgactaaggacctattaggtcgcagtccctggagattcggagagctcaagcagtaattttgagcctcc

SEQ ID NO: 29876 - DNA, 1064 bp, Homo sapiens
tgttctaagtagatgtattaactcatttactaggatatcaagtagattactactattaacctaattttacaaatgaggaaactatagctcacagtgaattcggaatttgtacccagggagtccagctccagagttcatgcttccatgctcctaaccatcatgctctgtgattaatggataacaatttgttccatatttctcctttccactgaacaccttggtatttctttttctcagtgacacagatacatgtttgaccttgaacaatttcttattctctctgaactttcttcatctaaaaagaggagataaagtatatctcaaactaattgaaataaaccttgaaaatgtctaacaatatgattgacacttgacagatgttcagtgaatgttccaccatgacaagcagattttcatagcagctttaagacaacagcttactacatgagtatttataggagccttcaagtgaggataggagcctgtcatttgtgaacagattttcatgacactaaaaaatgatttagaaaaatagaacaaacctagatgaatattccttcattttggttcgagcaatttgttgtacatggtttggaaaacattgattagcactgttttgaaacagtctctggggaagatgtttttaagctgacttatatgtggaaacttcatactttgagcactatcacattcatgtctcatttaatcctccacacaatagaatctgtggtgcagtactaatactattctcattttacatatgaaggaattaaggtctaagtaggttaagatgattacccaagctcaaatagccaggaagtgatagagtcgggactagaacccagatttgtgggttctataggttctgtggcctggaaaagagaatgttctacagaagggacaaatctgagctgagctttgaaagatgagtgggatttagattagtgaggaaggaaagaggcatttcagtaaaaaggaagagatagtaaaaatatagtaacagtaatgggaaagaagtgtgtagagcagatgtaggctagttggcataaaggtttcagggcagg

SEQ ID NO: 29877 - DNA, 1068 bp, Homo sapiens
aactaaagattttacttcatttccatgcttggagtggggcccagcagacccctaagaggggtacctgctccatcttaggctgacccactcacatggctccactaggcattgctgtagtggagactctctgtggtggcctcattcctatggcttagctaggcattgccctaattgtaggggaggggtgcggcacactagctgtggtggctctggctctgttcctgtgacaagtctctgcgttggcccccaggacatctgcaacatcctttgaaatctaggaggagattgccatggctccacatttcttgtattctgcatattagcagagtcagcaccctgtggataccaccaaggtttaccatttatgccctatggagctacagcctgagccacacccaggaccatttgaaccacagctggggagtctgaggaacactgtactggcatgcagggagcagtgtcctaatgaaacccgaggcagtaagtccactgagggtgtgccaggcatagtgaggaaaccattctgccctcctagagctctgggcctgtgatgggagggtgaaaatctcaaagatctctgaaatgccttccgggtcattctctcattgtcttgatgaatagcacctggcttccttctagctgtactactctgtttaacaaactgtcaattggctacatccttagtattctctcctgaatacacttttttattctttgcctttccaggctgagagttttccacatctttccttctccttcccttttcattgtaaattatgtctaagtcatttctcttttccttcactttactataaggggccaaaggaagtaatgaagcatcttgaacactttgctgcttagatgttcctcctaccagatatcctagtttatcactgttaagttctgcattccacaaagtcctaggacatgaagacaattccactaagttctttgcaactgtgtaacgagaatagactttactccagtttctaataccttgttcctcatttccatctgagacctcatcatcagaattgcctttactgtccatatttctacctacattct

SEQ ID NO: 29878 - DNA, 1033 bp, Homo sapiens
gtatattagcgttggtctgtaagccttttgaagtcttggaacatgtttgcttctcttatttccccatggaatttaagatggtacctggcatgtatcagtatatttggttaaataattaaacattgcaagttttgtaaataatgactagtatttgtatatcatgttaaagttcacaaaatgctctcacatttattatatttcttaattctcccccaaattttgtgatacttctatttaaagttgaagaaattgcatcttaaagagttgaaataatttgcccaaggtctcacagttgataactgctctagataggactagagcccaagcttcaggtctgttaaaaatgctgacttgccttgtgttttcttgaaatcccagttttctttaagggatttgtagatattgttgtttaatactatggaattatcctgggagctcaatggaaaggtaatgtcttcctgtgaactagacagttataggagacctgagaatgtttcagctgcaagtggatctaaagaaggagggtgtagtgggttgaatagtgttcctttctgcctggccctccccatcccccaattcaggtccacctcaaaatgtgacttatttggaaacagtgtctttgcagctaaggatcttgagatgaaatcattccagatataaggtagatcctaaatccaatggctggtgtccttataagaagaagagaagatacagagagcagcacagagaggagaagcccatgtgaagatggaggcagagattgcagctaggcaactacaagctagggaatggcaaggattgcttgtaaccactagaggctggaagaggcaaggattggatgggccctacagccttcggagggaacatagcccggccaacacaccttgattttagacttctggcttctaaaaccgtgagaataaatccccccacaccttttttttccttctcttttctcttttttttttttttgtgagacagcatcttgctctgacacccaggctggagtgcgatggggtgatcacagctcatt

SEQ ID NO: 29879 - DNA, 1049 bp, Homo sapiens
aaactcattaagcaatactctttttttttaattttgatgtggctttctgtatctttgttttattttacaacataaagtttaaagaaaaaaatgttttctgttgtatgaacaagagcaagaggattagtgggcagagaggagaaaagaagggcacctatatattaaaaatatttttgcctaaggtatactagactttgtactagagcatttcacacctgttatcttgacattcaaaatggattattcttatttggcagagtctcagaagttaaataatttcctcatggtaatgagtagggggcaggagttcaagcccaaatttgattgattccaaagcagactttctacttccctcatttactgatgttggcaaatagaagtgtgggtggtataccaatgtctctctaaacctagtgtctatagtatctagccttcagttagtcaccctcctaaaaagttgtgtcctttgtgtatattaaaaattatatggaaacatgtatattctcaccctctcaactaatctgttatataaaagactggttatattacttgttctaacagaacaaaaatgataattctaagacaagatatgaaaatatagtgacatctgggccaggtgtggtggctcacgcctgtaatcccagcacctttgggaggctgaggcaagcggatcacttgaggtcaggagttcaagaccaacttggccaacgtggtgaaaacccatctctactaaaaatacaaaaattagctgggcgtggtggcatgcgcctgtaatcccagctattcgggaggctgaggcaggagaattgcttgaacccaggaggcagaggtttcagtgagccaagatcgtgccactgcactccaacctgggcgacaaggcaagactgtctgtgtgtgtgtgtgtgtgtgtgtgtgtgtgtgtgtgtatactttttgacatctttaaatcccttatttttaggggaattgtttttctagtgaaacatgaacaaagatatttgaaatgagtttcaaatatagtccagcagctgagaagtcctagaacaatc

SEQ ID NO: 29880 - DNA, 1114 bp, Homo sapiens
tctagtatccagaatatatagagttcttataattcaacaataaagagacaacccatattttaaaggggcaaaggatttgaatagacatttctccaaagaacatatacaaaaggtcaatagtgcatgaaaagatgctcaacctcattagttctaacggaagtgtgtcacaaagccacaatgagatataactttacactccataggacaactataataaaaaagacagagaataacaagtgttggtgaggatgtggagaaattggaacccttatacatggatggtggaaatgtgaaatggtgcacttggaaaaacagtttgtcagttcctcagaagttaaatgtagagttaccatatgagccagcaatttcactcataggtatacctgagaggatttaaaacacgtgttcacccaacaacttgtacacagatgttcatagcgttattcatatagccaaaaagtgaaaacccaaatgtctgtcaactgttaaatgggtaaacaaaatgtggtatagctctacaatggaatgtcgttcagcagtaaaatggaattaagtactgatacatgctacaacatggatgcaccttggaaacgttatgctaagtgaaagacgccagtaacaatcatcaaataaatgcaaataaaaatttcaataaggtaccatctcacactattcagaatggctattaagaaaagtcaaaaaacaacagatgctggtgaggctgcagagtaaagggaacacctacacacctagacactgctggtgggaatgtaaattagtcaccgtggaaaacagtttggagagttctcaaagaacttaaaacagaactactattgaacccagcaatcccattattgggtatatactcaaaagaaaataaattgttctaccaaaaaaacacatgcacttatatgtttgtcgtagcactattcacagtagtaaagatggaatcaacataggtgctcaacagtggattggataaagaaaaggtggtacatatatactatgaaatactatacagccataaaaaggaatgaaattatgtccttttcagcaaaatgtatgcagctggaggccattatcctaaatgaattaataacaggaacagaaaacc

SEQ ID NO: 29881 - DNA, 1027 bp, Homo sapiens
agttctgttttatctatcatatagttttgtctaattttagcctggtacatctttttctatccctttactttcagcctttctatgtttatgtattttaggtgtatctcttgcaaaacagcctataaatgaattttcaaaatcaatctgacagtatttgtcttaacttgaaattttacatttattataattactgatgttagatttatttctactgtttgtataatgctcactactgtgtttttactgtttatcgttgtctttttctttcctgccttctaccagattgcaagccctcccactcttttttcagtccattaatttggaagttatatattctgtttgtattatgttagtgaatactcttaaaattttaaagttgcagttgacttaaagtccaaattcagtcaaattctttattcttctccaaaacaactccgcagtcttgttctgattatgtgttattattgtccagtttttatacttgtttttgtattcaaatttgttcttttttgttgttctgtggcttggatttatacaggagtcttaattctgccttatgcagactcttcctactccctatatttagttgattggaccaggggtagaccctggatctaagtcaggctaacccctggaaacctgaaactgggcccaagagacactagttggaactagtgaaaagccagagatgagagagagggaaaattttgttcctgatgactttgcagtttctgattccagtttctcaagaggtgcagctttggagttctctgagatatccctgtatccttgcaataaattctcctgttttgttaaagtaatttatagtgggtttctttcttgttatcaaaggaacttgaaaatgccattctccttcccagaattactaattttaaattaattatatcattgcacatctgtttaatacttcatagcttactaaatatgtactgtcattaatctattctccttacaacaatgtgaatattagtggtttttcaactagataaatgaggaaactgaggcc

SEQ ID NO: 29882 - DNA, 1050 bp, Homo sapiens
cctgtagccccggctgcttggggaggttgaggcgggaggatcacttgagcccaggaggttgaggctgcagtgagctgtgttcatgctactgcacttcagcctaggtgacacagtgaggccctgtctcagaaaaatcccaaaaagtaacccatgcgtttatgatcaattgattttcaacaaaggtgctaagaacagacaatggggaaaggacagtctcttcaataaatggtgttgggaaaactggatatctacatgcaaaagaatgaaattggacctttatctcacatcatataaaaaaaaaacccctcaaaatgaattaaaacataagacctgaaatggtaaaactcctaaaagaaagcataagagaaaaccataggttgagcaatgacttcttggacaggaccccagaagcgcaggcaacaaaagcaaaaatacacaatgagattgaatctaacgaaaaagctactgcacagcaaagaaaacaacagagtgaagagacaaccacggattgggagaaaatatttgcaaaccgtacatctgataagcggttaatatccaaaatatataaggaactcaaacaactcaataacaagaaaacaacccaatttttttaaatgggcaaaggacttgaacagacatttttagaaagaatgcatatgaatggccaatagatatatgaataaatgctcaatatctctaatcatcagggaaacgcaaataaaaaccacagtgagataacatctcataccttttagaatcactattaccaaaaagacaaaagataagtattgggggggttgtgaagaaaaagggtgcactattggtgggaaggtaaattagtatagccattttggaaaacgctatggaggttcctcaaaaaatataattactgtacaatccagctgtcccacttctggatatatatccaaaggatttgcaatcagtatgtcgaagagatatttgcactatggtcatttcagcattacagtaaccaagatatggaaacaatctaagtgtttgttaaccaatggacggataaacaaaaatgta

SEQ ID NO: 29883 - DNA, 1041 bp, Homo sapiens
ggggtcaaagactgtgtttcatatgtcattgcattgtttcagcactgactctagtgtttcaaaatgttttgtatagttggtacacaattaatgtttgttgattgaccaccttaacatttgagaggtggaagaagggcctgttgagccagagtttgaggtgactttggaataattttttaggtttcttgatcagtattaaagacccattggatctctgagaatagctttatctataacattttccctttttccccattttcattactaccctcactgggggttctctgtgacttctcccagggcctgttagccatcctgattacttttcctctcccacagggtgcctttgaccttaaagttattatttttcctctttgggcatctgttttctcatcagtaaaataacatgaaagtaatctttaagtttctttctagctccaatattctgtgatgccattgtccagaatctctactgaatgggggagcaaattatgtatcacattttttgttataaaaatcaaattggtttattgaacagattctggagaataaaaccttcattcaagcctcagccttagtggtcatattagtattgtggtctctgtgggtttttaatcaaagaaaactgtggacataggaatggtatcatttgtcagtgtaagctgcaatgaagaaatgcaaggtagaaaaagatgactgacatcattagacccactttgacaagtgtgatattattctcaaagtactcccgggcatgtgagttatttttgtctcctgtgggtcagagtctggggcttgttctcctcccctggtaagatagctagtttaatgatggctctgccatcactgaagtacatttggtcttaataatgggcttaaatttttcttggttctgttgggaacttcagctgtaacaaggaaacttagtagtaacgatactttgatgtgggaaaaactaagcaccttttgctgaaatcagttgctctcatcactgactttgagcatgttattttcctttccacattagcgtcttttttctag

SEQ ID NO: 29884 - DNA, 1058 bp, Homo sapiens
caggggggcagatctttcctgtgctgttctcatgatagtgaataagtctcatgagatctgatgggtttaaaaaggagagttcccctgcggaagttctttgcctgctgccatccatgtaagacatgacttgctcctccttgccttctgccatgattgtgaggcctccccagccacttggagctgtaagtccattaagcctttctcctgtatgaattacccagtctcgggtatgtctttattagcagtgtgtaaatggactaatacacttacctaatggggttgtggtctgtatatacttagcatggtatctgtcattttgaccctcaataaaggttgttattattttcatcatcaggattatcataatctcatcctattcagatccttttcaggtccttcggcaaccctaaagaactagaaattcctaagcactcctatttgatggtttggaggaagcgttttcatcttttagcagatcttactttttagaccttcctctatatcttaagtgggacttctgactcaaaagctttgaatttacttttaatgtcaatatattacccactctactggcttaccgagtggttctggttagtaggctgttttttaagaaaaacagatccaaactccttgctcatcagttcactgctttgggccattcattcctagggatattgactactgttccacgttgacaaattagagaatccttggctagtgtagtgtgatgtattattttgggatgcccacgcattaaggggctgggagaaggaatcctggtgtctgataaaatgaaatagaatctgggtcatggcatcattgttgtatccagcaggcttctgggaaggcaactttcagaaacttcttaggacattggcagaaactctgaggtgagacccctgggtgaattggtatggtttgtttccctagaatctctgctaagagggggagcagtgtttgtcactgaaaaacatgagtgtggtgtaacctaaggagaggcttatcagaagtgctctgagtctagaagagccttctgcttgggatctgaaagcaaagca

SEQ ID NO: 29885 - DNA, 1039 bp, Homo sapiens
tctgtaagtaaaatcaacttttgagggaagaatgtccacagccagttttcagtggctgcataagaacagtttcaaccctcgtatcttgtactttacctacaaaaaagtgccaagaaagttggctgtgaaaagcgtgaatttttgtgccatatatcagatgaaaccttctaggattcaggtttctcctttaaacttttattcattccgtatttttaataagctatcatagggttcttctgaaaccagttccttagaaaaggtgtgcaagggacccagaattccaatttacataggaacttaaatcccaaggggttctggctgatggtctttgatttttgcctccctaaatttacattagggtaaaagattatgttttgggagtgctgtcttgctccccagaatataactatattttcccccagcactcagtacactatgtagcatatagtaggcattctgtgaacttctgatgaattgttggcttcctcacagcagggtctggaattgttcatctctgtacacccatctcctagtacagcacctcctagcatataataggttttcaaaaattaattgcattgatattgttacttcacttttaggtaagtgcctatccttttaactaggcgtttctcagtcaagactgtcagagccctgaatgagtcattgagtcaggattagagggttaatgatagcccagaaaagataggcaccacttgttagctgattcatggggctaatgtcagctcttttaggggacgtggcctagataaatcaaagtctggcaataatgaacccatagcccgcagacagcaaaaattatggacctttctgaactcctgcaaaggaaatgaaaaactctttaatcagatttctggacttgaaactagggatttttgtaaggatgctgtatttcagattgccaacatggaattggggagcatgatcagagaaaggttggaagaagaggggaagataatagggacttagctggaagaaggaaaaggaaaaggttgcccggaaagcagagagaaagatg

SEQ ID NO: 29886 - DNA, 1029 bp, Homo sapiens
cccccggtacttgtcagaatttgactctctcctagccacacagggtgatcctgctattagcagctttttctgggtgatttcactgcttatcaactctctgaccgaacctgtgccccagtttcttcatctacaaactgggaataatagtagcacctgccaccactttgacagcctggttgttacaggctcctagtgtatgggttctcttaaagaaatttgtggccagacgtggtggctcacgcctgtaatcccagcactttgggaggctgaggcaggcacatcacgaggtcaggagatcaagaccatcctaactaacacagagaaacccgtctctactaaaaatacaaaaaaaattagccgggtgtggtggcaggtgcctgtagtcccagcaacttaggtggctgaggcgggagaatggcgtgaacccgggaggcggagcttgcaatgagccaagatcgcaccactgtactccagcctgggcgacagagcgagactctgtctcaaaaaaaaaaaagaaatgtgttccctgttttcttttcctaaactgtgccagaggccagggcaggaagaatggggagagcctgtggctagggctttgctcctcccgggatctgggatctggtgaggggtcacactctcacccattcacaatctgagcacattgccttgggccctgcatgaggagaacagcagggctccctggccagaccccaagttctcccttcagtttcacaaagcagctgccacatgaatgacgttttacatattgttctctgctagttcatgggagtggacaaatttggtgactgtgaggggagggtccctttcagctgatgactttgggttgtgtttctcaatatctttactatgactgctgttggtgtgaggagatactttgattgggttggaaaaggctctgccttgcacagctgtgtctctgagcacattgctgtctctgaagttggtcagggcaagccactgggatttggggagcagaagtggacctgtcaatgaaagcagcattccaga

SEQ ID NO: 29887 - DNA, 1078 bp, Homo sapiens
gactataagttaatgagataacgttctgtggcttacaaactagttctgaagtaaattaatcccagaaaggggtctcagatccattttgaatagtttctctctgaaataaatgtatagacccatcaaggttatcaggtttgaaagagaagttgcattccaacaagcaaattctgttgtttgtggaaaataaacaatttattactgtctaatttgcaggttacaggctacatttagaataatgttttctcctcaaataatcataacattattccttacatttgtattttacagtttatgtagcaccttgcagtttaaaggcactttacagtttacaaacactgattcatctgtcattttgtggaattctcacaatagccccatgaagctatccctcatcgtaggtgacttctgagtgtctgaactgtgggctcacacttgagtggtacttttcctcctgtggtacaagtttccttggactttaagcctgttgattgtaaacatgtagaaaaataatgcaactagtcattctctctgatttatccacctcttattcaacacccagatactctgagaacttgctttctatcttgcttggatattaatacagttagacacacacacttgtgcttgcccactggtctatattttcaggactcttgtttcatgggccctactccctagcctgctacctttatcgaggagataaccttccagaaaggggaagagggaacaccagagataacctgagaggggaggagagctggtacctggccccacctcatgtgtaaatgaatgctccccagggaaccgcaccccttggtcattttcagccacctccatatccacatacatctcttctgataagaatctccacccttcagctaactcctccaggcagttcacagcagaaagcagaaagctacagccacctgggtggatcaggttaagttcagcaaccgcctaaccctacttgttttagattcagtcctgaggaagggagattagctctattggattagtgaagggacaatacaggtttagacttcttggatccactctggaactcactggtaatgat

SEQ ID NO: 29888 - DNA, 1052 bp, Homo sapiens
cacactcttccattagctcaggaattaatctctttgctgagtttgatgcttccatatcatgctgttgatttttctcaaatgtttgttattcttttttgtgtgctcatctatgcttgagattccttatttggatgcttttttccgtttgccattatctaattcaggtgctaaatcggggagaacagatattatgctaaatggggttgtcggtgatctcgtttttgggctgtgaagactctgtggagacaacccttcttgtgtttggctcttactgaagtattggcctatttttcttactcccacattcagtgctttaatctggatgtagttgttgtaaaccatgctgagaacaagtgggaatggggaagacccagctggcctaatggctccaaatgcatcctcccaattagtaaccctgatgaatgctccaaccccctccccaccatccccaacttaaatttcctgattctgtgcttagaaccactctaaactgcttacgctttttcaacaattttctcttgtacatgctttgattatggtttcctctgatttttttttttctatgcatttggtcagatcttctgtttttcaaatattccacaaaattctggtctggtcatttttttttcttgctttattactatttattctttatacatttatgtctttttataatctcatatgattttggatgggaaaaaattaaggatttgtttcatatttatttcactatcttaatttaatctgcacatttcaataataacttggtatgatggctagttttatgtgtgaacttgactgaaccatgagatgcccagatatttggtcaaacgttattttaggtgtgtctgtgaaggtgtttttggaggagattatcatttgaattggtccactgagcaaagcagattgcacctccccagtgtgggtgaccctcaccccaccagttgaaggcctgaatagaacaaaaaggctaaaccttttggtaatagggaacttctcctgactgactgcttgagctggaacattagtctttccctggctttggactcaaa

SEQ ID NO: 29889 - DNA, 1026 bp, Homo sapiens
gtcaagcttttaaaaaattaactgttctggaaggaaatcatctgaaatttgtttttcccttataaacaaaatgtatagaataccattttcttgaagacataatcattattattcattcatttatttatttatttttagatatggagtctcactctgtcgcccaggctggagtgcagtggtgcaatcatagctcactgtggccttgatctcctgggctcaagcgatcctccctcctcagcttccctagtagctgggactacaggtgtgcaccaccacacccaactaattctttctattttgtgtagagatggggcctcatgatgttgcccaggctggtcttgaactcctgggttcaagctgtcctcccgcttcagcctcccagagtgctgggatcacaggtgtgagccaccatacctggaaccacttttaatttgttatttttaactggatatgggcataggaattattattgcctggtttcttgtgcagagactcccatatgaataaagttcattgactgtggtgcatagacttggtgacatatatttcatctgctcaaagacatgttttactgtcttttttggaagatgtgttccaaatagatggggctgcttgggtttcattactatattatatagttttgaatacactgaggaattaattcccatactaccaaatgaaatagcagatgctgtggtgcagggccccaaattcccccttcaggactaaggccttctttgcccaagcagcacatattgactgctcaaagctcacagcttagtttctctgtgggagtctccgtcagccacagagagcttcccccaaggttatgtgccctccctgggtgcagctcatatccagtgatcagtcagtgtgggtattcaaaggcccagcctccctgccttgaccggagacaactttgaaaggccaccccagctccagaactttctgtgggaccagtggaggcctctgttgcaaccgtattgcttccctcactcctttccactcctttattcactgagagca

SEQ ID NO: 29890 - DNA, 1040 bp, Homo sapiens
gcagagcttgcagtgagccgagatcccgccactgcactccagcctgggcgacagagcgagactctgtctcaaaaaaaaaaaaaaaaaaaaaaaaaaaaagaaatgtaaaatagcaagcgagtagaggtttcccaaaatcagtgtgaacattgtgaaagttatatatatgtatagacacacacacacacacacacacagtaatagcctttgaatgaattcttttttcatcttttctgttgcattgtcctagaaatcccaaaggagaaagttaagtggttttgcctttgacagcggttacagattacatttttcttgtcactttctttgggacttcttttgtgaaacttgtggcatgtcctagaataatctttatcttaaagttttaaaaactttttagaaatttcatatcagtgttataaatatttattctgtatgcctccccagtttgggatgatttcatccttaatgataagccaagacaaacttcagctaacaatatttagtttatagatcttagaatgtgtttatgggtaaaagaacctcgatgtgatgataccttagagaatagatctactgagactgatgcgttttattttcatttttgtattttatttatttatttattgagacagggtctcactctgtcacccaggctggagtgcagtggtgccatcatggctcactgcagcctcaacttcttgggtttaagtgatcctcccacctcagcctcccaagtagctgggactacaggtgtgagccactacacccagctaatttttatattttttgtagaaacaggggttcgccgtattgccaggctggtcttgaactcgtaggcccaagcagtcctctggcctctgcctcccaaagtgctgggattataggtgtgagccacgcgcccagcctgaagctttttttaaatgaagatttattcaacaaatgtctattgagccacttatttgtgccacaagctgtttcagataaggaggataaagcaatgaacagacaaattccattcctccttgagtttacaattattg

SEQ ID NO: 29891 - DNA, 1013 bp, Homo sapiens
ttagaagaaaggataatgaggttgatgtgcctgctgtgccggggggataagagaaaggtgtcaggcaagaatagatgtataaaagcactagttacaactatactttgaaagtcatattttacctggaagaaatctcaaaaaacaaagactacatggcagttaagtgacccaaatcaagtcactttccctcttcaggcctcagttttcccatatgttagacaggttaaattaggtgagacaaactgatcttttaggaccattctataatactgtgcttaactttctaagcattctggaatggagcagccttgatcttttcacagatacgtcaaccatatagctttatttataaaacgaacatgttgagataactaaaattagagttaatatcttcataggtacaaagaaacttttagaacttaagtccacaagtcagaatttctggatgaattcctttttcctcttattaaaaattgttaagatgtctgattagactagttgtaaattcccttgaaagcaaggatgatatcctgctctctactgtgtcctcagcatcaaggacagtgcctaacacagaacaactaccaatgaatatttatgaaatgaatgaaagtttgaattgcaaaattaaatgccaccaataaagaggctttgtgagcgagcgtggtggctcaagcctgtaattccagcactttgggaggctgaggcgggcggatcacttgagctcaggaggtcaagaccagcctggccaatatggtgagaccccgtctctactaaaaatacaaaacattgtctgggcgcagtggctcacacctgtaatcccaacactgggaggctgaggtgggcagatcgcctgaggtcaggagttcaagaccagcctggccaacatggtaaaaccccgtctctactaaagatacaaaaattagccaggtgtggtggcaggcacctataatcctagctacttgggaggctgaggcaggagaatcacttcaacccaagaggcggaggttgca

SEQ ID NO: 29892 - DNA, 1030 bp, Homo sapiens
ataaaatcatacatataatctaaaatatgaattcttatacattttatgtcattaaaattaaggtaaaattgaaaacagagttaaaaacttttcctcagaaatcggaaacaatctaaatgtccatcagctgaatggatagacaaaatgtgctgtatcaatacacagcctaatctaggcagttcagcagtaaacaggcatgaactgctgacacatgccacaacctgaacctccagactcaacctcggaacctccaaaacattatgctaagtgaaaaaaaaccaaacacatgagaccatatatcatatgattccatttatctgaaatgtctaataaaagaagcaaatctatagaggcagaaaagtataatagattaacagttgtctgggattgggggtagtaattggcgtttgattgtaaatcagcatgacagatcttactaggtgatgaaaatgttctaaaactgatttatggtgatggttgcaaagcttggtaaatttactaaaattcgttgaattgcacattcaaaatggtgaactttatgctatgtaaaatatgcatcaataacgctgttttaaaagctttttatgaagacttctagatctcctaagaatatttaggtatcagatattttcgcccttgacccttccaaggtcagaagacacagctgaaaaaatacttttagtggaaccaaagaatggatccagtaactacagtatcgtggattctagctttgactttgtcactgactgtacttgggcaaggcctgggcaagtcacttaacctctttttgctttggtttccccatctgtaaagagggtgttagtttaaatgttctccaggatttcttgcacacatgagagtcgcatcctcacatttctgttatctgtgaatctctacctcctaatgattccccctccctcaaatactctaacaaagcccctttattcagcatggcatatgtggcatattgcttgtctgactaattcttgctcacgcaagcttcctgaccttactgcataggtctttcagg

SEQ ID NO: 29893 - DNA, 1073 bp, Homo sapiens
aagagaacaaattaaacaagcagtcttcctttcttgtaggaactgtatttcagggtaattacatggctttagttgctgaaggaaagatcttccttatagaaaaatgcctgctgtctgggtacagtggctcatgcctgtaatcccagaactttgggaggccaaggtggacagatcacttgatcccagaaattcaacaccagccttggcaacatggtgaaaccccatctctacaaaaacatacaaaagttagttgggcattgtggcacgcgcctgtggtctcagctactcaggaggctgaggtaggaggatcgcttgagcctgggagtcagaggttgcggtgagctatgatcgcgctgctgcactccagcctgggtaacagagcaagaccctgtctcaaaaaaagaaaaaaaatttcctactaataaatgtggaaagagtggtggaattagaaaaacatttcataaactccaagtattgattcaggaaaagatgataaagtttgttacacctttaggtgaatgattaatgaaactgaacatccttgtaataccaaagtaacattgcactgatgactgtctaattgaaggagaaaaagtaactgtacaatggagagatgagacatatcaccattctaacttagtggtagattttaccatggctgatggtcagtcatatattttgccttctgatgtgatggaataggaagtacacatcccctatggtatattcaagcctaaaatgtttaacttgaatccagaaatccttggatatagtgtccagtttataagaaacacaggggatggagaatcaagctaaatgatacaacaagaaaacaaccagacaaattcagaggttgagacattctatctgataactggcctgacctcttcaattagtcagtggccttaaaattaaggggaaggagtagtcatgctagatttaaaacagcttaggaacatacagccaaatgcatttcatcatactggattagattagggttggagcaaaccaactataaagaacatttggggtcagctggggaaatgtgactatgggctgggtattgtttgaaa

SEQ ID NO: 29894 - DNA, 1026 bp, Homo sapiens
atagttttgtactttacatttagatctatgttccattttgagttaatttttatgaagagaataagctctgtgtctaaattattattattattattgttattattatatttttttgcatgtggatgtccagttgctccagtcccagttgttgaaaagactgtctttgctccagtgtattaccctggtttcttcatcaaagatcagctgactacatttatgtggtcctatttctgggctctgtattctgttcctttgatctatttgtctattcttttgccagtaccgtactatcttaattactttaactttctagtaaggcttgaagtcaggtaatgtcagtccttcgactttattcttcttctttaatattgagttggctattacgggtcttttgcttctccatataaactgcagaaccagtttgccaatatccacaaaataacttgctgggattgttattgtgattgcattgaatctatagatcaagttgggatgaatgacatcttgacaatactgagtcttcctatccatgagcatgcagtgtctctccatttatttcattctttgatatctttcatcagagttttgtagttttcctatataggtttcatatatattttattaaatttatacttaagtattttacttttcggggtgctaatgtaaaacaaaacagacattatgaggaaaatgtaatgtctgtttgggggtaatgtgtttttaatattaaatttcgcttgttcattgctggtatataggaaagcattatgacttttgtatattaaccttgtatcctgcaaccttgctataatcacttactaggtccaggagattttttttttttctgttcttttggatttttttatgtagaagtcatgtcatttgcaaacaaagacagttttatttttaccttcccaatctgtatcccttttatttccttttcttgtcttgttacgttagctaagacttctagtatgatgttgaaaagcagtagtgagagaagatatccttgccttattcctaatc

SEQ ID NO: 29895 - DNA, 1033 bp, Homo sapiens
gcgtgctaccacacccggccaatttttgtatttttagtagagatgaggtttcaccatgttggccaggctggtctcgaactcctgacctcaggtgatcctcctgcctccgcctcccaaagtgctgggattacaggtgtgagccactgtgcctggcctgtataccttaagtttaaaaatttttgtctattatactcaataaagctggacaaaattttaaataaataacagcagtcattaacagactcaattgatgacctaatgtagaagttaatgagagcaggcctgttggcaaaaaggcatttatatggatacactgtatgtatctgcactgtttcaggatcctctattatgatacctgggtaaagggtgacttcctttctatcataaaacagcctagacagcactaagaaggtggttatgttcttttctgttgttgtgagcgcccagatgagattactttgccaaagactcttttcatttctctttctgaaactctgtgagattgctgtgttctctaggacttaacttcacagctagtctatttttcctttcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtatgatgtttattttcacttttcagactactaggactagaattggactcatctctcagtaaccctgtaataaataatgctccagagactagaaatctaatagagaaggcattcaccattcatttattcacccatttatccatgaaatattaggtatctatgaaatgccaggaagggagctggcacgaggtcaatcttgccttccccgccccctccttccttcctctcttctttcctttcttgcttacttc

SEQ ID NO: 29896 - DNA, 1059 bp, Homo sapiens
caccttggtctcccaaagcgctgggattataggcataagccaccacgcacaatctaaacattactttcattagcctctcatgagtagaagaaagttttactttcatctctctgtataaaaattgtttttaagtggcaagttttcctattgaagtggactttaggtgagctttttgtatgtactctacagtgtatcctctgtgaaaaacccgtcgggggatagtggtaaactgtatataactgcacaatgtattataaagagcacgatccctttgtcatcttttgttgtccagttgaaaggagaatgtttctgaaatcaggtgcatagtgcagtagtcataagaatagcaaacatttatttaatacttgctgtgtgccaggcagtgttctaagcacttcatgcatatttattcaatcctcacaacaattcagggaagtaaggaccattttacaaatgaggaaaccaaagcactgagaggttttctcatttgcgcaaggttacgtggctagcaaaagatggagacaggattgtgagccaggcatgctggctcagactctacactctctaccatcacatcatgcggaataccggcctttaaatgcctagggtgcaaatagatcacagtatggcatagtttacctttggagctgtgaagtccagggtcaagtcgtgattcactttaaaataactacttgatattgtgggtttttgttgttgttgttgtttgttttttgtttttttgtttttgaggcgaagtctcactcttgttgcccaggctggagtgcaatggcacaatctcggctcactgcaatctccacctcccgggttcaagggattctcctgtctcagcctcccgagtagctgggattacaggcacatgccaccacactcggctaatttttgtatttttagtagagacggggtttcatcatattggtcaggctggtctcgaactcctgacctcaggtgatccgcctgcctcggcctcccaaagtgctgggattataagcatgagccaccatgcccggccgacgttatgtttaatagaacaaaaatata

SEQ ID NO: 29897 - DNA, 1027 bp, Homo sapiens
gcagcatcatgccagccaccctagcaaactcccaaaacctacccagcagccaaagccaagcgtaaagctcagtgaagctgacaagccccaggacactctggtggatgttttgcccccttgagtgtttgctgttttgtgaagaaaaagtgtaggagagttccagctggaactctgcagcaggcaaaagctctttttgttaattcaaaacagtttggaatccatttcagttcttcctaaacctccaagatacgggggaggaaattcactggattttacaatatatttttcaaggcaaattgccatcgccgtcctaatgacagagaagctgccgatatcactacaacggctgcagatggcaagtcatccagcctcctcctgtgccctcctgagtctggcttggtgacgcaaaccacctcaagggcagctccttctttttccagcagtcccagcactgttccttctctgtgaagccactttggatggctattcttggcatgatcatagacttttctgctgttgagtgggcaaggagaatagggtagaagcaggggaattgttctcattgctatgcatttatagatcaaagaggagcagatattttatgttaattggataacacctagttctatcaggtcagtaacctggggtccctggggctcccccatgggtcataccagatagatagattttttaaaaatttgttggaattaaagtagaatcaaagcctagtgctagcccagaataagttattcaataaatgcttgttgagtgaataatcatccgaaatgattataatactgcctaccattcgttgaaagcttcagtatgtgggagaatctgtcctgggcactttatatacacccataatctgtttggatttcttggtaggaagactacatggctgcatacatggtctttcattacctccattttatagatggagaaaatggaaatttaaagaggttaagcagtttgccgaaggtcacagagctactaatcggtgaggtcaaggttcagacccaggtct

SEQ ID NO: 29898 - DNA, 1067 bp, Homo sapiens
cccctggtcctgacaaaaaggtggggagcaaaccgcatggctggacgtaaattgagtgacctggaatgactagaacgacagggggcctctaaccccagggtgcacagaggtagggacccaagggctttccggggtcggacagaaatctcgggttccattttcactctgagagacccagaaatgacagagcccatgctcagtttccactggtggtgctgttgagtggaggggctttgaacatggcacacaggaaagggttgcccaccctgtcaccagatgggcttgcactgttttgtggtttgggagttgcatattggaggtgggagtggagtgttgagatgaggcaagttgagatgtaatcgctatttaatgggcagatcaaagaaaacattggctggtttgatttttattatggttatcccgctccaccatcctggcccagtcatatatattattgttatcaggcatagataggggaagcaattaaatgtgaaactgttatttaaaccggcaagtgtcagaatgttaacccacttcagagcgaaggctctaccagcaacatgtgtgttcactgcagaatgtgctggttacagatgatctttatctgtttgtcaaagcatttgcaagatctctattttatgtcatcccctttccctgaaagcagcagcagtaaacgacattgctcctcaaatcatccatggctcagacctctgattaatttaagctggccctgctagcgttcttataaatccccagcaagatgcaggcccaggagtggaaaggggaaaacatccggaaagcagcggggggcagggagggggaaggctgaagggaaaagaaaaaggctgaagggagcaataattgaggaagaaagaataggaaaaatgtagaaaggacccaagaaaatcagagaaatgagaggaaaagaaaggtaagaagaaaatgaggcaagtttacagagcagtaatgaaaatagtaatagctaatttactgtacaacagacactgtgctaagcactttccgtatgtccctcagtcctctgaccaacactatgagttaaattaccg

SEQ ID NO: 29899 - DNA, 1032 bp, Homo sapiens
aggatgaactttttttcatacgcttattagtcatttgaattgcttcttctgtgaattgtctgttcccaatttactaatttacagagagaaatgtaactgccaaagggaccggatacacgtgtcctccagccaacacgtcagctccctgcaggcacactccgcagaaagccaagttcaaatcaaaatggtgcttggtgagcacagaatgagaagggaggggtcagttatgggactccagtgtttagcagcatcggggcgagctagacctaccacgaggctcccccaaatccttggcctgggtcctctttttcctcctcttccctctgcctccctggctacccaagctttcttcagaaggacatgtatatgttttctttagaaactccactgcatccatttagggctgtctctggcctagtttccctctgggttgtatacttgaactctcagagggcaatcttcattccttttttaatatgtatttttttgagacagggtcttgatctctcacccaggctcttgatttctcacccaggctggagttcagtggtaccatcatcacggctcactgcaggcttgacctcgcaggctcaagcaaccctcccacctcaccctcccaagtagctgggactacaggcctgcaccaccacgcccagctaatttttgtattttttttagagatgaggttttgctgtgttgcccaggcaggtcttgaactcctaggctcaagtgatccgcccacttcagcctcccaaagtgctgggattacaggcatgagccaatgcgcccaacggcaatcttcattcctaatcccttgcctccttcgactgcctacccaggggtttgcaaggggtaactcacacgttttggggtgtctgcctccctggttgtctgggaattgtccccttccctcctccaaagcaactccagggggtctgccaaactccacaatgcagtccatatttggagcatttatatacttgagcatttttctggagtgagaatcaagcctctccctagaccctcatagga

SEQ ID NO: 29900 - DNA, 1021 bp, Homo sapiens
ttctttttcatggttatctttgtaattgatgtatcatttcctctaactcctctttagtctgtgtttttctgtgtcctcatataattcctcagcttcttccttgagaagttggatactgatatcatcacacgttggataagccttttcttaatggtcatgacactcttaaagccactcaccttcccctccctcagttttggccaccttcttgactgtttcaggcttgatggcatcccttgccaatgggatgcaagtactgagtgcaggagccacctaagtaattagtcttattttttcccttgtgaggattcggagtcatgtaggttaaacgtgtgtatgatttggccgcactgtatcttcaagcaccaggtaagctctcagttgaaatcaagtctagacctagtactgggggagcagcagattcaagtttcccatctcattccaggacagctgctcctcgagtggaatgtcttgcaccatttacattgttttcccatgtatatggttacgttttcctaggttaagtgcatctactgtatctctgtgtctgcatcacacaatatgttcacatttacttccctcctttagacattagtggataacagccagttccgttagctccaacctgctttctgtgcttccagctatgttatatacttgttttgtctccttggatccaatgtatggccccagagggacacgtactggctttggctttctgttctccctcatggtgctgggtgcacagtgggtaattccgttactgctcaataacccttcaccgtctgattttgagaaagagtcatcagacaaaagtagatagaccctgcctgtgctttcagcagaatctagagagagggcatgggcttgggagttcaacagacctgggtcacccgatgccaccacactcggggtcgtctacaaatctctctaacctgaatctgtttcctatttgtaaaatggtgttgctactgctcaccctgtaatactaattatagctgatacatgaatggtacacgct

SEQ ID NO: 29901 - DNA, 1259 bp, Homo sapiens
tgtttccagaattagaatttgtaatagccatgacatgtatgtgtgtggttctcccttgctgattctctttaatttataaatgttttagaatatttatctaaggaattctcatggtaattacttaagaaccaataccagcatgttaaaacataattagaaaggatcttttaaaggttttattgtaagaaaatatacagattaaaactgcactgagataacatgtcaacaatcaggcagaaatccaaaagtctgacaatatactgcattggtgaggacttcagaaacagaccttctcttgcattgctggtggggtgcttgtggtaccaccctcatggaggtgaatttggcaatgtctagcaaaattacctatgcatttactttgttttcttttcccccattcctctctttcctcagtccctggtaacctttatatgttttctgtctatgaatttacctattatagatatttcatatataaataacaatcatacaatatttgcccttttgtgtctgttgctttcacttagcatattttcgaggtttgtccctgccatagtgtctatcagaacttcattccgttttatagtggaataatattccattgtttggacatagtgcctttagctcatctgctgatggacacttagattgtttctgtattttggcttttctgaataatactgttgtgaatatttgcatacacgtatctgagtctatttttagttgttttggatatatacccaggagtagaattaatgggtcatatgataattgtctgtttaacattttaagaactagctaaactattttccacattgaccgcatcattgtacattcccaccagcaatgcaccaaaggttccaatttctctacatccttgccaacacttgtttaaaaaaataatagtcggccaggcgcggtagctcacgcctgtaatcccagcactttgggaggccgaggcgggcagatcatgaggtcaggagttcgagactagcctgaccaagatggtgaaaccccatctctactaaaaatacaaaaattagccgggcatggtgctgtgcacctgtaatcccagctactcaggaggctgaggcaggagaatcacttgaacccgagaggcagaggttgcagtgagccgagattgcaccactgcactccagcctgggcgacagagcaagactccgtttctaaataaataaataaataacagagcaagactccatttctaaataaataaataaaataaaatagtcatccta

SEQ ID NO: 29902 - DNA, 1088 bp, Homo sapiens
actcaatggcttaaaacaacagaaatttattgtcatggttttggacaccagaattccaaactcaaggtgtcagcagggccacagtccctcggaaggctctgggggagcatccttccttgcctgccttcactgctggctcctggcaccccttggcattccttggcttgcagatgcatcactctaatctctgcctctgtggtcatgtggcattctcccttgtgtgtttctgtgtgtctttgtccaaattttcctcttttttttttttgcattaaaaaaattgatacataatagatgtatgtattttcggggtatgggtacatgtgatattttgcctcttttaaggacaccagtcactatgtccttagatcaaattgattccatctgcaaagaccctgtttccagataaagtcatattcgcaggtactggggtgcgtaatctgggaggtgtatgttgtcctactattccttagtcaaggccccgcagttacagagttgcactgagaagtgaaagcgataaactattcactaataagcaggcctggcatgaactcaatctgcattcagatatatctctcttccttcctcagcgctcttgatatactttattgtgttatcaccttagttgattttttccttcaattctcctctagtctaactgccagattctcattttttaatccctttgccatactttgatcactttcatagacttcatgaatcctgcatcttttttgcaagatttaaatgttcaatttgccgtcaatttgcattgaatttacattaacataacaaaggacaaagtgacataaacgacacatagtgacagtgcaggaatgttgcttgaagggggtatgcttgtggggattaattttttataagaaattttcagattacagctcatttccccgtgtgaacctaaggatgtttaaagatgttaccagcacagttctatcagcaagctacatacgtcccccaaccaaaaccaatacttgatttattatttgttcacaacacttggaatcacaatctaaattttgctaaatataagaaaaattgatgcatgttcatatttttagattaatttttca

SEQ ID NO: 29903 - DNA, 1535 bp, Homo sapiens
ttcactatgtgtcaggcattgggtaggtgctggggacccaagagcgaggaaaagacctagtccctgttcttgaaggatttacagtctagtgagagaggaagagaagtgaacagttgtgctgtcctgtagtagtcggtgttgtgatagagataccatcaccattatagccaacaggtgctgactgctctggcagtgccattcccagtctctgagcttgcctgcattacctcctttcatcttctcaagaaaccttcgagggtaggtactagagatgtttctgtttcgtagatggggactcaggggaggcttcagtagcttgcccaagattacgtgggctcagcgccagagcctgggagacattgatatgggtgtgcacaccagcactccctgagcaccttccagtgctaagtatcgtgccagtgatgggcctgtgtgtcatctcaggtcctcacatcactgccatgaggtgggtcctgttcttatccatcttccacaattggaagaactgaacacagggaagtgaagctccttgctcagggtcagtatgtggacttaggcactgtggccccagaacctatgtgcgctaaccactctaaaccactctgctgtgcacttccagtgataaaggggcattcatcagtacaacaatagggaacggtgccctgtgcaaatgggagaggtgtgtgttcaagggtgcagaaacatgagaagccttggcgtgttctgatgggcacgtcctgtgtccttgcggtcctggatggtgctgctttccccagtcctgtcactgcttccagtcgtggctgctgcctcatccttctgccacgctcccccttaacactttctgcattttacttctcatttctcttcctgcaactgctccagcatctgggattgatggcaacaggacttggctttttaaggtgttgccagccagctagaggacgccttcagctctgacccatgtgtcgttgtcttagtcatttgtttgtgtggctcttttcatcatatctgacttggaggctttcttctacatgctcttcgagcctcagtctcctttgacttttcatagcgatcctctgagaccctgaaaagggaacacaggtatggcctggttctggtatgtgacagaaggcacagaggtagaagtgctaagtggcttagctcagagccacacggaagagccaactccaggacctagacctccagaggctgcgttcatccctgcactgctgcctctgctctcaacagcaaattaagacatttccattcattaacatctttttcaagataccatatattgagtctgatttatttttcaagccactcctaaaaactccacaatgatatagtagtattgattgaacacttcttatgggctatgcactttacgtgtcttatttaattcttgctgcaaccccaggaggtaggtgcagttatccctggtttgtagatggtcactgagccttagagaggtggggtcatatagctggtatgagaacgtgatggagcaaggattggaacccacgtctgctttg

SEQ ID NO: 29904 - DNA, 1077 bp, Homo sapiens
cattgtgttataattgtctacagattcagcacagtcacgtgctgaacaggtttgtagcctaggagcaataagtgatatcacatagcctatgtgtgtggtgggctgtaccatctaggttttgtgtaagtacactctaccatgtttacacaacaacgaaattgcctaaggactcatatcttagaacgtatcctcatcattaagccacacagactgtaattgttactagcataggtaactttgtgatgcttactgtatgccatacaccgtgctaatacttctgccttcaccataatccccatttttataaggaaattgacataaagagttgtcccatggtcttggcactgctgacttgaccttgggtccatctgctgccagtgttcttgcttaaactaagctgtgctgtgtcggagcccatcatcagaaattacttgccttgtgggtgtgagctactttgaagctgtgtaatgctccaggtgcatattggattaaagatgtgtgtttgattacaggtaatgtcatttgaggactagaaaagatctcaatttcccctgatgtcttcattttaggattttggaaacggaggctcagggaagttaataacttgcctaaaggcacacaacttgaagaggcaaagattgggcagggaacaaaactcccaagttcacttttgttccagtacatggtttctttccagtacactccatctcaaaaagttgaaaattgtatgtttggatatttacttacatttgtgcctcagtgaatttgagctgacttgttgagtactttaaatacaacttaaataggaaatacagaaaggaaatgtgaccatggaaaatacagacgcaaaacaagactaagtgaagggttactgtgtcgtccttggggccctatatggttactaaagtcatgctacaaatttggctctgagcttcctgagccaaaaagaaacatgattagttacaggattgatgtgtccaaaaaggaaaattctatccattcctcaagggaaacaaaacttttccttgaacttttcttttttttttttctttttttttttttttgagacggagtctc

SEQ ID NO: 29905 - DNA, 1030 bp, Homo sapiens
ttttcattaatattttctcaatagcaatttaggggaatttagaatcagatgatgcaaatttcattttctgtatatttgttcttggtaggacaaatattctttttaaacagatttatttcatgattacttttaacatgctttttctgtattttccagttattctgtcattatcgagctagttgatgaccattttgaaggctctctccgcaggcctctcagttggaagtccctggctgccttgagcagagtttccgttaatgtctctaaggtaacacaacatcagctttgccattggagtgtcacttaaatggttcagtttttttttttttcttaaatgtagtagaatcaaaaaagttagttgtagaaacttcataacattcctgccagtgacatgctggaagatttggggtcattcgtacccttcccttattgcgctagaagttgtcctcccctcatgttacattttattgtcccctccctcccaactgctgctgagctccaatgacggagctttggagtgtcccatggtgatctgatctgggtaggcattgcttctcttcccaggggtatcgttgctatgtgacttgttttatactgcaatttaacattcactcatacacatattcacaaaggagtcaaaacattgaaagtttgcagatctcttagagaggaagggacttgatatttgttgctaagcactttcccaccctgttgttatcctcatcctgaggatgagaaaccaaggttggagccgttgagtggctaatccaagatcacacagctcatgtgcatactcgggatccaaacccacagctctctggctccctggcttttgtttcactatatccttcgtgttgccatcagagataggagggactcagcttacacaaggactatcaagaaagaaagctgtgtgtgttctcattactcagtgatttgctggctgaaaacaaattgtagataccctctaatttcatcctcatgctgctggaggtgaggtggggctgaggccagagggtcttgcagggct

SEQ ID NO: 29906 - DNA, 1787 bp, Homo sapiens
attaaagttcaggtgggtaaactcagagaaattcatgtcatcccaaagattctgtgaatcatagtgtatctggaacatgtggtcccaagaaaatacatgaatacagttttgccttggtaacagagccttctcaggcaggctcttaagtctctcaccttttccccattgaacccattggacacgaaatctatgctgacttcctctattccttaattccccactttattacctgtgatgtccccatcactcagctgaaactgctctcttacaggtggcctgtgaccccctggccaggccaggacttctcacaggtctcattcccagagaccagaggtgtccctgttgacttgttcctgcttctgggcttctgtattgaaccaaggcgcctcctgtcatcttggcttgtttctctctggtctggccgagttgtctagtgtgtgtccgtgtttctgcattccctccctctgtgtgtagagccttaacgttgccattggctcctcccaacatccagtatgtctttgttgtcgtcctgtcttcttttcacaccaccctgcccctgcagacctgctggtcggtctccagggccccagcacgtcttcccttcagttggtcccacttatctccactaggctagtttctcataaaatgctcatcaacctcatttctcccttctcagtagctggccccgttacagcaatgccatcacagacctagctctaatgtaaaatgctagctttcatcccgcccacctgtttctgaaatgtgctagtagaataccacagcagaggcaagcttagctgttaaaatctttgcctggtgaaagtagatactgtatgcttgtaaggtttatattgttacattcattttctccagatgtttctgttctaaaggtgggaacagtatcatcattatatagaccgccctttgtgaaatgtagctgtggtgtcagctgtggtgtcagaatggtcttacatttctgttttaagaaatggtctttttttttattggttgtaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattggtgagaaagtcatgaagacttaagttgcctcagggcatctggtggcaagaggagggagatgggtggctgggcatggtggcccatacctataatcccagcacttgggaggccttgggaggccaagg

SEQ ID NO: 29907 - DNA, 1030 bp, Homo sapiens
gtcctcttgaccactgcagtgtggcccaggggttaagggcacagctttcatggtcaaaccctggtttgaaccccagttttgccactgtatgactttggacatttcctcaatttcccttttcatctataaaagaagcataatgttaagacccacctcagaggatggtcttgaggattgacaaggaagaataagtgtttcttctggtggggagtcctttatgaatactcattaaatgcagctgccgttactactaataatgagtaaagaattagactagagaagctgaatcctagtataaaatgtgaagaaatgggggcaaattggaattctttcatctttaccctctggggttttgttgatttcttgaacaccatggaatactagtcatagttctgcttaaaatggtatcaaattctgggtgggcagttttgtgtttgaaggaaagtacctgagcttgtaaatgcaaatgtcgctatgccatgcattctttcccattgacgttaactgtgctgaaacatggactaaatgcctatttggaaacaagctttaaggatctgtagcaagttttctgaatatctttattactaatgttaaaggataaaacacattaaagtttatttgagcaaacagccattcgtgaatcaagccgcaccaaaactgaagtggttcgggctcccgaaagagggtgtgaagggaggcttttagagggtgtgtgaggaggcacaggagagaagttggttggttaaagtttgagcagttgtcttatttaggttatcccagtggcaagtatctgattgtgtaactaacgctcagttggccatttaggattggctgatctgaagtttcatttagtttaatttggaactgggtgttggatccatctcggtgtaatggcttccccctaagttattttaacacgaggcggttattggtacctttaagatgggtttcatttttggaaattagacatcagttagtaccaaggctggggaataagattaagtgaagtagtacatcacatttggtcaaa

SEQ ID NO: 29908 - DNA, 1027 bp, Homo sapiens
gtcggctgagcataggattggaagtcagagggcctggttccaaattctgcttcagacacaagatgggaggtcttgggcaagtcaatctcactggacatctatttcttcctcttttaaaaaccaataaaaaatgtacaggtttgtgaggctcctcactgagaaaacgttaaagagctttcaaatattttgtattgttagtgataatttgccataaagtcaaatatttctcatttgtgggcaatgcctacctcatggtgcagtacaagaacccagtgaacaatggaatcacttattagatgttgccataatcaaatctccacaaatactgctttccttttgctgggtagtaggggttttttaagctacaaaactgcacttaccatttgtgttagttattccaacatgaagatcagaccttccatcatactctctgaaagaaacaaggtttgtttttttttggtttgcatgtatttggcatgaagaattggcatttaaagtaggaggatgccgagcacagtggcttagacctgtaatcccagcactttgggaggccaaggcgggcagatcacttgaggccaggagtttgagaccagcctggccaacatggcaagaccccatctctactaaaaatacaaaaattagccaggtgtgttagtgtgcatctgtgatcccagctactcgggaggttgaggcacaagaatagcttgaacccgggaggtggagattgcagtgagccatgatcgcaccactgcactccaccctgggggatagaacgagagtctgtccaagaaaataaatagagccagctggatgcagtggctcacgcctgtaatctcagcactttgggaggctgaggtgggaggatcttttgaggccaggagttcgagaccagcctggaaaacattgcgaaacctcgtctctactaaaaaataaaatacaaaaattagctgggcatggtggagggcacctgtaatcccagctactcggatgactgagacacgagaatcgcttgaacctgggaggcgga

SEQ ID NO: 29909 - DNA, 1095 bp, Homo sapiens
attacaggcgtgagccaccgtgcctggcctaattttcattttttaaaactacttttcagccttattcttatgaatatatagttataaaattgtacacaattccggaaacttgttcatgcttttgtagcaaagagccgatcttttctttctagactgcaaagcttccttccctcctttttctctgcagtgcagtgggagatgatggaagtaggcccacgttggtcttcccctgtcaatgagtgccaagagagacagtcagggagagatcattggcccttgtcagcattttggggactcctgctcaaaagaatactgggtcagtcaggcatcaggagattttagctcaacatctgtttggaactttcaggttctctgtgtggtctggtgctgtgtgtctgtcccactcaagtcccacagagacacttaagcataggtgatagatagcaaatgtccccctcacaatgaattgccaagcatctgttaataatcgataatcctgttagagtttaaatattggaaaagatggccgccttcttcacctcaacaagtgcagcagaaggagggccattggcatctggggagtgtgggagatgtgtgtgggtggcatgtctgtaatgcatctgctgtgtgttttgtttagatatgaccacacgaggccctctgctgcagctggaggtgctgtgggcaccatggcccacagtgtgccctccccagctttccacagtcctcaccctccttccgaggtcactgcatccattgtgaaaactaactcacatgaacccggaaagcgtgaaaagagaacattggttcttagagaccgaagtgagtaagcggaagccttttgttgcgtctttttgcatagcactcttgttaatgcttggtgctcctttctagcctcctcttgtcaagaggactcctaacctaatacacctccagattgtctgcgcggagagacttcagaactgttctgaagaggctccatgtggctgcagatcattcaaatgatacattcgccctcgtgcccaaggctgggttgagctccaagactggcctggtaaaacataaaaacacaatctttttgtcaacatgtaactt

SEQ ID NO: 29910 - DNA, 1080 bp, Homo sapiens
tgggtatccatgtgccacggtggttttctgcacctctcaacccatcacctaggttttcagccatgcatgcattagctgtttgtgctgatgttctccctccccttgcccctgcaccgacaggccccggtgtgtgatgttcccccacatgtgtccatgtgttctcattgggaaaccctattttgttaatagtaaataaggttcttggatgattgtgatttcatcttttggaatttctggtgaaggaaatgcctgtagtggtgaggcagttgagcaagaggtttagcagagagtgtgcccaggcttcgtaacatgacttctcccttagtaatctaattcttatttcaggtcttgtccagaatgccgtgtgatatcagagtttgtaattccaagtgtgtattgggtggaagatcagaataaaaagaacgagttgattgaagctttcaaacaggggatggggtaagtgcttttgagtttcgacgtgcccctgctgcctgcctggctctgctgtcagcccgtgtcctcgttctccttcccaggagtgtggtcttaggggcctcttcctctcttccttctctcaggcaccatgctgggctctgggatgcagcaatgagcaaggacatggtgatgtggacctgtttagttttggtgttttttttttttttttttttttttcggtgagatagggtctcactctgttgcccaggctggagtgcagtggtgcaatctcagctcactgcagcctcagcctcctgggctcaagcaggagcctcttgagtagctggggccaccagtagtgtgcgccaccatgcccagctaattggctaattttttttggtagagacaaggtttcgccatgtagcccaggctggtcttgaactcctaggctcaagtgatcctcctgcctcggcctcccaaagtgctgggattacaggcatgagccaccgtgcccggcctcaaatgttcctctttatcctggttgtcagcatgttgatattttgcctaggagtggagtggtttttctctacgcttatgtcactccccaagatgagcgaaattttagctattgtttcattaactttt

SEQ ID NO: 29911 - DNA, 1050 bp, Homo sapiens
agaatgctctcattagctgtgtctcaaagacacaggatgtaccctgccccccaccatcttgtagaggacctgggtcccctccctataaaacaaaacaaaacactcccaccttatattgccatctttacgaaccaacccatgctttaatcacattctagcagccctgagccttacctggggaaaaagaggcctctcttcctttactttcttcacacagtcagctaccagcctcttcattgctttggggcagttcttatatagcttactaagatctggggaggcatatcctcggcccaccatgaagatgatctaagggaaagaaaacagctgagctaatggggggtgaatgaacaacagataataacaagtcctaaccctctagctgcttaggctggcggaggcccaggggctcccacgagttgggtcctttcgcaccagcacagacttacctgatctcggttgttgatgtgagaataaggaagctcccccgtcatcagttcatacaatacgatgccataggagtagacatccgactggaaactgaatgggttgttatcctgcattcggatcacctctggggcctacatgtatcaccatatgacaaaagtgcatttatcaccatatgacaggcctcacagacatctaggggccaggctgtccctttcattagttatgaatgagtccattcttcagtccccacatagcttttcccccaaaggactccaactcaggcactggttaaaacagctcaggaatccttgtctttaaaggaccaagacccagcatttctgtcacccagcttattaactcctctccacactaagcttcacagtggttctgatcaacagcttcctcaagaaaatctacaattgccctgaggctggctgtcactaggggtcatgtggatttcggggaaatgtacagaaacgctttaagtttgcacataaatctccaaggcattccttttgccctataccagagactgctggtgggagcccagattctcaccatccagaggacagagccagtaggttgttcaacctgctgaga

SEQ ID NO: 29912 - DNA, 1050 bp, Homo sapiens
tgtactcaagctgatttgaatggcaaagaacctctgtggggaaactagccagtgcaaaagcccagaggtggagttaggaaatagctggtgagacagaagcctcaggagacctcgcagcagggatttatgttggggaagatgatggggcagagaggaagccaaagaccagtgaggaggcagtggtgtgggccaggctcaataaaggatggctgcttctgctgtttcctactttaggtcaaagctggttctgtgaagcaggagtttgaaaagcaagatgaactgaagcgctctgcaatgagggcagtggctgccctgctgaccatccccgaggtggggaaaagccccatcatggccgacttctcttcccaaatcagatccaaccctgaacttgctgccctctttgaaagcatccagaaggattccgcttcagcccccagcacagactcaatggagctcagctagtcccctcagcaccaaggtgggccctcgcttaagagaaaggagcccacccaagtccgaggcctccccatcccaccatcgcaggtctctacttttgcccttccaccatctcactgggggccctgtcgctcctggtcagggcttacagtgccttctccagggacccaactcaaaggcccccagcccaagctgtgaggctgccaacagttgggccccttccttaactcaggacagtcatccaaagaaatagggtgaggaagttttccagtgacttcacactgtacccctccatagtctgtctggttccttcagagggtgtctctgcctcacaaactagtagtatttagaaataggctgtgctgtcagctgtaaaagatcaggaggcagcagacaccactctggtttcttcactgcattcagcaatgcctgaagttagtgctcaggccgggcatctcaaaagaaaagatacttgagttattcacattttaaaattcaaaacggttcatttttaagtggcagtgatgaatcagaaatttggaagatgatacgggtttcttttttccagggaggaggaatgggttgggtagggaa

SEQ ID NO: 29913 - DNA, 1034 bp, Homo sapiens
gaatcctccccatagctccaaattaactgttctcaccctgaattatagacaaggggcctatgctggagcagggagggggcttgtttgggttgctcagccaggctggaactgaatccagatctgacacttgctcctcttccatgttgcttagaagggttgcctgtggtggaagggagttattccagcctcccacagagccaggggactagagagggtcaggatctgctgtatagccacatattaagttgtaggaagaagggcatggctggcaaagggagtagggagtggaaagaatgatggtgctgatagcacctggcagttctgcatgctccaacccgcgctgtgctccaggacttactccctgaatcctcgcagacagacaggggcccacagaggtgagggcatgcaaatagcaggggcagaattggcgctggcctctggtctgtggggccccacaactcccctgccactctgtgcctggccttgtgctgggcatcaggaactgactgacctgttcctatgtgtgcctgctctcatggggcacatagactgatggggggaagcaggccattaggagaagggggaagcacaggagaccttcctggggaggagggaatgaaggcttcctggaagagggggcatttaggacttggccttgtaggataaggcagaggttggggactgaagtcccagggctgtggggattctctccttaacccctacacatttcctagggaatctgggaaaatccagggcctgagtgacccacttacctcctgacctatgacccttcagggcacaggacatgccccctcctccagggagccttccctgaccacctcctgcatgcacacatggagccccacagctggagctgcacagctctccctggcaagtgacatctttgctgggtggcctgattacccacaagcattaggcccccctccccgcccctcgccagccagctgggagttgctgtagggctgggtcctctgtccgccccagatcctcatgtctaccctctcctccctggc

SEQ ID NO: 29914 - DNA, 1004 bp, Homo sapiens
atacaaaaattagctgggcatggtggcacccccttgtaatcccacctacttgggaggccgaggcaggggaattgcctgaacctgggaggcagaggttgcagtgagcagagattgcaccactgcactccagcctgggtgacagggcaagactctgtctcaggaaaaaaaaaaaaaaaaaagaaagaaagaacaacatgccctaatttagactgacactattgattttctgatgacaaatctgtgaaaatatgtgactgaaccaattatgcaatgttatgtacctcacatttataaataagtagatagctgtattaatcatgtgaaatattccacaactagctcttaacaaatttcttagtagaattttaacacttggaccccataactgggaaaatatccttgctgacttaaagaagacatgaaaggttgaactcctatggagaaccaccttttatggtagaagtggagcgacgtcttctaattatatctgtagaaaaattattctaatctatttaaattatgaatatatttaccactattttcatgtgcctaagaatgaagagagaagaaattttggaatgtggtcctgctaataattgatgactctactcacttagactaggtttttctggcatgagttccaactatataaatatcttcagggattcagagaaaaagttttaaattccatcaatgtcctaagaacagagattgttgaaagtctactattttggcattcatttctcattggtcttttaggcatgaacaaatctgaaaatttattaaaataacggcattctctcaatcacatgtatgaggaattatataataataaaaataatggttgcaatttcagtggagattattatttatcaggaactatctatatttgatacgtttacttaatttttttgcacgcataccatgatatggtttggctctgtgtccccacccaaatctcagcttgaattgtagttgccataatccccacgtgtcatgggagt

SEQ ID NO: 29915 - DNA, 1766 bp, Homo sapiens
ttgccgtgtgctgcttctcatcactgcacacaagtgccatgctttgccaccaccaccaagcacatctgtgatcctgaagggcggccgttagtcattactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttcgttactttgctgcttcatgtgtactttcctaccccaagaggaagttttctgaaataagatttaaaaacaaaacaaaaaaaacacttaatatttcagactgttacaggaaacaccctttagtctgtcagttgaattcagagcactgaaaggtgttaaattggggtatgtggtttgattgataaaaagttacctctcagtattttgtgtcactgagaagctttacaatggatgcttttgaaacaagtatcagcaaaaggatttgttttcactctgggaggagagggtggagaaagcacttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggatgtcttaaatgattctttgtgtaccttttctgtcatattcagaaaccgttttgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctttggaaaaccaaatttgtaatatcattgtattttttattaaaagttttgtaataaatttctaaattatcttctggtgtgggactttaacaaacatcctatttttagtttcagattttttttttttggcattctttccaaaatgtctgtaaagaattcagccataggatttattgagaactgaattttgtggaaatctgagctttcagtgcttaaaataagttaatttttttttaagggcaactcagtatctagcactcagaagtccacactgaagcccactttgttttggcttgatttaaagtgaatgactcaggcttc

SEQ ID NO: 29916 - DNA, 1025 bp, Homo sapiens
ataggtgtgagccaccgtgccagccggagggccttgaatgctgtgtaagtgggtttgggctttctcctgatggcagcaggagtcatactgggtttaaggatagtggggcagaagccagtcaagcctggagcccaggagaaccctgatggtgagtaaggaacggaactggggtccaggagacggagagtcaccgagccactaagcattttctgtaccaatgagtcttgccctgaactctttctgtaaacatgggggtgaaggcctggacatgctatttaaccggtacacaggccattaacttgctggctttgacctccctggagcacacagccctagtgtctctaggtgagttatgccagtcctggacaggtctgcggagtttcctttcctgccttacctggtcagaggcttcatttggaaacctgggcagaggctgatgccaagggtgggagttagggttacgagagggaaagcagagagagtgaggaattgctgttctgtttctaaagctccagcgttgtgtggccaaccacccttctcttggaaaaaccaacatacaaataataaaccacctgaaacaaaagagtggggagggaatgatgggggaggcaggtgggctgccctaactgtggtcaggtatcagaattgcctgggatacttaaaaacaaacaaacaaacatattcagactcccaggcccagcctggacatactgaatcagaacctccagggggatggagcctgggaatctgtatttttaaagtttttcttgtggtttttttttttgagacagggtctgacttcgttgcccaggctggagtgcagtggtgccatcacagttcactgcagcctcgatctcctgggctcaagtgatcctcccacctcagccttccaagtagctgggactacaggcatgcaccaccactccaggctaatttttgtattttttgtacggaggaggtttcaccatgttgcctgggctggtcttgaactcctgagctcaagcgatcctcccaccttagatgat

SEQ ID NO: 29917 - DNA, 1064 bp, Homo sapiens
acacgtagtgactctgagtcctcaaaatgctgtccctggcccagcagtatgggcatcacgtgggagcctgcagaatgcagaacctcaggccccaccccagaccttctcatttagaccttgggggcagggctccgcattctgggttttcaagagccctccaggcaattctgctttgtatttaactttgggaagggctgatgacctctctggctgtgtgcctggggccgggggtggggctgggggaagggtcaggcctaatccttgcccgtgataactagagtgccagggctgcgggaacctcaggtgttctgtcatctgcatccttcctcttttttataatgggaggagtgtgtcagagacatgcataaaattacgcagcaagttcaaggcagggtataggtctggattcttatcttgcaaatggcagaaatcagttcaaacagacttcagttttattttttttatttatttatttttgagatgagtctttctgtgtctcccaggcatgagtcaccacacccggcctaaactgacattaaaaataaaaaagaacatttactgactcttttaacttaaaagcctggggccatacttcagcctggggctgagtccaggtgctgaaagatgtcatcgggactcagtttccttctctctgtctcccggctccgggtctctctatgcctgcttcattctccatggatgccctagctgctcaccagtgtagtgccgccccctgccccaatgtagccatctcaaccaagaaagagccttgtttttccccaatatttttggcaaaagtcctagtcatcactgtttttgaccaggctggtcaagtgcctatctttgagccaatcaagacagccccctctgattggctagggctggctcacgtgcccacctaggaggaggaggtggggtcagtccatctagaccccttgggctgagagcaggcctatgtgggtctcctcctggaacaggtttaagctgtccccagaaggggcatgggtgccagcaggctagacatatggactttagtgctattcttttttttttcttttttttta

SEQ ID NO: 29918 - DNA, 1049 bp, Homo sapiens
tggtctcccaggccccatgtcccagggaaccaggatgggaatctgatcgcacaggtggggcttcctcctttgcatctctttgctttgtgaacttggggaaatggggaaggttttgcagatgccagcagtgtgcctcacccactgccagcactgtgacaggatcagagccctctgccgtaagaggtgttccctgggtgccggtcctcatggcaggcttctgtgtgtgcgtgtgtttggggtgaccacacatttaccatctaaaccaggtttaagtgcacagttcagtggcattagtaccttcagacattgcgcggccatcaccaccgtccgtctccagaactttttcctcttcccaaatggagcctctgtccccattcaacactgactcctaactccccagtttgccctcctgccggccccgcacctggctttttgtacatgaactccttaagctgcagtgttgcaatgcctgggtactatttttacccttcttatagctgaggaaactgagacttagagagaccaagaacttagccaaggctccacacagctagtgaagggcttgataccaggtctgcctgtctgcagaaactgtctcttacctgctagtttgtcccaactggccttccccttgaattcccccaaaataacttcctcctgttggaagtatggagatctacagcccagaggcagaggcctcccgctgatgttattgcgtcctgggcaagggagcagggggtgtcaccctgactcatcaggggttcctaccattggcgggaacagtccgtctggcctaagagccatcatactgctgcgcctttcttggtgagacagggtagaggagtcagccatgtggaggcagatgcctgttgccatccaggctacccaagagggacacggttttttgtttgttttgagatggagccttgctctgtcgcccaggttagagtgcagtggcgcagccttggcccactgcaacttctgcctcctgggttcaagtgattctcctgcctcagcctcccaagtagctgggattacaggcatgtgcc

SEQ ID NO: 29919 - DNA, 1053 bp, Homo sapiens
gtggaggcattggctgatgagctgtcaggggtgatggggccaccaggcaatgaatgtgactgcttcttgtccattccatgtgtgattttcctttttgatgtctgaaaactgatttttatgtcctagatgaagaagtagaggatatgtaccttgtggatttcacacagaagatcatagacaagcgcaaagaaatggaggcatctggtgcccatagagattctcaaaaggcaggagaaagggacgacgatgaggaaaaccttcctgagggagagatccctcctccccaagaccccagtgaagaatggttggtaacatcatggattagctcagaggaacatcctcagacttgcgctgacattttgggagtgattttgttgggttgttatcgagccatttctctttattcttcctgggtgttcttttgagacttccctttaagttaggttggattaggttattatagttgtaaaaacagtagctcaaatgaagacataattacaataattacaataattacatataattacaaatactgactgggcttctgctgtgtgcccagctctgtgccaggccgaaggaaacccagtgcctggcagacttggcttgcctggctcactaacatgaaacagtgagggcagagcgccttccttttgtacctgtgctgctgccttacccgtgttcttgttctgacatggtggagagctgtcatctaggagaaggaagccggcagaggtggcacagtgtgttttactccgcctgtgacattgtttggcactgtggtgtggactcgtgggccttggatggttccatctgcaccttttactggctgtatgatcttaatcaggttccttagtctttgaggctcaggatcttccattataaaatagagattataatgcctcattcccatggccctttgctttaacacccccccgccccccttcaagaagtaagtgttccaggctacacaagaaagtgcagcctgtggagtataagcaggcattttgtaaacttttattattgtcattttcctgaattttgcctatatgtaga

SEQ ID NO: 29920 - DNA, 1050 bp, Homo sapiens
ttgggtagaattataccaattagaggaaataagagaaagaataaaaagtcagacttgaagactgtgaggaaatgagcaagttgagaatctcaggcacaaggcaaagttattaagatactgataaaatgtctggaattgtctcaactaggttaaagtaagttcgtagatgctgcagcaaaattccgtgtgggtgatttatctgtgagatcaaaggcataaatgatcaaaattattgttaacagtttctaaaactaatatttaataaggggcacaatgagcttattgtgtgtcagctttaaaaagcatattcctatcagtggtagtggtctctgaggttgggggctcttcttggtagtgaggcctatcttcccccttcactgttcacctactccctgacttaggggcttgtacatgtgtacaagtccttcttcacatctttttgctttcatttcagggtggattacgtggactctttggggcgttcccggcgctgtatgagaaaggatttgccagatctgctggagatggataaaaatcttcaggggagactgtaagtgtgtgtggtatacagagctctgccaaggtctgaaatgcagccacagggattgttttgtgaggggaggctgttttataattaatgatctctgttgctccagtaaggagatattgattgattgattgattgattgaagcactttttagtggttagcatgcacatacacacataatccacacttggggaacaacctgactggtggatgagtagagctgtctcttttacttggaaggatgtctgacaacagagtaacagaataaacccaaacgaaaccagcaaaccaggctttgtggagacaagtggtttgagaatatacacttgattatcccacaaacaagtggctctagggagagaacttactcactttttctttatgtatcattgcatttttgaagtaagggccttataactagatttttcagcagggcctaagacctaagacataactctaaaacgtaagacctaagagataactctgaaacatccaggggaat

SEQ ID NO: 29921 - DNA, 1050 bp, Homo sapiens
cagattcaagaatcaatttgcagatggattgaggagttacatatgaggggaaaactggaacatttctaagaaaatatttacagttacattcctgggataggacaggattttcataaatgaaagtacaaactgtaaaagaaaatagggataaatttagccttattaaatttaaggacttctgttcatcaaaagacaccttaaagaaagtaaacagatgaaccacagagtgggtgaagatatttataacttatcaacaaaaaattaatgtccagaatacttagcttttctaaacttaaacagatttactgctgcttctctgtgacttcatatctgtagtcacctgttgttagatttatcttgggatccccagccctacctgaagttgattgatcctgcaaatttaaagtgaattattacagaaataattctgtactaggcctctattaaatcagattgtcatctataaaatccacttttactcataatttgatgtatcaagccacctcttttagggaacccaatagaaagatacacctttctagtactctgtttctatactattcaataatattttcctaacaatattcctgtaataattcaaattcacatatttcttacattgaactatagttaataacagaggagaaattctgttgacatctaaaagtgataaaaattattagttgcagccacatgtttagatttattttttaatgtacagtacctattggctatccatttctttaaaaattcttattttctgttttgaggaagaatcagactctagacttttacatgcaatacttgtatttttaacaagtcagttgacttttctggtagacttaaagacgccttttccttccatctccattagttgtaaccaaactatagcaagaaaaaaagaccaaaaggtatctttgtgtttttttcttgtagaaacaagtaaaagttaagtttttaccatctattaaaacaataaacttatctcctcagtttcagacctaatcatattttgtgaaaatgagtaactgatactggtggtctcatgtc

SEQ ID NO: 29922 - DNA, 1575 bp, Homo sapiens
ctaaattgaaatgtttctacaaattaattttggtacctgtaactgaaggaggcggtgcagcatatacagataggtctagcttgctaggtctgtctgctatagagggcaaaatccacacaagacagtaccaaagatgaattttgattactaatatttttcaagtagtctggtttctccccacctgatagaggttgctacatctttccaaacaggttctctaatgatcttggttcaccatggctacaaatatggaggggctggttcagcacagagtggggacccagcaggtggctgaggtgagtgacaggggctagcacagtagctggcaccctcactttcgaaagaaaagaaaaatcagtgtgctcatttttttcaaaacagtcccttggaggtcagcatgtgatacgtcctagggtgctgtcatgggagaaaaaaatgacaagaacatttatttgtaacttttttttttttttttttttgcatgagtagggtggcctatctgcttttaataaggtgacttgaacttttactttaaaccgaaaactagtagaatctgattattattgaaccttgtgggtatagtttaaactccaaatctcttagtttctcgtacgcttgattcttcgttaatattatggaatagtagaagacgtgattatgtccattcagcagtcattgaccatttgccatggaccagggattgtactaagtgctgagttatatgggggtgaatgagtcatgggttgttcctttagtgatctcaaggcctggttaaggagttattataaaataggttgagaagtataattccatgtgagggatttgatcctggaggtggatcttccattatgagtaagcatttgtcagacccaagtaagtggggtggggaactttgtggtagattctggggagagcatcctaagtcagaaacctatgtaaaaggacgtaggcattaagtagcttggtatgtgcaggcaacttgacatgaaatgcatggtaaagctaaaacactaattgcatactttgggcattcattctgtaccatgccctatgcaagggctttaatcctcacaataactttctgaggttggtactgtcagtattcccatttagtaggtaaggaaaccaagtctcaaaaaataagtaattagccaaaggcactgtatagcaggacaagatgctgacgcaggtccgttcacctccaaagctcttccaattaaccatgggtcctactgcaaccaggagccaaaaggttgagattcgcattttttattttttattttttattttttgagacggagtcttgctgtctcccaggctgaagtgcagtggcgcgatctcggcccactgcaagctccgcttcctgggttcacaccattctcctgcctcagcctcccgagtagctgggactacaggcacccgccacaccacgcccggctaattttttgtatttttagtagagatggggtttcactgtgttagccaggatggtctccatctcctgacctcgtgatccgcctgcctctgcctcccaaagtcgcattttttaataatgctcatatatctagggcaaag

SEQ ID NO: 29923 - DNA, 1031 bp, Homo sapiens
actcctgggctcaggcaatcttcccacctccaccttccaaagtgctgggattacaggcatgagccaccacacccagtccagattttctgttccttcatgatgcagtcctggtaggttgtgtgtttctgagaatttgtccgtttcatctaggttatccagtgtgtcagtgtgtaattgttcatagtactagtttataatcttttcttatttctgttaacatttgtaataatgcccccacttttattcccattagatgaagagactttagtgttcgttcagtgccatatactcccacatctcttccctcccaataaaattatatcctgtttgtataaatcggtgttctggttatataattatgatactattacagatacttcctagtgtctccaacatagttgtaaaactctccagatactattttctattcaaatcagaagcatttttagtttcctttttttcctgtgaaaacattccttctaaaagcctctgacctcctgctgtagtccctactgattgctctttgaacttactgtgcacagctgtcatcctttacttctctcttgtttggagtctttgttttcttgagtctgtcttccttccttccttttttttttttttttttttttgatggacagcatgctgtattagcttcctaggaaagggtgcatcagaggtgattttcaaaaatcttatatgtctgaacatattttcatttacattacatggctaattgatagtttgatgaggaatagaaatctaagttgaaaataattttacctcagaattttgaaggcatcattttattgtcttccattttctagtgttgcttttgtgtataatagtcagtgccactgtcattccttatctacatgggtgacctctcttcctctccctcccaatctggttgttaagatcttttctattctgttctgaaatatacagtcatgtcctgtagtatatatattttttcataaatgataccgtgcactcagagggttctttcagtcaaagttcatgtcctcctgttc

SEQ ID NO: 29924 - DNA, 1053 bp, Homo sapiens
gaaatgtaaatgattttgtttatagatttttttaacaatcttgctcttacgaattctaataaattcatttagatttttatgttatctatgatttaatgacagtcttatctttttctttctaatccttatgtttttgtcttgacttattctggcagagagctccagtacagtgttgaatggaagtgttgatagcaggcatccttgccttgttcctcatcttaaaaggaatgatttcaacaatttgctatgagcctttattcgattaaggacattggaataaaagttgttatattcagcaaatactgaattttatcaaatgctatttttaaaaatttttttaatttttaattttgtgaatacatagtaggtgtatatatttgtagggtgcatgagatattttggtacaagtatacaatgcataataattacatcagggtaaatgggatatccattacctcaagcattcatcatttctttgtgttatgaacattccagttgtactccctcagttatactgaaatgtacaacttattgcggactgtaattacgctgtagtgctatcaaatattagatcttatttattgtatctaactatattttgtacccattaaccatccccgccactacccttcctagcctcggataaccatcattccattctctatctccatgagttcgattgtcagatgctctttttttttatgatctgagatgatcatatgatttctcttttttgatcaggtaatgtgaattagcttgactttgtaatattaaacccatcttgtattctgcagttaatctcaacttgataggttaatctggattatactctttatacacacacacacacacacacacacacacacacattcttagtttgctaacattttgtttagggattttgcatctgtgttcatgagtgagattaacttttaatttttcttaaatttatgctagcctcataaaatgagttgggagaaggttcccttttctcctccctcctataataatgtatataaaatgagaattatttggtccttaaatgcttataga

SEQ ID NO: 29925 - DNA, 1039 bp, Homo sapiens
agcctgggcaacaagagtgaaactccgtctcaaaaacaaacaaaaaaaatttaaattggcccggcatggtagcacacacctgtgatcctagctgctcaggaagctgaggttgggaggattgcttgggcccaggaggatgaggctgcagtgaaccataattgtgctactgcgctctagcacaggcaacagagtaagagatcttgtcccccccaaaaaaaaagtttctagttttaatgattattttctaatttttcttgtgctatttttgcttttggtgtcatctaagaaacaatcacctaattcaagttcacgaagatttacacctgtgttttctgagagttttatagttttaactcttacatttagatctttgatccattttgattttttttttttgtaatagtgcaaggtaggtgtccagatttgttcccctgcatttgatttccacttgtcccatcaccatttgtcgaagactgttctttgcctattgaattatcgtggcacctttatcaaatttgaacatataggtgagggtttatttctgcattctctgttatattccattggtctgtatgtcttgtctttatgccggtactgcaatttttttaagttacaaattgagtttatattgcatatatttacagtacaaagtgatgttatgatccgtgactacaatgtgtaaaaattaaatcaagctcattaacatatccatcaccttaaatacttatttttgccatgagaacatttgaaatttactcttagcaattttgaaatgtacaataggctattattaactgtattcgccatgctgtgcaataggtctaaaaaaaaagaaaagtattcctcctaagattttgtaccttttgacctgactttcatctccccattccccctgcccctcagcctctgttaactaccattttactctggttttatgagtttgattcttttagattccacatttaagtaagaacatgtggtatttgtctttctgtgcctggcttatttcacttaccataatgttctccagttccatccg

SEQ ID NO: 29926 - DNA, 2083 bp, Homo sapiens
aaagtgagattgtatctctacaaaaaaactaaaaaattagccagacatggtgatgcattcctgtagtcctagctacttgggaggctttggtgggaggattgcttgagcccaggaggttgaggctgcagtgagctgtgatcatgccactgcactccagcctgggccacagagagaccctgtctcaaaaaaataaaatagtaattcagaactattcatatgagctaaaatttatacttaagtaaaagatttatttaccattttgcaaaggtcaggatttatttacctttttgcaaaccttttttaaagcaggttctttttaccctttttatttttagtcaataatctttgctattatcttttggtatgctctaatataccctgacctatcttataaactttatatatatgctatatgtaaattctatgtatactataggaaattgtgtatatgtaggtatgtgagtgggcaggtgggtatgtgtgtgtatataaatagtataggaaatctgaagagctggttttgggttgagggacaaacccttgaagggattctcattgtactcagaaagaaatccaaactcgcagcagggccgttccacctccctctctaggttcctgggccatgctggttgtctgtgggcctgatagcagttcccaagaaactgttcctcccagggctttccatataccagaacatttctctttgctgggaacactaaacatttatttggctgctgtctcctcagccttgaatcttttttttttttttttttaaaggcatttcgctcttgtcgcccaggctggagtacagtggcacagtgttggctcactgcaacttctgcctcccaggttcaagcaattcttctgcctcagcctcccaaatagctgggattacagacatgcgccaccacgccaggctaattttgtattttcagtagagacagagtttcaccatgttggccaggctggtctcgaactcctgacctcagctgatcagcctgcctcggcctcccaaagtgctgggattacaggcgcgagccactgtgccacccagcccaaatctcatcttaaatgtcaccttgtcacagaggttttccctgacctctctttttttttttttttttgaggcggagtctcgctctgtcgcccaggctggagtgtagtggcgcgatcttggctcactgcaacctccgcctcccgggttcatgccattctcctgcctcagcctgccgagtagctgggaatacaggtgctcgccaccacacctggctaaatttttatatttttagtagggacggggtttcaccatgttagacaggatggtctcggtctcctgaccttatgatccgcctgcctcggcctcccaaaattctgggattacaggcatgagccaccgtgcccagccccctgacctctctttttaaagttaagtacttttgttattcagggttaccccaacctgatcttttccctcataacatgtaccataaattgaaattgtttactgactggtttgtttccttgtgtattgccagtctcttccattgaactaaaagtttcatgagggcaggagccatcttcatatgccactgtctaacacagtgtctgacagagtagcccctcagtaaatattttaggaatgaatgaaagaatgagtaagccatggtaaaaagtcttgactttttcctcaggagcgatttgataagatgaaagggataagacaagactgagtgaggaaaggagtatgtgagagcttagagggaagaaatactttaccaaggtcctgtcatgttctgggcagtgtaccaaacagtttcacacacatcgtatcatttcactttcctagtcatcctttttcatagatatataaatggagctcaagggcttatgtaactgctccaagttgacacagctgggaagtagaagagcaagcattcctattcatgtctgtagctaccaagccctttctcgggtgtttacagtgaaagaggtggcaaggtggatagggataaactggagaggctacctcatctaaagaggtagccaacccacacccgctccagccacctggcaccatggggag

SEQ ID NO: 29927 - DNA, 1064 bp, Homo sapiens
gaatacataaaactgaatgaaatcctgcactttgtgacaacatagatgaacatggaggacatcatgttacatgaaataagccagacacagaaagacaaatacgatctcactcatgtggaatccttaaaaaaaaaaattgatatcatagaaacagagagtagaataatggcaccaagactcaggaggggaaaagtgagagatagttgggaaagactgaccaactggtacaaagttacagttaagtagtaggaacaagttctggtgttctattgcactgtagccatagctaacaataaggtattatatattataaaatacctagaagaaagggttttgaatgtccttattaacaaagaaatgataaatgcataaggtgatggtcactctatctgatttgatcattatacaacgtggatatattgaaatatcaaattatgcctcataaatatggacatggacaattacaatgtatcagaaataaaaagagacaccaaagtaaaacaagattagaaaaatggactgtgtttaataaatgcattcctagaactgtgtttctagaaggctttgagtggctagcccaggtggaaccatatggtaatcctcttttgctgtgggcttcggcagtgacagtccccatgcttctccctgtgactatcccgcttccccaggggaggtttcgggcccaggacgtgaatcagagaggggctaaatgcaggagtgagaccctctgtgccaaagccacacatgcacgtgtttgctatgtgccactcgtggcaggacaggggccctgagccgcatcacaagcccagatctccaggaataggacccaggtgtgttcaagtggacagtagagttcagccgtcacctgtgagctcctactgtatgttagaccatttgtatactaagagcactaaggtcatgccatctgccagctgtcatataacctgtctgagtttcagtatttccatcatgaattcataaggctacttgaaagatggtagagaaattacgtgaagggtgtggccagtatgcttaatgctcaggccacgtggctgttggcatct

SEQ ID NO: 29928 - DNA, 1040 bp, Homo sapiens
agacgtgtcccacagcaggcactgttgtggcttcccacccatctgccatagcctccagcgttgtgttgcctaattctgccccttctggagctgctcagtcacacctctggacaggcctgaggatgcctgatttatgaaggggtcagaaattctcctagccttgaattcagattatgtcctgcaatttaggcatcattcatacggaagacaattattttatgattcaagattggggcatttctgcagtacacacaaaaggcccaaggtgagataaggtctcagtgctacagttaatttgtatattctttttaatataatctattgaacttactttaaaaggaacggaaagaggggaaaacaagcaatccaaaatgtatcagagagagagctggagttgaggatgccttgctgattttctgaaaatcaagttaacttttctaggcagaatggccacagtctgcagtcatcctggaaagccctgggggatgcatctgcatttcatcctgtctcaagctgtaaacctgactttatgtatatctcattgcagagagacaggggtgggggttctgcttagtcactaagcggctgagtctacttagagcttttctactattcagacagcttcacaaatgtggaaggacaggtaaatgcagcatgatcatactgtgcataaaatgttggaagctactctgagtttctttatgtcttaaatagacaaacaggtcttcttgatccagggatgcttgtgaacatccagcagcctttgatacgtgaggatggtacagttctcctggccacggattctaaggtgacgttctctactcatgctctctctcatcctttatgttgacattgcaggctgcttctctaactgtgtgcaccactttcttcctggccttcagagaccacatcaaaagcatgacctatgtctcggtctccttattgttgtgatagctatcttgtgatttgttttagagatgctgatggcttctcagatcagagctggctggtcataatcactgtaacatgtcagtctagat

SEQ ID NO: 29929 - DNA, 1517 bp, Homo sapiens
aaaagtcacttaggctaattgttcacctcacagtaaggggttggacacagcttaacctttttgtcttccttcccagcccttcactcacaaacaacaaaatagctaataaaattgggacaaattatataattatttagaaagtaaatgacaatttgtaattttatgtgatagtttttaaaactatgtgttttctagggtagtaggaagccagatgtccagaaccaatcatgtggggctgttcagactgggatccactcagggtccccgacccgctcccaggaacttcaggcctgggcagaaaacagaggaaaagccagtgttctaataatacccaaactagatcagtctttgagttcaatttgttgtacttaagaagtttgcagaagtttgactaaaagtactaagaagtctacaagtgagacttttcaaatacagagggaactgggggggggtacttttctgttttcagatcatccaggtttgaccagcacaagccagattgaaaaattccaagaaaaggcacagatggagttgcaggactatgttcagaaaacctactcagaagacacctaccggtgaggcattcaggcatatgcgctcttgcttggggctgcaaggagtgtggctgagtctgcagtttctaatataaattatgttaacctttccatttttagcagcctgatagagcctccattggatcacactctaattcttgagttttctttgttttttccaagctcccaagagctagagataattcttgaatgctagaggtggtgtagagtgtagacagtgccagcaggagggccaggactgtggctgattccagttttgctgtgtgactgtgagcgaggcctcagattgctactctttaattggaggagttggaacagatgctgtgtggcctgttctggggctaacactgtacatgaggcttgagttctcatggagattcctttgtccagaatagtttgaaaggtctgctcctctggtcagcatccattgaagaggcagtgctagagtacttgacagaaaagtgcttattgacagaaaattcttattgacagaaatcaaatctgacccctataaaggagtggatgagttatataaagtcattttaccctcagataaactaatggaaaaaagtttgtttgggtgcaaattagtggtattatttgtaattaatgtgcagtaaaaatatgtgtataaaaattaggaccgggcacggtggctcacgcctgtaatcccagcactttgggaggctgaggcgggtggatcaggaggtcacgagttcaagaccagcctggccaagatggtgaaaccccgtctctactaaaaatatttaaaaaaaaattagccaggcacggtggtaggcgcctgtaatcccagctactggggaggctgaggcaggagaatctcttgaacctggtagggtgggcagaggttgcagtgagctgagatcacgccactgcactccagcctgggtgacagagtgagactccttctcaaaaaacaaa

SEQ ID NO: 29930 - DNA, 1052 bp, Homo sapiens
agtagggtaagtgggaacagtgtttccaacttctaaattcttgtttggatttaattatatcattttataattcttgccttggcagcaaattttggagagtagtgggagtggccattataaaatgatggaaaggatttaattttgccagcttaaagtaatttttacttttctaaccctgatgtgttttcagtttcaaaattaagacaaaaaaccagctgagacaatggaattagggcaggtttgtttcatttctgcttgtgaaggcttttagtagcaggcatcctgcagctcagtggtgcctctaacacagattgttgcctgccttccgtcgttttgatccttgagagtgaccatgagggccatgttgcagttccctgggaatacaagcataacagctttcagatcccagttcttggtgttggtgaaaaggtctccaccagcccctcctctcattcccaggtcattcagtggcagccagtaggctgcttagactcaggctggataaggaagtgttgggctgtggtgaaacaaccttgcagaaaacgtgattttgcttggaaaggtgctgattctaacctggtcctgctctttaagtccccttgctggtgatggctgattccagggactgttttgggctttgaacacctcttggttggtttctgagatcctcttggccttactttgaagtggccttttctttaaggatcatgtccacgtaacctgtattcttgctgctttaactcatttcaagcctctgactgcaggtccatttcatctcctgtcaggttggttaagtaaagtcagcccaaagtcaagaattacttaaagagatgcaaaccaaatatttgggctccaactttcacagggcttatagcccttattagcagtttgtgaaactttgggtttcatgaagtgagacctgtcctctggctactgaactccatggagccacgttcatgctccctcttctactggcctggctgctcctccctcaatgaggagaggcagctggctcagagaggtgggacagacacatgctgtcatcagttaag

SEQ ID NO: 29931 - DNA, 1066 bp, Homo sapiens
aaaagatatttagtataaaaagtaggtacttggggcaatgtacgtatattgcggtaatgttgaaattacgtgaatgaatatgaatatgttaattattcttattaacagacaatagtatcggattgctcctttgtggcatcactggccatcagtgcagcttatgaaagacgttttaataagaagttaattaccgggtaaaaatgtgtctctctttacctctttttgtgtaattgtcccttaactagaaatttaaaacttaagccttatctgtatagaaagtggagagggcatatcattcagaatatggcccttctgtagaaattaagcagatgatttatgaatgtggaaagatacgctaaaacagtcttaagaacctatacacgtagttaatatatatgaaattaatgtgttttgaaataaatgaaattgatcaaagtaaaatcatgtcatattgataatactttatgattggactgttaagtgaggtagtcactagccacatgtggctatagacacttgaaatggattagtctgaattaagaggagatgcactgcaagtgtaaaatgcatgagattttgaaaacttagaacataaaaaatgcaaaattgcaaaatatctcatttttgtgttgattatatgttaaaatcatatttcgatttgtgattaaaacatcaaaattggttttactttttttcttttttttttttttttttttttttttttggagacaaagaatttcgctcttgttgcccaggctggagtgcaatggcgtgatctcggctcaccacaacctctgcctcctgggttcaagcgattctcctgcctcagcctctgaagtagctgggattacaggcagttttacctttttaacttttaatgtggttactgggaaatataacatatttctgttggcttgaactgctttagaatgtattaaaatgtttctgaaatactttttcagtttttaaaagatacattagcttaaaatcattcattgcaaaaactaagcattataattttttcaacttttcctgagcggtttttgtgtgttaagtcctaagagta

SEQ ID NO: 29932 - DNA, 1414 bp, Homo sapiens
tttctttaaggaaagactctgaactctgttataagggccttgcattgttaaggttctccaccacctgtccatgttgagatccatgcagcaacatcagcatcacctggaagtttgttagttttgcagaatttcaggcttcaccctagacctgctgaatcagaatctgcgtttcacctagatcccctgtgatccagcctgaaaatcattgctctgtagttcagtaatactcaaattttagtatgcacagaatcacctggcaggtgattatctgttattaaaacacaggtttctggacctcacgcccagagtttctgattctggaggtctgagatgagatcaaaatttgcatttctaacaagattccaggtgatgctgatgttgttgtctagaatactctctgagagccattttacctgatttacttaaaaagtaaagaaaattattgagaataattttactgaactataattcttgacctcttgtttaaagaatctttaaagatgtatggcataatcttcctattggtgttaaatcaaaattcttatcctcatatctctgagaacactttttttttttttgagatggagtctcactctgtcacccaggctggagtgcaatggcacaatctcggctcactgcaacctccgcctcctgggtgcaagtgggtctcctgcctcagcctcccgagtagctgggattacaggcacccaccaccacgcccggctaatttttgtatttttagtggagacagagtttcaccgtgttagccaggatggtctcgatctcctgacctcatgatcctcccgcctcggcctcctaaagtgctgggattacaggcgtgagccaccgcgcccagcctcagatcactttttaatatgaattagatactgtatctgatgacttcctctgttatttatatgtattttctagccataatgttctactcttacaactatacatgagtctttttataggtttagaataaaatgacaataatactgcatttaaaagtgaggcccttttgtaattattttaaatgtacatttctagaataatataggttgagtatcccttatccgaaatacttgggaccagaagtgttttggattttggattttaacagattttttaatatttgcagaatacctacaagttgaacatctctaatctgaaaatccaaaacactccagtaagtatttcctttgagcatcatgtcagtgatcaagaagtcttggattttggagcatttcaaattttagattttttatttcagatgctcagccttttaatttcagtgatagttacatgacatttaatcaattgattgaaggttatcatctgacagattagcttgtaaaattgaataaagacatcatattaaaaagaacaacattttgtaattggtatgattcta

SEQ ID NO: 29933 - DNA, 1273 bp, Homo sapiens
aagcaaaatatcaagtactgatacacgtgtaaaaaaaagggttatgtgtgagtgactggttgcttttggtgggtggtcatagaagacctctttgagcagggatgagaagagctatgaataacaaaaaggaaccagtcatgcaaagaaatcaagggaaaagcattacaggcagagggaacagcaagtacaaggaccttacagtgagaaaagatggtgtatttttgggacagagaacaggccaattgcctgggtaggtgtggtatcaaaagaggtcagaaagatttgcagaggtcagatcacatgaggttctgtacaccacaggaagggttcggagagtctttggcttgtcataatcaggaaaatgacatgtcctggctccaaatgaagatgcagctaggctgttggatttttgaatagagttctggggtaagggtagagatacagataggggagtcaggagcatatagatggagtttgaagataggactgcataaatcacctgtgaagagagttgtgggtacagagattaacacccaggatctgacccttggactctcagacaccttgaggttcagcagaggaaaaaggtaccacaaaagaatttgaacagagggcctgatgaaacagtgaggtttcacataacccaagcaaagaacatttttcaagagaaaaagaaaggacagttccatctattgatgtttgagaaatcaaatgagattaggtgagagaagaaactattgtgggaactaaatgataagaacttacgaacacaaagaaggaaacaacacatactgaggtctacttgaagtggggggagggtgggaggagggagaggaatagaaaagataactattgggtcctggcttaatacgtgggtgatgaaataatatgcacaacaaacccccatgacacgtatttacttttgtaacaaacattcacatgtacccccaaacctaaaataaaaattaaagggaagaaactattggacttagcatcgtggcagtcagtcattgttgaccttgataagaacaggcatagtggagaggtggggctagaagcccagttggattggttttaaaagagactatgatgtaaggaagcaactgttgacagttcttgcaagaaagctgtgcaaagaaatgggcagtgatgggaagatgtgatcagaagtggtttaagtcttactttgtttaatcatagggaagtatggcattcttccctattacaatgtgttgatggcaggcactgagtcttgctagtcaatatccctgcg

SEQ ID NO: 29934 - DNA, 1059 bp, Homo sapiens
atgagaaaaagaaaggatatagattccttgagtggaatagtgggctagattaatataccgaaatatttccattgtttcccttttttgcagagcatgtggaagttaaacctgcttgattctactatacatcttgggcaactagttaccaaatgaattgtgccaccataactgattttaattttgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaacagtaattgagatattgaagacattacaatttagtttgtgtggtctttttttaaattgctgtatcgttcagtctcttgtggcaatagcactttgaagaaaatagagaatttaatatatggtgattgggatatgtagcattcaaaaaaagtgaattgccaagatactggtgtcatgtaaattcccactttacataaaaacccatcaggacagaatgatgctcaatattttaaaattctaaaaatagggtgggatttttcattgtctctactttataattatcaaaacttattttgtattgctactaccttaaattgaaataaaatgtttatacttacggatattgcatagtttaagttagatttattgaaagatttcatctgtcgtgtttcatgtaaatgagaacagattatttgcatgaaaatatatacttcaacaaaaatctgttctttaacagagtagtggtagattattacactaatgagatttcactttggtaaatacttcatgctttcagttttagcctattaattttaggtggacaaatttaacaagttttctgttactttttaaaaagaaaaaatccagaacataagaactatattatgaacacatgatttgaacctgttgtggtaaagatcttgtacaggatgcaaactaaaaacctaatccctgccatcaaatttattagaag

SEQ ID NO: 29935 - DNA, 1070 bp, Homo sapiens
ctcacaccacctaccctagtgtaggtaataggtctacgctaggaccccgtgctgggctctcagcccatcatgagattttggtggatttaatggcaggtaggaacttatttatagtggattgataattgctttataattccttggtaatgacagctcagggaaggtttcacaaggtcatgatcaggagacttgaattgttactggatgtaggaattgtttcactgctcttaacttgctcaaactggggcaggttccaggaacttgaactaaaaatatctatttaagcctctctctctttctctcctccccaacttttttctgaaagccttgatttctgtagacagaactatggtttttggcatgttgggtcaagacgtgtttctataggaaatgcttgcacgtggcactggcttggtgagtcaagcttcctgagcttcagaccgtttgtcctgtcatctgtcctgcccaacactgtatggtttttctctagcacggcttcaattttgttctctgcacaaagcctttggtggttctgccctctgccctccagctttacccaccagagtaagcaatcttttctttttagaaatcaagaatttggcttcacagatggcttctcacagatgccctcctgccagccaaaccggacttgttcttcctgcctctgtgccttctctcattctccttctctccctccataccccacttttgaggttctgtgggtaccatctttgtggactcttgtcttttttttcaacccacatggagtgccctgtgtgtacatactgaccttttttttttttttttttttttgcttgaactctggtcggtatgagctccttaaaagcaggtactgggctggctgtggtgactcatgcctgtaatcccagcactttgggaggctgaggtgggaggattgcttgagtccaggagtttgagaccagcctgggcaacatggcgagaccctgtttctacaaaaagaaaaagggaaaaaaaaagcagggactgtcattctcatctcctccctggggtatccacaggaatggacattcaaatggttgtagcctggt

SEQ ID NO: 29936 - DNA, 1056 bp, Homo sapiens
aagagactcttagagaattgtctctcaacagagtttagcctttagtaagagcttggacacctcatccattttaaatggtagagggtgaggggtggggaagatagattattggaaaagattctagtacctcttttttgcttacttttatttttttccctagcaaatcaatagatgaaggtatcaggtaaaatttaggagtgggcatcaagagtatatggtttaaagagagatagagctgcctagaagagaaggagagggttggccaaggaaatgtagaattattgggtactgctgaagacactcctatagtgtgtgatcataaatttaaccagtcaacacaattgcgattgttttatccaggttcatttcatgcttaagtgcagggaaaggtcacgcagagagttggctttaaccaagattggagtttttttttaggacagtatgatggagaaagaatgtggtaagggccttaggggctgtacactgacaaacccttaattagtatgaatacagtcatggaccatggaatctaggctggataaaaaggacagtgaggaaaggaagccccatgaaaaattgatgaggccaaaggatcagagttcctgctaggattaaagaagagttagagtgtattagaataagtgaactaggaagatagaaggaggtagtcaaataatggaatgcctaaaatcaaggttttagagtaatagtatatgagcatgggagtgggtagctaaggtggggtggagaaaaagatcattagagatgaggagtcaagaaactgaatgaccagagtgtcagatgtatcatttagtgcttgttgaagtcaccaagaataacaagtcacagtggagagacagggacctgtatgctaaaattttgaatgaatgagaggaaatgactgaaaggtcagtagatgattgcaacatagaggggtggcaggtgccattgactgatggcaaactattcctttatttaataaatatttatttacatatggccaactaattactgtggggagaacaacttaccacatcctcaaggattacatgctaa

SEQ ID NO: 29937 - DNA, 1217 bp, Homo sapiens
tgtcttgaactcctgacctcatgatctgccctcctcggcctcccaaagtgctgggattacaggcatgagccacagctcctggccctcctcttctgtttctaatttcccctcttctcccatacagaatgagaactgcgaagagttgggaggaactggagaaagctagatggtatctggctttctcagcagtatatggtcattaggaacttgccccaatctccagagggtgctcctagccatagagtaggggctggaccctggactcgttgaaatgaatggcacctcaggtttggccataacagaactggatcagcttcttatagtctcgtcttccattcttgcctttaatttgtatagtgagtatactttacacatgttatttgctcttcagttcaagtccatgaggtagcctaaggatacgatgccatctggattttacaaagaggaagcagggcctaggacatgtctctcagtgacgaaaggaagctccagctcagaattcctagctaaaggactgtgttgctactcttggagtcgacaggaaatggaatactcacccagaaatgttcttttggttttgggcatgtatttcctctggaaagtttactgaatgaccatttatgatgtttatgcttcttacttgggactgtaactgtaagtagtctgagattgtgctgatggaggaaactgaactctgaattgaattacattggaatgtttgtgttcaagttttattcattttattcttaagaatcaaaagaataagcagtctgagtaaccctagaaatgtcaaggagataaagatagaaatactgtaatgcagtaaagattgttcaggcaagacaaattttactggagggggtcattccgtgcttggcctctacagactgttggcctactgagcaatatatgctctgttcatcagtttgttgggagagtttggcagtgaaagaatttcttaaattactaattcatatgcattcatttgttcatttggaaatgtgccagaccctgggccagatcctggggttacagcattgaaaatgatagataagctcctatcctcagattttaatgggactctgatcagaagactttatgcacctaattgattttggaaatctttctaattctttttctattgtactagtttgcttttagaagcctgtgtcttttcctacagtatcttatgtgtatgttgcctttttgtttacaaa

SEQ ID NO: 29938 - DNA, 1083 bp, Homo sapiens
aatgaaataatctacctcgaggctgtattttaacagattattatatcgaaagaaaaaaatgaatgtttataaaataacatttctttttttttttttttttttttgagacagggtctcacttggctcactgcagtcttgacctccaggctcaagtgatcctcccacctcagccttccgagtagctgggactacaagtgtgccaccatgcctagctaatgtttgtaattttttttttttttttttttttttgtagagatgtggggttttgccacgttgcccaggctggtctcaaactcctgggctcaagctatctgcctgccttggtctcccaaaatacttctgtaaatgtaagaaaaggggaataatgaagtaatagagacctctgatgattctcattacttgtctttgtaataagatacttaaaaaagaatgtgtggcaaacaaaggaaaataccagttctactaaataaatgtctgctctccctgaactctcccatacttttaaacatgaatctggattttctgtagtgttctcttcccctatccacccagcttaaaaaaaaaaaaaaagtgctcctgcatttctaccaatctttgttctgaaaaaccattttaagtgacttaaagttcaagtttttattcattctgcaaatacttactgagccttactgtgtgttgggccctgtgcttcatctagggagttgacttatacatgctgaatatggtcagaaaggcaaaaacattatattggtagagttgagagtatgaagagaagagggaggacctcaggcagggggtgttacttgagcagggcctagaagggtgagcagaaggttggtagaactgagagagcttggcacatgctgaatgacctaggtagggttttggggaagggcaggtgttaggtacctttgaggaccagcaggttgtccagtttggccaaaaaaccacaagcacagtgatccaggaggagtcccaagttcgtatgagttaaacgggactttcagctttttttttttttttttttttttcggtgattgagtagtagagagccgtttaaggtttttaagctggagagtaact

SEQ ID NO: 29939 - DNA, 1031 bp, Homo sapiens
ctttttggtacttaaattgagctaactccagccagagtggcttggaattcatagtgcggtggctcagagtataggctcgaaagcccttgagccagattgcctgggttcagatctcacctatactacttactaggtagatgaccttgagcaagtcacttaactgctctatgcctcatttaaaattacatacaactacatgtaaaagggagatgatactgctgcctacctacctacatgatagggctgttacggggattgaaggtgatcatacatgtaaagtgcttggcagagcactgcatgagtgtgttgtcgttattaatttgctattccttgtcctattcagaaaggatttcaagaggctggatgccttagatgtggtctaacttgaaaccttcatgtgggtgtgcgtctgtcttgtttattgctgtgccaggcacaaaataggtatttcataaatatttgttaatatgctcagagttgataagctggattaaagtgacttcttaaggatcctctggctctatgagtttgaaaaaatgtttcttcttttgacataagaccctttcccagcctactcaagggactaggttagtctgatatttgtatctttctcagattttatttatattttttcaaacatatgacaaagtagagatagtaaaatgacttctcgtgcatccatcacccggcttccatgactagcagcattctgtttttgtcagccctcagcttctttgtgggggtgttcttcttgctggtgtgttttcaagcaaagcctagcaattgtatcgtgtcacttctaaattcttcagtatatatttctaacagatacatcacctcagcacaaccacaatgtcatcatcatacctaacacaagtgacaatgattccttaatatcctctaagacccttctgtgttgtttcctcatggcctcaaaagtccgaatattgcattaggttaatgtcttttattttaattaattaatggcacactccttacaccccctacacatatacatggacacttttttt

SEQ ID NO: 29940 - DNA, 1023 bp, Homo sapiens
atttcctggagaaagggggaaatatggatggttgatttcctgaagaaagtagagaaaaaggaaatacagagaaacggagggaaactttgctccctgtaaatcttattaagggcctcggcaaatcttgttagtctatcacacaggaaagaccaagcagagaggcgtgaagggatggtgggtaagtccacctgggttcatatgcccgaactgcctatttccagactgggcaacaaatttcctctctaaaccccagtttgctcagctgtaaaatgtcttgctttaggcaagtattttaacaggtggtgtgtaggttttcatcggtgcctggcaggctgacacttcctgtgtgaaaactggataattcaagggcaatttcgagagcacaggagataaaagagctcacagtctagaatccacttcaaacgtgacattttggagcaaactgcaagtcaatttcatgtggttctgaactccccagaagtcataacttcagtaagtaaacagtcaggtggcacagataactgcttgataaagtttctcctgtttgatggactgctgtctctacactctaaattccattcctttttctctgagataccatggggattaatgaaaagctgttagctgctctttaagtgggtcaaaactcccattgctgacatacttactccctgagagtggctcttcatgcacctccaaggggttgctctccggtccatccagtgtcttgctcaccccctgtggtgaaagttctccaccatctccctctccggagggtgagctgggctgcttggcgaggggcacctcccctctggggcctgagctgggctctgggctttggtttctcccagccggagcactgcacacatccccagtccccggtttctcattctccagtgacgcgtgatccccacgtgcgttttttgcatctctggcatcctcggtgctgttggcagtagacaccggagcactgctgcctgccgagttcacagaggaatggtactgaggtataacaccaacgaa

SEQ ID NO: 29941 - DNA, 1110 bp, Homo sapiens
aaatataaaatttggacagattttagagacaatcattatataaaaatctcatgaacatttaaatcattaataatgtacttatatacatctaaacattatatctcacctacttctgcattcatatctaaaagtgtaaaactcaatgactagtctcatccaggacccatcactggtaatgcccattatatctttttcagcttgaaaaacacacaaaaaaaatctaagttacttctgattgacaaagaggaaaaaatgtcaattttcaattcaacagagttgaataggtagactattcaatacaagactcccacaaagatttaaagtaagacaatctgagttcctatatttaatatgagacagacatataaatagaaaactccaacgctttagtaaaattatttgcaactaaattacctacacttatgcatacgattctcaaaatcatgtccctgtagtctaccttgcaatgctaccaaataaatcttcctagagagtcaatttttacttaaagattgtatgtacatgtgggaagagggggcctctattttatttaaaaacaaatacagacatttcatggtactgaagtattcacccaagttttaagattaacaggaaatttcaaagaaattcagtgcttgtgcatttgtttgggtacctgctcactgttctctgtcatttcaaaatagttctggggagagggtggaaatcactagtgtgctaattctctctctcagaagaaacaaacaaacaaaaaataaataaaatgtgaggaaagacacaggccaatcaagggcagctatagaacaggagtggggaaaatgagctctcacaccaaccatgcacgtctccttcttgttctctccaccggggtaaaggccaatgctttggaggaagagaacaagagtaactcggcaagccatttaggagtgtggattggaaaaaattctttcccccaagagaaggtggctttacgctggcatatgagattgaaaagtgcaaacaaataattaacggtgaatcctgaaacttcaacacaccagaaaagggtgtcactccagagtgagatgggaaaataagaggaataaattaaggtagtcttggtgatgctgg

SEQ ID NO: 29942 - DNA, 2383 bp, Homo sapiens
tgtctttttgctgcatacatagcttttagtgacttacgttttcttttactctgtagcttatgtttccatggaagttgctttcaactgtgcatgataatcaatcctattgacagagttaggtgacatttctgtttttatttgtcataaaatatttgtggtgattttgcattgtggtgttaataaaatttgaggtgaaaattccaaagaagataccagcctacctaattttaacccctttcttttaattgttttgaatacttgtttttgcattaaaaaatcaaactttattagtgtccatagtgagattcatagtgtaacttactgaattacaaaaacatttgttttaattttacattactgggcgataagcaagaaggatgatttgttagtatttctgatatatggaattgggaacttgtcaatagataccatttcttaattgaaggctctagaagcacatgggggaaatgattaatgttcaaaaatcactgattttagaaatgatattgatacttatgttgaattctgaaacttttaaggatattttgtcatttttcttctttgtaaagaaagcatttggcttcttgttcaccagtgtaaccctagatataaagtgccaggaatgtagtagcagctcaataaattgcttattgaatgaatggagaaagtacatgttttctctgagttctgttaatttataaaacaattggttttggatttaccagtcccatattttgttcattgtattgtacctccaaagaaggcttgacatactcctttttcttgcctctgttttcactttgcattttcttaaaactttcgaaaattatggaagtagtgttgaaagttgatcaatactgggttataggaaagagaggatgctatatttaaataggtaactacttggtatatttccctttgaattggtgccttgaagcatcaagatttttggaatgtattgtggtattttctaaagataacttccagcatcaggacaatatcctaatagaaaacaaagtctttaacatcaaatttcataaagcaacaaatactgcacagatagttttgtcatgtgaatggcagaaattatgtttcacttttgtttaaaaaaaaaaagaataaaaagctaaagcagaagcccatgtgaaaaagcaatagtgacatctttccttggtttccttattttttttaatataagggatgaatgcagtcaggtggtctctgagtagaggcaggagtagattagtaagcaaggtgataattggggacttgagggaatagcagggagtgaatgctgcctggggaactgaggccggtatttatggggttgtattagttgaaatgctgggcttctgaactgtgcctctctcctagctttcatcttcattacagtcttgacagccctctttgttggagatccttaaatcagagggagaataatggcctaaatgtgctataaggtgggcaaagaaagggggactattgctaaagtgcagggcatatgcagaaatacactgtaggctgacccgaatcttattcctcatttaaaataatttatttggtactccatctgttttgtaaatgtggtgttgagtaagaaattgttgtaaaacaatattttctgccaaaatagatgcacagatctatactaaaagaactctttggttatgttaacagtgttgattaaaattcagagtgagcagctttgtagaaccttttacaaataccttgagatgataaataaatcatggaaatcatcaccagacttttctacttttccttagcttattgaaaataacggtcgacttttgagattatttacaaaggctcattactggattttagagaagaagccattatgtttgtcatcttaagtaatctagtaaatgaaaacatcactttcattttctctttccataattcatttcatcactctattcaatataatctatgctttattttgaaacagttaatttggttaattgttcagatggcatcccttatttgcaaatagctcaatcttttaattcaagagcctggtctaaaaatatgaagtagcattttaggccttagatttctgtttaagtttagaaagaaatgaagttaaaatgtctattgctgtggatgatttagtcagaactagttaaatactttggttgatactttaaaaaatgaggtatgatttacatacagtaaaattcacactggtttgtgtcgagttctgtgaactttgaccaatacattcagtcatttaatcaccaccatcatgaagatatagggcactaacatcacctcaaaaaactcccaggtctctgtgatctttcgctcccctcatccccagacaatggcaatcttcggttcttttttaatcagtaggaaattc

SEQ ID NO: 29943 - DNA, 1044 bp, Homo sapiens
ctgtggcatgccttttgactttgtttatagtatcttttatcaggcagaagttttaaatttagatgtagtcaaatttatcttttcttgtgctcagaatcccctccatcctcctcccactttgtttaattctctgctgttgccgtcttgaaagtcgtgcattttcatttctcactggggcacgcaagtaatgtagtcatttctgcttatatgttattttaggcttaggtctttaattattctggaatattttgggtgtgtgtgacttgtgtgaaaaacaggtataattattttgtattttttgcaaatggacagccagttatttcaataccatttgtttcatagttaatccctttcccatcatttggaatgccacctttcttatattttgaattcccttgtattcattggactgtctctggaatatgcattttgttctattaatctggtcatctattcctgtaccagtatcatgatgttttaattgctgtatcttcacaaggtttttcgatatctggtaggacaagacctttgctcttcttttctaagattacttcaactatcttgtatttgtttgctttccttttttggcatcaacctctcaattccttgcaaattccatttgggattttgttagggattatatgaattttataaattaattttggagaaaataacatcttcatagtattgagtcttcccatacagggacaagatatgtctcttctttaattaccttatgtccttcactaaagttttatctattttttcttaacaggcttgcataccaagcattttaaattgttattttgaatgggatttatttctaagttttttaaattggtgtatttaagagctaataatttctggttttggtcttgtatttgatctccttgctgacatccttgtagatctactgttgatctcttagcctgttgattctcttagctcttcatgtagagattttaaaatactgacagtgttgtgtgtttattgctaatatttgttttattttgctttttttttttcgatgctgctttagctaga

SEQ ID NO: 29944 - DNA, 1132 bp, Homo sapiens
atgtaatgtgttcatgtcatcctttctttcccagcccctctgctgcctctcatgtctctcatatagcagtggcccccacctgcttcctgttcccacttttgtgccatctcccatttcttccttcacactgatgcttgttcatggttctgaaattttactttgttcataacacctctgcttaaaattgtcaagggtttgtgattaaattcaaactctgcagtgtagaagtttatatcttatccaatctggccctcactcctcttctatccatgtttccttacattctctaatacgagttgaggtgcctagaaagcttaacaatattttacatgatttcaagtcctggccttccacatcatgcctgcagcggggtcctgtgtgtggcagcacccaaatatgctcctctgtatgtttgttaacagttgagtagtgctttttatcaagcgcatgtcaagttctttctacaactttcttttatatagggttttttcccccctataatttgcgtagtggaagatgtggtagtggaaatgaagtttcataagaaacctaggacaagttactctggaaacggtttgttatttagaaagtgttttcatagtgaccttgctggaagggaggacgaccacagctcttaatgatatggcagacctcggcccctggataggcaccagctctctgtcctccccacagtggactgcagccacaatgctctccccatgtgagatggaaaggggagctgggtttaattgtagcgcacagctggccaaagacctctacagcaataatctttcagtatttcagtgtaaatttgtgacttatattatgttcaagtatttaaaagtacgttgtattttccaacaataactttataaatggtgcctcttccattagttcaactttgtaacatttttctgtacttggaagctttagtaaaggaaaaacttacctctggatttcagttgagaagtctcaaatcccgatgttttagaatcaaactaaaattcttcacccgcacagtaataattattttaaagtgttaaaaagagagattatattgttaactcagagaggtgtttctctcaagagtgcagaaaaaagcaccaaagcttacaaattcccaagggcatct

SEQ ID NO: 29945 - DNA, 1050 bp, Homo sapiens
accccaaaatgataaaaagatacttccttctgaagcaagtagtacaaatattttataacaggtgtgacaacatgaatcatctctgctgaggtctggataagttttctgcctgccttgtctaagctttgctcattgtttactatgggcctaccttctcctaggctggttccttctggaattcccctctaatacagtctgcaaatgcctcctgctgtttacttgcaaacctaggaggaatggcttctcactattgtgttctccaccctgaagtattagtcatcttcatattttatatactactcatgaatcgggggacgatattcactgtcattatcagcagaggaacttcctgtattgaaatctaagccacaagtggatccttctgtggctgtcaacatggataccattacactacaagtgcttcaccattaaatatcctgccaaagggctgtagcttcagaatattgaattttatcacatccaatagctcacaggttacaatagcaatcccacctttttagttattctttgtgcatctgttttatttctgtaccatagtcccagtgcagcaattgttcttttttttatatatatactttaagttctagggtacatgtgcttcattctcagcccttagctcagggtctcacacatagagggcctcagtaaacgattgtcccaagaataaacaaatgatcctccaagtgttacagagtttaggaggcagatgagcttctatatctggactcttgagatggatgtgcatttattcagccttaacgtatattttatagctggaaggtgcataattatttatcctttggtgatacttaaactggaagatgattctaagaataataatgcaacttgtttctctgagcttcatcacacccagcttttcaagtggaactaaaattagtaatgagtattggaaacattgccagtgaacatatgaaaggagggcattcagctaatttggggctaccagaaaatgctctgccaggcctcctggataaatggggagtcagccgtgacagctgccgcttgcaa

SEQ ID NO: 29946 - DNA, 1044 bp, Homo sapiens
agtgcacatgaaatatattgtcctgggtgaagggaaatatttgcttcaggaaacagtaaaaattaggttggaaatacaggctgggcccaattatggaagccttttaactcaagtctaaaacatttgggattgattttttttaagccaacatttactaaagcctaattcatgcaacactagtcatgttcctcgggcaaaggacttcatcatcaaatttttataatgcaacttatcccctttggagattctcagtacacattagcatgctaaatatccttcatttttaactcagcatttctcaaacttatttggtgataaagcccttgtctcaagttctatctgtcagtgtcttaaagacttcgggaaactgttacaagcagtgaggtcactagatagtttaggactcactcggggactcagtgattggttctgtctcctctgccctccgtgttcatatattactcccagaaaaagaatgtgaatgcctgaagtattagtttaggaagaagttggttgtgaaggtctgtttcaggtttgacacatatgagatcacagtaggatgctcaaatggaaatagctagtaagttgtcaaaacaattatagtgaagcttcagatagagatgaggcctacagatagaattggctgtcatccaaatagaagggccgcttgagtggatgagttctctgtaataattgtttccttgtaacaccccatataatttacttatgcccatcacttgttgtctgtgtttctcctactagagtggaaactccttgagggcaagggacctttgtttgttcataacgtttcccaaatgccaagaacagtgtttggtacaaagccagcactcaataaatatctgttgagctgaattgaatacagaatgccgcatatttatttgttcaacaaacgagctcttactctccgtctgaccaggagctggagattccacagaaaaacgggatatggaccctcccctaagagggctccaggtcaagtattggagacaggcatctaagccactcataagtgtaagtgcagcc

SEQ ID NO: 29947 - DNA, 1034 bp, Homo sapiens
ttccaggataatatttgctacagatggtgtttaaggatggtagaatgtaagtgaggcatgaggaagaattggaaagatctgtgtgtcatttctgtagaatggggtttttttttcattcctgtatgtcactggtttaaactttctttagaatgagtgctgacagggaatcttgaacgtgaatttaggtctaagttgagctaccagtattttcctggcgggagggcatgggatctgtcgagttcctcccattactttttgtttgcagtgagctaggagaggtggcagcgctccaggcagatggccagcagtaaacacacagcaggaggctcccagtagcacaaatgcttagggagggtttcagatgaccccggaaatgcagagaagaggaaatgaaggaggaagccaggaagactgctgaaggagctctgaaacagtccaaggcttgagaattacctgggatgcttaaacatgccctctcctaagcctcatcccagacttcccagaccagaatctccaggcttggaacccaggaatctgcttatttaacaagtttcttgggggattctgaggcacacacaaaaaaaccttattattgttgtcctagaatcaaaagctttcctgatgcatcaccatagtcatttgaaccataaggaggtagggtggccagccatcctagaagcaagacattcagtgctaaaaccaggacaatctgggcaaactgggaccattgatcaccctgagaggagttcctgccactaaaagtgtcgtttcattgaaggatgtctgtcccagtttttatgaatctttacttgcctagtttagtttttttttattttgaaggttcttttaaaattcagaaatgaacaaagaagaaataaagtcatctataactgccacacccagaattatctactattaacatcttggcatacttacttccagtcattttttttcttgaataaaaaagcattcatttgttgttataaatctatcttttttaaaatagaaaaatgtttttaagtgacccaagattc

SEQ ID NO: 29948 - DNA, 1031 bp, Homo sapiens
agatggagcattgaagtaataacttaccgatacaattttgactgtgatgtgatttttttttttattgagctctatgaaaatggttcaaatgagttgcatctcattttaaatttgttagaaccctacctggacatttctcgggactcattataacttttcaggcaatatctgggtcttacttattagcaaagtgggattaaaccagatggggcagaaaagggttaaaattaattggattaattcaaagtgaggaaatattaagggttgccattatgtacagattagagagcctatagtgagatggtgagttatagagagatggagagttatggtgggaaagttatggtgggaagtgagaagtccatagaatatggtccgatgttagaggctttttggcaaaggatgatgagagattccaatttaaggtatgcattttcccttattcacgatcttcattgctgaagttattgcaaacaaagaaaaatttactgtaaaataaaggataaaggactgagaaattatttcaagtgccgtgaaaaacactgctgatgggtcactttcctcctaaaaattttagatagttgagaattcagaagaactcaattttacgtaatatgttacagttatttttgaattacaaaatctgataattgtgagcattgcctaggttaggattgagaatgaattattactgaatgctttttggcataatctgtacctgtatgtttttagacatggaaaaagagaaagagtaacctcccaccctggctaaactccacacttctcttttactcctccaataaaaatatctttaattttttttgaaaaagtgctagattgagaactttataacccttgggaaaaaaatctgcaaaagggccagtctttgcctctgggggttataaaatatgataattaatattatatgatgacattgctcagagctatcctgttcatcaaataacttgtccatttttactaatatgattggataaatgttttcattcatattggggtgccaagtccactca

SEQ ID NO: 29949 - DNA, 1156 bp, Homo sapiens
acctttgaatttttaagatacatgaactactacatgtccttatttgcttaagtctccgggtaggttcctatcccttgtaatggcttagcatataatagctgagagtcttcatattttgatgtagacttcctttcttgcttgtcttccttttgtttgttaaatttccctgaatcatcaccaaaacacattgtaactttgaaaaactctttcccttgggaaccgtcatttgatccatatagtggctatgtgatggtggttcaagtgatactgggcaccaagtaattgaacaagaatttcctaaatgtgtttggtggaatactaaagtgagacttctttttcaaaattttgtttttattttctatttttaacatttttgtgggtacatagtaggtgtatacatttatggggtacatgaagtgttttgatacagacctgtaatgtgaaataagcacattatagggaatggagtatcccctcaagcatttgccctttgagttacaaacaatccaactacactctttaagttattttaaaatttataattatgttattattgactatagtcaccctatccctatcgtactataaaatagtaggtcttcttcattcttaccatgtttttatactcactaaccatccccatctcctccccagccgcagccgccggccaaccccactatcattcccagcctctggtaaccatccttctgctctctatgtccatgaattcaattgtttttatttttagctcctatttgttttctggtttatctttcttccttctttccttcctgttttcccctagtgaaggtgatttttctctggcgatatgattcagcttcttggtttttattttttgtgcattcattgtatgttttttggtttgaggttaccatgaggcttgcaaatactatcttataacccatattttaacctgataacaacttaacactatttgcataaacaaagaaataaacaagcaaaaggaaaactaacaaaaactctatgctttaactttactccctcacttttcaactttttattgtttctacttatatctttttgtactggctatgtctggaaaagttgttgtagttattatttttgattgtttcatcattcagtctttctacttaggataagagtagtttacaca

SEQ ID NO: 29950 - DNA, 1044 bp, Homo sapiens
accctcggttttgcttgatcaacagctaaatttgatggtttcttgagggattcacagccaacacttgccttcacagaagttacattctagtgagagagacagatgatgaacaaacaaacacattgtataattgaaggtagtgataagtgcaatgaaggatcctaaaatggggagaggacagagaactctcagtggcaggggctactttaggtgaggtgctcaggagggcttcttccaggacaggaaatttaagcagagacctgagggcagtgagatctggggaaagggtgtcttagttaaaaagaataggaattataaaagtctggaggtaggaatcactggtatattcaaagaagagcaagatggttgaagcatgatgaagagaactgaggaaattgagtttggagacataagagggagccatgggaagatggttgagttctgttttaaatgtgaaggggaagactttggagggttttaagtggagagtgacatgatctaagttagatttttgaaggattactctggcagctctgtagagactagattgtgggagcatggtggtgatatggtttggctgtgtccccacccaaatctcatctcgaattgtaatccccataatccccacgtgttgaaggagggactggtgagaggtgactggatcatgggagtggtttcccccatgctgttctcatcatagtgagtgagttttcatgagatctggtggttttataaggcagttttccctgctcttgcttgcttttctctgcctttcctgccaccctgtgaagaaggtctttgcttccccttcaccttccaccatgattgtgtttcctgaggcctcctcagcaatgcaaaaccatgagtcaattaaacctctttcctttataaattaccaagtctcgggcagttctttatagcagcatgaaaatggactaatgcaggtggattgggggcgagcataggaggctactgtagaagtcaaagtgaaaaagggttatggccccaatgtaggcactctcagtggaagtgctgatgggattt

SEQ ID NO: 29951 - DNA, 1025 bp, Homo sapiens
atgtgctgaagttgtgatttgaaaaaaaatcacaaattaaaactggagaatgtaaaaactgaggcagaatgtttcagcacaatttatgaggtttatttaaatactgcaattcttgctaataacttgtgaacaaatctcaacttaaaaaaagtcagaatgagcaaaagattattttaaactcttccattatcttctattgcatccctcactattctcacttaccatgatagcctttcctgggagccaagacttcctgagatgctatacaagttaaggcaggatggagcatcaatcattaatgtttctttagcaaaattctgtcttgaaacctgactttatttgtccaagagatccaggtggaaacaactgtttcgttgatggtttttttggggaagaactggctcctacctctagaatattcgggttgtagaagcagccaattagttgccttaggaaagaacatgaagacagattgagaagttactgggttggggagcaatggtttaagtgtggctgttacttctttctatgagcacctgtgcacttctccccactaacatgcactggcctggcatttgtctattttctggatttctttggatctacatgatgataaatggctgggtagaaaggccaaccatccaggtgttttaactaaatgttccaggcatttcatcaacatttattgagtggttcttacaaataagggtgagtgctaaaggcattgggagataacaaggtgaataggatacattttctattcttaagaagtttgcagcagagtcaggctttgtgcagaatccaaaagaccttaactggatcctggggatttttaacaaattcaatgggtacaagtggaggaaagctatggtttgacagactgtatgtctataggccatatccatgaatcagacagagtagactctttagcctgtttcttcaaaaaacgatgtccattgcatagggttgaaagatcataattccagcaggaatttgcaacttcgctgactgatgcatttctggtg

SEQ ID NO: 29952 - DNA, 1014 bp, Homo sapiens
tttctattatagaccttaaaaaatggctctgcatttcatttattttgacttgtgttttaaaatttgtattttatttttctctaatctctgagcatttagaagtatattttaaatgttaataaatactattttaagttattcttttaatatattttaaatgatattgcattttggtgagggagtatggaatatatgatacgtatttttttgaaatttattaatactttgtgccctgatacttgattaatttttgtaaatgctctatatgtgttgaagataatagcattctttaattggagcaaggttctttcaatgtccattaaattcagcctgttaattttgctattcaaatctatatttctactaatttcgaccttttaattagtaagataaattttaaaaatctcctattagaatggtgaatttattaatttcttcttgtaatcttatgtatttcaaggctattttatttggtacaataaattttttaatcgttttctctttctggtctgagatatatgtatacactcttgtctctgtctctgtctgtctgtcggtctctctttttctatatgtcaattttttatccctaataatgctttcttgccctaaggactgtgatatgatataatatggctattcttccttttgatcagcacttgtctgccgtatttctgtatgcttttattttccacttttccatttctgtgcatgtaggtgtatatcttgtaaacaacatagagctaaatttctgttttccagtttgatttactgtaattttattgataatatagcactttttttattcttgtcttcattctgtttttaagtgtatcctgtttttcccctagattcgatttttcttcttatttaaatttttttcttaatttttcccctctattagtttagaatttatattccatttctttttggttagtgatcagcctttaactattaaccaagtttacaaagtctaaatttaatcagtatctttctcatgattctgttcaatgc

SEQ ID NO: 29953 - DNA, 1039 bp, Homo sapiens
actttacaagcagcactctggagtcttttctgattggtaatcacagtgtttccttattaatactgtaaaaaatgtaaaaggcataaacattttgcaatctctctgttctttctgtgtgggcatacatcaggggctgctttaagcattcctaatggctcacccatcacattttttatgagtttatatgggaagaaaattgtaccagaaaactgaattcaatgactgccattctatgaataaattctgttatctttgatactctgggtataataaaaacatacaaaagttaaatttcagcatccttgcagagttatgtcaactgtttttaatgtcaataagacactgctgtttcaaccaatgtcttttccctccaaaaaatactgcttgattttcaggttatgttttcattaaaacaacttgtttttaacagcaagatgctgtgtatgtttgctaatttatgtatactacaaagtctgatcaaaatgaagagttataattttaagacatggagctcagtaaaaattcatctttactttggatgaaagattacaataaaagtcaggtgtccataaaatgtgttttatgtaagttagaccagaaaatatcttggtagagtaactttgatcaagcaaattattatatatttttgtatttacatacatctccccctgtgattagaggagatattttatactgtatgctataggtatattctataagagttttttccttatgatcatctatgagttttttttttttcaaaaactgcagtcatctaaatactttaaaacaagagtagattctcctaaactatccaatttacacatttgcaaattaattcaaggcatttcctttatatgataacaaactctggtttccttattatatatgggcagcctgaagctcagagagttccctcaaagtattgacctacagatagctgcccatccgaaggtctatcattttctttttgggagaatttttacctccaaactgtccaacttgtctaagcatccattttcttattaatggcctagct

SEQ ID NO: 29954 - DNA, 1048 bp, Homo sapiens
tctgtggataaagctaatatgaaagagcactggcacatcaaatgtcttaaagaccatgtaggaatgccatgtctccatttttcaaaagccgcatcctcctattttgttgaactctattaccttgtttaaatttttattgcattcccacatagtgttatgcataactatataagaaatgccacaacggattaggccaatggtccgtcttgcctgcctctgagggacattttgcagggagctaaggttgtctttcttgatgttactctgaaaacattaggaattggctgcacatagttcttacatccccctcctttaatattccattatagaaccagcatctgagaattttcctaagccttttaaaatttatttatagtttcaccctttgttatacttttgggacaataagatcactgtttgatttgaataaaaaaactgctttcctcaagtttcaaaagttggttcctgtggcctagcattttgaggtttgatccacaagtccgtttacaaaattcccatcttcatgatttcctggaattcagttatatagtaggctgcttctaaactggttcctagtgatctctaaatcctggtatttataagcctttgtgtaaattcctttcttgtgcttgggctggacccaatgacttgcttctaatgaatagaatatggcaaaaatgatgaaatatcaatgtcaagattaggtaataaaagactgcgactttcaccatgcttgtactgtctctcttggactcctttcacatgccttctctgcaatagcaaactaccacattgtgaactgtcctactgaggggtccaaatggcagggacatagggtagcctctcgccaatggccagtgaggaactaaggtcctcagtccaacaatccttgagaaactgggtcctgccagcagttacattgagcttggaaaccgatcctcccctagttgaactttcagatgaggcaatagacccagctgataccttgattgcagctttgtaggagactctgaagggaagttgaagattactggggacagttttagaa

SEQ ID NO: 29955 - DNA, 1205 bp, Homo sapiens
ttgatgagctcaattttttttttcttttatgagtcatgcttttgatgttatatccgagaaatctttgccttgtgcaaggtcacaaatatttacttttgtgtttttttttctagcaacttaacaattttcaattttgcatttaggtctatgatccattttgagttaatttttgtatgtgatgcaatgtatagaatgtagttttgttttggttttgcatttttgcctataggcacagttctagtaccatttgttgaaaacagtatcccttctccattaaattattcatctttttacctttcttaaaatctcttaaccatatatatgggtctgtttctggactctccagcctattccattgatctgtttggtctgtcttgaataccacactgttttggttattatcgccttatagtaaatcttaaaatcaggtagtgtgagtccagaatcttattcaaagttgaaaacaacataatgtaaagcataaatgtattttctagtcagtgttagtgtatgtctaacatacactagtctagtctagttagtgtatgtcaagtatatacactaactttggatgatgtagtaattgtgaatgcggaccaagtgagatacacccaccttcaccctggggattttggaaacactgtaggatgtgtatatgtgtatgaaaaagaaaatgagagagactaacatgatggccagagatctgaaaactatttggatctctaatcaaataaaatgtcttgttaaggatatagatattcttattaaggatataggtacatttaaaaaatcctgtctttatatttttatggacatgtctacaaatttaattcagaaaactctaactcctttgggctgctgaataaagtttctaggtagaaacagaatgtgactattccctattgctcaccatgagataggacttaatattaaaaacttgcttgatgcagcgcttgactagttacaagtttcctctatgtatgtaattgcgttaagttctcacaacaacccttgaagcaggtcttcacctccccattctggagataaggcatcttcggagtcttcaaatcactgactcactgttactggcagaaagcgtctgccagtttgagttctttgtagattctggacaatgagaacacttggacacaggaaggggaacatcacacaccggagcctgtcctggggtgggggtaacggggagg

SEQ ID NO: 29956 - DNA, 1025 bp, Homo sapiens
agacaagaagtgtatgatttctgaaacaattagtcatttctctctggttgcttttatagtttctaattttctgttgagattctctattcacttccttattgtgtttatgtttttcctttaaatccttgaacatatttatactagttatttgaaagccctctgtaaattgcattatttctttcattttaacctgtgtattgtccaatttttcttctagttgtgagtcaaatgttgttacttcacctggctagtactttttgatggcatgctggacgttgtcaatccaacattcttgaatgtttggattttgtcctcttaattctggagtcttgaggatttgtttgtttgtttgtttgtttttggttttgtttttctccctggaagttagtcaatttacctgcaggtcacctcgatccattcaaagcttgttctaaaatttgtgagaaaagatttagagtagcattttgcctagggttaaaataaccctgttcccaagggttgaactttctagaatctttactgaatccctaagatgctcagttaagcctttccaacctcatcagttggaaccaaaacattccccagtcctgtgtgagttacagaattgttcttttctcagtagtttttctgtgctcagtctcatggtgtttaatcctgaacacgtgcaacttagtatttgatcaaagattcaaggggacctatatgccagaggccagatgttcaggcctaaagccattattgctttaggacaaatagttatattgattgcttattttgggatttcttcaccatttatgatatctgtatttatttttatacctcatacctgcatgtggcacagacttgaggtactaattcctctttggagaatttttttcccattggggactctgagcagatgacaaacttcttattggatcagtaaatggaaattttctaagctctttttccccaaataaaccattcttagagttctgcattccagttcttcaacttgtatgtgttcaaggctatgtgtcctatca

SEQ ID NO: 29957 - DNA, 1037 bp, Homo sapiens
ttttgagacacattctaccttgctcctagctcaataacacacttgcataagctttcctctattcctcttatttcttgcctgtttcccactccttttcattcactttacaaaatagcatatctgtattcaaactcttgtctcaggctctgctttctagggataatccatacaaaatcatacaatcagttcccttgacatgagtaaatgcacgcattcagctgatcccaaactacttcttcagtctgtgggcagcccatggtttacttacagcttctctctcctgtctttttgtgcctgcagagtcttcttggacagcacctaagatggtgcctatttcagcactctctttgcaaagaagcccatttctggtgcatagaacacatacaaatcctaagtgacaaaaactctgggcatgcaggctgactcgaacgcacccatctttctttgttctactaccagtcagcctctcttatgttaaatttttcaggaatggggaggacacaaagccactgtggcagcaaggctcaaaggactcattttaaactctccaagtattttcctcaaaactcattccctgcccattatggtctccactttgagggcaaggtaggattcatagcatcacagcagctctctccaaaatattaacttttaatttgacccttttatcttctccaaatttctttcgtagtataaaggtggatcttcaactaagaattgcaaaaactggttatcaaagactacctttacatgtcctgcatagatacctcacaacttgatttgaattgtgacctttattgtcttgggacctcagccaagaatagttcaaactgaatattattacatatacaaagaaaaatagttttatgggtgctctgagtccaagatctgattaggatacagaactgtttgattgtaattaatgttgtggcatatttgaaataattataaggatggaaagttcctagtgcttaaagaagagtgagggagataacaaaacattaaacttaagctctctctcaattttaggaaataac

SEQ ID NO: 29958 - DNA, 1070 bp, Homo sapiens
aagccccgcctttgactaatgccacgaatgcatgctgcatctcctcaaactgttctcaaagacagagacttatctttccttatgctttgttcaaaattacagtggttctcttatttgtgtgtgtgtagttatatatatatttatttttccccatatcatttcataagatattccataaggcttttgtctttaaatgaagcatttttttaaaataattaacttctagtttacttttagcttttaggtggtgtaaatctatataaaaagtcaaagctcaagaggtcacttagtctacctcaaaataccattgcctagatttttttttaactgaaaagatctctagtaacatactacatcaaaatagacttttatgaagtcagagtgcttctacatacattcttgttgcaatctaaatgctttcttctcttttgtgaaaaagtattcaatctttctaaatagctgagtaatttagccagcaatcttttcctgtggcaaatgctaagtaggtctcatattctaaccaatatgtaatatgagtctttaggattgaaaaataaagaaatgttcactagcaatatattatatgcataggatgatgtggtagttaagagcataattttaggttcagttagaagctcagcttttgcttccttagataccttgagctcccttagcctttttcctcatctgaaaatgggataatacttgaacctactgcacagagttaaaatgagggtaaatggaaataatcaatacgaagtgattagcatggtgtctgccacacagtaagttcttaactgttactctgttgataaagttatcattttaatagcccagctgttctactggatactctcaaatgcattctacttatggacctagaaatttccatattccagaggtctacaggaaaaggcaagttatacaaaagcctacatttttctgattccttgttcactcattctgaggacatttgagttacatctttttaaaaaacttttctttttagttttatggatacataataattgtacatattttgggaggtacgtgtgatattttgatacaag

SEQ ID NO: 29959 - DNA, 1125 bp, Homo sapiens
atcagtaaacatgattcatcacatcaacagaatgaaagacaaaaatcatatgatcatctcgatagatgcagtgaaagcatttgcaaacattcaacattccttcataataaaaagtcttgatgaactaggcacagaaggactatatctcaaaataatgaaggccatctatgaaaaacccacagctaacatcatactgaatgggaaaaagttgaaaatctttcctctaagaactgcaacaaggcaaggatgcatactttcaccactcctattcagcatagtactggaagtcctagtcagagcaatcaggccagagaaagaaataaaatacattcaaattggaaaataggaagtcaaattgtccctctttgcagataacaggatcttatatttagagaaaccataagacttcaccaaaaaaactctcagaggtgataaagaaatttagtaaaattctaggatacaaaatcaacatacaaaaatccgtagcatttctagacaccaataatgaaataggtgaaaaagtaaccaagaaatcaataccatttagaataactacaaaaaatctgagaataaatttaaccaaggaggtgaaagatctctacaaggaaaactgcaaaacactgatgaaagaaattgaaaaggacacaaacaaatggaaaggcatcccatgctcatggattggaagaatcaatattgttaaaatgagcatattgcccaaagcaataaacagactcaatgaaatccatatcaaaatgccaatgtcatttttcacagaaatagaaaaaacgatattaaaattcacatagaaccaaaagagagtcagaatagccaaagcaatcctgagcaaaaagaacaaacctggaggcatcacactacctgacttcaaaatataaggttacagtaaccaaaacagcatatgcatctaaaattagaattaaaaataaaattaaaattagaccaatgaaacagaatagactaatggatcagtatatgtaaatccacatatttagagccaaccgatttttgacaaaggtgccaagaacatacattggagaatgtatacccttttcaataaatggtgctgggaaaattggatatccttgtgcagaagaatgaaaccggact

SEQ ID NO: 29960 - DNA, 1025 bp, Homo sapiens
ctttttatttttctcaattctctctggtccagtggaaacccagctttccttagacatgtatgaggcaagtatgtgggaactcctgttgtagttggcctttctggaaatgggaattttaaagtaacaccgcctggctcaaagtaaggagagtatacgattttgttaaacgaaatagtctccagatgcattctgtgaggcttgcagagaagagtatcttttcacacttgatctgtaaaatcaagttgcttattctgtgcaggacactaaaccacatactcccagattctggaatgattgtccaatatggtgttacattaagatccatgaagaggattacaatttgttaatattttggcataaaattttattatgtctttctcatgttttccctattttttttttaccagaggctatcgtgatgagtggatttttagcaaataaataaataaaattcagataaatatttagccaatccagacagaattagtccatgcagctgctttctcctagacacactgacagcattactcagtctctgcaggtttcatgagccaaaaagttaagagagataagggcagagccctttcttctacgttggttctccagtggtcagtagaacatttctccaggatatagcacccaagcactgggtgtacaaaaatagcctttctgaaatcggggcggggtgggggagggttcttagtgtaagaaggaatcatttaaatcctcgtggtcgtggtcttggtttacttcaatggaactctctctagactgaatcatttcccgaaggaccatcaagcgaagtgccaatttaatctcaaatcctcaaaggaaaagcttacagttgtcagtggcgcgtccttctcaggatggaaataaaacagctctagctttctgctgggccaggaagcattgattgcaggagagagcaaatgctctcacagtctaatcaatctcacagagcagatggatacagcaattagtgcaaaaacaattttgccaagaatattaacacttctagagtt

SEQ ID NO: 29961 - DNA, 1105 bp, Homo sapiens
aatgcttgtttgaggctccggaataagaactaaaaaaaaaacaaaaaacactggtttcatgcttacggggtacacactttggtgcatcccgtgaacacaaattttaataccaaacaatccttgatgcttcacctggggctgccaagcagtttgtaaaacagaggaaaacatttagtgcagtctgtattatccttttccaacttttctgtttgtgcaagtttttgaagattcattggccaaacaatgaacaacaaaggttttctgagagaagacaaggtggacttttcattttgttagtaaataccagtggcactgttgaacgaaacaaatacttttatctcagtctttcaaatcagtattaatgtctgtgtttccttccactgacagctcttcttctagtttcactgaaaaaagggtgttagtatttttatcttggacactctcttccaaatccttcagcagctcctcttctttatattctgccacatcgacctctaaaccggaattgtccttcagtttgccgtggtgcttgagatagtaccgctggttctgaaagaacttgatgatggtgtacttgggaaggtcgagctgggcagacagagtctggatggcctcttcgtcagggtacaggcccacgtcttgtatgaaactctggaggattcccaaggcttccactgaaatttttgttcgtggccgggtcttctgtcggttttcctcatctgactctgctggagaggccaccgtgggttgccgtggggggagccgagggcctgtctgtggctgctgctgtggctgtggaggcggcggtgcctgctgctgctgctgctgctgttgctgttgctgctgctgttgctgcaaagaaacaaggagacaatcagagctctgctatcgtggagttccacacaaagccgtctccaatcaggaaaaatgtggtcccggatcctacatatagcttctttgatagggatgaagatttagaaagaaaaggtaggccggcgaaatggccgacagcatttacaaaaaaatcaaaatgatatgactaggaagggatgaattaagacagctttggggggctactgcacttacttatcagagatcagcagag

SEQ ID NO: 29962 - DNA, 1035 bp, Homo sapiens
ataaaggagaatacagcatgtattcatgctgcttttttcccctcatccatggttattgaattcactggaagttattcatcttttttcagttgatcatcattttatgccgagaccacaattccaaacatataggaattttttaaaattatgaattagggttcttttagggaaccaaccctcctttttaaagatacaagtgcccaccacaactcctagttttgtaaagcaaagcaaaaaggtataaatgattataatgagcaaaacatagtaaaacgttttccttcttggatcactttctgtccccacaggtcccaggagacattaaatcctcctgccttaatttaccaaaatgctgcatttcctaaccagtaacaatatctgtgtctgagaaagacatcaggtttggaatggaaaaaaatacattctcggtatttaattactgcttaacagtaatttattgtagcaggcagttgattttccaattctgaaagcctgaaatgaagctgaacagaaatttgaaatttttaaaaaaggtttttttttctttcttacactcttatatactcatctgcttccccaagttatcagccaagcccctataactgaaagtatgatatgctcctctgagttgaaccgagaccattttgcccctcattttttgaatttgctttttcctcccaatagtcttgtatagaaagcacatgggctctgttagaatacagaattatgcaattctgggtgcagtgcattaaatgacatagtttgataaactcttaagccttacagctcagatgttaataaaatattgtagttggccacaaatttcatagcacaaggctaagatcatttttcagaagaaaggggcatttaatctggattatttggttagttgctatggtctgaatgttagtgttcccccaatattggggttcatgtgttagaacctaatatcaaaagtgatggtattaagaagtagggcctttgggaagtgattaagtcatgaaggcttcaaccctcatgagtgacaggagtgcc

SEQ ID NO: 29963 - DNA, 1044 bp, Homo sapiens
caatgtgaagaatatatcctctgtccaaatgggatagtaaatgccattggtgcctccattctccaaagaaaagcaggaaatttagatgtatatgaaaaattgaatattaaatgttgtcaacttatccatattttgaagtacactgttagtccttaagctaattttgacctacagacaaattttgtatagcttttgcatgtatatttctactgaaggtcaaagtgtttatacccattggagaatagtagccactctttatctgcaagttatatgttccaagatccccagtggatacctgaaactgtggatagtactgaactgtatgtatactgttttgtcctatacatgcatacctgtgatgaagtttaatttataaattaggcaaagtaagatattactaacaatagctaataataaaattgaatagttatgatacactgtaataaaagagactatgatctctctctttcaaagttatcttattacactgtactcacctattttcagactgcaattgacctcaggtaactgaaactccagaagagaaacctcaaataaaggaagactattgcctgttttatctcaacctatcccatagccatgtgcctaaggactgtcttgaggatatttaatttttgtcatttttttaattgagtccactaattacttactcttcctagctgctctcttgctttcatgccagacttgctgccactcaatagtcagaaatatgcagcaacaccccacactttcctatagcaattataatgttagaaatactaggtatcctttcataacgcatgctgaccattttcttgtagatttggtcccatgggtacatccagattcttaaagtcattcaattcactgggccatcaggtctttaagttcttgacaacttggctgtacagattacaaattttattcgatcttcttgactgaaagaaagtcaacgttcctgggttgttttgtctaacttataaacaataacaatcatccattttatgtgttctgtgagttttgaatatgaaggggcagcatgag

SEQ ID NO: 29964 - DNA, 1050 bp, Homo sapiens
caagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgtcaccttcttatttcagaccatcttctctccccagaataccacaacagcctcccagctaatatctctgatttgactctttccataccaattccttctctagacattggcaaagtgattttctttaaaaaattgaaattagataattttatttcttgctaaaagcttacaatgacttcccattgtgttcggggtaaaatacaaatatctaaccacagcctacaagacccagtatgatctaactcctgtccatattgcctcacttatgctccagctcttattagttacaggaacacaccaagctccttcccatcctacggacttttactctgttctttcctctacttgtaaccagactttgcatagctagatccttccctttcttaggtcacagcttacatctcttgctgaccactgtatttcaagtggattcctcttcttttattctttattaatccttattttttcacagaacttatcacagcttccaattattttatagtatcgattgccacttgccattagtttttgaccatccaagatctaaattcccatatatttagagattctcctatataatgaatctaagcctatcctcaacatggaagtcacaagtgcaaatactgactttctcagagtcttctgcatcttggacacatgacctagatcataccattcagatcatttttccccaactttgacttagaagctagtgttgttatgaattttggtgagagaggtggcagcagcagcaacagcagttaaatccatttttcagaaactgcagagcctgtggttatgatgaaattggtacactgtccagctctaatgtggtgagaagctcaaggctggatatgtctgttcaacagtggcaa

SEQ ID NO: 29965 - DNA, 1045 bp, Homo sapiens
caacaatctaggttttaataagttttccagatgattctaatggcatgttacgtttgagtagttgattttacattggtactaacattgattcacccatacatggaataattggggggtttttttgaggtgtggtgtttgtcagatttttaaaaacattgttgactgggcgcggtagctcatacctgtaatcccaacactttgggaggctgaggcgggcggatcacgaggtcaggagttcgagaccagcttgccaatgtgatgaaaccctgtctctgctaaaaatacaaaaattagccaggcatggtggcgtgcgcctgtagtcccagctacttgggaggctgaggcaggagattcgcttgaacccaggaggcggaggaggttgttgcaatgagccgagatcatgccattgcactccagcctgggtgtctcagcgagactccgtcttaaaaaaaaaattgttcatgcaactaacctagtttgagaattacatgtattatgtactgctcacattacatgttatctgtatctctttataggagaatgccttcctgttagccacctgccagacatctttaggaaagtatgatccctctgtccaatcaagagtattctgctttttctctacttagggagtacccatagttttcagtcatctgtaccactgctgctctcctttcttgtcacaaatgatcaaggcctgataatacacaaaattaattaagaaatttagtgtaggccgggcgcagtggctcatgcctgtaatcccagcactttgggagggtgccagcacactggcagatcacgaggtcaggagttcgagaccagcctggccaacatggtaaaaataccagaattagctaggcgtggtggtgggtgcctataaccccagctactcaggatgctgaggcaggagaaacatttgaacccaggaagcggaggttgcagtgagccgagatcgcgccattgcactccagcctgggcgacagggcgagactccgtctcaaaaaaaaggaaatttagtgcaattattaactcttaagtgaag

SEQ ID NO: 29966 - DNA, 1028 bp, Homo sapiens
ctctgccgctgaggcaccgtgatgtccatcaaacaaaccaaaaaaacacacattaggtttgttaccaaaattactcactacagtgaatttatcattcatgtcagctttccatgtagaattcctgtcttcacaaatgcccactcctttaattaacagatgacatattttttgagaatatatgacactcctgtcaatgttatcaaaaatcttatagtatgctggtatttgttttttccaaagcagctcaaaagcattattaatgctctgtagggttttttcagtgaacataaaagatgacaatagtttagaaatcatgaactgtctctgaacagcaatcactgagggctgtggtttctttctacccatccattggaaacccagcgtggccagagctacatgttgcttcttatggagaaaaataccagttaggtcaatttcgtgcttgcatatggaacagggtaatgtggtcccttgctcatagacctgctcctcttcatggcgtttggtgtgtctcactggtcttgactttttctttctaaaacgttttcttttgggtaaaagtagaatatcctcatctgaatcaaatgttgatgttttcatattccattctcttgatttccaaaacactctgcaaacaggatgaaagatatttacatgccaggatgatgcagcgaaaatctcttcaagcaggctgttatcattgcaatttgatttggctcctcacaatcttatataagcctaggattaaatattctgagtcatatttctcaaaaaacatgtaagtactcaattaactggtgattgacctgtgtctccctgaaataaattaggcaaaaattccaaaaagtcagctagacatctaagcaaatgctcagataaatcagcacagtattttaccttagacatgcgaaagtatgtatttgagacctgagattctgatttctaatatggacatacagtcatgtattgcataatgatgtttcaggcaatgatggaccatatgcaacggtggtaccaaaagattataa

SEQ ID NO: 29967 - DNA, 1024 bp, Homo sapiens
tccaccccagctctgccacttgtgtgatcttaggcacaggtcacttagtttttctctgagcctcaatgactgcatgtataaagtggtgatcatgacttcaaccttaaagttaaaagaaaaaagtgtccccagaattcctagaacataaagatgctaggttaatgctggctaaataaacggaattgcctggtgctttactcgtatatcagagtcagtggccacaaagcatttatggagaacccagttgcttgggttctcggcaaggtgccacatttaaggagtttcatgggtacaggactataaaattagtcttaattgaaaaaataggcccagggcatggtggcttgtgcctgtaatcccagcagtttgggtggccaaggcagacggatcacttgagctcacgagttcgagaccagcctgggcaacatggtgaaaccctgtctctacaaaaattacgaaaattagccgggcatgatggtgcgtgcctgtagtccctagctactcaggaggttgaggtgggaggatggcttgagcctgggaggcagaagttacagtgagctgagatcatgccactgcactagaccttgtctcaaaataataataataatgatttataatctagaagtagcactggttgtagaatatacagagagcagaggtagatgtgccaccacaaaacaaaaagcatcctctgttggctaagggctggtgggtggggcactagaacaagccttatagttggagagcgcccccaacacctttgtatttgtcagtcactcccccagagagcaaattgtctttttcatttgtcagcatttagagcagtggctctcacccaggagctatttaacctcccaagggacatttgacaatgtctggagacattttcaatctttgcagttgggaggagggaatgcaactggcaactagtgagtggaggccagtaatgttgctatacatcccacaatgcacaggacaactccccccaacgaatgattatctggtccaaaatattaatagaatt

SEQ ID NO: 29968 - DNA, 1037 bp, Homo sapiens
cctttcatacgttgagacctgctgaagcatacagtgtggtacctggtagaataattgataatttttcatgcttgccttccatttcataggtcagatcacttaaagaaggctacatcatgttcactcttggctacaaacatagggaagtgtgaagagtatgtggacaaagttaaggaagctttctatcaagtgttgctaaaataatggtgttctagtacaggaaacctgggaaatgtacgtgtaagtagaaacccaggactacatgatgaagccctcttcatttctaaagctgggagctcacagaagtcttggaggagcctgcaagtgtgccttcagctgggtgtgccccgtctcatcttcctaagattgctaacttcttcggttctatgggtttcccttctggtccatggggcagagatgcagctggtgccttggaacctgcaaggctcaaccttagcctagaccttagctgtgtttgtgggacatcaggagtctggcttgtggatttggaatgtccatcttttgagatggactttcttggaactcaccacttcatggacacccactgggggcaatggtagcaaagtgtgtgggtcagctgcgtgagctgtagcatgcagattccagccagcagacaacaaaagaaaacaaaaagcaaagcactcaaatcaaataccacctttgggttttctgtttttctcttgtgtatatggcagacgacaaagtcaggggtgaggggatagctgtcatataattagtgtacattgttctcatgtaaaaccatcagtccacggctgcctgttaaataattttgtctctttctttattccatttttaggccgaggagtcttgtaaatgtaatggctggaaaaaccctaacccctcacccactccccccagagccgacctgcagcaaataattgtcagtctaacagaatcctgtcggagttgtagccatgccctaggtgagttcctaaatcttcaaggaaagtataacgagttcattgtagcgtgagactcttaacttactgaattct

SEQ ID NO: 29969 - DNA, 1021 bp, Homo sapiens
cagttagagtgaggttcacctgggtgttgacatgggttgggattaattaggagactggtaaatctagagataagttaaacaagtctaattctggtcagcatccccaaagagccaggagtagtctctggatctggtagagatggggttgtttaaggaaagtggtattttaggaagactaccctggcagcagagagaacagtctagggggctattttattatagtaggtttgacattccaatggaagaaaggtaggatggggaaatgcagtgtctctgagagagaatgaggaagctcagtggagtctggtggctggtaatgtgtggaaggtaaaggacactaaaggaatgaatgatgggcttgttggcagaaacagggccagcaagaggtagctgccattttgaggagggccatgaggagttcagtctttgagtcattttccgtgatggtggtgcacctattttgttgggatagggaggatggaaggtggggttcggggaagattggagctggagaagaggttagctggtgatgtgtatttgttgagaacagaaagttcagcgctacttcctcagagattgagttaggtgagagctgaaaaggatttttggtcaaaagggatctgtagttggcctccttggagaggggctacattggagggtctgagaagttggcacatttagacaactacgtatttatatagtgtagtcatagctgttcttgtctggctttcttattacagggaagcttctctttgataacaacttgtctggacctttttccacccttctccagcagactgtccactccatctactttcatttgatcttcctccacctcattgtttattctaggaagcttaacctttctcatacaatattctcctgcttcagtgctccccctaccactccagacctgcgtttatttcattctcagagtaagagctatcctcttctgctatgaaagttactcaccctttgtacaggggagcctctttcttctcttctgggaaactgttgctgc

SEQ ID NO: 29970 - DNA, 1034 bp, Homo sapiens
gccttttctgtcttgtcttcataacttgtatgtgtatgtgtctctgtgtgtatgtgtgcacacatgtgtatttaggactctgaaaatccacaaatgtgtatcttattagaacaaagatgagaagcttggatgtgtcccatccccactgtcttgagagaatagctctgtgtaattttttcctgtctcttgcatctcagaccaattttctgtcagcacactcggccagggatgaggcggcaaggttggaagagcgcaggggtgtaattgaatttcacgtggttggcaattccctcaaccagaaaccaaacaagaagatcctgatgtggctggttggcctacagaacgttttctcccaccagctgccccgaatgccaaaagaatacatcacacggctcgtctttgacccgtaagtggtactttctgttccttcttccttatttcctttttaaatgaaagaggaactgcttagatagtgaaagtcagccatagtcatccaccgaatactactgcacctgtcttgctgtggatacagagcttcaccaagctgattttcatgtctgaaagtgctaagagtaattttcaacaatttacaaattttcttgttaatgatgatgaaactttatattttacattgctgatgactctcctgtgcttcattctttatagcagtgagagaatgtaacactaagatgttctgctttcttcataatcaaaatattggttttggtatcttaactaggtgccattattgcccaggtctgtgggcaattattgggatataagacaggttaactttgaaaatccattgcttaaaaaaaaaaaacaaaaaactaggccgggcatggtggctcatgcctgtaatcccagcattttgggaggctgaggtgggaggatcacctgaggttgagagtttgtgaccagcctgaccaacatggagaaaccccgtctctactaaaaatacaaaattagccaggcctggtgacacatgcctgtaatcacggctacttgggaggctgaggcaggagaattgcttg

SEQ ID NO: 29971 - DNA, 1050 bp, Homo sapiens
agatacatgtgcttttatgttcattgcagcgctattcacaataacaaagacatgaaatcaattcaggtgcccatcaaaggtagattggataaagaaaatgtagtacatatacaccatggaatattatgcagccataaaaaagaacaaaatcatgtcctttgcaacagtgtgggtttagctggggccattatcctaagcagattaacacaggaacagaaaacaaaatactgcatgttttctgttataagtgggagctgaacattggggatatatgctcacaaagatgggaacagtagacactggagtttccaaaagaggcaagagagggagaggagtaagggttgaaaaactacctgtcaggtactgtgctcactacttgggcagtgagatcattagaagcccaaacctcagcatcacacagtatacccataataccccctgtatctaaaatgaaaacaataaattaaaaaagatctcttctccatactgattactagaggtacagagagcttaggacgcctcccattcccattaacagtcacttctcaggagcccacaatctttaaggtgctacatgaggtgagtggaagccatctgtaggtcattgcatttgagagtcccttggtgaagagaaggaaactttcaaattgaaacagtcttcagcatattctctgaaggtgtcgatttaagagattgcccttgggattcttttttttttttttttttttttttttttttgagacagcgtctcactctgtcacccaggctggagtgcagtggcatgatcttggctcactgcaagctctgcctcctgggttcgcaccattctccttcctcagcctcccgagtagctgggactacaggcacccgccaccatgcccagctaattttttgtaatttttagtagagaaggggtttcactgtgttagccaggatggtctcgatctcctgacctcgtgatctgcccacctcggcctcccaaagtgctgggattacaggcgtgagccaccaagcccagccaggtttcttttttcttttttttttttaaga

SEQ ID NO: 29972 - DNA, 1042 bp, Homo sapiens
taagaactgtgaaagtccagcttgggtaatgtagtgagaccctgtctctacaaaaagtaaaaaattagccaggtgcagtggcacacgcctgaggccccagctacttgggaggctgaggttggaggatcacttgagcctgggagtttgaggctgtagtgagctgtgattgcaccactgcacttcagcctgggcactggagggagaccgtatctcaaaaaaaaaaaaaaaaaaaaaaaaattgtggaagtgttaaaaatgtgaaaaggaagagtgaaagggacgcattagctccttgaaaactgagttatttacaggtgttttctatagcatttaaatgtttcacatgaatattttatatatttgtagtaatgatttcagtagcctacaccctttaaagtgaacacacatctatatgcttttctttctctcttctctctgacttaccactatttatttcagtacaagaaaataaagggtatggttgactcagtctagaattctgaatggaaggctgatttgggaatcaatattgtccactatgtgcaaaatatgttaaaactctttgtgtccatttccaaccataaattaactgatttttgcatcctcttcctctggaccatctcagcttcttttgggaaacccccatgggaagctgtgtgactttggggccctttcagcccctgtgcacatgcactctgatgacgtgcagcgataggtctagcagatctcgtcgatcatagcctacttgcagcctgctttctgaaagtgttttgcttggtcccacccgtgaaggttgtgaacttctccagttggataccacctgtatgcatagctgagtctcacaaggggggaaactgacctaattgagcaaggccagtgatgggctgaaatgtgtgctggacaaagttaaagctataaatggtgttcttcagtagggcagtattttttttcttggtattgttcagatgctgagtaaaatatttagtcttgtccccaagattatcttgtatttgaagacaagattgacaaatcagtaatttta

SEQ ID NO: 29973 - DNA, 1615 bp, Homo sapiens
tggtttacattatttcttgtcgtcattggttgtgactaggtaagaatgggtgatttgaggcaatgatgttaaatgtaaaactctctctccctttatgatcatgacctcgaattttctggtcagtgtttacttttaggaaagaaaagtgcttacctggaaatggttaatgttataaagatacatggacaaagaggagaaaaataacctcttaccttatgctgctgctttgggtctggtgcagtagttagaagatggctgtttggttatttttaagacacttatttctgttttgagatgagatcagcattggaaccaggccaacctggagtttttctggtttaaaatgataatcttatgcattgaaggtgagagggccgattaaataaaaattttcccaacgttgaacgcaggtagaatttattgcttggtatgatttctgagtttactgatcttacttttatgtaaaaacaaagataacaattttgtgtaggaaaaattctaataggacttactttgtggtgaatctaatatggttcttcaaatgaatcatgtacagtttataaacttacagtaataatattcaaagaatgtttcactcaaatagaacaaatatttctttgttaggtaaaaccgtttaacctaagactttttgtcactcttaggactgtattacatcaaagccgtttcagatggcagatcattgtttagcttttggtggtcaatgattataagtggatggatttgtggaaaaaccccagtttgaattaaacctaacatcctttgtttcttaggataatatttgttttaatggtctgaatctttaaaaaacccatattattaatatattacatatattatttttgtaaccttttttatgaacaattgaactgataaataagtgaactttatacacttctttgcttaaattttgacaaccccaatcaccggcaaaataaacaactttgttttaataagtttgtttaaggctcatttttaataaatgaaatccacatacagtatcatgtgatgtagactgcaattttgctattagataaatggggaaaggaactatataaaggttattatttaaataaacaaataattgaaccatagttctattaaaagtaaaagaaacgtttaactatagtgtcatctgaaatttggaggtttactttgtctttgagccttagtgacatcattactagttcatatgtaagctcttcataaatagagcaaaatgtgtattacaggttttaatttttaaatgtagaagtcacacataataagcccttcaaacagtttcagggaagatatctactttagttaattttctgacttgggaatttgtaaggaaattctcacttgtgggctgaggattggatagctgataagtttgctttagaagctaggtctgcagtgcagtggctttggctccttttattgattctaaaacagttgcttggactgggtcaggcagagagaaaggttatttaccttcgtatggcactccctttggcaagcaaagggtcctctgtgctgtagctgatagaaaatgtaaaactggttaatcaacacttatcagtgtgcttgtgttacttaatatggatgtttggtg

SEQ ID NO: 29974 - DNA, 1070 bp, Homo sapiens
tagatggaacctctgaattttggtgcatctcttaggtgatatctagttaagcttcttttggaatcatattgaaggaactgtatgtgtttaagcgttgtgcaaatctgttatttaaagaagttgagactatcaagtcaccccgaatcacagcattcagtgtagataaagttttatgtaaggcatttttagaggaagttattctaatatagtattggttaattttttttcaggttttgaataaacaaatattattttaaagaacacctacaaatgatttaatagattgaattatttcatgtaggagatatttgcctctacatatttcagttttttctcactttattgttgtctttgaagtaaaaatgcagtaagatagttttatttttgaagttgggttaaatatgtcatcctttttaaaaacattactcacagtttaatgggtaaatattttaaaacaaaactttatagctaagaaaaaatttctgctcataaaatcgtagcgtctgtagggccataggcatagaaaattacacttcatttgagtgaaatttggtatatgcttagagtatttcctataagtagtggaatatatttttcttggccttaactgtcatgttggctaacataactgacccatgacatttgcaagggttctatcctgaggccttcacagatccactgatcaataaatgttttcatactactgctgagttagaggtgctgggcagttggttagaattgctcgttaccttggtgccttgcacaccagcttagatggatagagtgggtcaaattgatgctttatccttacagacctctaacaggtagattcactgccccttataaatgactacaggttgtaactttcacagttcttcacaaattgttaaaagcaagatcttagatctgtgcatgtcagtgtgttcatttatacttcctcggtgctagtggagaactggcagctagtgggccagcaaatctccagataaaaattaaaattaaaatcgtcatcatccaaaggataacttgctcctctgtatcacagagaagctaacttgttcaaatgctat

SEQ ID NO: 29975 - DNA, 1023 bp, Homo sapiens
tggaaaggtaaaaggaaatagggatggctttacgtaagagaatgaatgagagcagaaacataaaaggggagaatttagtatagttattcttgggacagtgagtttaacaggttggccctccttcccatgtgggaggtaagatttgttaggactttctaggaagggtgttaaaattaccagttgctgtagtttgaggtttaaatactgagtaaaagagagtgaaattgaagttttgatttaaaaaaattgtgtcatagaaattaatttgtaatatggagtggagaaagatataaagagtttgggaatccagtaagaaaagtgttgcatgaatacaggttcaagttatataagacctggtgatgtgataccatgaagaccaaaaaaaaaaaaaaaaaggcagtggaaatgggagacgtttttgaactggcccaccttgttgatggtgtggttttgagagacaaaattaatgatgtcgaggatgactttaaagagtgtgatatttgtagactagaatggtgatactattggcagaagtggatttgtctctatggcctctacggatcttaaaattgataatacatccctctttatttagtttggctgcctggaaactcatagccttatttgctcctcagttttagtaattaattgcattttgtgtagaaacctcaactctctggttgtatttgatttttctacccttttccctcttttatatccatatcttcatttgtactttcatactacatatatttttgtcagccagctcagagtcttttcgagggaggcatattattggtaaacgtacaatgtgaataactgaaagtttatgtgaatgtgtattggttagcaaaatgctggcatagtttttaagaggagttattaacatgataaaatttaaatatacattgaggacctatgttatttatttagggtactgaattatttgtatccatctctttttcctttatctaaaacaggtaattgaggaatatttttaattcaatcctgtgagttcttgac

SEQ ID NO: 29976 - DNA, 1084 bp, Homo sapiens
gcaactaaataactgatttttaattttaatttagataccaatatgtgacttgaggctactatattggacagcatagatctagaaaaatagctttttaaggttaaacttataagtatatgcttaaacttatgtttatattgggtaagagtaaactacgaggtcattttgatggtgcttgtagttaggtatttatgttgtgtatgtgtataaatacatatatacataactacatactacgtaactacttgtagtatatatttatttatctcccctctgctatccaccattatattctaaggactcttaaatattgtgggagacaatttaagtaaaatacctttgtcagttctattaattggttagatatttattttaaatttcttatcaaaatgaaagcaatattgcaaatgattgtttttaatacagactgtgaggctactgaaactggaaagtttatggttcagcagtgtctgcagcccagagagagaaataggacttcctcaaggatgtggagtttaaaagcaaaaccaggactagtattcagtcccgatagttcaatgtgttgcttatttcactgatagaatgtggatgcattttataaacttagagaatttagaaaactcataaataaggaaaattgggagttcttatccatgatcatgaggtacattggagaagagttggctgggcgcaggggctcatgcctataatcccagcactttgggaggccgaggcgggtggatcatttgaggtcagcagtttgagaccagcctgacgaacatggtgaaaccccgtctctactaaaaatacaaaaaattagcccggcttggtggtgggtacttgtaatcccagctactcaggaggctgaggcaggagaatcacttgaacctgggaggcagaggttgcagtgagctgagattgcaccattgcaccctagcctgggcagcaagagcgaaactccttctcaaaaagaaaaaaaaaaaaaaaaagagttggatttatttttcctggagaggtgaagggtcatgacagcagtgatgaactgttttcagagccttaacattctttattaagcttattctgt

SEQ ID NO: 29977 - DNA, 1069 bp, Homo sapiens
aaaattaataattaatgaaattttcaagtgaatacgaaagtagaataaagttgtaattactttcttcaccgggaaagtaataagtaaataaagactatttagtggcattgagatttcaagagtaatttcttcagtaattttgcaagattattcatattacctactcaaccagactccataattgggctcaggagggaaggctttcccttagagaagcagagttctgttcgtctgaatgttgtccagtcaggctttgggacttaaaaatgcttttgaggattcttaggtccttttttttttttttttggcctgtggactgaacatagctgttcagtgtgtatcattatttattgcctttctcttactatagattatttctcacaggagaagaagttattgctggtagcatgtcagtttacatgtgtctagctcccatctctggaacacataattaagtgtggtcgacatatattcttcttcatttttgccgttgagaaagctgtcagaaatgttacatctggagaacaggaaagactaccctcaaagccagcgttggcctaagtgtactcttaaacatttcctgtggatgtgtggaccgcctgtctctctatctcttcatgacttctgcctgtgtcttgtgtgtgcagaggccaaatagtagtagcagagatggaaaaccttctcctacacatgtgcaccagcatggtcctttgtctctctctttcatttgctcttcaaggcttcgctcaaatactgcttccattctgtaattttctcttcccagcgcacccgtgggacctgttacattgagttagaggcagtattacacggtggtttcttttggagagactggctagactacgtatacatagcctcttggttagttacataccttctcagtgcctcagttccttcatctgtaaaaccacatggggttgtgtgaggattatatgagttaatacatgtaaagcactcagagtagtgcctggcatataagggctcaaaaattgttagttgttgatgctgttgttgctgtttataaggcttgcgtgcatttcttttcttcatt

SEQ ID NO: 29978 - DNA, 1061 bp, Homo sapiens
acacaaaacttaggtgggtgtgttggcttatgcctgtgatcccagctacttgggaggctgaggcaggagaattgcttgaacctgggaggcggaggttgcagtgagctgagatcatgccactgcactccagcctgggcgacagagtgagacgctgtttcaaaaaaaaaaaagaaaagaaaagaaaagaaaatagttatcactgaatagaaatataagatgatcaaataactattgaagttaaaggaaactacaaagaaaatctccaaaggacgccatcctagtttgtttttttgttaagcactattcacctgctgcactagagccagcaatatggacaaacaatactactactaataccattatttgttaggcacttatgaggtagcaggtctcatgcttcatcttttatgctcccagcagttctgtaatggcagagaatagcattttgtttttctaaatacattcaatctctgagcctcagtgttcccctcagacctctcagatcctgggccctttaccctacattttatggcccgcttccctttctgcttctttctgatcattttattttgtatttgatgttctgagttttctctaaagaacaacatatattcgttttagattaatggctttaagaaaatcatttattgttaagaatagtacagttttgtggctcagcaaaaaataattctactgttcagccataatcattttggcaagtttacagcctttttctcaagcgttggttagattaactgaacttctgaatacctttgtggtattttaaaaatctgaaatcacttgtctacaaatagtatttctttttttttttttggccttaaagttttaataatgaaatttttctatgtagtcctctttaaaatatttaagtatagtaggaagcagcagagtttgttccacctaatgtcaattcagagaacattttacattttatattaaaattatgatgccttaggatcgttcttttacctgtgtatttattcattttcacactcgggagttttagttgccactccatatcagtggcacagccatgatga

SEQ ID NO: 29979 - DNA, 1050 bp, Homo sapiens
ttgaccgactgatttaagagctattcaaaggtaattttgagtatgcaatttttgccttttgcaactaccttaggaccttattctggccgggtgcagtggctcatgcctgtaattctagcactttgagaggctgacgtgggaggattgcttgagcccaggagtttgagaccagcctgggcaacatggcgaaaccttgtctctccaaaaaatacaaaaattagctgggcatggtggcacacacctgtagtcccagctacttgggaggttgaggtaggaggattgctttgagcctgggaggcggaagtttcagtgagccgagattgcaccaccacaccccagcctgggcaacagagcaagaccctgtctcaaaaaaaaaaaaaagaacctaattctggagtaagatatgactttaccataatttgtgaattaaggattaacaaggtcagcagagctgaagccaagtgaaagcatttgagaacaaatgactgaaaaatactggatatatggtaagatatgtgtagaaaaagaactctttaagcaattttcattaaaagcttcttagtatgttttccagatactaaaaattttggtcactggaaacaattgggaagcaaagagattgattcaggataaacgtagttaaattagccaagattagggattccagtgaccttgaaaataaatgtgtagattaaaattcaggttattttaatttgatggctaaaataaaatgtgtgtattaactcagatttttttttttttaaattttgagatggagtcttgctctttcgcgcagactggagtgcagtggcatgatctcggctcactgcaagctctgctttctgggttcatgccattctcctgcctcagcctcccaagtagctgggactacaggcacccgccaccacacctggctaatttttttgtatttttagtagagatggggtttcactgtgttagctaggatagtctcgatctcctgacctcatgatccgcctgcctctgcctcccaaagtgctgggactacaggcgtgagccaccgcatccggc

SEQ ID NO: 29980 - DNA, 1072 bp, Homo sapiens
tcgactatttatgtattaggagatccaactcttccaaaaaacatggctagggtaaggttaccagcaatgatttgctatacccatacatttataggcaaatgctataccattagaggaaaataaagccagtgctgctaacctcatcactcagattaatttccacagctgtcattttaacagtgttattataggtcttcaaatgaaaattatgttaacaggtactccacataaatgtgctgtaatccaagggggcacatgtattatatttttgattgtagtaagctttttggcctaattgactatttctctgcaacaaaaaaattagttaaactggaaaagcataataaagctatatgctctttactaggtgatatcttggtggtttaaatttacaagttgtgtatacatacatattttcctgttgaagacttgatgactgactgaaaatgtaccagggtgtcatcaccataaaagttgttgcatctatgaactatacagcagtgtgtatgatggtgtgagttataataaactattcattagttttttgctgcatagttttaggatgctgtaacagtgatcttgaggactatgacttaaaaaaatgaataacactatcattcagcttgctactctgcagacaatgtgtatgaaaaagaatttgtgtgatttaacctcagacattaaaattggtttgccagtaaaacaaaacaagattaaaaaaaatttttttttttaattttttgagacggagtctagctctggcgcctaggctggagtgcagtagcacgatctcagctcactgcaacctctgcctcctcggttcaagcgattctcctgcctcagcctcctcagtagctgggattacaggcacgtgccgccgcatccagctgatttttgtatttttagtagagacgaggtttcaccatgttgctcagtctggtcttgaactcctgatctctggtgatccacccacctcggtctcccaaagtgctggtattacaggcgtgagccaccacacctggccaccagattttcttaaaccatattatttatgtccccgcagtagaaagaa

SEQ ID NO: 29981 - DNA, 1416 bp, Homo sapiens
atgtttaaaaccagtggcagtctgtaaataccaacaattattatcttttgatacccttttaagttatgaaactcatattgttgaagaaatacctggattcattaagaaaatgatttttttccctctttctttcccctcttcttcttctctcttcctttcccgacccccttcctttcctggaaggtctttctgttatatgaacagagtgacgagtccctctctgttgcccactgtgttgcggcaggctgcagtgcagtggcaaggtcacggttcactgcatcctagctcagcagatcctcctatctccgtctcccaagtacctgggactgtaggcgcgcaccaccatgcctggctaatttttttttttgtattttttatagagatggagtttctccatgttgcccaggctggtcttgaactcctgggctaaagtgatcttcctgcctcagaggcacctcccaaagtgctgggattacaggtatgagccatcgcgcccagcctaagaaactgattttcagtgactgtattccttcatatgtgtgttccacaatttaatcctagaattctttggtttttaaaataatgatacactggatattatttgtaaatattctgagtagctcttattatttctttacagcaaatgctgtgtaggtaataaatggagtgatgtcaaatagtatcccttttttttgaagagttttgataaatattgcctaattgcccttatttattcactcatataaaatcaataataattacagctaacttgtttagagtgctggtcaggacctgagctgtatgtggactgttcaatgtaatcctcaaaataactttttgaggaagttgttatcaatgtccttatcaggaaatatctgagtgcctactgtgtgtaaagcgttgtgttaggcagggggactgcagtaatgagcaaccaaccattgttgatgcccacattctagaggatgtgcttaacaattactgtcagttaatttaattgcgttgtgggaaaggctgtgaaagagaaatttgggctgctttgaaagtatatcacacagggtgagagaagcggtgctaagagagaaattatctttgtataaacatctcggtagcctaggtggagtagccaaggtaaaaggacgtgttttaggcagaggcggcagcatgtgtgaaggcactgaggtgctaaacggtggacatgtcccggaagctgaaatagaccaattgtgcctggaatactgaggtgttacagtagattgactcaagataaggctgggcctagatcaaatcctgcattgtgtttctggccacctgaaggatttagtccttcctaagagcaatgggaagcctttgaagtgtttttagggaggacccgtaagatgatttatattttaaaaagaatgacttacctgcttt

SEQ ID NO: 29982 - DNA, 1035 bp, Homo sapiens
atcttaccatgtaacttattttttgttgttgtaataaacatggttttaaaacagttgtcactgtttataattgtatcattcattaattttcaggtaataaatggacagatttggcttagtagttgaggcgtgatttcagggactgcttaccctgctttcttcagtatgttaaaaaatgaatgtgagatctaccggaggaaggagaaaggaaaaaaacctttattttccaagttagcaatctgcagttttgggaaacctagcttctggggaaactgaaagcacacgcttggctgaagggagggaaatagcagcatttaagccttccagggtctgtcttacatattcatcagatttggggaatgtctgtgaatgtttacagggaaagtcaaatgcatgtccagatataacattaatataacatacattctatattcactttggggtggggttttaacattaaaatgaggaggaatttggttctttgcatcaaaaggtgaactataagggacaaagatgttttatgtgccatctctgtaagccagttggaaccagcttagggtctatagctgcttatcaggagagaatatttgtaaagctggtgttttctctaatcagtgctgttggctggacccccaaggtgggggtgttcttgttagctagtgtcatgtggtctaccagagtcagttggataatgttttcctagaatgagcttctgcttaactgcaggaagaaaaccttatggcaatgaacaaaccttatagtagttaacagtgtaggcatacatgaccaaactcttttccctgctctggccacttaattttctctgagggtctcatcttagccacagagcccatcttgtctgtcatctaggggtacattgttgacagttacctttgttaccattcaccaatgcttaagatcaattaatagtagacattgtctctcattcacctattaggccatacattcaaataagcatgggagagaaaacacatttgacttattaccacggtaaggttcaaattactgatatca

SEQ ID NO: 29983 - DNA, 1178 bp, Homo sapiens
aggagattgggaagtccaagatcaaagtgctggcagacctggtgtctggtgagagcactgttcctagtttgcagacagtcttctcattgtatcctcacttgctggagaaagaaagaccttgtgtctcttcttttataatagcactaatcccatcgtcagggacccaccctcatgacctaatataacctcagttacttccaaatggcctcacctccaaattctgtaacactggggacttgagttgcaatatatgaattttagggagacaaatattcagtcaatagcagaggtaacacttacgttagtgaggaagaatttttaaagatttcatgtttgttttagatataactacttaaaatacatgggaatgtttctgtaatataaaaaaatgccattgtagttccatattcataaagtgaaacactttataaagaaataacgtggctgggcactgtggcttatgcctgtaataccagcattttgagaggctgagacgaaggattgcttgaagccagaagtttgagaccagcctgggcagcaaagcaagaacttgtctctacaaaaaataaaataaaataaattagttgggcccagtggcatgtgcctgtagtcccaactattctgagaggctgaggtgggaggattgcctgagcccaggagttgtaggctgcagtgagctgtgatggcaccactgcattccagcctgggtgacatagcaagatcctgtctgtttaaaaaagaaggagaaggaggagaaacatgtttttcttaaactttctttaatttggttttatgttaatgttaagaataaataaccagtaaataatcttgtaaatagaaaatactatttctgagaatttcattcgcagtaatattagaaatctattacatctcttagaaatatgatatacaaaatagtttgaattattgttattgaagaggatgtatgccagattttcaagagtaggtttattgtttgtttatgaaataaaacatcaactgccatttattaaatactttctttgtgccacaaagagttttgaatgcaatttcagtctagtcctcaaaatcatcctaaaagattggaggattatgtaaattttgcaaatgaaacttggcttttgaaatttggtcacttactctcaaagctttataaccagcaaggggcaagggctgag

SEQ ID NO: 29984 - DNA, 1058 bp, Homo sapiens
tttatcctttgtgtttcaagtaatccagttgtactccctgaggtctgttctaaatttataattattactgactgtagccaccctgttgttctatcaaatactagatcttattcatttttttttcatttttctatagcttcttgttggaaaaaaaaatatatatatatatatttatatatttacctgttaaccatctccactccccccaccccatgcctcccactactctccctagcttctggtaaccatctttctacgctctgcctctatgaactcaattgtttaatttttagctcctacaaataagtgagaacagacaaaagtttgtctttctttgcctcatttatttcacttaacataatgactttgagttccatccatgttgttgcaaatgactggatcccattcttcttttatggctgaatagtattccgttgtgtatgtgtccattttctttatccacttgtctattgatgaacagttaggttgcttccaaatctttgctatcgtgaatagtgctgcaataaacgtgggaatgcagatatctctttgataaattgattcctttcttttgggtatacttagcagtgggattgctggatcatatggtagcccaatttttaattttttgagcaacctccaaactgttctctgtagtggttgtactaatttatgttcccaccaacagtgtacaaggattttcttttctcagcatcctcctcagcatttgttattgcctgtctttggataaaagtcattttaactggggtgagatgatactttattgtcgttttgatttgaattttgctgatattcagtgatgttgagcactctttcatatggctgtttgccatttgtatgtcttcttttgagagacatctattcagatcttttatcccccaccctgcttttctttttgagacatagctttgtcatccaggcaggtgtgcagtggctctcactgcaacctctgccttttgggttcaagcgattctgtttctcagccactcgaatagctaggaggattacaggcacccaccaccacatctagctaattt

SEQ ID NO: 29985 - DNA, 1056 bp, Homo sapiens
attaagtctgatttttctttgttgactttctgtctagatgatctgtccagtgctgaaactgggatgttgaagtctccagctattattgtattgggatctatctttctctttagctcaacaatatttgctgtatatatctgggtgctccagttttggctgcacatatatttatgttatatcctcttgctgaattgaccctttatcattatattatgaccttcattgtctctttatagtttttgttttgaaatctattttgtctgtatagctgctcatgctttttagctggtattctttgcacacatatcttacaatgtaaaaaaaaaaacttctctgagcaaaagcaatttgacacttcataacgtctagaaatattttttcaaatgtgatgtatgaataggaagtagcatacaaaaacaaattactgtgctatccctcccccaagaatacatattctctcttcacaccacgtggctgctgctggggcatgggggaggggtggcattggcagttcaagactgtcctaccctcttcagtgactcttttagcaatatgaagttaaaaaccaggtactgttaccactcacctgatgtttaattctcatgaagatgcttttttgtgtagatagttgtcaaatgtgatgttcctgcagggaggacaattggtggaggcttctatttggccaacttgctcctcctcatttgtaaatatttcagtgggtacctgtgatttgctttgaagtacagtaattggagaaagggtaatgagagttaacaaatacggctaaagtggaaacgtggtcagtcttgagctgattattgttgaagctgaatgagggatttataaaggtctgttatgcttttctttctaagagtttgcttgaaatcttttatactttaaagttgagaaaaccaacaatgataccagctcagtacagtactcacacagtgaaggtttgttactttagctggcattctttgcagacataccttataatgtaaagagaaaacttttctaagcaaaagcaatttgacactttgcgacttctagatacaa

SEQ ID NO: 29986 - DNA, 1027 bp, Homo sapiens
cctactgagagatgcctcccaggtaggctacttgggggtcagggacccacttgaggaggcagtctgcctgttctcagatctccagctgcgtgctgggagaaccactactgtcttcaaagctcagttggaaatgcagaaatcaccagtcttctgcgtggctgacactgggagctgtagacgggagctgttcctattcggccatcttggctcctccccttccttaatgtttcttcgcttaattaatctttcttcccaatgtagttcatttcttagtttctttgtctttaatcattttcctgataattcagacttgtggaaaattgctgacacatgtccattcatcctcctggcccttttatttctccttgtcagtatagctcgtatctttgtaatttcctccattccaggagttcttgaggcttgggctctccatgattactttaggtttctctgtctcccagtctgtgatgtcccttccagccatatccagtctgttttcaacaaaattctgaccactctacttctattttcaaaagccccagtggttcttatttcctgcctgcaaagtatgtttctttttcagattttcagagactatataatatttcccttaccctatccaaccatatttcccactgtgaaatagttattactacaagttaggaaagtatcttattaccagttatgccttttgactttatttattgcaatttccccaccactaaaatagcttcatttttttattcctttggcaaaaacaccgcacattcttaacagctgagttccatgcttttcaggaatcttctctggtgacctgagcacacaccaacctctcctttctttgaacttctgttacatctaatgagtgctgaatagcttatcatctaaaatcctagatgcttctagagctggaaagtagtaggcatcagctaatcatctgtgcattgtataaatgacagaacatttgtgatttgcccttgatcatattatttaacagcagagcctaaattagatctgtcagttaatt

SEQ ID NO: 29987 - DNA, 1202 bp, Homo sapiens
tttgacttccttgactccctgaaaaggtctctgggatgctcagagggaggtccgtgtgccacatttgaaaatcatggttataagccttgcagaggacagtgtttaatggtccccttttcttacagttattaaaatgtagtaaccattctttttattttttattttttacagacaggctctcactctgtcacccaggttggagtatagtggtataatcacagcttaccgcagcctggagctcctgggctcaagctctcctcttgccttagcttcccaaagtgctgagattacaggtgtgagccacagtgcccaaaccctaacagctcttttgttttatttcatttactttggtattctctaagactattattatgaaactttgctcatttttctaggcctttattctcaattttattattttgttcaagggctgacatgaccatattaacaattatccttagatgaacctttacaagttaagtggtagataaaaaaggaagagactgaaaaagtgtttaagaaaacatttactagcaacctacgtggccactgaaatatttaaaagaaactaattgaagttaacttttcattttataacagtgattgaaaatcaactgctttgtctgcccaaagcattctaagtctattctgttatttgaggaagtcatttgactgtctgtgtctcagttctctgactagctgacattgctgtaaatttggtatgtatgtccaggaattgaaataggcctccgtggaaagaaatacaattatttatttaaactctctaacagtagtttagttgtggcttggatctaaagacaaatattagccaatccagtctatatccccttccccatgcattcattgtgtttgtagaaatggtatatgtctaagtatcaaacgagttgtatctatcaaagacaaaaatattctggttcaaattatagataacaataagattccaatcaaaacaaagaggtaaataaatatctggtcatgatccttttgtttatactgcaaatgtcgatattgcttagtggcactgattgatgatttatggccacacatgtacccattgtttctgcttcactcctcctggttggctttcttatagtaccattcttccatgaggaatggcaagtaaataaaccagttgatacctacggagcaagaaccaccattgaaccatggatgctgatttt

SEQ ID NO: 29988 - DNA, 1047 bp, Homo sapiens
catgatgtgcagaaattttatttgactattatttataacaatccagacagacctgttactcatttttagattttctttaaaccagattctattattaaacattaattcagcaagagattaagcaaatctcaactgatgacttaaggaaaattgacacattttctcaatatgttcataggaattctcttgtttaataatttaaagatattatagactttataatacaaaaaagcaacagacaagctgatatttttggtacgatattatttataattcaaagaaatgtaaagagtatgctaacttggagatgttttggttggaaatggtgcccacatttgatgactttctgcctccctttccgttttgtctttccatgtgtcttttaaaaaatatatactgttgcagtttcatagctgtcaatgtcttctctttctgaggatattaattaataaattcttcctccctctgtatagtcattcttcaagttgcttttttctgacgctttcaggtctagtaatctttggttggttgagtgtatttaattgtggaccaggttacttgaatctcctaaggcattattgcttatttatatactgtccagcttccaaagtttattgcttttacctctactccctgtacctccataatgatgtatttatgacgttttacaaattttgctctatcatttaaataggactttggaaggtagcagatgatagtgtgtattttgttctcatctttacttgaaataatttgcttatttaaatgaaagcatctagacagtaattgaaaccatgagttgagttcagcaagtactaaagtcaatatgatagcttaagaaaatgttttagcaattatatttttatattgatatagatcccattaaacagtcatatgggttcaggagtattagttatgaattatcacatgtatattttaattaaaatactatagggttttaaaattaaattatgaattatttaagaataagcctatttttatttacttaatgagttaggtagttctaattaggtaaatgtaaataga

SEQ ID NO: 29989 - DNA, 1024 bp, Homo sapiens
ataagcccctatgtagtttttatttctttaggatgacagacatgagttctcccattattttctcattgcctgtgctttattcatattaccatcattatccttcattgcgaagaatccattacatactatagtgaattaacaataaaattcaagatgaatttacacaaaaaggaggatattatttttacacaaataaatattaaggtaatgaaaacagttttgctattgttgacaatcattataaaattgtttaccatgtcttgtaattttaaaagtttagtttttatcatttaaagacaggtattcttattagacacttgacatctgttagtctcaaaatttgctatgttttggatcgcttacaagattagctgagtgtattagtcagggttctccagaggaatggaaccaataagatatatatacaaaagagaatttgttagggagaattgattcatgctattacataggtgaagccccgccataggccatctgcaagctggagaatgatggaagccggtagcatggctctctctaagtccggaagcctcaaaaccgggtaagctgacagtgcagctctctcagtctaaggctaaagacctgaaatcccccaagaggctgctggtacaagtcccacagtccaaaggctgaagaacctggagtctgatgtccaagcacaggtggaggaaaagatgtactgttccagaagagagagaaagtaaaaagaagagcaagcaaactgaatatcccccttctgtctgctttgttttagctgtgctcacagccagttggcatgggcaactgttctagttcctggccactttgttctagaccctgcccactttgagggcaggtcttcctctctcagtacactgactcacaggggtgccttgttatatttcccaggctggtctctaactccaggcctcaactggagttgtcatcttctctggaaacatcctcatagacacacccagaaacaatacttcagcagccatctaaacatccctcaatccagtcaagt

SEQ ID NO: 29990 - DNA, 1066 bp, Homo sapiens
tctcattgttcagttcccacctatgaatgagaacatgcggtgtttggttttttgtccttgtgatagtttgctgagaatgatggtttccagcttcatctatgtccctgcaaaggacatgaactcatccttttttgtggctgcgtagtattcgatggtgtatatgtgccacattttcttaatccagtctatcattgatggacatttgggttggttccaagtctttgctattgtgaatagtgccgcaataaacatacgtgtgcatgtgtctttatagcagcatgatttataatcctttgggtatatacccagtaatatataccaggtgtatatttggctgggtcaaatggtatttccagttccagatccttgaggaaccaccacactgtcttccacaatggttgaattaggaaacagtgtagctctctactgtagatggttaataaaatatggagaaccattagtgtaatcagagagacttgggttgccagtggctgcttgtacaaccttggtcagttgcttacattctctgtgctttagtttcttaatctgggaaaaaaaatggattgaactaaatcatttccagtgctaacatgttatacctttggaaaggaacttagatatagttgaaacaatttgaatttctctagtttttagtttttatttatttaaattttttctttttaaatcgtgggtacatagtaggtatatatatttatgggatacaggagatattttgacacaggcttacacatcaaggtaaatgtggtatccatcccctcaagcatttatcctttgtgttacaaacaatacagttatactccttcatatggtttggatctgtgtctccaccaaatctcatgttgaattgtaatcgccagtgttggaggtagggcctggtgggaggcgattggatcatggggagtggtttctcatgaatggtttaataccatcaacttggtaccatcttcatgatagtgagtgagttcttgccagatctggttgtttaaaagtatgtagcacctccctcctctctttctcctactcataacatgtgagatgcctgctc

SEQ ID NO: 29991 - DNA, 1030 bp, Homo sapiens
cttgaccttgtaatccacccacctcggcctcccaaagtgctgggattacaggtgtgagccccggtgcccagcctgtcttgtttttttaatccttgcatccactctgtgtctcttgattggagagtatagtccacttacattcagtgttgttactgataagtaaggatttgctcctgccgttttgttacttgttttctggttgttttgtggtcttctcttccttctttcctgccttcctgccttccttttagtgagggtgattttctctggtggtatgttttaatttcttgcttttagttttttgtgtatctttggtatgtttttagatttgaggttaccatgaggcttgtaaataatataaccattattttaaactgaagacagcttaacactgattgcataaacaagcaaacaaaaaggaaactaataactctaacttggtctctctgctttttaactttttgctgtttttacttatatcttgttgtactgtctatgtcttgaaaagttgctgtagttactctttttgttgttgttgttacagggtattactttgtcacccaggctggagtgcagtggcacaattacagctcactgtggccttgatttcccggtttcaagtgatgcccccacctcagcctcctgagtagctgggaccaaaggtgcacaccaccatgcctggctaacttttatattttttgtagataacgtgatttcatcatgttgtccaggctggtctcatactcctgggctcaagtgatcctctcgcctctacctcctaaagtgttgggattacaggtgtgagccactgtggcccgccatagttattatttttgttgggtttatgtttttatctttctactaaagatatgagtagttacatcacaattagtgttataatattctttgtttttctgtgtacttactattaccagtgagttttgtatcttcacatcatttcttcttgctcattaatacccttttctttcagattgaagaattcctttagcatttgttgtaggacaggtct

SEQ ID NO: 29992 - DNA, 1048 bp, Homo sapiens
tgtttgtctccactaattcctaacagtattagtttcctagggctgctgtaacaaattaccataatctgggtggcttaaaacaacagaagttagtgcctcacagttctgagaactggaagtctaaaatcaagtgtctgcagggccattctccttcagaaacctttagggaagaatcttacctaactggtctggtgtttgccagcagccgttggccattccttggcttgtatctgcatcactgcaatctctgcctttgtatttacacagcattttttctcatgtgtctgtgtctttacatggtgttcgcccctatatgtgtatgcccaaattttcctcctcttacaaggatatcagtcatactggtttagggtcgactctgattaacttacagatttgggaaggggattaggacttcaacttttttgggaggggctggcacaattcagtccataaagagcttgttctttaccagctgtgccacttggatctaccctgcagagcaggacctgtgtgtatacttgtttgtgaagacgatagaaactgatgttgccatccaactcccggcatctagtagggagagtcagagtggcaaaacaggcattgcctggctgccgctactacctacttggtacaggtcttctgtagcatggagctttgggaagcagtatctgctgatgttcaccagctgctaaatctcctaggaatagctcttctactcctgggacctacaggagatgagagctgctactcaactgaccccactagaatagctcttccataacacagagttgtgggggaatgggggtagtctcttatctcgaatgccatggcttcccactattatgactgaatttcgatagattttgttgaatgaatgttttacaatttgttgtaagccctctgatcaatctccagagactgaatcattgtctttgctaatttttgctggtttaataagtgttggagagaagagatttatccaagctctttatactcccattctagaagtctagccccttgaaccgtttttaaaagcaccaccttccag

SEQ ID NO: 29993 - DNA, 1109 bp, Homo sapiens
tctatatcttaagatggtaactatctctgtgtatatgttcatttattttaataatgcttttattattttagagatggtttgaaccttatattttgtttagtccaccctcatcattttgatgaagtaattaagtccagagagcatgtaacttcgtaagctttacagtctaaggttacatatataactctaaaggaaagaacaaaaaccataatacttccaaaaatccctgaagcagtgcgtagtattttttcagaaagctttcataaatacagtgtattttctctataatttaatattatcattattttgtctagcattaatttggtatctataataaataattgattttagccttaacttagctgtagagtcctaaggattatatatttatatattttttctattagacaggcattttcttgtctcctttcacaacatacgtggttcagtaaaacataaaatcacttgtcaatagttagtattaatataaatatataatatcgtgtctatacatttcacttaatttttgaatccatgaattaggaattatctagatttattaggcttaaacaaataattatttgctttgttttgtgctgtactgttgataaagaagctgtctatatgttattatatttgatcctcacaaccaccttatgaaggtaggttggacagcttttattatttctgttttattgatgaagaatcaggtttggtgtttaagtaaattgcctacattttataactttaataatttgctcctatagttacccatttatttttatgttactggttagtcatggtagtacttactgtcttgtttcttctagggaatacaaaagtcttgatttttattctagacgatttaagaagaccaatttgggtcatttggcatgaccccagggctagctcaggtgtaagtaatacggggtgagcatcccaaattcgaaaattcaaaacactttgtaattcacaactttttcagcaccaacataacactgaaaggaaatgctcattcaattctcaattggatttttggattttggatgcccactaggtaggtataatgcacatatttcaaaatctgaaaaaataaaatatccaaaaca

SEQ ID NO: 29994 - DNA, 1024 bp, Homo sapiens
aaaaattacaaaaacttagagaccctagttaaatgttttctttaatttaatgaagggaagaggagatgatatggtggggttggttttattaaatttgactttataattatgttatgtttaaattttgattcctgagtatttacttcacttgaggatttttttttaaatcttcccattctcttaaacattgtcttgggaacagatgtatttttattgtgttagcaagatgtgtctttaaaatattttcttgaaatacagtaattgcacttctagaaatggattcattttaacctgatttaaaataatcaaagtagtcagagtgattaattttatgtttgttttagtttatttttaattgtcaggaataacgggaaatactgaaatatttagagaaaaagagttaggatgaaaagagggaaaacatttaaagtctttaaatatttggataatactgtgaattttcagttgttaactcccatttaatacatggataagctgaagcctagaagcttaactgttttgccaggacctacgtagttaacctatattggaggtgacattttaacctgtgtctgtatgtcaggctccagattttcccacaatactgtaatgaataaaagatgtatatattctactgaattgtaaagagccattactctttaaaattttttctttttgcctgtttgataatcatgttttcagaatgcacagtttttaacatttatttacattaaatttttagctaaaatacagagtatttataaattggttatggaaaagtgaggaaaaataatttgcatctactatgcactatatttttttcttcttgtgaagcaagtgcctgtcatgctctggaaaatataaatatgaaatctgaacagttgatgattataaaaataattacaggttgccattatgaagcacacagtcacacctaatcctttaaataaatgtgcttaactacactaaaatacatgttttaaaatgttaaacagagacattctaaaaagacacgtgaaaacca

SEQ ID NO: 29995 - DNA, 1033 bp, Homo sapiens
ggggacacagagagcagagaggaacaaagaagggcatcaatctatctgggctcagtgtggagccaggagaacctcccaaacatgggaaagaatgagtgagtgtgagcttcctgggggagcacatccccctgcgcttataggctgaagcagagagcccattttgtgtgggggcaactctcgagtccaaggagaccactttgagacttgggccctggagcagaccaacactggcaccatagcaccaatagaaccttcagtcatggggcctgggagcagtaagattacaccacttctgccctcctccctccatccctgctggatgaggcttggtgtcagcttctggcctagtggtcctgcttctgtctgaactcggacagaggtcctggcttgctattgtcccaggaaggacccagatggcagggtgggccaccctacccacccctgccacaggtagccaggcaagcaatgcctgctagagtttctggctcagtagtccagcttctgtgtgaacttaccaagagggtgcaacctccctttgtcctgggaaacacctggacaaaagggagagtgacctcaccccaaccctgtcacaggtagccaggtagcaatgcctgctagaacttctggcaaacagtcccacatctgtgagaactcaggaagaaggtgcagcctactgttgcttgtaaagtgtctagagagaaggggtaggtcacctacaaagggaaccccatcaggctaacagtgaaaacaggcttttcagcaaaagccctacaagtcagaagagattggggggtctatattcagcattcttaaagaaaagaaattccaaccaagaatttcatatttggcaaaactaagcttcataagagaaggagaaataagatccttttaagacaagcaaatgctaagagtatttgttaccaccagacttgctttacaagatgtcttgaagggagtgctagatatagaaaggaaagactgtgttaccaaccatcacaaaaacacatttaagaacgtagactagtaatgctat

SEQ ID NO: 29996 - DNA, 1049 bp, Homo sapiens
tagtttagccattgtggaaagtagtgtggcaatttcttgaagaacttaaaacagaaataccattcaacccagcaatccctttattgggtatatacctgaaggaatataaatcattctccacaaagacgcatgtgtgtgctcatcacagcactattcacgatagcaaagtcttggaatcaacctaaatacccatcagtggtagaccagataatgcagtatggatataccatggaatactatgcagccattaaaaaagaatgagatccttcgctttgcaacaacattgatggagctgaaagccatgatgccccatgttctctcttacaggtcagaggtaaacattgagtacacatgcacacaaataagggtacaacagacaccagagcctcctagggtggagggtgggaggagggaggggattgaaaaactgcctgttgggtactatgcttattacctgggtgacaaaataatctgtataccaaacccctgtgacatgcaatttacctgtataacaaacctgcacgtgtacctctgaacctaaaagttaaaaaaaagaagaaaaaaataccctgggatcagacatttagagtaaattgtgaaaaattacactaaaacttagacatataagttgattttagttcaattaagaaaatttgtataacagaaactatgttctaattatagaagaacaatgaaaattagtgtttattggtattttttgtatgtacaatagcacataatttttacaaaaaaatagtaaattgcttctatcagtttttctaagggactctcttagtccttggcagacaagtcattctgaagaatttatcctgtcattatcctttttgattttctcatcagggcctttgaatgtgatcctgcagttctccatcatccctttaatggatttcatgaaatcttttaagtgattttcagtttcattataaaatggaattaatttgccctgtgtttgttgacaaaccaatctttatgatagaatggctgtgatatatttggtttacaatccagtttcttggtattagaaactc

SEQ ID NO: 29997 - DNA, 1037 bp, Homo sapiens
gttgtgcaaaggcggaggggtgggagggcagtcttgtggactgagccctcactttgtgggatctgaaactacctccagttaggtagtgtcagaattgaattggaggacacccagctggtgtccactgcagaattgattgcttgcttgttgtgtggggaaaactcttcacacatttgctcacagaaatcttctgtgttgatttttgttgtggtgtgagagcagaggaactgtggttttccgtacacagaatggtcgatacacatatagatatttggctttggtctaattttgtaagtggtcatttaattagcattttcattttgtgatggcatttgatttcctatgtactgtgtttttttcaaactagtatacatcaatattttttaacacaacatttcatttactcttaattatttatattatgtatagttctcacttcataaaaattataatcctaatttagaaaccaggtagattgtgaaatggcaaagttgatgatgatggctcctccaatgacagtgataatagctgccatttgtaaagcttctactctatgccagctgctgtactaggtagtttaataatccttcccacaacctcaaaagattgatgttaatcacctgacttcatggataaagaaattcaggaaattcgtagaggcaatgagtgtcttacaagttaaaaacaagccattataatgatcaagtttgtgtttttttccaaaacactatgtctttctttggtttatagaagcatttacttcagggttttctctataaattaattatatttttggtacatataatataaagttgataaaaattggaatagcccacagttgtaggaatacttttctatgttattatttctatctgtattattaatgcagtgggtgttaatcttataaaaattattttttccttttgctttttttgttgagaggtatttcacaaatactccttcttcagcagatttgaatcaaaatggaatggaagatgtggaatttatgaaattggattttcacaacaaaaaagtca

SEQ ID NO: 29998 - DNA, 1033 bp, Homo sapiens
tagaatttcaagttttcaacagcttttatgtacatctcttatgtacatgtgtattgccaaatgaaagcctgtttttcttcctaaaaatgactagatattatataactctataggtaatgttcttatgagggcacacataatcaccaccactcacaatacctagttttggaatcttaattattccttccataatattttcttaatctgctataatgtgagatatatgactacagctgagagatattaaaagcagaacaggaaaccacagaagtttcttaaaataaaaatacaaactgagctcagaaacatgatttttatatacatatctgaaaaagaaatgtagccagtgagcagaatatactcaaagccaaccacaaataagcagtaaaaaaaaaaaaaaaaaaaaaaaatactgcagtttattttaaaattgtacacatcttgctttcattagagtatataggaatttcattataaaatacatttttaaaaatttaaaggtacatatgtgctttgactgaataattctgtgatgttgattatactctaaagtatacatgtgaagctagagttgaatatgaggtgctgccttgttcttccagactgtaatagcgtgtatgctatgtggccaaaccctgtcctctgcagagaccagcaagtcaaacccatgtttctcagagcttggttacatgagctcttggtagcacatgtacctatatgtaaaatatttatagatagctctcaatttttaaaaagtaatgtacagtaaattttatgatcaccttctaattgcaagtgaattggcttctgtttttgaattgacagcttccctttgaaattcatttacttatgcttttttaaaaagtgtgttgattttaaaaatcagcatgaaaactagtatgaggatagggagaaagtacaaatgttacactcagctgactgaagttttggggactctgaactaaacagaactgtatagttgatattttaacttaaaatattacctgtttggcctacctaatttttacttgag

SEQ ID NO: 29999 - DNA, 1090 bp, Homo sapiens
aaatatgcaaagacctagggcagaaaggagtttggtccgttagacaaactcagagtaatcctgtgcagtgggagcttagtgaatgaagggaagagaagtgagagataagtttggaaaagtgagaaggaatcagtggggcagtctttctcccagatactgtcactttatcataaattaacttagtgaaactacactagagctaaaactgttactttaccttgaatataaagggagaaaatgctaagaacatttgattactgtaaaaaaaaaaaaaaaaaaccctgaaattgcgaacttctctattggaaatttaaaaaaaatcattttgttgaaattgctatactcttgtggtagtgactaaccatcactaccatcccatttcttctttattaaaaaaaaaattatttttctagagacagggtcttgctctgtcactcaggcaggagggcagtggtgcagtcctagctcactgcagcctggagctctagggctcaagcgatttttctgagcagctaggactacaggcacatgccgtgactacaggcgtgtgccgctatgcccagctgatttttaaattttttgtagagactaggttttgctatgttgctcaggctggtcttgaactctttgcctcaagtgatcctcccgcctccacctgccagtgctgggattatagacgtgagccaccggtgcccagcctcactttcttctttagcaggcctccctgccctataccttctgctcatatttaatgcataggccctacagtcagatgaaatcttcctgggaattgatttccctgaccttaattttctatagtcctgtttttacctttcgtgttctgtgcccagctctgttggaatgcttatgcacctactatcagtgactttgatctggctggaggggttctaagtccatatgctcccccttgatttagaattggattctctagtactctgtatttcaggtacagtgtaggttaagtgatttttttttgagctgccatgagatttaagcactttatgtaaaacaatttaattaggtaagtgaattccaagctctaagcactaaggtaggtagaccaagtttt

SEQ ID NO: 30000 - DNA, 2392 bp, Homo sapiens
gctctgtaatcctgccttgtctgttaatgtcaggtgtatctcacagctgatgctgatgaaactgcttaaagaaatcagatatgatctttagcagagccaaatctcatttccatatgtgggtttaagttctgttttgatcagcttcttgagggcagagtcctcaaagtcctacatcatggaatgcaagattgtgtggtagagacaaaagtcgtagtaatttagaaaaaccatcagcttcttgtactggcttctcacagattgttgcacttgagcacattacatctgtatgctggatgaataggaagtttttcaataaaggaggacattccaaaaataggtaacagcttagcctgatacataagtggtagctgctattattgtcatcattttgtttttattattatgattgtgagaactggataaattgggaaggaaagtaaaacaaactaaattttttcaacttatttgatgcaaagctagttctaaaatcgaatagaattacaaacatttattagtgtggatcatgtctgaatgctcaggctatttatctctttaacactatttcatataagtagttgtctttaataattgtagaatgtcttagcctgtttggaatgccgtaacaaaataccataaactgggtggcttataaacaacagaaatttctttctcatttttctggaggctgggaagtccaagattgaggcactggcagatttggtgtctagtgagggtccccttccttgtttatagaacagcaccctctccgtggctcctcacagggtggaaggggcaaccaagctgcctcaagcttcttttctaagggatcctgacctcattacctcccaaaggccccacctccgaatgcaatcaggttgggggttaagatctcaacatatgaatttagcggggacacgaacattcggaccatagcagaaagtatccgtaaaggaataagaatgattacaggtagttcggttcttaaaaggcgtgagtttattctgtagatgaataataaaactgtttgtctaattggtattaccaaaccagaacaattcagctattatatttattttcatggatttatttaaatgtataatgagtttttaatatgagacaagcatattgaagtgaatttttacatattaagagccatcgtcacattattgtttgacagatactgcttttgaaagtaagctaatcagttcatttttgtcaagtattttatatactcagagtagggagtagaattttgaatttgaagtagaatgactgttttcctctgtcaatacatatggcttatattttagatttgctggccattcagttttcatacattgtgacctgttgtcagaacccatatcttcatacttggatcagaaaatacaattcctgttaatagtggtccctgctgcctgaccttctgatcagttacagtttacccaagttgctgaattagaaagcattttaaagtacctgctatttgaaaagtacctataaaggattatgaaaaagaactctatttgaggctaatatctacaaagactttctgatttcagggtaggagtagagttcaaaatgaagcaaagtttaagacgcacatatgcagatgctattagcagtacttgtttctgggaagactaaatgtagtattcctattcctgatggtttaaatagactggttatagatttctgtggttacagggcagacgttgtaatagaggctatgagattttcttcacataaagcactaagtactatttctttctttgtatttattctttagttcttttcaaaaggtgaattggattagattttgcttctatctcaggtaaatcccctactttcaacctctgcaaatttgctactcttttattgtgtctgtaaaaaccaaccttgcatgaattgtgtcccttaagtgctatgattgtgattcccttttttatctataggacacagttttctcatgtttgtcttttcttgtcatggccttttttaagtgaaatgacatatcagaaaagatcatgatgaggccccaaaatagtctggcaattttgtataaaattagtccctgttatcaatggctcatgtttctctctttctttaccatctttaattatttgtgtgtgtgtttttgctgttaggtattgttttaagcactcaaccgttgaagtgtaggtatgaagtgcctgacaggccattgaaaataaacgaagataaattacagttgtagcagaggtttcagtccttgttattcttgatatgataccctcattgtctctggcgaattcctgtagacctttaaagtggcttgtcaaattgcttaacagaattagactttttctctaatgctgctagtggggtcacatctagaattgtctttcaatgtgat

SEQ ID NO: 30001 - DNA, 1052 bp, Homo sapiens
agatgtggcttaagttgagacaacatggcttcagggaaggatcaccttcttcctgcaccatcccctttccagctccccttttgctgagagccacttccactgcttaataaaatcctctgcattcatcacctttcagaccttcatgtgacctgatccttcctagatgctgaacacgaacccaggtaccaagagggcagagtgtaaaaggctgtcttcctgactctccactgagctggttaacagctgtctgcagatggcagctgctaaaagagcattaattgtaacatacccttagacagtgctgtggggccagagcccaaaagcacttctgcacctgcttgcctgtgtgctccctctcccacaaggggtttgagctcagtggtggccaggtaagcgagccatacccctgttgcaagtcccacaaaggggtcaagggaactctcccatcttgttatcttgttgtatatgaacatgacaagaaacatcattatatctttgcttttggcgttcatgcttacctatatgtagaccacaattgtaatcattcaatttgaataaataagtaataatgtagatatacaagtttatatctgtatatataataatggttatataacaactaatacttcttcaatgcttattgtttgtttatgaaatgctatttgttttacatacattggaaacatttaatccttaaaataattctatgtggttaggtatattatcactattttgcagatgataaatctgaatccttggtttcaggatggttgtttacttacccaaagtcatacagccagccagtagcattttgtcacacttcatagttggagttcttatctacattataagttaatgattaggtaattcctagaagtcagcctaagttgccagttatattaactgctacttaaactatacatttttaaatctcagttctgtaataatagtaggtttgcaatagacttagaatgtatatgcaaaccatagttcaggaatgtggccacagtatgcctgtgtattagcacattcacttgtcatcaaaatttttg

SEQ ID NO: 30002 - DNA, 1051 bp, Homo sapiens
ttgttatgaacccagttaatgaagtgtttgcactattatgcatttggatttttagttgactcattaaaataaactaaataaattaataaataaattacattcaggtatttcttgccatctgattttcttttgtttcctaagcttatatactgagagatactgcattaaccgcatatttttggcttctgaaatttgaagagccagtagcagtgaaagcttgaagagccagagaaaacagcctcatctcagagagtttattcttgagtttgggtagtgtgagttcagttagggagagtttggattgtgagggatgtgtatatcatgtcttaaaatagtatatcaataataaatagaacgaaagggtgatttaagacgttattacccctccaccattgttctattatgtacccattgaatataaagatattcctcaggaatatctattcctctccaaaaataattgtcacagtaatttaataactgaattttgtatacatcttaatgttctgtttgtgctggcttacatatatgtaagtaaaatggtttatcatgttttaatacccaagtattgggtattagaagaattgaaagattatctacataacaagagtgtatagtcttgaaaaagtggagtctgttatgcattatgcttagacagatggcagaatggaaagccctcttttaaaatcagcttttatagtatggcctagcgaataatatataacattatgctagcacactcaaccaatttgtttactcattcactcaacaaattgagtgcctgatatgcatgagactgtgtaaactgtatctgcttggtgcctggcccctggagattaaaatccagttgagttttctactattcaagagatagtatttgtagtctggaaacaagtagcttgggtttgcattctggctcttctacttactagctgcttagccttgggtgaactgttgaacctctttatttctcagtttcctcttatagtttaaaaaaaaacaaaacaggaagaagaagagggagggggatgatattaagagcatctacctt

SEQ ID NO: 30003 - DNA, 1044 bp, Homo sapiens
tctgcataatatcaaccattgacataattttttagatttatttttaggaccttccaaatacaggatactattctaaaacctaataagaataggggagatatatatatataaagctatgctttaagagttcatttagaaactttattttactgtgctggaaaatactgtgtcaagttgtacttaaattcaaagacaaaataaattaactgtgaccttaaatcaaaatttaattatgtagtacctatttctttatcttaaaatgtgaagcaaatagttatgagggcacagttggtgtagtgagaaaatacttctctagttactgtaattatgggataattaaataacctttctgaacttcagtttcctcatctacaaaatgtgaacagttcttgtactgcttacttcttagtgtttgcattgggaatcaaatgagatgataatgtgagaaaatgcttctttaattactaagtgtttttcaaatgtctgtgaagtcctaaatacaaatcataaaattagcaatgtagaagactctaggctgcagctacacatgtgtatcttcgaagagtatttacccaacatcctttgaaaagcaaagaagtaacctgagctttcattgacacacaaattttcatcttaatttttgtgtcaaagagatgttgcttcatgtagctgataagctagcatttattgacttcttattgttattttagatattatttctgctaatcaacccttatttctacatgtcatatcatttaatcttcccaacaatcctttgaggtaggtaatgttagtagcttcattgagggaactgaagtagaattgcttaaaggattatctaaaaccacacagctaataagtggccaaatgaagactgaactcagagctgtgttattccaaagcccaggcagctctcctggcccccaaagtaggcaattggaatcacactaggtataatatagcttatcccatattaaagcaccccctcacccaaatcataacttctaaaagacctattgtcataaaatagttttaaaacttggt

SEQ ID NO: 30004 - DNA, 1049 bp, Homo sapiens
ctggcagcagatagtaaatgggagaaaagtaaagccagtaaaaacggttcttaatagaaatgtaaaggaatttaataagtatatattctgttcttaagcctttgaaaaccatgagagattacttttataaaaatatatatatttttttttgcgtgaactccacttcttggagctcaagttcttggcccaaattgtctctgcaaatctgtattatgaaagtctattcttaggtatggtttttaaaggatgacccctggacagttatgttccgacacttttaaccatgtaaccctttcttcacacaaaaatatttcattgaagtacaatatctacagtgagccccctctgtttgaagtggggtaaagaaagaaaaacagaagtccacatatacacacagacatgcaacatgtatgcataaatctgtggtttcaaaggtcacagtttgaaaatcctgagtattttactatgttttcattagaaggacagccccagtttttcaaattctgaactagaccttgagcaataattattttaaatttaaaagtacaaactacaggaagaagattcctgaaagatggtagcagtagtgacattgttctttaatctcatcataaaacagagcaagtaggatatcaaaaccaaaaacctacagatagcaacaacctcaaagctaagtatccttataaacccccaaatactagcaggtaaggacaaactgccaacaactacaaaatcagtgtgggatcagtaaatgtgtggaaggaagcaaatgtaaggaaacaaggtggttgatgggtcctgagaagaggaaagcccttgaagtgccagcaaatactcattggaaagcacagcaagccaattacatagcaaccactgagattgcttgggcgtttttgtaatgtttaattcataggtgaataaaggagactggaaagtgattcagtttgatagtgctaaagcagtctgggccttaaaaactcctgaagcagacaaaccaaagttgtcttccagaacaaatgctgtcactgaaggaagctacttgaagtaga

SEQ ID NO: 30005 - DNA, 1043 bp, Homo sapiens
tagtgctgcaaaggaacacctgccttgtggagtgactgtgctatatatggctgttgttgtgtgtataccttatctacttatattcttctaatcatccatccatccatgcagtaaacatatagggtaagagggatacagagatgacagacagtcctgtgaggggagaaacttgtttagcactggttctccagtacctggaacagagtaggggctcaataaatatttgttgaatgagtgcatgggctcccgtccagtgagaaaacagaaaagtaaacagacagctaaaaggcagtactggcacacctcgtttgacagtgcttttgtgtttcacatatactgttgttattgttttttttttttaacaaattgaaggttagtagcaagcccgtgtctgtcagccccatttttccaacagcgtgtgctctttcatgtctctgtgtcacattttggtaattctcacaatatttcaaactttattattatatcctttatggtgatctgtgatcagtgatctctgatgctactattgtaattgatttgtaatggcctctaagtgttcaagtgaaaggaagagtcaaatgtctctcactttaaattgaaagatggagataattaagcttattgaggaaagcatgtcaaaagccaaaacaggccaaaagttaggcctcttgtgtcaagcattagccagttgtgaatggaaaggaaaagttcttaaagaaaatacaaagtgctactttgatgaacacaggaatgatttaaaaaaaaaaaaaagcaacacacccttattgctgatagggatttagtggtctggatagacagtcagaccagctacaacactcccttaagccaaagcctaatccagcataaggccgtaactctctgcaatcctgtgaaggccgagaggtgaggaagctgcagaaaaaaagttggaagctagcagaggtaggctcacaaggttttaaaaaagaagccatcttcctaacataaaattgcaaggttgagggtgaccaaggaacaaggcaggtgcaagatgtagaagcagt

SEQ ID NO: 30006 - DNA, 1045 bp, Homo sapiens
catttcaacatctgagaaaatgaagaagaatcacaaagagtaggcagagaggcaaacgtttcgaacaaacccacatactaagtagtctactaattgtgatataagtgaatgtaggaaactggcttctccctggaataattattacgagatttacacaattccaggaaaacttaagcaagtcttgttgagcaggctttcaaaggctttgttatcatgagcttcagcagataggttaaaaagtggtgtttctattatacctttcatattgagaacatatgaccatgagtgccttacaaggttagtctcaggatcttcccaagttgccggtggtgttgggccacagacgtagttccatattctctactatttttttcctaccaaacattagcttttgatgatttttctcattttccctagtggatcctccttacctgactgctctaatatacccaaattcccaataccaaaaataggggaaatataaatcggggaaagagtgaaattagagaattggagggaaaagagtagaatctgggatctttaggaacctaagttactttttttttaattgctttgctttttgtttttttgtttttttgtttttttttttttgtctttttttttaaagagggtctcactctgtcacccaggctggtatgtggtggcacgatcatagctcactacagactcaaactcctggactcaagcgatcctgctgcctcagcctcttaaagtgctaatattacaagcatgagccaccgtgccccaatttttttaattaaacgttgacccaatcaatattctggatagagagctatctcccagcaccctgttaagttaagcaccctgttaactaacagcaccctgttagttaagagggtgaactctggctccaagccctgctccacccctttctccacgttgggcaagagactcagcctccttatgctccaatttcctcctgtgtcagctccttagaaatccatgtcattaacatattagagttttaggacatggttagtcatggtgagtgttagctattatt

SEQ ID NO: 30007 - DNA, 1025 bp, Homo sapiens
agtggtttctaaaccgtgggtagaggaaagcccccattgcaagtggtctgaacaagaatgactctctggaaataggtatgagttactcctgcaaatctcttgccagttttttggaaatgcaaatgctgtctgtcaagatgaagttgataaagctttttggtattaacgcttcttaggtattaaagaaacaactacctttttttgtgactattttatagtgggagttgggttggcaaggaggactgaagtcaatatgtatttttatatgcgttgtgctccggggaggaaatttttgcctacgtgtgtaggtcttaaaatacagttatttgaaaagattcaggtaaagaatcaggaaaccaattttccaaactttgagtctaatgtacagtcatgagtcaaacagcgggagtatgaatgtctcagaaatgaaacgctttttgatagtagaatttagcaggacacaaatacgtgtcaattgagattgtgaacaaacccctttctaaagttgacagatacgtagggacaggaaatgtcctccagtaggaaggtttatagaacctcccccagtcgtcgtccttaaaacctgttcctcattacatatagctcgtccgtcctcctacccgcagaaaacctttggaaaggaaaacgtatcctttgtgaattagattgctctgtgtgtgtgtttaaaatttttttaactacagtgctgcctcggtgagatttttaagttgtaacatagccccattgggctttatatgataggaggaggaaaggttataaaattaggcaccgtttagaaggtggaagaagcttagaggccctaaactgtcgtattaattgatgctctaagtgcctaggtaagcaaaagacaaaggccagggcttggtgtgaactgcctggtggcttcggcctatgagtgggggatggggccctttgtgaagtcgagggttggtgcggagggagaaaactgcaggtctccagtctatccccagtgtgagctagagagcggaccatgaaggaagtgg

SEQ ID NO: 30008 - DNA, 1050 bp, Homo sapiens
ggcgcgcgcggggtgggggcggcgtggccgggcggtggcagcccaccgctggggagcgacctgcggtctgggcctcccgggcaccccgccacggctggcaggtcactcgggcccgaggggcctcgtggggagcggccatgttggcttcgtcactgaggactccgggcgggtcgggtgttgagcgaggcctcggaccttcggcctgtcgggggcgccctgccggggtgggcatgggggcatctgaggggtgaaaggggcaagggaggctggaggctggcgtccttcccacgcaccgatggctgtgatctctccgtgctggggagaggtgcaggggagggactgaggaaaccggtcggcaagtgagaaactttaaaattaggtcctacatggaaaacaccgaggaatagaactgccctggtgtgcgaggcaaggttggaagccaaactttgcagatgagaacaggagattccaggctgcctcacttcctccgtgaaaagtttttttcctaaactagggacctgaagttcttgatgtgtagttcctctttgcccagtagaatccagtgatcgcgcttaggtttatctgcagacctgcacgctacaggtgggaggcttccgcgccttaatgcttcttgtgtttgtctttcccatttctcccactccagaattcagaaggagctggcggacatcactttagaccctccacctaattgcaggtgagttgcttttcggattttttccatttttaaaattcttctaacctttgtcttgggtttttctttttattatatactttttctttgattctttggctaatgcttgttatggcactaacatcacgtaacagctgaaatttattaacctgagtataatgttttgatgagcctctgacaagctcagtactgttgagaagaagtaatggatttatttggagtggatttttacatatatgaaacaaaactaaagtaaatttaaaggtgtctccttgcctaatcatgggtctttgatatgccattaaagatgatgtaaaacctttcagatgcgaaggaca

SEQ ID NO: 30009 - DNA, 1034 bp, Homo sapiens
ttgattattgcaaatcagtagaattgctcctcttgaaggaaggtgcactgtttgtgttcactaattttggcacttggcaaaaatatttgaagttactgagcatcaaaacttatgtgaaatgcaattgctcaatatgttataatgtatgaaaacataaaattaaattcttaatgttgtatattatgttgggtggatattttttagaacacagtacagattgtgttcaatgacctggtccaaagtcattttaagtaagtattttcaaactgctttatgttgccatagaaatcaaattcttaattttagtatctgtgatttgtgtgtgtgtgtatatatatgcatacacacacacacaaaatagtttcccaactcactcttcattttggttaggcttttattcccatatcatttagctctattcttttagggaaaaaaatatgttaactttgtaatgattccctaaagcgtgccagatcttagattgtaaaattatgccttttagatagctgatgaactctgggccaccagagtcagttttgcagctgttatttatagcccagggctcaaactttgctaaattgactagttataactagcctgtagacacgaatatctgtagacagtatgtctatacagactaaatggcatattttgcctaagtcctttaaacttcagattttatttaatggatatatttgtttcatgagtaaatgtctcagtgacttaacctagaaattcagatggggtgctattttaggataaaatgtctgaaaagtcattaaacacttcaagcatgggtgagaataataaaaatacatttctttctttctcactttttttttgagacagggtctcattttgtcacccaggctggagtgcagtggtgctcactgcagccttgacctcctgggcttaagctgtcctcctgcttcaggcccccaagtagcaggaactacaggcgttcgacactacactcggttaattttttgtatttttttgtagagaccaggttttacctattggccaggctgatc

SEQ ID NO: 30010 - DNA, 1122 bp, Homo sapiens
ataggctaaaagctcatcaaagtccctgcttgagaaccgtaatccaggaactttgctgtatgctaatggctcttttcttgaaacatatacacagtgattatggattgctttgtagagtccatgccacattacatagatgatcaacctttggaaggccaagttgatgtcccatcccactcaggaaatcttacaaagccaaaggttttcacatacagaacatatttaagttgtcactgggttttgctacagtgacagcaaaccattggggcagtgtgttgttcactaatacttttaacagagtagttaaaaactgaattctgtctgctctccaaagtacatgctgacccaaatatgacaaagtgaatgcaaagccctcttatatagcattcaaaggcagatttgccacaggtgccacatctgacttgtctgtagtgatctgagtcattattaaattttaaatagtaatacaacggagtagtcttagtagagtctactagcattgaaatgatgatcattatccatactgccagtacattggccatttgtatttattaaaattgatcgatggaaaattggtgtgggatggacctctagtaaattctacagaaaaaggcattgaggcacatttccaaacagatgagagtaaatagagtaacttgggatgatcttacttggagaaaagttttagatgtgatgcagctcaaaaagtcagcattattatgaagcaatgttgtacatgtgacagcagcatgagtagatcagatcgtaatcatttaaaacattagagtgtctgctgtgtgctaggcattgttctgtaggtgactaaaacagacctggcctctggcttgtgaaacctgaattttagtagacagtgcaaacagcagctaagcaaaaggattagtacaagttgtaatggctagtaggaaagaaattgacagagtgcagtgatggagaataattggggagggtgtgagggttacctagagaagccttacaaagacatttggtcaaagacctaaaagataggaaaggaaatggccttgtgaaaagtaccagaagacatctgggacagagggaaggtaaaaacaggccctgaggcggggacaagtcaggtgatgctga

SEQ ID NO: 30011 - DNA, 1047 bp, Homo sapiens
tttgatttgcatcgaccttttgtattctgttcaagctggagaatgcactagaatgagttggatatatgtatttacttttaacacagcataagttactcatcatatttaatgtttttcatcccctcccccatccccccacccccaacccccgccaccgcccttccagagacggagccttgctctgtcgcccaggctggagtgcagtggtgccttcttggctcactgttacctgtgcctcccgggttctagcgattctcctgtctcagtctcctgagtagctggggttacaggcatgtgccaccacgcccagctaatttttgtatttttagtggagatggggtttcaccatgttggccaggctagtcgaaaactcctgaccttgtgatccacctgccttggcctcccaaagtgctgggattacaggcatgagcctctgcgcccatcctgtttttcatccttttaatatgggctgttatgttaatgctttacattggatatacttagaactcttaaagcaatcatataagcattgtctttttaattgtccactgatcatgtcttaataatttgtttcagattatgccagatactcttggtcctgcttaccttgataattgagggtagaattaagaaagttttaggattaggaatcattcttctaattcagagagtaattagttggaatcacaaaagcattaggtgctgaactgccagagacaagcaacaaataatatgtggaaccacaactgttttggctacgtaggaattttgctccacaagtaatttaaattgttcctactaccacttacaacctttcctcctctatgggggtacatctcaatttttaagttaatatattagaattggtgttataaaaatttatttcttagcagactttgctacaacacatttatcctaaataaaaggagattgttgactttgcagagaaaaagaccctaaaagaaaacatttgttttattacaagcacccaggaggattttttataaacatgaaagataactttcctctaacctaagtaaatatttc

SEQ ID NO: 30012 - DNA, 1916 bp, Homo sapiens
agttgttgccattttctgcattcacactactggattctttgtagatgcggggatttctacttctacattttactgtaactatttacatttacctgtattgggaggaaattctatattgtagcaagttaaaacacatgattttggtaaaaaagtaaaaactgttaagatcttggagcccagacttatttgttatggagatttggagctaggagggacccgatgctcccttctctgtctctgtgtcctgtttattgtgaggtgtatattgataatgaatttgtgaagaaaggcattctttgatgacttagcagagaaaaaagtgatagtaattttatccattctgtctccagatgactggtactatgttttactttctcctcttttctccagagccactcttaaaatctttctgcagttaatggtttgttatagtccaattttcattgctttccaagatttgaactttctatctgaatgtaagtccccctccaaaagcagtcatctttcagttctgtagctcctctgatactcttcaagcccctcaaggagcattaggtttgaggatggtaacatttactcgttgtcctttgacctgaagatgcgtagaaagaaatgctatgttggatctcagtatacctaataacagtcttgcaggctgaatttgcattttcctttctggttgaaatcttgtcagtttactcatgcatttctgactttctcccattctggtgtgcttcctccccttcctgctcccttaagaaaaaaaaaatggttagccagttcggtgaagttttctcagaaatttcttgtggacagtgctaacttaagccggaaaacagtttgtgacacttgacttttcaaggaggagataagattttgtgtacccagactgtatatatcaattattatggggctaaactttgaaagtatgactagttccccaacaagtatatacgaaaccttgtaggattagtaattatatttcttgaattaattttaaaaatatgtaacatactacacacacatcatttgcaccatgagaattgtccatactaataagagatttttgtttgttccagttaaatcttactcctagttttgcaagtgtattcaggcctgcatggttgtcagtgactcaggtggggtgggcagggcagtctccaacctgccccacctgtgtttctctgcctgtttacttgtgaccttggctgagcagtacaaatcattgacaacactggcagtgctttggtctgtgcctgccctggcttattccattttttggccctttgattgaagatgcagttacaaccagtggctcctgactgtatttagtcattcgttctgatatttatcggccatttattgttgtgccaggtactgaagatacagcagcaaaaaagacactgtctctgtgctcatggagattttattcatatagagggaggtacaataaaagaaacaaatgtacaaaagtaatttcagaaaacagtaccaagaaattaaaatagagtaaaatggcttggtgagtgactgcgcaggttgggacattggttggtgccacattggggaaatgaccctgaatgatgacaaggacccaaccatgagaagggcattttaggctgaaggacagcagatagaaaggtgctgagtggggtaggccagtgtggctggacatagtgaatgagggtgagagtggtaggaaatgaggtaggcaggggtcagattttatttgaatttcagtagaaagccgtgggagagctttaaatggaggagtgaaatacgaggtatttggagaatacctcacgtaaaatttcctactcatgaaaagagagaaggcaggtgcagtggggcatgcctatattccccgctgttaggagactgaggctggaggatcactcaaggctgggagtttgaag

SEQ ID NO: 30013 - DNA, 1026 bp, Homo sapiens
aaaggaaagaggaactgagaaaggaaaggggtctagaagagcggttagaaatggggactttggttttcccctcaggcttagctcactactttctataaataagagatgtctgaaagagaagcagataaaaggagaaagccttcagcaaatttgtgagttgataagcatggattgattggctctgttggcctgggttcttgaggagtttgctgctatttcggaatttctgtagagaaaccctggcattgtcaggatatgggtatgccacatgtttcccttcctcccccttccctccactccttcttattacctagctagctacacctggaattttggttctagaataatttaaaagatactttgtcaagaaaatatctttggaaaaatcatgcatatattatttttccttttttctttttaactacttcctggttctttaggctcctctaattcttacatgcatgtgcttgatctctgggccatgcttgcttctagttaagtagcctttcaggatggtgtttaatttattctgagccctttataatatcccctgacaagagcatggagtggatagagggagtcttagtcaatatgtattataaatagatttagggttcacaaaggtcagcagccttcatctcttgccctacccccatcacacacaaaaataaaaatcacaaataataaaggattttaagagttataccagtcgggagtgggttcatttttttgtttttgtttttgtttgtttttggcaagctgaagtcatctgttggatccaaaaatgcataaaaatcttcaggcttatagaaccaacagcatcaaaggaagagcagtgtgactcaatattggggtgggggcaggtttggggttttggttgtgtagaagctccttatgagagaacagtgtgatgcttggagctgtggagaatccagccactgctttttctctcttccttaccttattactcttcttgattcacctggatgtggaaactgtccctgtttaagagtggccttgtcaatg

SEQ ID NO: 30014 - DNA, 1434 bp, Homo sapiens
ttgtttggcatattgagtaacatggcaggttctggagccagactgagttaaaatcctagctctcacataatagctatgtaatttggggaaggaacataaatctctactctgtttccttatctgtaagatagggataataatgcctacctcatagagtttttaggatttagaaatgtatataaagcacttggaacagtgcctggctcacagtaagcactaacactaacaaaaaagttatactattattttcacctcagttatacaggtgaggaagttgaaacataaaaaagttaagtaacttgcctgtgatcataaagctagaaagtttgggagccagaattaaaatacaggagtctgagtgctctgtttagatttaggacctgagccagggagtgtgttccaaacccagcactaatacttgagaagctctcaaaactgtaagtatccccaggatactggtgtctcaaaaagatagtaatgtgttaactgtaagctatttagtgatacatttgctttcttctgcagagaggagggactgaattttgggactgttgcctgcaccatcccagtccaacttgctatgtgtttttatttttagccattggctgattccaatttgaaattcagaggatttgtgatatattatgtgatatgttttaaaaattactagctccttgctgcattttataaagcgttggagatagtttttctttggttggctgattggttttggtgttttgttttttagaggactagcctacacctggtttgagtaagaaagttttgtttgagaagcagcgtttttaccaccttcaatcttttgaggaacttttggcatgtggaaaattaaatactacaaactttcaatagaaggtagacaggtaatatggagaactgagaattagaaatcttgaccatgctgttgggaatttcccttttctttctgcttgtccactaatctgcattgcttattaaaacaggttgatacttttaaggctctgcaaagaagttcttttcattggttagtatctaataagtgatagctggtacaggactttaaaaatatataataggggtttattttctttatttttattatttattttatttttttttgagacaaggtcttgttctgttgcccaggctatagtgcagtggcacaattacagcctactgcagtctcagcctcccgggctcaagtaatcctcctacctcagcctcctaagtagctgggactataaacgtgagccaccacacctggttaatttttgaacttcttggtagaaaatgtttcgccatgttgcccaagctagtcttgaacttctgggctcaagtgatcctccctcctaggccttccaaagtgctgggattacaggcatgaaccaccatgcctggactagcggtttcttttaaacagcatataattgggacttg

SEQ ID NO: 30015 - DNA, 1072 bp, Homo sapiens
agtttgtttctccatataatgtgtcatctttttgtctggctacttttaagaattactctttatcactggttttacacagttagattatgatataccttttgatgtagtttttttattttttgtatttcttgtgcttggtgtttgttcagtttcttggctctatgagcttatagtttcatcatatttggaaagaaagtttgttttctgtgtttcatttgaataatttttatggctgacttcaagtttcttatttttcctttgcatagtctaacatgctgttaatttcagtatatgtttaatctcagttgttgtatttcttcatatctggaagtttgatttggatctttttataatttctatgagtccacttaccatggtcaggtatttatcattttaaatttatgattacagttataacaagcgtttactgtctttttgtccactaatttcattatctgggtcatttctggatcagtttctattgattggttttttaccttatattttcaagcccctgcacatgcgtgataattttttgttggataccaaacattgtgaattttgcctttttgagtgctgcctttttgtattcttaaaaatattcttgagctttgtcgtaaggtgcagttaagttggaacttagtctgatccttttgaggcctgcttttaagcttttaaggcctccttttgaagcctgcttttgagagtgaccagaacagctattaaggctaatttttaccattcactgaggcatcaccattctgagtattctgctggatggcccataagttaccagggtctttttctttctgactaatggcaatgcaaactattctcagccctgtgcgagctctggggagtgttctctctgttctctggtgattctttccctggcattgcgtagtgtcctctcatgcatgtgctaattcatgcttaggtaaatacttgacgggaccctctacagatctccggagttctgtctctgtgcagctctggtacttgtgaactctgaccacttaggttattccttcctgcaccacaggcgattgtaggtctcaatatatttagtttt

SEQ ID NO: 30016 - DNA, 1028 bp, Homo sapiens
tttaattgttttagggttttttttttaagaatagatgattgatttttttctgtctctctactcttcttactcagaattagatgtgctttgagcacgtattaattctaatacgattaaaggtcaagccataccacaagaatatttatattatatgtgttgattagagttggacttgtaatggccgcattgttagagattgcatttctactttccatgaattctgttggatttgcagataaaatgttttctgtctaatagggagaaaatataaatatcatgcattcatctctcatactttttcatgtatcatgccattcacagttctaggattctggagccacatttgtagccaccattaaccaaaacaaaaacaatcccacatgactattacctttgaattcagtattgtactgtattattctgacacagaaatttgaaatccaatgggttggtgagtgaaaaagtcacatgcagctgacagtcacagtttttatatgactctcctagatctttttgttttgtggacgtatgtttgggggtagatggtttagagttctattaggagagagatgaaggtattctaggtgagtgttgagtggctgactgctgttagagggcaaaatgggataatcttttacaaaaaacttgaggtacatgatttagtactttgattatcctagtgattgttacactgaatcagaaaatgcatttaccttaaaacctttattgtaactaggtgaaagtaaatgtggtgtaacttttggtttgactataatgggcagtggaatctcagatgttaggatcaggtaagaagaaagattgaactatgtcatgacccagtaagtgaaggggtgtgtgtgtgtgtgtgtgtgtgtgtgtgtgtgtgtgtgtgtgtgtgtgtggtgttgttgttgttggcgacagggtctcaattcgtcgcctaggctgggatgcagtggtgcagtcacgactcactgcagcctcaacctcatgggctcaggcagtcctcccacctcgcctcctgagta

SEQ ID NO: 30017 - DNA, 1042 bp, Homo sapiens
ttatcctgcagttgtactgacttaacgatatcttcttgatatttcttccaccatgtgtaattttttatgctcttagggctcctttaatgaaggcaactcatatgtaaaatgggagtatgtaaaaataatttgtgggagagccatgtgggtggggtttgtgagtagtctctaaggcgcaggctacagctagctagcctagtgtttgtgagccctccccttcccccagtaaaggttgattcctttttctcctctttcctgcttgtttattttattctattttatcctcattttctacttctgccccaaaagcacccattctaatgcctttcactatattgtttgtgttcttgtaaaatgtatttagtgtttgtatttttaacttacataaatgatgcctaattctttcttacatttttctaagcacaatgttttaagctctctccctgttgctatgcaagcatctaattcattgcgttgaacagccacatagtattccaaggggtatactcattttatcttatagaagaccagatcgtttccagctctccatccccactaacagtgaacattctggtccgtaatcttttttggacctctgtaagaattaagcagaactgcaaggggatcatagggcttacttaaatttgatttgacttaagttgtaccagattgttccccagaatggctgtactcatctccatgcccaccagtagcagagcatgagaattcctgtgtcctcttaggtgcgttctgattttctaatttttgccaatcatactctacacttacatatggagaatatgttcatgaacatgtaggtcagtcttaggtgttatgcgtgggagatgggttgttgctctcccagatatgaagacgtgctccaataatactacactgtatttattaccgtagccctgtggtaaggtaaacagaccaatgaagctgacttggagcacccagagatggacatgtgtatatgtaggattttaatatataatatataatttatggcagcaccaaacactgaggacaagatgggatt

SEQ ID NO: 30018 - DNA, 1043 bp, Homo sapiens
tgtttaccaagttgcccccattttatttagcaatgaaattgtaagccacatgacaattccctttttctaagcatatgtaggagtagagtgtagatcagtgttttctgaatatattgtctgtatcagaattacttgaggcagttgttaaaaatggaaattcctcttttgtccatctccccactgttttggtttctctctctctctctctctctctctctctgtgtgtgtgtgtgtgtgtgtgtgtgtatgtgtgtgtatgtatatatataatttttctttttaaacaaaacctctctagggtggagtttggcaaagttatttagcagaagtccaagtagtaaatattctaggcgtcataggccatttgatctctgttagaaccgttcaactctacccatagtacaaaagcagccatatacaattcataaatgaaaaaatgtggttgtgttccaatacagctttattacggacaccgatttcaatttaataattcaatataaaatttattaatagttttcacgtgtcataaaatactagttttctttagatttttttaatcacttaaaaatgtgaaaacctttcttaactagtagaccaaacagaaacaggttgagggcctgatttggcccatgtgagtcatagtttgccaactcttgctccttaggcaactaaggttttcaaaccagtgccctagcttatctgatagttaactgtcattctctgtattatttgggaaaagttcttacatcagtaacatgaattttcagtacctgtaagagaaagtagttcttaatggtcaggaagggataattaaataaatgtcttacataaatctagtttaaggtaaatgtaatgttgaaacatttggttttttaaattccttttaagcctattcaagagtgggtaatagagctgggtgcagtggcccattcctgtagtcctagctacttgggaggcttgaggtaggaggattgcttgaggctaggagtttgagttcagcctgggcaacatggcaaggccacagtctcttaaaaaagagaatg

SEQ ID NO: 30019 - DNA, 1019 bp, Homo sapiens
aaaattaatgtcatgattatcaagaatgtttccagaaggcagggctcatcagtccttgacaaaaaggctgatgaaaaaaatggagttgagtgcagccgatcacctcaataatcctagcagtttggcaagctgaggcaggaggatcacttaagtcccggattttgaggttgcagtgcgctgtgatcacaacactgcactcggcctgggtgacagagctaggctgtctcttaaaaaaaaaaaaaaaaaagagagagaatgagaaatgccatttaattttgagcctggcaggtctttggtgacttttgagactagtttactgtggaatgttgaggtaaagtaggactgaatcacatgtagagggatctgtgtgtatttaggagaagcatcaggaaattggcactgaagggcaggagaaagctggcccagcagcctggaggggtagaggtgttcaggagtatgttttagagtctggtggttttttttttctttctgcataggaaagtttgaactttttgtaaccaagtgttctattcactgttaaagtaaaagaggaattaggtaaagaccacatgtttatcttagaaagaagcacacatttttgtgaaatgaaagaagagaggagtgaaaatagaaattttcatgtgggaagaattgaagttgaggtagcaaggaataccaagacaactgagaagtccttataaagaacacattcagtacttttaagatgttattttccaaaacatacacttttgggttgcctgtcagactggagatgtatgcctgtcgagtcacgttacactgaatttatttaggaaatagtctgacatacagaagtttcacttctcctgccacttgtgaaggatttgtctcattggtgtggtgtcagcctggtgagataggacttgcttgtggtttggaagctgtctgtgggcaactccaagagctgttgtgctctgcctctttatgaaccttctgtgcttatggaaatggttcccagcgtgtgctcctcaggaatgagt

SEQ ID NO: 30020 - DNA, 1040 bp, Homo sapiens
atatggttaacagttatggatttttaccatattcacaattaaaacaattatttaaaacatctatgattgattttaaaataacaaaaaacatattaatataaataacattttaaatgaaaactgtttttcaaaattaaacagcctaggctgggcgcagtggctcgtgcctgtaattccagcactttgggaggccaaggcaggtggatcatgaggtcaggagatcgagaccatcctggctaacatggtgacaccccgtctctactaaaaatacaaaaattagtcgggcgtggtggcgcatgcctgtagtcccagctactcaggaggctgaggcaggagaattgcttgaacctgggaggcagaggttgcagtgagcctagatcacgccactgcactccagcctgggcaacagagcgagactccatctcaaaaaaaaaaaaattaacctagaagactggtactatttcacatatttgcagatgactttaatgtctgacttcttagcagacaggtagattttcatacctgcttctgcattcaggctgtggccctctcacacctggtgtagattcaggaaaatctcacagtacaaatgtgagaaaatgggagtaaaaatggtaagtcatgttttagatttatgaaaatagttttgactttatggggctcccttgaaagggtcttgggagaactgcctagtttttccctgatgatgtaaatgctaccttcagctgaaggcatctttatccttcaaattcacatgagctctgtactgagggaaggtacagggagccggacctaggatgagagaccccatggccctgggagggtgcaggtggaggttgaggttgaagcagcagcaaaatgtcagaattaggcagtcgggcgcggtggctcacgcctgtaatcccagcactttggggaggctgaggcaggcagatcatgagatcaggagttcgagaccagcctgaccaacatggtgacaccccgtctctactaaaaatacaaaaattaggcaggcatggtggcgtgtgcctgtaatccca

SEQ ID NO: 30021 - DNA, 1037 bp, Homo sapiens
tctcttctgtctcttaaatgaaggcatcagactttgtaaccagttagcagagggcatcttgaaggagtttgtcttgttcagcatcaaaacccctgacatttaaccctctgcctagtacatgggcattcagtaagtgagtgaataaatccaattcacatcgtacatttatttaaaagagtagttttgctgggtgcggtggcactctagaagccaacacaatgctttagaatggtattgtggccaaattatggtgtacccaagtgtatgtaacagtgatttatgataacagctaacagggttggaggaatgtctcaagtattagtatttagagaacccaattatagaatacacattgaaatgaaaattgaataacctgtaactggatacttaccattctcctcccacctaacatggacatactttttacattataaaccatctattagattcttttaaaggtgagattatggagatagaagagcaaggaagagccagttagtgggtcagaaaatgaaacttctgtgcttaaaatggtcataagtgatgtagctgtgagcaaaaactgctcgcatttgtcactaatttcgcttctaggtgctgagatgtgtttcccattttaagtattgtttacactttcctacgtgtccaggagagttttgagaattgaggaaagtttcctgcttattcgtagctaggtaggcttagaatggttttaacattcttttatcatccagtttgcttgaccaatggctatgggtttgttgcagttctgcatccgtttctgtacttgttttgtaaagagaatccacacagtaaacaaaagagaggagagaggtaatctttccatctcttttaatacactgtaaaaattgggatagtgccaccatctgcttatttgttgacgtattattcacagtgctggtcccaaaggcgataacatctatgaatggagatcaaccattctagggcctccaggatccgtgtatgagggtggtgtattctttctcgatatcacttttacaccagaatatcccttc

SEQ ID NO: 30022 - DNA, 1055 bp, Homo sapiens
tcacagtattcacaatgccgttaactggtgacattgagctaagggtcacatgaacacagctggatgttcattgcagtctgaagccttgaccgttccagtctctactgaactcagcctaacacataagagtaaagaaactccaattgagtgttgtttgttgggagaaaaatggaatgaactaagataaagacagaccagtacactaaagcctaagcattccctcttcccccaacgttatgtttttttgaaattttgatggaaaaatatccagcatggtggagtggtgtttcgaagatgggtttgatcacacatactttgtcgtacgtatctacccaagctgtcactattcgctaaagtttaaaatgttcttttcctttctccaaagtaatctacattcttttcttccagccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctga

SEQ ID NO: 30023 - DNA, 1026 bp, Homo sapiens
cagcaagaactgtcaaaggcctctctgaggagcagcagtgaactcatcagatcttggaaccactactgtcttccttcctgtctgtacattgagcttgagctccctgtgctccagtaaggccatgccttgctggcaggatgaaagtgggccagagctccagttttctaggggaatcacatactctatctcatctttcaagccctcctgtcattcttcatcacccagggtttcatcttcatgtatctccccctactgtgacctccatctccctctcctcccaactgcagaaactcgttcactttaccccttagaattcagcaagactaacccccactgcatcctccacctctgcgtcctccacctctgctttgaatgttccttcacctttcctagttgccttgcagtcctgcttcctctatcactcccctcctaccactaccacaaggttggggtaagatgtcctccttgtccctcagtgctacctccaatggtgtccttctctaaaacccctgcagaaagctgatgctatcagtctgttgtacctactaatcccaggccggccccccaactgctcctcatcacagagctgactcatggtcaacctgctctcgccgttactctggtcataattcttagtgatttcactggccacgtagatgctgcttccagtaacctggtctcttattctttgacttctccaatggtctcatcatccttacctcagccattcaccactcccgtggtcatatcctagaccttgttttgtttgttttttttaaagagacagggtctctctgtgtcacccaggatggagtgcaatggcttgatcatagctggttgcagccttgatcttctgggctcaagcgatcgtgatcctcctcctcagcctgcccagctatttttttaatttttagagatggggtcttactttattgctggagctggtctcaaactccttgcttcaagcaatcctcctgcctcagctccgcaaagtgctgggattacaggcgtgaactaccacatcca

SEQ ID NO: 30024 - DNA, 1049 bp, Homo sapiens
tccagtggtgagccaccatgcctggcctgatgtgtcttacaaatataatgttgagtaaaagaagccagacatggattaatttaattcatagaaaatccatagggcaaaaaataaactagaccatttagtgacacacatatgtggcaattaaaaataaaaagaatgattaaccaaaagtcaagggaaggaatgagttgcaactggacagaggaacacagggagccactggcctgtcctcaatgttgtactttttgatccatgtggagattatgtgaaggtttgtcttataattattaaaccatatatgcaatgctttcaaaattccgaaagtatattatttttgacctagagttccatacccatcaaaattacaattcaaatgttagtgtaaaataaagacagtttcaaacatgcaaagcctcagaaaatgtatcacgtatattttctcagaaaactatttgaggagaccctccataaaaactaatatgtaatcatagaaacaggaagaaacagaacctaacacagatatgaagtaaaggaaatcacaagcacaattagtaaatatctcaattcggaagccccagggtcacgactacgtcccaggtagagggcatgttgaaggccatcatcactggatgttctgttctactgtacaaccttttcaaccccagaaaagtactggaaaatgtgctccaaaaaaaaaaaaaaaaggtataagccaaaagaagaaaagaagacaagagatctaggaaacaggaaatcaaaaccagggagaggccgggtgcagtggctcatgcctataatcccaacattttgggaggctgaggcaggcagattgcttgaggccaggagttcaagaccagctggagcaacatggtgaaaccctgtctctactaaaaacacaaaaattagccaggcatgatggcgcatgaccgtaatcccagctacttgggaggctgaggcaggagaatcacttgaacctaggaggtggaggttgcagtgagccgagatcgtgccactgcactccaccctgggtgacagagcgagac

SEQ ID NO: 30025 - DNA, 1059 bp, Homo sapiens
cccatgacgctctgggaggccgcagctttccaccggaaagagggtggctgaggtgggggaggagcccaaaaggcattgtgggagtacagctctttcctttccgtctggcggcagccatcaggtaggctgcgttgaggatctttgctcttccatccgcctttgatcgtcttcctcttcagccatccaggtccggggaccctgcgtcctcggagataggtctccctcctgtgcggccagagtttggtcaggatgcgggacagcaaaggggtggagaggcggcccccggggcgggttgagcgaagatgtgatggcggcgcgaattcgagctgggcccggatcctggaggaggcgtggggctgacgaatggggcgcccgggacaaggcagcctaaagtgaggctgctggttgggtggggtagatgcattttcctcgagagttaatcctcggtggccgcagcagtaccttgtcctgtgatgtcagcggcatctcctttcaggtcctccttggggacgccgcctgccgcagccacccgcccccttggtgctcagttctggttctgttaattcgccccaccaaaacgtgccgagcaccgctctgtgctggggttgcggaagtgactgaacgcggctccgtgggcgcagtggtgggggttgggctagctgtccccggcagttggtgcagagccattttcattcccggcggtttccttgtttttgttggggaactaagatggacggatacagtcgtcttattgtacttaaagcggatgatatttaatacacagtttgatttcacaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggtacgtgatcgactgcgtggatgcttggataaaattatattcgagaaaagttggaaaccagctgttaggaagacactgct

SEQ ID NO: 30026 - DNA, 1159 bp, Homo sapiens
caacctcccatgtgggggaccattgaatatttttgtatactcctgcctcctgttgtaaagggaaaaaaatactcttgctgatgaaaacatctatgggtgatctacataggtttgcctgattttaagatactttattgcaggcttatgccaaatgactggtttataaacatattgtatgacaaatttaataaacacaatatgctaaatgaaagtgaatgtagggttacatagcaataaagttgcatagtgtattagttacctattactgcataacaaattgtcccaaaattcaggggcttacaaatgcaaacatttatttaatctcacagtttttgagggttaagatatgatatgagagataggatatgatatgtgcctctgactcagggtttcttaggaggttatagttaagctgtggacagggctgtggtctcatatgaaggcttgagtagggaaggatctgctttcagttgtatgtagttatcggcaagattgagttccttgcaagctgttggactgagcacctcagttgcttgctgactgttggctagagcccactcttagttccttgccatgtgggcctctccacagggtggctcacagcatggcagcagcttttctcagagtaagtgagcaagagcgtacctaagatggaggccacagtttcttgtaagctaatctcagaacggacatcctatcaattctgccatattttttttcattagaagttagtaagtctaggtccacttagtaggaggaggttgcgcaagggtgcgaataccaggatgaagggatcattggaggccattttaggggctgcctaccacacatggtgacatacaaatgggagtgtattccatatgtattgaaaatatgtttatatactacattattttattttgctaattagaagcagttgaaatcagatgacatctaattttaaaaagtcagaacctctatgttcttgtgaataaaaattcttaacagtaaagaattttgattgatcaaatgttttatgtgatatatatgctttataatatagtaactagctaacgatttgttactgagattttgagaaatttgtcaacttttgcctttattcagatgtataaaaccttgctttctattcgttagtgacactgataagcaagaattttat

SEQ ID NO: 30027 - DNA, 1732 bp, Homo sapiens
tcttttttcctaaataacactacagggattttgtcatattagatttaatttataatttgaaaaatcatctagtgtgtgacctacaggcttagaaatggtatagtcaaagacattttatccacatttctaatagtggacttgattaagtagataagatcagcatctgtttatggtagtaggagaaatagccaaagttgaggattttatgtatgttttcctgtttacctggaaaatagcaattaattggattttttggtaaagattgccttctgtataatgtttggattatataaaattgcaaaaatgataacagcccgctttactgtactaagcctgttactttcatgacgtgtgagcagaatgccttattttgtaatcttgtttaacttgttgctactgggacttgatttactgtggcactagttaagtaagttaaaaaaaagttaaaccctctcattattaaagaggaaaggcgatggtgatgtctgtagtacaatataaaccataattgtgatttaccttaagtaggtataactcttatgggatatacagtatagtttttgtgaatctttacatgatagcattatctttttataattttttttcctaagataaacaaatgcatagttttcttctatgggtgatagaaacagctttttgaagtaatgaaaacctcaaaagatcatgttgattcttaatttttgccttttgcataagcctctttataacatgtatctttaaaacaattaagtctttaggaatgtgtaaccagaactatgttagtattgcttataaaactttagttaggttcaatatatacatatatacatctctatataggtatatagatttgcattttgtcttgtaaaattttatttgaataaattcttcctgtaggtaatgggaaacaaaattaatagttcatatgtcactcatagcatttctatatttgaaagtagcccaatataaaacttttgattctaaaattaaaccagcagcctattacaagcacattctttgattgagtcattggttataaacttactaaatgcagagaaagcagccaatttaggaaacttctgagttggtgggacactgttgattaataatgtactgtatgaattaagtgatgctttaactttgattttacattttaaagttaaaatgtgggcattatgtcagcaaacttaagggcattatgtcagcaagctaaaacattttttttcctgtgcttttaatgtatctctttacatgatctgagagaggattcaagttgatagaaatagctgaggggaaaagggggaacatcttgggatgaagcttgtccttatggtgatggtttaattacagattaaaaaattagaaggaaatttcagtggattaagtgtatagctttcatatctacatttcaagaaattaccattgtaacttgataagagatgatttattttatgtaaacatctttgcaaagcaaggtgtagcagctcagctagatttattactgtgcacgaaagtaaatacctatctcaattattctttttcttttccaatataaagtttgctgaatgtacaagaagagtttatcacttaggatatagaatttttttaggggttgggggaggggatctgttaggaaactgttacctataaacaaagattgactggattcgatccaaaagataaaacttgaagctattctggaactaacatggaaaaatgaaatggctattgt

SEQ ID NO: 30028 - DNA, 1035 bp, Homo sapiens
gctgagaagtgacttgctagaatgtgttttagaagaaacattgttatcttgtctttaatttatttaaaatattttatactggacagtgggttttaacacttaatgaccttttttcattaagtgttgaagaagtacatcactatgttactgggtatatttaataattacattcaatattgtagtgaaatagggacgtgatgctttccagaagagaaaataatcaaatagagatttacaaagccatttgctcatatctccatgacggacacaagccttagtctttatgcacaggtgtatgagaaatgtaaatctttatcttcccatcaatatactcccagcatgagctccattattctgggggttccttcttctatctgagtttcatgtaagtcagggggttaggatgcaacagaacagcgattctccaagtgtggttcccagagctgcaacatcagcatcacctgagaacttgttagaaatgcagattctcactctccaccccaggcctgctgaatcaggaactgtgtggctgggctcaggaatctgtgataacaagctttctagataattttgatgcacattaaaatctgggaaaattttcttatggtgtcaagtcgtgggtgacgacagctagtctgtaatgtcgtcagtccacagtccacaatggcatcagctgagacgttgtcttcccctgttgatccacgcagggtccagctttgctcctcatgcctgactgcaagctctttcatgtcaagttttctctttctctcagctaatttttgggccattcttatggccctgttcatatgatgattctattatttctctatcaaattgagctttgggaaattttgtggttgttatctaaactcaggctactttgggtctctctcaacatcgtgaaattatcctgccatttccttgttactctgaggcttggagaactcatacatcacatgtccatttcttttatggggtcttgctgtcttcatagcctcagcccaagaatgggagtccaagtcttcttcactctca

SEQ ID NO: 30029 - DNA, 1054 bp, Homo sapiens
catttgcaatgtttttatgacaagctggatgtcatcaatccttgtaaatatgtgactcgtaatcactattttggaggaagaagttgcaccagcacatttttagttttgcttataatccacagtaatttaaagtggtcagaatctaattatgcccatttctgatagacattcaaaataagccagtttcttagctctaaagcttcatgaggcgcccatgcaggagtagctgagatcttataagaagaacagaaaatacaacccccttaccctgtctattttaaggcacccctctgtcaaagtgcacttcccatttcccagatacctttgcatggaatcaccatggcattgaatgaaagtgttctgaaacgtggaagaagaattaactccttgaggaacatgttttaaaagttctatttgtctctgctacatgaattgtcagagaagcctctcaaactgcccactggctgtgattttgggctatatcattagtcagccaagctgattaagactaattttggtcaaaataaattcgtgcctgagcaaacaacccatgtgcagaatctcaaccaaaggcaattaaatcgagattccttttatgatggagactcaataactactgtggtttttgacatcattctaatgaaccaacggcaaagaaatgtccccagtgtatcagactatcctagaatttattttctatatttcttctcactttagagttgctctttgattctggcacatcattctctctgataatggtttcaaatcagcttgtctgattcatggctgcacagagaaggttttctcaggagctagtggaatggttattaaaaaaaacatggagaggcagatggtaggctattttactggctcatctgcttttgcagggaatgattatacattcaaagtaagtggcaccagaagtgaaatctaactgaggttgatctcccatgtttccttgtagagaacataaaatacagcagcagagacagcctaaaagctgatccctgaggacatggtcatggtcgtgatacaacctggggctgaagcagat

SEQ ID NO: 30030 - DNA, 1062 bp, Homo sapiens
tgtctgaggtctctgtgtccctctgattccagctaggctcccattattgcaaactcaaagacagaagagagctggaagccaaggcagcaggagtcattccaggtgaggaaacttagcttctttttaggtgagaccaggatcacttatcactcagcctgcttacctaagaggctcacagctgtccgtgaccctctctatttggtatctttctgggtcctcttgaaggtatacagagcaagagacaagaatcttacgaaatttttttaaagttttccagaaaacataaccccatttgattaaaaaagaagaaggttagaggcaggatggaaatgtaacagataaaataaaagcagtattagcagttaaactatggaatacttattataacccaggcactgtctaatcactttacaaatatattatcccacttaaaaaacctttcaacagctctaagaggtagacattattgtaatccccattttaaagatgagataagtgaagtttgaagacattgggtaacttgtttaggattcttgcccatgtagctgactgtagagactgtggcatcagccaccacagggcaggcctgataaagttcaagtgtcccaaagggaaagtcgaagaactccggtgggacagctctacagggtgccctgaagatgggacaagcaagagtgagcttataggaaaagacgaaagatttgtggggatattaagagcctggttctatgaggggcatttaacttattcttgaggattaagaaacgaccacacagtcatctcactgggatatgcactgagaagaatacagacctaggctctaaccatgatgtcacatttggataacttaatctctttgatcttgattgtccccgtctgaaaatggggttaatacaagcaaccctgcaaatcggttagaaggattagattgaatgtgggcaaacctgagcacctgagtgtggtaactaggacagcataggtgcagaataaatggaatctattgctatcattatttctcaatgcctggaatcagggggatgaataggatcttgatgggcctta

SEQ ID NO: 30031 - DNA, 1107 bp, Homo sapiens
tctactaagcatcttgtattcaaacagagactgtttccttttgcttttaagatgcatagatttattttaaatgattgatagagacatagatggactctatgaatgaataaatgaatgaatattggtatcaattgtgagtgaatcaaattgggtttatgacattattagatcacaaggatgctagagttttctgttggcgtttcaccgtaaactgacatggttttagtgccagcccatacaatgttgagatacaatctggccacatacgctaagagtaaatctcaattgtattgcaaacaaatgtattttgcgcacgcacacacgtgcacacacacacacacatacgtcctacatcctgactcctttgaaaaactttattttgcttttttttctatatagccctttcaatttctcagatctcctcaaatatatatatatatatatatatatatgagagaaagagagtccaaatacaaacctttccaaagggacatgtatagttttgactgcactcaaatcagagctcagaacactatttcactattacttttgaataactctatttccaactgaaacactcaatttcccaggtaaactggtaattcccaggagctttcaaagcattttcagaaaacctaaaagaccagttcttttatatgaaggataaatataatcatgtgtatatgttcaaagtagagcagctgtgtaagtccttcatgccttgtaaatgggagtctttgcaaactttattatgttttggtatatgattgtgagattttcaaaacacaatttaaaactttaccatgagtcacaatcctcaaagaaaaactaaatagacccccccttttcttttaaaaaagaaaaaccactaaactgaaaaagaatgggaaattaaatgaacttagacatttaaagatgcaaattgatctcttggacattgaaagacacaaattgatttaagaagcaaagattttggggagccctaagacaataaagcgatcagcacaaagacatctgtcagggtggaggcgacctgaggtaaagaacagttaaatctaatgcaatcaggaacttaggccagtttaatgttttttttgccttatgagc

SEQ ID NO: 30032 - DNA, 1028 bp, Homo sapiens
ttaccatgtcctccttgtatcatgtaaatggtacatgcgcccttttccctcttattggactctaatcaatgtatccatctcttaatctccacaggtctaagcacaatgctataacatgatgggacctcaataaatattatttggaaataattgaacataataagaacagatcaaaataccccgaaactgaacagagcacatacaggtttttattcatttaggaatttctatttactgagcaataatgtgctctatgcaaggcagagtcagccataactggttagcatcaaagttctgcaacaaaaggcagctcagccatcaacagatactgtagcatagccttagacaagctctgtgagcagggaagacagaaagggcagctagatggctttattcttccttgtcctcaggctgtgtaaaccaaccgtgtttttactttggcatttgtatcggatgccggagctggtatctcaaggccatctttctaagacctctgaaacactgacttaatcggttagtccactaacatctgggatggggtgagctggtcaccagagggcaggctcctggcttgtgtttcccagtgcctttgaatctacccaggtggctttgcctggcctgggaacttttaacagtagcctgaagctgcagtgcctgctcgcttccatttatgtaggtctctgcaggaactctgccccagctgatgccatgagacttgtaaatttggaatattcggacaagggaggagagacatctccaaaatagtgaaaagttaaattgttggctgtttctaaaggaaatctgctattactacattcaagaattgctatggaagcgttataggttataggacctcacagtgttggtgtgaaagtacttcacaatgttgatgtgaagaatacatgagccaacacatggacaaggtctagccttgtgcagaaatacagtaagtgttcaaagtgtctccccccgccccccccccccccttttttttttaactactagtaattacagagaccaaatccaca

SEQ ID NO: 30033 - DNA, 1038 bp, Homo sapiens
gactaatacccctgctcatatctcacctttgttcacctctatcataacccctagtgtccaggccgatatcacctttcacctattatttttgtcctgacatgatagatgtgtgtgactagtatcactatttaaagataaactgatttgctatattttgcagattatataagtttcacacaatctaatgttaggaggttgaacatcaattaagaaagagcttatacctttcatggtaactcaccaattcaatactaagaggttggatatgttccaaggtagaagtcctttgtgagctgagaaatatgcttggtggatcccacgctaaagcgacagattatggaatttcacttttgccaaatttggaacacagtactatgtttgattgttaattttaggaaaatgaaatcagattaatttctaccactaaaaaagagcaaatttaaataatcataatcttgaatagcctgtttttttctcttggccagcacagtacatataataaaaaacctagaaatacatttaagagactgagaatcaagcatgttcaatgttgtatacagatttttttgacaaaaaataaaaatgaaagcaaaatatttgagtgagaagtatcatcaatgtcaaccccagaactgttgtagcaggcttcccctctttcactaggaagccactgttctgagcataaccggcatccttgagttcacttcactttgtatgtggtacatctgagacgtggaaggttttacctctctcaaaagagcagtgatgacgtcaatgtaatcatgtaaacaagagtcaagtgatcattcagtggtatcattggactcgaaggtcaagaaaaatctaagtctcaattttctagggatagaagcagttttattcacaaaagagtaacaggactgcaagaagaatttgttcaattgtaagcccactttatattctctgttagtctttttgtgctgatcctggcttttgcttttgcattgctctgggctgtagaaccagtctcatagtaactttcccttttccttttatttc

SEQ ID NO: 30034 - DNA, 1075 bp, Homo sapiens
tcctctgtctagcgtatccatgctgtatattctgagtctggtagtcacttagtcatttcaattataggttacaaaaacatagcatatatagggtttatatatctacagtttcaagtatccactgggggtcttggaatgtatgccccacgtataaggagggggctactctactaaacctgaagtagaattaagatatcatctttatattatactgtactgtatctgtggtacctgcccttcggcagcctagagttacaaactaaatgtaataatcaactaaatttatagagtgtggattccaaagcaggtcattcagttacatagactcacagaggctggggtcagctgagagaaatactggagctttagtgggaattgtgaggcaaacttttgaagtaccaggaggacttggatggaaacaataatgcagaagaaataatgtggggaaaggcacagaggcagagatggccagaaaggagaatagccccatattaacacagagcatgtgctgaagaataaggaaagaggaggctgattgatggggtgatggcagccataccctgtccaaatcaggagcatccattttgagatgcctcatctaactggggctgcagacaaatggcttgtgaaaagatccgtactaacagagctttacaaggattccacccaagattttggccatttaacttcatggatgaaccaaccgagctaaccagccacagatgctttgtttataaccagaggaattcatgtgagcttggtgatgacaattccctgtctataaaacgctgatagttaaacagtgatactgtgtgaagcacttggagtctctatctcgggaggcagttcttaagtgtaatggtttaatggtcatttagcatgatgggcctttggagtgtaatatcatttgcctgccagttaaaatgaacacttctctgtgggaagtcaaagatcatgtcagcgtaacctggattaggggaaggaaagcatcaagaagtgaatgccaaaatagaaaacagggaataagatttcttgtacgcctggcctgttcataaatccaatttaattagagaac

SEQ ID NO: 30035 - DNA, 1058 bp, Homo sapiens
aatttatttagttgtaaaatttctcatttttatttcttctcattaaaaaataaaaatacttactttgtatatctaataatatccatatctgaagtcattgccagtctgatatattaactggctttcacacctacttttcttttatgttttatatattttttttctcactgtagacttagttttcctggaatttcatttttggtaatctttaaggcctgagttaaaaattgagttccagctggacacggtggctcacgcctgtaatcccagcactttgggaggccgcggccggcggatcacgaggtcaggagattgagaccatcctggctaacacagtgaaaccccatctctactaaaaatacaaaaaattagccgggcgtggtggcgggcgcctgtagtcccagctactcgggaggctgaggcaggagaatggcgtgaacccgggaggcggagcttgcagtgaggcgagatcgcatcactgcattccagcctgggcgacagagcaagactctgtctcaaaattaaaaaaaaataaaaaataaaaaaattgagttccagcagaaaggatctccatttttttttttttttttttcttaacctgggaggattaacaatcaagaatcactttaaagctgggtgtggtggctctcctctgtaatcccagcactctgggaggccaagtgggagtttcacttgaggccaggagtttgagaccagcttggaaaacatagacagaacctgatcttttaaacaaaaaaccgaatcactttacattcttgacttgagggatttaggatcaccgtggcagaagttaacttaaatactgtaaacctgtgtgaggtcctgctaggatttcccagttctcagtggagagatttttgtctttcacttttcaccaggattcaagatgtgtagattttcttgcagatctcagatgggtttttagttcacagttacattaagggtgtacattttgagaatatttattcagggagttttgtcctgcgtgaatcccatcttgcaaagttcttgagttttgtgttacgcctctgtcctac

SEQ ID NO: 30036 - DNA, 1035 bp, Homo sapiens
tcaaaataagagcacaatgatggctgtggcaggtggtagcccaaggctccctgtgcagagtggaggaaaatagtgtctcaggagtgatgactgctgaaaataatcaaattgatcattttttgaactgtttgatttgaggagagttgtacttcagcagagtttttgaatgaattagtgaaattaacaaaactagaccaaaaatattgactcaatttttagctcttgggaaaacagttttatgaaaaaaagatacgtaattatgtgccacatgactcagctatagattatatgaatattgccataacaatgaaaaattgaatattgaaaaaatgaaagtctaatagtgacttgtatttggagaataagagaataatgtctataggaggctgataggtagaatgacaggcaagacttaggagatttagtaaataacattctgcattaaaatcaatagcaatataatttttaaagaagatatagcagaacaagtagctaagagagttgagttacattaaacataactgattacagtcggccctttgtacccgtgaattctggatgtgttgattcagccaattgtcatttaaaaatttttaaaaaattgtgtgtactctagatattccttgttattcactaaacaatacaataaaaataactctagcatttatattgtactaggtattataagcaatctagagatgatttgaagtatatggaagggtaggcataggtgacacacaaatgctatatcattttatatcaggaatggaacttgataatctgcagaagctcctgggagcaatcccccatggatacaaagggtgactgtagttaattttattgtcatctatgggaccataataacatccatttcaacttcaatattttctcagcacaaacttggtattttgtggtgtatttactagagaagaacagagttgcttacatttttcatagtttaactgccccaacatcttcaaatctgtatagaagccttaacttgttacccagtccacagacattccccatgtctct

SEQ ID NO: 30037 - DNA, 1035 bp, Homo sapiens
gctcactgcaacctcatactccagggcacaagtgatcctcctgtctctacctcctgagtagctagaagtacagatgtgcaacagcatgcctcactgatttttttttttttttaattttgtagagatggggtctcactatgttgcctaggtgggtctcagacttctggactcaagcaatcctcctaccttagtctcccaaagtactgggattacaggcgtgagccaccgtgcccagctgtaaaattgtttttatggatgtaatcatgtgcattttctaggaggaatgtttgtaacactttcacttgcttttcagataaagccagtgactacaaaagctcaaaacaattatactttcagtgtacctaatacaagcctgtgcttttattatatttgaaatatttgttgaacaaacaaatgaacaaataactgaacagaaagagatggcagaatcctattcaaatgattagaaattatttcctatacatttttagtctttgagaatctttatgtgtgaattgttttattttttataatttcgacttttctcacagattaaaggatacatgtgcatgtttacctgggtatattgcatgatgctgaggtttggggtacaaatgatcctatcacccaggtagtgagcatagtacctgataggcgatctttcagcacactgtgccgcccccgcccccgccctgcctctctctaccatctagtggccccatctttgtgtctgtgtattcactgtttagctcccacttacaagtgagaacatgcaatatttagttttctgttcctatgttacttcacttaggataatgacctccagcttcatccatattgctacaaaggacatgattttattcttctttatggctgcataatattccatagtggatatgtgccatattttctttatctagtccactgttgttgggtactgaggtttattccatgtctttgctattgtgaacagtgttgcaacaaacatgtgagtgcatgtgtcttttttgtgtaatgatttattcttttgaatat

SEQ ID NO: 30038 - DNA, 1011 bp, Homo sapiens
ctttttctaggccttccattccttttatactcaatgaaatcttaaaaccagagtgccttctgtccagaaaccatcacagtattttccatagaacacaatgctctgaggctttttttttttttcttaaatgttttgttacaatttgggtaaataggtttaaataaaactttaaaagaaactgccggacatctaagaaacttccttttgctaatttgcattgtgaattgccaagaagacatttgccaaatacagtcatccaaaacttattcactatggaacctttttattttcccagaagcatctcgtggaagtgggagaaaataaaatgggtgttgagaaagttagtccaacttctttcatcagacaaatggaggaaagaaagactttagacctcatggtttatttggcattctgtgatcttaaaaatagattatttttcacttcaggatagaaaggccatggagttaggagtcaagcccggagtttgagtccacacattgttggtggcctgactggtacctacagacactgctgtgactgatgcttcatcacgtgattagggcattgctttctctcatacccaacccactggatagttttgagcaagaaagaccatgcttgtgaaatagcctgcaaaataaataggaaataaatgaaaaataggaataaattataaatataatatttatattgtatattatataataaataggaataaaatgatttatatataacaaataggaataaattataggaataatttcagagtgttagcattgaaattatcagtacaattagacaataactttaatatttgttacatgattatatcaagatagaaattttaaatttagtgtaattacacagtataattatagcaatgtttgaaaaataaccttatgcgtagaacaaatactggaaggcacgatgcccacatgttggcaatattttattttggtaaggatttggggtgaatactttttcttctacttttctattttatatatcaat

SEQ ID NO: 30039 - DNA, 1023 bp, Homo sapiens
agtgggtacatgcaggagaaaagtccagttgcccaaactacatgtgtagggtcttccatccagatccttcctttccattccaatctcttactactccccagctcagagtttacattttctatattttgtgcagaaggcccttgcccagttcagttgtcacctttccccaaccagtcctttgttggctaggtgtgcatcctgtgtgctttcataatactcgcacctacctacatctgagcatggcgccaaccctaaaggcttgtcttttccccagtaggctgtgagctacttgggaggaagcaggggtggcatgagcatggcttttacttttgtattccaacatccaatgtaggacctaacacatagcaagtattcatgaaacttgcccaattcattcaatcacttgttaacattttatcattctcacatccaattctgttatttcttctcattgccattctctgatttagattttatcactattctctttccgtatgcattatattccatctaaaatgaaatattgcttccccaatatatctgtcttgtctgctcaattcttttttttgtattttttagcatttttcttccatgctctctgttctgtcatgtcttttctgctttcctgccatgaaagtgatcaccctcccttttagaactaattctcttccccctgaccccagcacacgtaaactttatttgcattgcattgctattattttgtagcagtcactattcccttgttagattgtgggcagggattgttcctcccttactgtcttccctcacgggtctatctcagtgctttggtcatagaaggggctcagaattgaattggaactgaacagaattgaataaactatccgtttatgaaataatttgctttagagttgctagaattaaatgactgctccagtggcaatattactctaactcactaatatcatttgatccactgaggagctagttaattaagtaggtggattaaaaatataatctggaggaagaatgttttggctggga

SEQ ID NO: 30040 - DNA, 1049 bp, Homo sapiens
aaattaccagcacctgacgagcaccttattttcccactttcttccctattccccaagtcctcgctgtcctgccttctgacagcatagatctgtacagctttcttttgtacactacatactatataatcacacagtttgagtccttttgtgtctgacatccttagctcaattttatgtttttgggatttattcatattgtcctatgtagctatggtcggttctttttcacttcccggtggtattccattgtatgaatataccacatctcatttattcattctattgctttgacatttgggaagtttccatttttgaagcattaccaataaggcactctgagcatccttgtacatgtcttttggtgaccacgtgcacattaccagagtatctacctagaagtgaaattgctgagttgtagggtatgcataagttcagcttattagtttctgctgaacaatttccttaagcccaaaacagcttttaaacaaaatggaagtcagtcctgctgaaggcaggcatactgatggcaacggcaatgagagctagaataatgtttaggagtgcttagctttcattcaccaaagatgtcaaactatggtcaatcatgcctatttaaaatggcaagggagggcaccttccataatgtaatgattaaagtctggactcttatgataagtttctcttacttggcaatgttatttttgtaaaccattcatttcccactataatctgctcttatgaatgaatatagattttgttatatatttctagacatgctgatggccaaccaaagcatagaaatactagtaaaaaaataatccagagatgccaactcaccaaagccatgcatacagagcattttcatacatttctgtgaagatgcaatacatttgattcatagtcagcatagatagatgggagttttgaggtcaaatataaagcttgtgtgctcccagaaaagcagcattttgaaagtttgaaactcaggccaaagcactctagtggggccctatccttggcttctttgctttctcactctgtgctggcag

SEQ ID NO: 30041 - DNA, 1051 bp, Homo sapiens
tccttcattctattgatgtaatatgtcaggtttattgagttacatatgtggagacattcttacatccctgagatgaaccccacttgttcatggtgtattatctttttgatgtgctgttgaattcagtttgttagtattttgttgaggatttttgcgtctgtgtctatcagggatattagcctgtagttttcttttttgttgttgtgtctttgtctggtttttgtatcagggtaattttggctttgtagaatgaattagagaaaatttcttctctcctcaactttttagaattgtttgagaagaattggtgttctttggaagtttggtagaatttgacaatgaagccatttggccctaggcttttctttattgagaagttatttattaccaagtcaatctcattacttcttgttggtctgttcagcctttctatttcttcttgattaagtctaagtagattgcatgtgtctaggaatttatatatttcccctgggttttccagtttatttgtgtatagttgttcataatagtctctgatgaccttctccatttctgtggtatcagttgtaatataatgggcattctggaacatgctgtttcatttacatatatttgtacaatttccaaagtttctctagttactgagttttagtggtctgagcagatacttgttatgattttgatttttaaaagtctgttgagatttgttttatgtctttttttaaattatactttaagttctgggatacatgtgcagaacatgcagttttgttacgtaggtatacatggaaccatgttggtttgctgcacccatcaccccatcatccacattagctatttctcctaatgctatgcctccccttccctgccacaacccccggacaggcccgggtgtgatgttcccctccctgtgcccgtattttctcattgttcaactcctacctatgaatgagaacatgcagtgtttggttttctgtttcagtgttagtttgctgagaatgatggcttccagattcatgcatatccctgcaaaggacatgaactcattctt

SEQ ID NO: 30042 - DNA, 1070 bp, Homo sapiens
tggtccctcacagattcccttgtcgaggggagggagttccctcaccccttgaacttcccaagtgaggcaatgccccaccctgcttctgctcatcctccatgggctgcacccactgtctaaccaatcccaatgacatgaaccaggtacctcagttggaaatgcagaaatcacccgccttctgcgttggcctggctgggagctgcagatgggagctgttcctatttggccatcttgcccgggaatcattttatgtcttaacatatctattctgaagaatgttccaagtactgattagagggaatgtgtatactgtagctgttgggtgaaatgttctgtaaattaatgttagatccattagtctaaagtgcagtttaaatctagtatttctttgttagttttctgtctagatgatctgcttaatgctgagagtggagtgttgaagtccccaactattattgtattggaattcctcttcctttaaatctaatatttgttttatgtatctggatgctctggtgtcggatgaatatatggttcaggatttttatttcctcttgctggactgatccttttatcatgatataatgactttttgtgtctctttgaactgtttttgattttaatgtctgttttatgaagtatagctactcctgctcatttgtggttttcatattcatccaatatcttttttcatccctttactttcaatctatatgtctttaaggtgaggtgagtttcttgtaagcagcatataggtggatcatgtttttaaaattcatttagccactctatcctttaagtgaaaagtttaatctgtttacattcaagattattattgatatgggagggcttactcctattattttattaattgagctattgttattttgaatattctttgtttctttctctcctgtttatcattgtgttttgttttctgtagttgtaaccattggaccctttcctttccttatggtgtgtttgctctaccagtgttttttatacttttgtgagttttcatgatggtagatagtatctttttgtttccaggtgtaggactcccttaaagc

SEQ ID NO: 30043 - DNA, 1067 bp, Homo sapiens
cctcttaagtagctgagactacaggcatgcacccccatgcctgtctaatttttgtatttttgtagacacagggtttctccttgttgcccagactggtcttgaactcctgggctcaagtgatccacacgcctccgcctcccaaagtgctagggttacagccgtgaaccaccatggctgtccaacaaatttttaatcttacaattctgaaggtcggaaatccaaaatgggcttcactggctaaaatgaaggtgtcagcagggctgggttccctttgaaagctctaggggagaattcattcccttgctttgcttggtacaagctctagaagccacccacattcattggctcatggccccaattccttcacctcaaagctggcaactctcaacctagtcatccttacactgccatttctatagttctcccttctcattcctcttccagctttaaggactcttgtaatcacattgggtccatctgcataatccaggatcaattcactcttaagttcagctgattataactgtatctacaacctaatatgttaaatatcatataacctaacatattcacagatcctgggtgttaggacataaatatctttgggggctaatattctgcctaacacaatattaggcttttaggggctaatattttgcttaatacaacaataggggttctagcccttcggaatccaaaatggaaattttttctatcacttaaatttaaaattatgattatactatgcaggcatcctttctaatgtttttctgtcctttttcaatgattgaattattcacaccttttccccttatctttgttgacctcaattatttattggagttttttatatattaagaatattatatgtatgttgcaaatattttttcttaattttacatattttaaaatttatggtctctgtacagaagtttaaaatttttatgcccacattccttgatcctttttatcagactttgttgtcgtatctttgaatttaaaccatcatggctatggattcaaccgtgtccctgcaaaattcctgtgttgaagccctgacacccctg

SEQ ID NO: 30044 - DNA, 1053 bp, Homo sapiens
cattgattttgtatcccaaaactttacagaattcatttatcagatttaggagctttttggatgagtctttagggttttctaggtatacaatcatctcattagcaaacagcaacagttttactccctttttattgatttagatgccctttatttctttctcttgtctgattgctctggctaggacttccagtactatgttgaatacaagtggtgaatgtgtgcatccttgtcttcttccagttctcaagtggaatgacttcagattttccccatacagtataatgttggctgtgggtttgtcatagatggcttttattaccttaaggtatgtcccttctatgccgattttgctgatgttttcatcaaaaaacgatgctggattttgtcaaatgcttttttctgtgtctattgagatgaccatgtcattgttgtttttaattctgcttatgtgttgtatcacatttattgacttctatatgttaagccatccctacatccttagtatgaaacccacttgatcattgcggattatcttttgataggctgttggattcagttagctagtattttttttttctttgaggatttttgtgtctatgttcatcagggatattggtctgtagttttttgttatgtcctttactggtttggatattagggtgatattggcttcataaaatgatttagggaggatttcctctttctctgtcttttgtaatagtttcaataggattggtacccattctttgaatttctgatagaattcagctgtgaatccatctgttcctgaacttttttttgttggcagttttttaaattaccatttcattctcactgcttgttattgttctgttaagagattccatttctttctggtttaatcaaggaggattgtgtatttccaggaatttgttcatctcctctaggttttctagttaatgcacataaaggtgttctagtttgtgcacgtgaaggtgttcatagtagccttgaatgatcttttgtatttctgtggtatacattgtaatagcttctgtttcatttctaattgag

SEQ ID NO: 30045 - DNA, 1087 bp, Homo sapiens
cgagactttgtctcaaaaaccaaacaaacaaaaaacaaagaactggttggaagaatcttgaaaagcatcgttctttttctctttagaacatgccgtctggtgtctgtagttttatcttatttttgaatatgactgacagtccactgaatcaacttgcagggaattcaaggttgaaactgggatttgtctgctggctgttttcctcagctctgtggcctttgaattacagtttgattttcagcctgtagggacttgctactgtatgtgtgtcataaattcaggggagctggatttaaaattcctgcctacggaatactggaggctgaacatgtgtcagagagtagtatatggctgctttgaatcaagcaagacaattgttttcaagtccaacagtcttaattgagtgaaagagcttcttcttttttttcaggaaagaaaagaaacatgacttcaaaggcaaatacaactaactcatccataaaaaatttctcaaaggaactatggctgttttgaactagcccttccctagatatataacttctttaagtcctctctggatggttgtttacatctgttgtttatacatctaaattgcatgattcatttgtaattgttaacatgttggaataatgttacaggtactccatggcattttatatttggcttagcagagttagcacttaactgtatatattggtcaggcactgttgtataacaaaccatcctaaaactaaatggcttaagacaacaattctttatttagcctgcaattctgtgggtcagcagtttcagccaaactcatctgcatggttcacctggacttggctaggctccaccatgtatctctgggcagttgtaggttagctagttggctctgcttctaggggtgctgactgtgggctggggagactcagctctcctccatgtgatccctcattcccatcaggctggccctggcttgttcgcagaggcagggttccagaagacagaacaaaagcacataaggtctccagaggcttaggctaagaagcatctcattactacttctgccacactattggccaaagcaagttataaggtcagccta

SEQ ID NO: 30046 - DNA, 1031 bp, Homo sapiens
tttagctttctttgcaccttttaccacttccatttgctttgtgaacacttctgtctgtctttaaaggcagtaaagactagtaatcataataacagcaaatattttttgactgcttatgctctgccaggtactgttttaggctattaacaaatttaatattcataacaatcccacaaggtagaaaatagtactatccccatttaaaagacaaggtaaggcacagagaggttatgtaacttgtctgagatcacacagctaataacaggcagaggccgaacttgaacctagggtatctggcagcaggacccaagcccccaaccactagactacctctgcaataagaagcctctgctttcagctcccttttttttcctacagaacctggctggacatgtggggatgcttagcacatagcagcacataatgctatggaaacagtcatttccactttccttctatattcaagtggtatgtctggcttatcaaacatttgtcgcaataaaaatatgactgtatgcaggctgagacaaagattactgctctttgaaatttctggagttgcctgatgacactcatgtaggatttagttgatcaaaagctttacttgatttggcctttgaaaaataatcattttggtcaatagcagagcatgtactcaacaaaaagtttcaggcatcactgcatttagaacccagtagaccagcactgttcaacagaaatatgctaacaacaaatgcaagttacacatgtaactttaaattttctagcagccaaattttttttttttttttttttttttttttttttttttgagacggagtctctctctgtctcccaggccggagtgcagtggcgtgatctcggctcactgcaacctctgcctcccaggttcaggtgattcttctacctcagcctcccgagtagctgggactacaggcgcgtgccaccatgcccggctatttttttgtatttttagtagagacggggtttcaccatgttagccaggatggtctcgatctcctgacctcatg

SEQ ID NO: 30047 - DNA, 1056 bp, Homo sapiens
tcctgggccctgactttgtgcctggcaccgtgcttggctcggagcatgcagagggaaaggacacacacctgctgtgggtccagtgttccagacacaacgtggagtcaagtggctaccagcgaataagggaatgaatggttttccaggctgaagatttcatactgtatcaattattatttttaagtaattttatattccaaaacagataatatggttcatacagaaagtttagaaagcagaaaaacacgaagggacaaaaaccatcatccttatctcctctcagatgagtttcttcaaaagtgcctgtcacttaattcagaaaactaaaaagcaaagacaccaaaatgtgtagctaggaaatactaattatgaagtaacggggctttgttcagagacctgacccttcccttacaatgtcactcagggcatcccatttgagggtaaagctcttggaaaaatccttctctcttcaagagatccagtccacagaaaaagttctctcacaacaagccaagactctgagcctcctgggtgagcccaagctctccaaacaactgacgggcacatgcatatacagaaagacaaacctagctctctgccggggtcccgcggctgccaaatcccttttccagggaggtgtgttattaccacctcttcccactgtttctgtcccaaatatcaaatgagcttaaggcagccttgggaggtggaacctcccagctcaggagcacaggcccagccttcagcgacccctgatgtgccttctctctcgtttccagctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacggtaagagatactcctgccccaggctgctgggagtgtggaaaccttgtacgtgcatgtgtgcagacacacacacacacacacacacacacacacacacacacactttgcactgggcc

SEQ ID NO: 30048 - DNA, 1033 bp, Homo sapiens
gagctgcagtcatctaaagaattccagaggctggaagctctccgcctccacaatcgctcatcacatttgtctaggaatttagtgctggttattgatgggaggactcagtttcttcctctgtggacctgtccgtggggctggttaactgtcctcttgaaatgtcagctagcttccccagagcaagagattcaagagacagcaagcaagaaggaagtgacaatgctttttgtgacctagtttcagaagtcacacaccatcactttcaccatattctatttgttaaaagcaaatcattaagtccaggccacactcaaggggagaggaattaagctccaccccttaaagggagtaggatcaaagaatttgcacacatatttttaaaccaccacacgttatacctcagttttaaaacaatgttatttcttattccaaaaaccaaaagggtggtgggatagaaaataatgggttttaggaagcattttcactgaggctttagaggaggtgacatttaagctgaactctgagaaaagagccatgtgaagatcagggaaaagcactgaagccagagggaaaagcaagtgcaaacactttgcctcagcagtgagtcatcgaagcttcacaaagaagaccaagatggccagaagttcatgagcaaaggaaaggaggagtagttaaagttggcaaggtagggagaggccactgaggccacagaaagaagtttggattttattctgaaggtgactagaagccatttgaggagttttctcctctgatgaacattttggacaacatgctctggctgctgtggattgaccgcatagtactcgagcaggaatagaaatgaaggatcacttcagaggccctcaccgtaagagaggtgatggcagcttggtggacaagtccctggctctgcctctggggtcccacatcatcagattcttccagggttccattaacaagtgggcctcccccaggacacacactgaacacacactcccatcaaaagcaatagagagatgcacagttgtctttg

SEQ ID NO: 30049 - DNA, 1074 bp, Homo sapiens
agaggctgagaaaacagcactcctgtgaattcctgagagaaaaactttttttttttcttttagtggtgattctttataactcactagcttaaggaagtacagaaactaaagaaatagactgtaacagctggatgtttttcaatacatttgaacaaaataatttacagcgttcttcccctacccattcctccacacttgatttacatgtatattccttagcctagaaagaatatgttttcgctataattttttcagattcataacccccaccccattctttgcagagacttaagactaggagcctcaaaatatgcaaggagtcgaaggcccagagtagtatctttagcttccccttaatctgaccaaaaaaaaaaaaaaaaaaaaaaaagcttggagaaaagcgatgcctggtctccttatgctaatgctattggcatctctgccatcatgccacacagcacctgttcaatgtcctcaaaaaattagagattctcgataaataaagactttggctacttccacgactaccttaggaggctcttaaatgagctttctgtgtcctggtaattacatttcttctggccctgatgctaccaccccttcagttgcaaccctacttccctttcataagtggttttaaaatttgttttttaaataaaatgtaagtgtttagatagatggtggcacaagatgcagcataggatccaattagcttttaaccaaagctgggaaagagttcaacagagcttttaaacattagaggcaagttatctccctgccgctccaggcaggaaaaaggggttttcagcatgggctgttaacagatagccagtctaaatggtagaaaagcaaaaagcagaggagacagttaacatgcaatgaagaacatttgggggaacaaagcttattctctaggaaactggtcgacctgccagtctttttttctgacttttgcacttttcctgactttttctgactttttttttggccaggtaattaactggctaaccaattatttagccaggcatgctggctacaaagataaatcctatgactacagtatacagtatagcc

SEQ ID NO: 30050 - DNA, 1094 bp, Homo sapiens
tgacctttaaagtaatctcatacggatgaggagactgagaatgagagaggttaaagatttccatatatctacactttttgaatttagacaaggaaatttgggaaaaaagtcttcatacttgctctcttcacttgcttaccttccagttactcataagccactccaatcttgtgttgtacccaaggccacacagctagttgctggtagagtcaagtctggttagaacctaggtaatttcatttccagtccagtgctgtagaccatgccaccttttgagtattgattaaacaaagacttgttgagtgtctggtatatgtcccatattgttctggaccctagggaacagtagtacataggacaaacaaaattcctgctcccaataaagcttatctagtggtagaaaaaacaattaacacccccttttccccctacacagacacgtgcgtgggcacacacacatacacacacacatttttacagattgtgataaacatgaagaaaataatgtcatgtggtagatggtgaagagattagtcagtgaagagctttatgaggaagtgtcatttgaattggaatctgagggatgagaggaagctaggcagagtgtgcttggccatcaggtagcaaatacttaaaatatttaacttgaacgtgggtcagagtgtggaggggatccataaggaaagatattgggaaagtaggtagtcactaaatgcctagatattgcagaggctgcaagtcctcaaaggctggctgtgataataaagcatttggattttttctaatggcatcaaatgcctttagaatcttttaaagagggcagtaacataatttatgtgtttattatcctcgctacagtggtagcatgcattgtagaggggtcaggtcataagtggaagaagggagacaggttaagggataggagcagtagtccaggccaaatatgtttgtatcttagcccaagatggtaatagacagatggaaagaaatatacagcgtcatgaggagaaattgacaggacctgtggttgcattgaataaggatggtgagagaaagggaggaaacagtgggcaccgtggctcatgcccttaatc

SEQ ID NO: 30051 - DNA, 1051 bp, Homo sapiens
catgaactgctgtattttcaatcgtttgtactctgttaatgtacataagtattttttgtgttcaaatttccccagatttggccagagttccctttaagctagcttctggatctttgtcatatactctcaccatttttttgagcatttcctttttattccctcacacaaggtatcactgcttcatcttgtacctaccctggccaatccatacaattagttatttctctgagaagccctggttccttttatttgggcacagtattagagagtaagagctggtcactagaactgcatgtaatttgggtggtttattaatagattgcctttaggaaaagaaaaaaaaaacccttaagagagtaaggaaaataggagacgggaggggaaaaatctgagcaaggatgtggtttcaggtcttaacctaatcagctctggtgtaccacatggtacatacagtttattgtgccttggaggcaagggagctgggctttcatgccctttttcagtcattggttactgtagtagttgggagagggacagcagcaaggaaaacagcaaagggctaccatggccaggggcagtcctgagaaggttgcagatgtgaatgctccaacattctctgctgcaggagggataccagctctatcctaaaaataatttatctgaatctgttaggaatcttagttggatagtaagagttttgatagtagtgagagttcagatagtgacaggtcagataggaatgggtacttgcacacatgtatacatacacacaggtgtgtgtactgcatccagtaaagtgtcacaggttgtggttaacaagtttgaataacactggcttaagatatacctaaggtaggctaagctgtacttttttttttgtcttctaggccatcgtacatgctgttctctctagaatttctcccatcttccctatccccaggtctactgaattcttgttcatttttcacaactcaatttaaaatcagtttcttaggagagttttcctgattgccaccacctccagttaaacatttttttttaaggtttagga

SEQ ID NO: 30052 - DNA, 1033 bp, Homo sapiens
caatttgccattttagtccaattttggaagttgtgtttaaaatgcacaccagagccaccggaactttgagtcttcccagatcaggcccctctgacccatagtttattgtttattgttttacatcactaaatttgatgagtagttgttgcacatagtagtcattccccagtgtacgaaggggattggtttcaggagccccatatttaccaaaacctgtgcattctcaagtcccaccatgggcccctcagaacccatgtgtatgaaaagttggcctgaaaagttggtataccatataggttcgcatctccaaaatattgtattttcaatctgcatttggttggataatatctgagtattaagtggacccccacagttcaaacccgtgtcgttcaaggatcaactgtaataaggagattacttctttttctgtagggtttgaaggtggtaagcattttagttcctatatatctgaatgtccttaacctcactcataattggtagtttagagactctagaattctttgtaattctttataattctctctcagaactttgaagttatttctccattgtcttgttgcatcatgtcttgccagtgagccatgatgtaaatctgattctcattcctttatgtaggcagtgtttattcccttttgaagcttttaggattttggggtttcagacatttcatcagagtgcatttaggtaatccatggtccattgctgtctgaggactcaggtctttgtatttgcctcagtatatttattatacttaataataatctaaaatcttctttcctatattcttttaatgggaaactttctggtcttttggggataaatacctatatatacttttttcacccgtggcctgaaggcagcagaggaggtgaccatttggctcctactgagtcactttaattaataactgtttagtttcctccagggaagttttcttgctttccatatttgctgcttcagagcatggagcagcacccacttttggcatgcgtgtttttcctggatactctat

SEQ ID NO: 30053 - DNA, 1058 bp, Homo sapiens
cgaaatggggacactcccaagatccgagttctccgatgccacctaagggccaatcttgcaagcaagccttttaaggatagcagtgtcatgcctgctatgttaactcttttctgcacatggacataataaaagttacttagcagtaactatttgtgtatgcctatcatgcctggtgttatgccaatggaatcatgagtaataggcttatatcaatcataaatacagctgaattattttaaaaataactgaacaaagtatatagcagtccttcttatttgtggtttcactttccatggtttcaattacctgtggtcaactgaggttctagttttatcatttcatatcatcatcataagaagggttagtataataagatatttatagtacaataagatattttgagagagaccatattcacttaacttttattgttacaaacattctattttattagttgttgttaatctcatactatgcctaatttataaatcaaattttatcaggggtatgtatgtagaggaaataaacatagtatacataggatttggtagtatctgcagtgtcaggcatccactagggggcttagaacgtatcccccatgcataacaggggactactgtataatggttattacttactgatccagtggttctcaattgtatgtgttagctcatatgctcattatcagactcaatagcttattatgattatcttgtttctgaaaacaggacagttttgcaataaaattatatgtagttggacataaatacccttgaataaaatggctagttttcttctcacagaggaagatgcagtatattttggttttagaaataaatgaaactttactttaagttctgggatacatgtgcaggatgtgcaggtttgttacataggtaaacttgtgccatggtggtttgctgcacctatcaacccatcaacccattacctaggtttctttttttttttttctttgaaaccgagtctctctctgttgcctaagctggagggtagtggcgcaatctcagctcactgcaaccactgcctcctgggttcaa

SEQ ID NO: 30054 - DNA, 1070 bp, Homo sapiens
gatgatatgcctttatggtgacggaataccctggctttattgactcagtaggaacagttgtattccatctcaatacagattactgcagttacagtgtctgcttatttcttgtcactcacctacacagactgaactagaccatcctaggagaaaagtcaaagctatatttggaaatttgaaaccctctttaaaagcagctagatgttcattgaatcctagattgtgtcagtacagtgtacaaatttaaatttaggatatgttgcattgtatttttttcctggtatacctcccatagatatattttatgcctagatcgcaaaatttgaacttttggaaattagaatatctgaagatttgacttaagtgtactttgtgatgcattagtgtgaaaaatcttaattgttcctttccctctcattttggcttcagagatcatctgtggttgacttatttattgttgagcatattgaggagctctttcatttcattagtacccagtgattttcagagtagacctaaataggtctactatttactgcttccgtgattaaggcttcatgcaacttcttttgtgttatctttttctttcatatcttccctggtgaagtctgtttagatgatgagattcaaattgtcatattcttagagtagaacctttactttgcctgtacaatcgatgtgtattggatcctcatctctcacacacaggctaaatcagtgatcctcaaacgttcattgtacttcagaattatctaggaattaaaacaaaacaaaataatagtgcacatgtttctctccacagagagataattgcattttttttcccaaagctttcaaggtgatttgaatgtgcatccaaggttgagaaataatggattagccaaaggaacagaatgtctccttaaagcagcccatagcaacaaaccatatagattttgctcatttgtgtatcttaaagttacataatttattatctaaagcactcttctatataagccataagtttttggctgtttttgttgttagatttctgtgtgtgtgtgtgtgtgtgtgttggctatttcttgacc

SEQ ID NO: 30055 - DNA, 1060 bp, Homo sapiens
tagtcttcattgttgaatgattgctgttaaagaatgtattacataatgatattttgcattagtgaatggaatatatcaattttcttctttccatttcctttttgtattagaggaaaagttccaagatataaggaagtaggtcatggtatctataaactgctgaggaactgaagtgtatattatgaagtaaagattgaagctcagttgccctctaggggttcaattttaacacagcacatgtagaaataatttactgagatcttgggggaagggtagatctgctgaatgtgggagcctatttttcattttctgttagagcctgactggtcattaaaaagctggttttgattatttattgcaaaagagaagaatatatcccagttttgtaatatacagacagtttaatgaaacatcctttttgtttgcttaattttaaagtcagggcttttgtgctggaataatccaaccgtcaacacattttcaggtattatttggtgaccaattctcggattcttcctaacactcttttgtcttctcagtgtcacctctatagcacttttaaatcagcttcctcccttattctgcccaaatccaagaacagactccagtgaagtggcttcttcatgaatcctctctacgttttatgagatgtgatcatcatgaaacttttccttttggtttcagcacctttgactggcatctttgtctggattagtaagactatttctctcagtttgaaacagaatggctactggctctctagtttaattgatacccaactttgtattgattgaggtccacataatttatgttggaatctttctctggtgcaaagtgctctactttgtaattgcagagttagactcctactgttttggtaagagggagcaaatttttttttcctattattgaaaatgttaactttgacttgtgtaaatagtaaatatgtttattgtatgtgcagatatttacatgttttaaataagcacatttctatactaaatttgaaaattcacatggttattggtatactttaaaaagatttgtgtgttttaatata

SEQ ID NO: 30056 - DNA, 1084 bp, Homo sapiens
gacgaacaatgatctggaataaagtaacagctgtacctttaaacatggacatgtgttgtagtggttcattacagtttttgtgcttgcactgttcatgtatttgtatacacacacattatgtatttatatgtatataatatatataaagatagatacatttatatgcaaaaacatatttctctgaaactgtgctccagtcataagaaaaccaaactgagatgttggtctggttcaagaaaaacaggatggagccttttgtgaaggtaaagaatattcttttgtgtttaacatgcaaatggctcagcttccaagttgcataggtagcccagcctgagtctacaggactctacctgtagagtagagtcctactctacaagtcttggagagtatcagatctgtcaagttttgatttttatgcccttaattataatctgtaggtaactcatatggctcattggatatgaattttggaaatctatgcttccagattactttgcttaattcttgcgtcctcatactttttctgtgaagggatatatacctaagacactaggaaaagcacatccgaggtaagtaacactgatgaatatttagtacatggttaataacctagtttgtgaggtttagaaatagtaaattatattttatatataatattctatataaaatatatttttatatataaagtatacatattacatatataaaatatagtatgcaatgttagtacatactaagtattctctaaattatttttatttctaataaagtgtacatttatctgtggttctgctctcttaaatttattttttaaaatttgaacattttcatctgaatttttgagtttgctaacaagccaaaaatcatttctatttgattaatccaacaaataatttactcttctttatcttaaatttgaagagaattaagaaataaaagaggaggaacatctatttcatgttctgtttagtagtaacagttgcaaatatgtaagcattttattcttggattcactaatttccctgctcaacaaagatgggtcagtatgttctgttttttttctgggaaagtctgtagaaataat

SEQ ID NO: 30057 - DNA, 1046 bp, Homo sapiens
cattttaacattgcctgctggtcatacttggtacatgccttttctcctccacctgacgtccaccacacacacacacacacacacacacacacacacacacacacacacacacgctaatagcaaatgtacaaaccattctgaattattctctgtaatatgtcctgcctgttcatctccagaccttctgtgcccttccctttgtccagaatactgttccctctcttcatttgctaacacaacacagtgtacatcatagcttaagagtatttcacattggaattccctcctgagtgtgtctgaggttcccgttctgtgcttccatagcaccctccctgcccagagcaggtatcaactcaactgttagcatttgaagattacttgtcttcctcagggactattgttagctcccacagagtaggaaccctctctttcttactctacatggtaaccccagaagctagcacagtgtttacacagtaagtactttgaaaatgtttgttgaatgaatgagtgatattttatgagcccctgaataaatgagaaaatacttaaatattgtaatttattgaatcagctaaaacgtgaatcattaattaactcattggacagtgtctattataaacacaataaatattagctattgttgctatcatgaagacaggaatgtagataattttttctttttcgttctactttggtaattaaagaaaaactaatgcagtatttacaaatgaatcttttctttaaaattaaggtaatgatttggtgatttcccatctgcagtgtatagatttgcctttgaaaatggaaatgtttttaaagatgtagtgcagtgaagaagccactgtttcaatatatgtcttgtgagatagcaatccccaacctttttggcaccagggatcaattttgtggaagacacttttccagtggttttgggatgaaactattccacctcagatcatcagccattagttaagagtctcataaggagtgtgcagcctagatccctcgcatgcacaattcttcacaagagggtttgtgctcct

SEQ ID NO: 30058 - DNA, 1068 bp, Homo sapiens
ttgacaaaattcaacaacccttcatgctaaaaactctcaataaattaggtattcataggatgtatctcaaaataataagagctatctatgacaaacccacagccaatattatactgaatggacaaaaactggaagcattccctgtgaaaactggcacaagacagggatcccctctctcaccactcctaatcaacatagtgttggaagttctggccagggtaatcaggcaggagaaggaaataaagggtattcaattaggaaaagaggaagtcaaattatccctgtttgcagatgacatgattgtatatctagaaaaccctatcgtctcagcccaaaatctccttaagctgataggcaacttcagcaaagtctcaggacgcaaaatcaatgtgcaaaaatcacaagcattcttatacaccaataacagacaaacagtcaaatcatgagtgaactcccattcacaattgcttcaaagagaataaaatacctaggaatccaacttacaaggaatgtgaaggacctcttcaaggagaattacaaaccactgctcaacaaaataaaagaggacgcaaataaatggaggaacattccatgctcatggataggaagaatcaatattgtgaaaatggccatactgcccaaggtaatttatagattcaatgtcatccccatcaagctactaatgactttcttcacagaattggaaaaaactactttaaagttcatatggaaccaagaaagagcccgcattgccaagtccatcctaagccaaaagaacaaagctggaggcatcacactacctgacttcaaactatactgcaaggctacagtaaccaaaatagcatggtactggtaccaaaacagagatgtagaccaatggaacagaacagagccttcagaaataataccacacatctacaaccatctgatctttgacaaacctgacagaaacaagcaatgaggaaaggattccctatttaataaatggtgctgggaaaagtggctagccatatgtaaaagctgaaactggatcccttccttacaccttgtacaaaaattaattcaaga

SEQ ID NO: 30059 - DNA, 1056 bp, Homo sapiens
gatactgttgtttttctcaaacccaggagagttgcataatctgtgatagcctgcagctaaaaatggatatatatcttcctataaccaaagtattgtagagcgaaagtatgacaactttggaagaacaatcatttttctcattcacatgcaaacaataaaaccaatttctatcataagtagccgtttatcttcattactattccatatgtatttattcatactgtttcattaaattctagtattgggctgggtgcagtggctcacacctgtaatcccagcacttttggaggctgaggtggatggattgcttgaagccaggagtttgagaccagcctggccaacatggcaaaactccgtctctattaaaaatacaaaaattagctgggcgtggtggcacatgcctgtaatcccagcttcttgggaggctgaggcatgagaatcatttgaacctgagaagcagaggttgcagtgagacaagatcacatcactgcactctggcctgggtgacaaaaccatactctgtctcaaaaaaaaaaaaaatctggtattattcaaaactccttgcatgtgttgtgattttacctttttgggtacatcagtcacaaaatagatatacattgtaataaaaatggatgcttcataagaatttatattggctatactccatcttaaatacctttgttttaatgaacgcaaaaactatgtaatattttaattcaggaagaattgatcttattttttaattttttcaaattctgctataacatttaaaaataacatgtatgggctgggcgcggtggctcatgcctctaatcccagctctttgggaggccaaggcaggtggatcatttgaggtcaggagtttgagaccagcctagccaacatggcgagaccctgtctctactaaaaatccaaaacttaactgggcttggtggcaagcacctgtagtctcagctacttgggaggctgaggcaggagaatcacttgaagccaagaggcagaggtttcggtgagccaagatagcatcactgcactccagcctgggtgacagaatga

SEQ ID NO: 30060 - DNA, 1026 bp, Homo sapiens
aataaagcagggacattactaccaattctacataaataaaaatgactataagagcatactgtggacagttatacagcaatgaattggataacctagacaaaatggacaaattcctggaaacacagaatctagcaaaactaaagcatgaagaaatagaaaacctgagtagacctgtaactagtaatgagattgaattagtaatccaaatctcccaacaataaagaatcttagacatgatggcttcactttgaagtctaccaaacacttaaagaacaatactgatccttcaaatcctacttttccaaaaataggagggcacacttcctaactcattctataaggccagcattactctggtacaaaagacacataaaaacactgcaaagaaagaaaagtataggccagtattccttatttacattgatggaaaaagtcaacaaaatactaacaaacttaattcagcagaatagtaaaagaattatacactatggccaaataggatttatcttggaatgtaagaatagttcaatatataaaaatcaactaatgtaatacaccacattaccagaatgaagaaaaaaaatgatcagcttaattaatgtagaaaaagtatttgacaagatgcaacaacctttcatgatttaaaaaaaaaaacactcaacaaactaggaatggaaggctactatctcaacataataaaagccatatatgaaaactcatggcaaacattatattcaaagatgaaggattaaaagcttttcttctgagatgaggaacaaagcacagatgccaactttcaccattctattcaacatagttctgaaagttctagccagagcaattaggcaagaaaaaagaaataaaagatatctagcttccacgaacgttgtctagaggcactcagaatggtccagcatttgacataccatcgtagggtttcctacaatacaaccactaataaaactaggctttcctgaacccctggcaatagaattgtttacctttatacaaagaaggttgggaaag

SEQ ID NO: 30061 - DNA, 1051 bp, Homo sapiens
cggtggagttgggatttaaatatattctgcttggtacaaagcccttgctttctttcaccttatggtgtatatcagactaactgcaatataataagtttgtttgactttttgttcttatatctctggggaaaattaaatcatgtttcttgatccttaaatcacattgtggaggtgtcttcctactcttttaaaaatcattcctgatcccaaatagggccttctcaattctgaacaggcattttatttcatgtgttgcctttgcatgctcacaaatggcttaaacaatgtttccgctaccctttcttagagcgtgggtctcctttgtgaataaatttgcaagcatcttgaagaaaatggagtgcgagccattaaccattttggctttttggagaagaatccaatcttctgtgacagaatggcaggattgataattcttgtgaaggcactttggaaagaattctattaccaactttagcaacccttttcattctgtcccacactaccaactcatcggtaaactggtaaatggattcagctgatacagattttcccatttgctgggcttgcaaacccatgttgtcttcaacagctcttttcttggtctagcctcatagaatcagtctttgcaagtggtaaaaagaacaagcttttaaatcagacggctctgagttggaatcctggctgagaacctttgtaactgtgtatggtgtttgagaaattacttaatctttcaatacatcagtctttaattttgtaaatggaaatggtagtgcctaaagacctaaacaaggacacataaacaaaaatgcttggtgtcagaagaccagtaggtcccgagaaattctactgctacatgaatttgtttaaaaaacaatgtcagttaggaatgcagcaagtaacaataacaggaacaacaaaagtatgaaaaatagctagagaaatcaggattgatttttctcacttagtaagtctgtagactggtggctagcgatgttggttcaggacctctatggcatcagggctgtaatctctgtgattctcttggctttgt

SEQ ID NO: 30062 - DNA, 1032 bp, Homo sapiens
gtaataattatattacaagtatgcatccatcatattttactgattcattttcccagtggtaggcggtctcactcccagctatgacaagcaatactttattgtgtcaaaatgtttctgtggtatatgtttcagtttggattgtctggttatagcatatatagtaatgtgtatcactctcaagtatggttatattttttttattgttagtgcaagcacatttgtgagaaacatatatgaaaattattcttaaccatcacttaaatttttccattctcatgggatttaattacatttcttttattaatagtaaatttgagcatctctttttgtgtttgtgggccatttggttttcccctactgtgatgtgatgtgtgtgtgtgagatgatgtaattttggataacatagtgatgtaagtttggaagccgccctcattcttaatagctaccttatctatctaaaggaatcaactgctaatcccatcagtaaattactcttagtaaagacaaagggttagggctgggcaccgtggctcatgcctataatcccagcactttgggaggccaaggtgggtggatcacctgaggtcaggagtttgagaccagcctggccagcatggcgaaaccccatctctactaaaaaaatacaaaaaaaaaattagcagggcatggtggtgtgcaactataatcctagctactcaggaggctgaggcaggagaatcacttgaacttgggaggcggaggttgaagtgagccaagatcatgccattgcactccagcctgggcaacaagagtgaaactccatctcaaaaaaaaaaaaaattttcaaaggattaataagattccctcctcctcctatctctattaccagatagagagttaaaagctttgttaccaccagtttctaaaagctaagaaaagtttctgtgcatctcattgcaggcaagaagtttgaccctattaatggaggcactagtctgatagagactatccaagagaagtcagagtcagagactctaatttctcatataaccc

SEQ ID NO: 30063 - DNA, 1058 bp, Homo sapiens
agatatggcaggaatgttggaattattggaaagggaattattaatatgctaaaggctctaatgaaaaaagtagacaacaagcaagaccagctgggtaatataagcagaaaaatgaagattttaagaatcaaaaaagaaatgctacaaataaaaactattgtaacagaattgaagaatgcctttgatagactcatttgtaaaactcttaagtgcctctaatgttatgagtatacagtattcaaatgacactttaaattttaaaacaagtctcaactttacaatctctgtgaagcacgttgctttttacgtgatacattctggtgctgcttatttcattcttgactttgaaatgttcacggaagggaaaaggggagtttttgaagaaatagtatgggaatcagaacattatgcagtgccttcaaaggtacgatgtacaactacacattcattctgggtgaataaattttcatttagaaattatttagtgaaaattatttttgtcttaatgaagttgaattcaaattgtggcataaaagattctgacatcagctttaaaatttggatacttaaaatttgggaggtgtgaagatgaaaattagaaaaaatgttatgaaatgctaagatattttatttaagatttacagcacttttttggtcagtatattctatcaatacttttttcccccagagaaatcttgcatctcatgttttgtgatgctatataagttgttgcttgtttttaactgacaatagccatcaactatgtttggcttatgcaaaagactgcaaattaggctgggcatggtggctcatgcctgtaaccccagcactttgggaggccgaggagggcagatcgcttgaggtcaggagttcgagaccagcctggccaacatggcaaaaccctgtctctactaataatacaaaaattagctgggcatggaggtgcgtgcctgtagtcctagctactctggaggccgaggtatgagaatcgcttaaaccagggacgcggaggtttcagtgagccaagatcatgccactctactccagcctgggtgaca

SEQ ID NO: 30064 - DNA, 1047 bp, Homo sapiens
tgcgttcatcattctttgtctagctgcagcccgagtgggcgcatttatccattttgattagaaggtgaatcaataatcaagcatacagggtccctcaggctcagtcttaagagctgctttcagcttaaggaaaaggaaaatattctccctccttttctatcatttcttaccggaatcagatgttggatgaagtgccttggggccctgatgagtgacatatgaagattcctgcacaccctcctacctttacatcatttgagaactccaggtcgactacatgatttgtttggttgtattataaatctgaagtgccacgtgacaatgccccagaaatgttttcagggaatgtgactttatgaggcttcaagggctggttacaatgatgttgaccaaataaagaaataatcaacagaaaactcgtgtgatgagtcattcaacaaattttcattgagcacttagtatattccagacccgctatggcccaaatctatgcctgtttttttatatgacctacaagctaagaatgatctttgtagttttaaatggattaagaaaaatcaaaagaatattctgtgaaatgtgaaaattatatacaactcaaaattcagtgtccataaataaagtcttactggtaccttgccacatccttttgtttactgctctctctgttgctttctgccctaaaacagctggaccaagtacctgccaaaaagatgctatagcttcagaggcatgaaacatttactatctggcttttttttgtctgagacagagtctcactctgttgctcacctgggctgcagtgcagtggcacgatcttggctcgctgcagcctccgccccccaggttcaagcgattctcctgcctcagcctcctgagtagctgggattacaggtgcctgccactacggccagctaattttttgtatttttagtagagatggggtttcaccatgttggccaggctggtctcgaactcctgaccttgtgatttgcccgcctcggcctcccaaagggctggaattacaggcatgagccactgcacccg

SEQ ID NO: 30065 - DNA, 1926 bp, Homo sapiens
aatatataggactggggaagttatcaaacaaagcattatctgtgaaaaaaagtctttatagatagaagggaaaacagacagctagatgttgacagtgaatgccaagtttcaacagttagctttactaaagccatttatttgcagcaattctcagtggggttgatcacacttctaataatgcctgtgaatcatatttcagagctactctaaacatgagagaatcattcacaaggtacaattttaactcataagcttaaagtgatgtaataatggatagataacttcattttaaaaaatttgaaaagaggatattttgattgaaatataaccagtgcttgtctcaagtttttgtaaggtagcaatctcacataattgtatcatcctgagtgtgataatatggaaattgcaggttgaatgtggacctatttttctgtattcaatgaatatattgctgtaaagctatatgtaaatcacctttaaaaatcaattgaatcatctttgatatgttagaggatctctctgagaaaaaaatccatttgggaaagatttcatagactgctgtgtcatctcctagtttatagtatttaaatatggattttctcagacttgtttaaagtgtgcattgtagttaatcgtcctgacatcctgatttgacttagctatgtgactattgcacatttttggagaggatgggatgtaaaagcaaaacggtatgtgaagttaacaactaagagagggaacagattcctgcatatgtgttttttgttagaatcttattttttcaatgttacatatagataattttgaaaattatacagttctgtaagattcacaataaccaactgtagtcctctttctccctttctactcagctcaattccttcctcccagagtcaaccatttctaatgtttagagctgtttctcttgagttttaccttaatctttccaaaaattcaagcttataccatcattgatttgattctgggtttcattttttttcttttcttattttcttttgcttttactatgcaccatgacactcaatgtttttgagtgttagacattaactattggcattctttgaaggggaaaggctaggctctttccttcaccacaagtgaaacagattctacctacctctcctttagaggtgtataatagtctttgtaagaatcaatgtttggttttacaatatttgattatgtaaatgtgatgggatattaaattgtttcatccaagaaaccatgtaacaatacacaatttcaaagtgaggtagaataccaaaatgaatgaccaagaaccagttgcttgtacatggtagggaaggagagtttgctgtgttggaggcattactgagataaattaaagatccagttaaacagaatgatatacccagagcttgttgaggcaagctgggtatgtcctgtgaacatatgtgaaccccagtagggagggctagcccagagccctcgttactctggcccaagaagaccttgggtgtgtgtatgtgactgtgtgtatggggggtggttaggtagggtgacaatgtagagggagtctgtgttgagaggtagaggggtagaaagagtctgggggatctaattgctttgttatagagacttttagccattcttcttgttttctgctttccccccgtatttcataggtatctattgctccccaaacctggatccttctggggcttgcagtacaaatacttttagaaaggggcttccccactgctgacacacttcccctggtctgctgatttcacatgctcgccagccttcaaaagtaactgttgttttttttctcctcttctttgtctttttttgccttaaaaaaaaatctctattgttgtgattggtggggttttgagtcagagtggtggtagacatatgtgttcaatctgtaacatttacctg

SEQ ID NO: 30066 - DNA, 1032 bp, Homo sapiens
atttaactcaaatttgaatttttaattctcaaaaactctgtgagttagctacaatttccatttctatgtaatagatgtgtaaactgaggtccatagagattaaatagtttacccaaggtcacagaactgccaactggtagagctggaatttgaacccagaataatgatagcatttcccagcatgatttaggagaaaagataaactctacttttttctttggccttctggaaaattcatattagctcttgtatttaatgtaaaatcataggaaattttttctataagggaataatatgaaatacatattaggttggtgaaaagtaattgcagtttttgcaattaaaagtaatagcaaaaaccataattacatttgccccaacctaatagattgcatttttaaaattatatattgaggaaaccttactcaaaactagtttaggcaataaaggagatttatatggaattcaaagaatggttaacttacaaaactgtagaaagaatacaagtcggcccaggaacagctggtgccagagaattaaaccccaccgggactttcttcccatgtttcatctgtgcctctctgtgcctgttgactcctccctttctcattgtagacaggctttctagttagtgcaaaaagcatagctgctgacaacctaagtgtaacattttatatgacttaagccaagtgagagggctcaatttccttctcagattcaggttgcaaaaccccagggaagaactgagtcagagcctcatccttggaacacttaactgtagcctgagaatgcagtcctaaagaatatggcttcccttgaggcagccttgtaggcttgggattatggagggtgagggcagccgaatcagtcaggaatacttttggctgcaggtaagaaaacagagttaactaatggtggcttggtctaaagggatatttatgattcacttatttaccattataacaaaaaatctgaagttagggttgaaccattatgtcagtgatattattaagaaccttataatgttctatt

SEQ ID NO: 30067 - DNA, 1046 bp, Homo sapiens
ttatacaataaaccactaatttcaggcttcatttacaaacaagtagcacgctgctgttaaataaacattaaagagctttctattatccagttattgttgaaaatactggtcatgtaataacccagatagtcaatatatttttgttaaattaagattgacatttaataagaaattaaagatatttaataagaaaaatgtgtgctaaaatcagagtcagaatacatcattgcatagcactaaagtatgttaacctctttaagatgtcacaacagtatttcagatgctgtccaatttttcatggacatagttactaaacggcatgacatttcaaacatgttagaatcttcaaaaactgcatacccttctctttactctggtttctgtttcactatcaggaaacctgaagaacaatgagtattactaatgggttgacatttttggaggtatattgtgtgccagggagtgtgctggagatttttaatatattttctctaatccccacagtaatattcctattgtatggattagaaaactgaggctcagagaatttaagtaacttgcccaagagtatgtaactcctagtgatgaagaagagattcaaatgcaggtccatctgcctctaaatttaagaccctttccattggaacaactacatcagaatctctaggggtaggcctcaggtgttaatattctttagaagatagccttggagattttaacatagagctttgattggaaaagattgcatttgtaccttttgtctttcatgagcacaagtaaagaaatcagctttgctaatgtggtttgtttatggggacaaagcgatatagactagcaaaagtaggaatatcttcattttgcattttcttcagcttcctgtttggagttgctccattccttacaacaagaggaagaaagtatgtattatatgtgcaaatatatgtgtatatgagactgttgctatgtgtacatcattcatgtctgtaagaatggaaaactatttaaaatggcagatatgtagatgaaatgtttatatagaaaaagta

SEQ ID NO: 30068 - DNA, 1096 bp, Homo sapiens
tatcagaacatgtttcttcattatggagaactacccctcccacccctcttctccccattcctcctgctttacagccttattgttggaagacaattcttgtggatctttcatatttctgcacatcttgtgtcagctcttgtttcagaggatcttttcaaggatgtttatagtaaacagccttggataatagagatagggcttccctgcaggaaatggctaggtttgtttcctgactagaataataaagataatatctccctccagggtgaagggtgagcaggtttgctagcagcctccttctaagatcaggggtttcctaaacttgaggccctcacatatgaggcaaatcaactgtatgtatgcagcacctacctgggccactctgtatgtttttcaagggacttgtggagcaaggggagccaatgtgaatatgaagcacagactgctttctgtgccatgagtaatcaagttttttgtctctgacccaagggtctagcagcatgtgtgaagctgtgggaggctctcttcttaactggcaaggaaggtaagatctcagacccctcacggctcttgacagctgactgttggttggaaagcctggccagtgagagtagagcaggctcctgtccacaaggatcactttggtatagtcggatgacaaagatcaggcccataggaagggtcttcaaggcttttgctggagttactgggcaagggatgtagaataggagcctaggcatctttgtggttacctggggagagccccttgagaatgagtccctttacagagtaaagcagagtcaagaaaatgagagaggggaggggcagaaagcaagggaaattgattgaggttgaaattgagattgattttatttgggagtgttgattgagagcctggatatcgcgctgccttttctgttacataagtcagtacattcactttgtttgcttaagccagtttgtgtgggaatttcgatattaacaagtgaaaaagtcctgtcaaatacagttgcaaaagagtgggttgaccatcccaagagggaccactactctagaggtttctactcaagcttttcctgtgtgagcatataacctt

SEQ ID NO: 30069 - DNA, 1050 bp, Homo sapiens
gaagtatgatacagtacctaactatatccaccattcagacggtgctctgtgttaaattggttgccctggaaacagacgctgaggcagagatttatatgtagatttttgggggcagtgatctctggaacaatatctataagaaagtgagggtcacaggattaggcagaggggaaagttgaattgcagtgcaattgcaaatgaggcttcagccaaacccaagggaagactccaattgggctgatcctttaggattatcccaagggggcccagcttttgttactgcaacatccagtcattggatgggggctacctggggtggatggtttagtgtggagctccctttgaccaagggcagttcctggagaggggtgcagctatgagctgtcagtaggcagcacttctgatagctgcaggattgagtgcctgtgtcctgaaggggatctgagcacacagcacagtatccactatatgctcagtaattttaaattgcttctcttcaattctttggcatccatttcctttctcttgttgtagctctaagtttcaccctgattagcacttgtctttttctctagagagtccccaattccgatgttgctccttttgagttgaaataggttattttatgactttcatctttcttaccttgggagctagttgcagcaggggttgaggggtgaattagggaaaccagttattcatctctcattgtccaatgattaaagacttaaagtggaggtggtatctttcctttttaaatttaatggccacctctgaacatttgatgttgaatcccctcaattttgtgatgaacagatttggaaggctgtgtctgtgctaaacgtgaaagaatgctgtgctcagttaatggtgtataagcatatataggcctagtatactctcacaacagaggacacttctgtaaccccaggtgtgtgggagtttttcctcccacacaccagtcaagcaattctgtggcggattctccagcagacaccacctggtgtcctcaattcaattcgattctgacagtatctacctggagagagt

SEQ ID NO: 30070 - DNA, 1048 bp, Homo sapiens
taataaatttagagtggcttaaaaattcaataagcatgtttgctttttgccaatctactcattttgaatagaacaatttcaaaattaatttttttttttttttgctaaatccaagtgctactcgaataattagcagtaactggtgaaaaactctgagggagtaagtaataactaatgaaaaatgtttggaaaaaggaaaaatgtttctattttagtatgtatatatcttaagatacaaattgtattttattgaaaacaatgtatatgaaaaacaatcaaataaaaacattctcttgaatttttaaacttttttttaaccaatgaatatactcaaatatatgtgctcagacaagaaaataatatcagtgaaatgattctaaagagtttatctgcctctgtcaagtcttctgaattatctttatctgttgtgtactcaagtgtattcacatataaaatccacttctaaacatgggaaatagggtttcaaaagagctcacccttgtgtcactgatgccctgtgtctattactctgacaatttatctgtgaattaaaacaaaattgccaagtccaataatgtggtacagacaataaaaggagcttagataagagataaataaatgtggttcatggcagacatgttggggtatctattgacaggtatatttctttttttccaacgaactcctattgcttgttgtacacatttaatttgcactcctttaattttattcctttaaattcaatgttgctctttttgccacttccactacagtattgaactactattagaatgctttctttttgatgttgtactgtgctttattggaaagaaaactggacttagaacaaatcattggatttgctctgaagtagagcccaaacacttaccaattatgcaaatttatcttttttgtctataaaatgggagttatagttatgatgatcataataacaaatgtggtgttaaggtgatcactaattgcttttctgactcagtgaagtgaagggatttacactctagactctgaatcaggaatcagcaaacta

SEQ ID NO: 30071 - DNA, 1091 bp, Homo sapiens
ctgttattgattactattttattccattgtggtcagagaagacatttgacatactttcattttttttgaatgttttaagacatctttgtggcctaacatatgttctatccttgaggatgatccatgtgctgagaaaaagcatgtgtgttctgcagccattgggtgaaatgttctgtaaatacctattattaagtaggtttgacgttgaacaaaggacagtctagattacctgtttaatgctgaaagtggggtgttgaagtctccagctattatcgtattgaggtctatctctgtttagctgtaataatatttgctttatatatggggggtgctccagtgttaggtacatacatacttataattgttatatcctcttgctgaattgactttatcatggtgtcatgaccttttttgtctctttctatagtttttgtcttgaaatctattttgtttggtatacatatacctactcctgatcttttttgtttttcattggcatggactgtcttttttctatccctttattttgtatctatgtgtgtctttacagttgaagtatgtctcctgtaggcaatggatcattgggtcttgtatttttatccatccagccagtctatgtcttttgattggagagtttagtccatttacattcaatgttattattgataagtaaggacttacttctgtcattttgttatttgttttctggttgttttatggtcttgtcgtccttctttccttccttcctttcttcctttcagtcaaggtgatttattcaggtggcatgttttaattttgtgcattttattttttgtgtatttgttgtgtgttttttgatttgaggttaccgtgaggctttcaagtattttataacctgttattttaaactgatgacaacttaacactgcctgcataaaccaataaacaaagaaaaaattaataactctatactttaactttatcccctttttaactttttgttatttttgtttacaccttattttactatcttgaattgttgctatagatacttttttgatagatttatcttttagtctttctactcaatatatgagtagtttacataccac

SEQ ID NO: 30072 - DNA, 1032 bp, Homo sapiens
agcgttgctgcaaaaatcgcttgctattcgagatagccagcagagggaatcggaactttgcttgcagcaggggttgaagcagcctttttttttttttttcttggaggaaatactgcagccttctggactgcgtacgctgctccctggagaggctctctcggttccacccaccggctggaaggaggggaagtgaatgaaaggacaggacaagccccgaacaccatgtcactctgggagggagacagcagcaactaagctgtacaaggttttttttttttttttttcttcctttttttctttttttttttctttttcccctttctttttctttctttctttctttttctttctttctttctctttctctctctcttttttctttttctttaaggtggggaaagagacaaccaagagacaggaagctgatctgcaaggattcggagttgtgctaaaaggactttgatttttttccccctttacgaacgctggcaattgacatcactacagacagcctggttagagaacaaactgcctcatcccaagtggaccccggcagctgggggaagccaggcaagatctgggaaggctgtgtgtgggtgttttttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaaggtatggcttgacccacggtctggcgatcagcgtggtatcgttctgcacttgggatgggaaacagacaggcgtgtgaattattagttaacccccacccccatcacttcttcctgcttctttgaaa

SEQ ID NO: 30073 - DNA, 1047 bp, Homo sapiens
aactttctccaatgtaaatatttctgcattgcttataagcaattacatttgtatgttagtcctattttaagtagctcacttacagctggtactgagcaatgagtaagcatgtggttctctatttataaagtagcccctaatctctcaccatgataggccagctatacatagtggtctgttttgagagaggggttttctagaggtcaggattatgtggctaaagagcagggaaacccaggaaaatgtaagtgattcaccacagtgtgctattggtgtttccttgggaccatgatgttgttcagtgcaaggtgaaagcctgagaagaacagatgagagacgctgtttagagtgacagacatgtagtaagtggctgcctttgattgtaggatttcaagaaaaaataaaagaaaaacatgttatttatgggttcgaataatattacaataatccaaaggtagttttattctagcagtgtggaaaataaaagcctttgtaaattaattgcttgtctatgatatgagaaagcacagagcaagcgctgttgaacataaatcaacttgatttataaacaatttgttattcatctaagatatttaatagtatatattaaattcattttgttatataaaaattaatgagtgaatgattggtaaatgcataaatgggtaaattacataaatcaagaaaattacccctcacacttttgcttttgagttaaatttatgaaaaatgcactagattcctcaccactaaaactttctatatattggaaacccaagttgttttttgttttaactagcattttgtaagcccattaagtagtataaatttctgttatttttaaatacttgtcagcagtatgttttgcaattggaatgaatacttagacaaataaatgttgagtttaacttctcatagagttacaaacttctcatagagagttcaggaagtgtttgaattcatggtggctttacttcattcacctgtatggttggggacaattccattctaaatacatttattcagcacctgccatatatcaggcac

SEQ ID NO: 30074 - DNA, 1076 bp, Homo sapiens
ctatttgtatttctacttttttatattaagtaatataataaatattcaatttgaccagcaaggttattaaagctcaaggaggtaaagtgaattgtctgagcttgctcatttctctgggagcccatcagaggctggaacattgcactgatgacccccagctctgtggtcttgtccctagacctccacttggcttctcttcctcttactgctcttaactaacagcatgcatttgtctttagtggtttataatcctttataagaatttctgcctatttaacatatatgaaattattatttttcacctcccaccatctaaaataataattaccctcaaacaaggaagacaaactaaagtcattttttattctgaaaatgtagaactgaactcttcattttcagtatgatgccaaacactactaactggatttcatttaattggattaaaactgacgggacacatattctctcgaatgtgcaacctcacccctcttgcttgatcttcataaaacatcatgtatttagtcagattgcatccctggagatacagttggagtagctggtgactctagagaagtctgaaagtaagaatacgattcttgatgtgataaggagatatatttttgaagtaacaacatggaataaatcaagaatagtctgtgctgaattttgagttatttccagaagtggaggcttcaggtgtgaacagaaaatggaaacctggttttcttaccaattgatttactagatcatccgaggagatttgagacctagttctttctgctactcacagatgtatggaagagctgcccagtcataaaaccaattttgaggccaatttcaagtggacagataatggtaaatctttaattagtttgattatatttttagccagttgcctttctggatttggaatatgctaaaaattaatttacctgtgccttacccattgtgtctattattggcacctcccatttctatttgaataaggtattgaaagtttagaatcattgaaaaaagtatttttatagtatctttaagaatcacagtacaataaatagctaatttaaagcttggat

SEQ ID NO: 30075 - DNA, 1053 bp, Homo sapiens
tccaggcattattcagcaatttggtcacataattttctctaatattagatttctgcttccaatggtgggtggcatagttgaagaaagaactttatgaagacataaggtcttgatctaaaccctaagaagggaaagagtaagtaaatgaggttatatacctgaaggcatacttttttacttcagaaatttttattttccttcggagtgtataaaatcatgtacttttaatctgcagagtagttttcattctaatctactagtatactttgataaaagcataatttcataggtatattacattcgtgggtctcgtgtttatggtggttacgtctttaaaaaaaatctaaaccttatttatctacatcagttgttgactttgcagatcacagagaatacagagccagtcatgcagaaagtacctgtttgtcatcctgagagttcagacatgaactgtaaccagtggcccattaagtaccttctcttgttgtttaaagcatatcctagctttgcaaattaattgttaatgcagaatgttgtaacggagccatggaatgaaattcctgttactccagtcatagtagatgttgcgtcaagtactctgagttgtgttccattgttttgtgattctgtgctgtcggaaagtctggcctagagagtgtttagaaataaggaaatcaagaaatagtatggtttgcttttttggactctgtgtgtgattttccattgatagtaatattgtaataatttctgagaaataaaattctttttctttgtttataaaaaagttacttgtcaaaatactcacaaatgctttccataagaaaacatttaacattttttgctgtaaaagtgattacatatactacatttaatgcagtagaggacattcttgtaatattgatacagtaggacaatatgcatgccattgactattgttaacagtccagttgtgagatgaaatccactatgaaacacagtaatgtttaatttcatatttaagacagagctaaatttcagtttagaaggttcttatataaaaatttcaggaacacc

SEQ ID NO: 30076 - DNA, 1099 bp, Homo sapiens
tttggggagaaggtgttggacatgctgagttagagtctctggcatggcaaccatgtggaagatgtcaaagaggaaattgtaagaaagcccagggctacagatgctgactgaagtcaaaggaatagataagattaccaaagaataatgtgtagaaggggaaatggagtggagtgaattagggtgggcagttgagaacttggagaacatttgagaagaaagctgggccatggccaagggatgttctgtcactcttggcctgtgggaagcatgtggcatgttagaagcattagaatgcgaattatagtgcatctagacctgcccaacccatatacaaagtcttgggtcagacagttaataatattaatcaagcaccaatcagaagcacaaatactgcacaggtaagcaacacctggaaacctcaatagatagactcataaccggagcggtcaatatgaagggatacttccttatgcagagttttgctcaagcatgctgatatctgttgtcacagtacaactctgaagaccacgaaaatgtaaattgccaacatgcaaaaactgtacccttctataactgtgaaggtttgaagaaaaagggatgtaactaaaaatgggcggtcagggtctccataagcaaattatatagtgggagcgtgggtgcttatcaggacaaattatactatgggtatccttatccttacatcagctcctaaaatccctatccacgctattttgcaacagcttatttaattttctgtttctgtagagagattcctaaaatcagtggaaacagggcctgtgtgctatagaaaacttacctccaaagtgggatgtgtgaagggtgatacaagactgtttattggagaggctaaaagaaaatattagaatttacatctctctttgttttttatatcaactttttgtgaacattacatattaatataatcttacaaatacatagattttaaataaatatgaaaatgttgagtttgctgcttcaaaatacttttatctctagtgatatgaatactggtctcaccaataaatatggaagaagaaaaggagtaagagaaggaggtaaaaaaggaaggaagagaggg

SEQ ID NO: 30077 - DNA, 1029 bp, Homo sapiens
aaaatacagatgctccagttaaatttgaatttcagatacataatgaatacatttttagtacttgtttcatataagtatttttattataatgtgtcacatgcaggtattattcattgtgtatctgcaattcaaatgtaactggccatcctgtatttttatttgctaaatctggcaacctagtcccaatattaagaaggtccattcattctaatgatctagacatagcaatggtagtcaaggagccaagtgtagctactgagcacttaaatgtgcttagtccaaactgagatgtgctgtgagtgtaaaatacaaaccaagttttaaaaacctactattaaaaagcgtgcagtatcttgttaataattttaaaattgattgcatgtcaaaataataatattttttatagctagggttaaattaaatatatttaattttacctgttccttttactttctaaaaattcggatactagaaaatttgaaatatttggggcttgcactacatttctattggacagtactgattttttagatttaagggaaatactggtttttcgttagctgttttatcttgcaaaagatgttttcagtgagttaaatatacaccaacagcatagaaagtgaacaaaagttgtgcaaggtttacacaaaacaagtttagccaacataaactgagaagaaggagagtatatcttcatttcgatacatatagtttaataaacacgtagggagggtttttttagatcagaaaacacatatgcactatatacaaattaatatgaaggatgtattatgctttattcctgtgtctcagcgaaacattgaaagtgctgatttctttgtgatattaaaaatacatgtagtatttcttcatggggttccagtcataattctttggtgtttcattctattcaaggaggttaaagaatcttacagcatagacacctaatttggaaggaatctcaatgaaatacctgctaaggtcaaggttcatgtcaaaactaatattaactgttctctctgcctgtag

SEQ ID NO: 30078 - DNA, 1079 bp, Homo sapiens
gcccatttctcctccttgtcatttctcaatcagtgtggtcctttgtgggtggggataggtaatggtataatgatgagcctgccttgaagttcttgttccaaaaaatcaactttttgacagaaaaaaaaaggcttttttcccttgtgatccataatattagtaaaaatactttggcttccaggggcgtctatgaggaatgtctgataactcaacaattctttctaaatgccgtaataattttggaaaatacctaccgtgcagcccatagcaactttctggaatgctgctttaatttgcttctctttttccctattccaacaagaacaatgacaacaacaaaaattaacttagagaagcatctgctggaacaagtggtgattatttccaagcccaaacaaaagtaggtagggaaagaattattcagagaaaacatttttcaagatcttctccagtgtgtgagagagtatgtgagaaggaaaatgcacatgtggataaaatgttttcatttgacgtcgaaaatgatagggaagtgagagtctgaaaacggtttcacaatgagaacacatggacacagggaggggaaagggaacaacacacgccagggcctgttgtggggtgaggggagaagggagggaacttagatgaagggtcaataggtgcagcaaaccaccatggcataagtatacctatgtgacaaacctgcatgttctgtacatgtattttatgtaaaaaaaaaaaaaaatgaataaagaaaacagttttagtttaaaaaaagaacaaaaatgcaaacaaagaaaaactcctttaaaatttgtgatgtacttattagaattatggatagctgtaaattgcaaaaatcacaatgataggcatgatagtgtaagcttctttatggtgaggaccctgttgtcaatttcttttgtatctctcttagcatggatataggcatgtagttgggagatctttttaagacaccagatgggcaatgtggcaatagagaaagcagtacatggagaagcaatatgctctctgctgaacttggaataatctcttatctcaccaagcctcagtgtatccat

SEQ ID NO: 30079 - DNA, 1019 bp, Homo sapiens
tttctctttctcctaattgcattataactatcactgtaaagacaataaataatacaaaacttcttaaataatgtgaatatatgagcacataaaaataagaacattccttgaggctctacttttttacagctttctattacactatgataaatagatgaataataaccttgccaagttatatttgttcttttatttgtctctagacatgtacaattttggtgccatcatttcatctctgactgcttttctgttatcttgagggtctcagtcagataaagcattataaataataaatattcttgagtcatctgatagctcaatcccagaggaaataaggcgttcaaatttccatagaagatttttattaaccttcatataaatataagtataattatttttcaatagttttagaatattattactatcctttagtaagacatgttgacacaccacaggtcaaacaccagaatcccactagaacaaaatttgaccctaaccaaaataatcacacatgtccccgtattgctgatgcttattgattcatttgtaatgagattttctacaatgaatagcctagtttaagcatgtttttttctagtctttgtaaatcactatttgtctatctggaaacctattttgttctgtttgcagagtacctttcacttgctaatgatctgtgcaaattaaacagaaaaggggaggagaggcatggttaacttttcaaaacttctttcctctgggtggatggtaagcaagaagcaattatcctctgactctcctcactcccaaaaaacttcacaaccaaaaagaggaacaagcgacacatacatgtgcatttgcatgccaaccagaagagcaaaccagtgtgcagaaagtgtgtttacaacacttccttgcaaatgaatgaccgttagattagatactttccttattctgtataaactggtgcctgttgtatttctctgtagagctgcttcagttcagagcctgggcatgtgctttgatgtgagttttaccaa

SEQ ID NO: 30080 - DNA, 1037 bp, Homo sapiens
ttgagtggcttaagaccaattaacacacaagccagggaaaccaaattgaataattaagttcttagtgcatttcagaatctagaatctcatttaataggattgatttaagaacacattctaaccaatttttgtatgaatggatagtattctgaattaaatacttgcaactctctccttgtaaccatcaaaaagcctgctatacatacacctcatcatttatgatctaatttttagaatgatctaatttttagaatgaaaagtctgcaaaacataagaaaatattttaagagaaatgtgaatgaaaacagtaggcaagctctgaactagccattatgtgtttatcttactagctgcttcctcttatttcttacgtctttcagccctgaatgatgaatcaattatttgagtaatattttagttatttttcagtacaaaaaataaatctttcataggaaattggcatgcttatgaaggttcatttgtcccattagactgtaggtttttctgagaaagaactttgatgtttatctctcccatcttccttaaacaattcaaaccctttgaaaacaaggactgcaccttactgtttcttccaaacatctagcccaatgcctggcacagaacaataccaatatcatttgttaaataaataagcaaatacctagttgtggtagacagaataatggtcctctaaagatctgtaaatcctaatccccagaacctgtaaatatgttaggttacatgaaaaagagtaattaaggttacagcaaaaattaaggttgcagctggaattaaggttgctaataaacagaccttaaaataggaaaattattgtgttagtttgttctcgcattgatataaagaactacctgaggctgggtaatttataaaaaagagaagtttagttggctcctggttccacagggtgtataggaagtgtggctggagaagactcaggaaacttacatcagggcggaatgtaaaggggaagcaggcatgacctacatggctggtgcaggaggaagagagtgaaggag

SEQ ID NO: 30081 - DNA, 1031 bp, Homo sapiens
agtgatgtgaggaaggggctgcaagccaatgaatgtaacagcttctagaacctgaaaaggcaaggaagtatatgcttgcctaaagcctccagaaggaacagggccctactgatattttaatttcagaattctgacctccacaaaagtaagagaatagatttgtattgctttaagccactgagtttgtagaaatttgttacaacagccataggaaactaatatacttcttttactccaatttctttctgtattccatgccattagatattgcctccagaatcaagcatctatgatagtgcttagcacttaaattggatgatacatttaagttcaacccttgtgtcatagtggattggattttactctttataaaatgtatattgtgaacttctattaactcaaggtcttttctgtttttgtcacgagaacgtaaatacattcaaatgaaaatatgctgcatatttttagaagacaaattttccttgaacttgatccttatagaacttaactctgtttactggaaagtaatattagagtttaaaatctagagatagcggatcatatagataagcaatgcaggatttcagtgatttctatggtcaccagtacaggtgtgatcttaaaacatcgacactattgaactgaattcataggtatgtatttagcttgcatttgtttattccagtagccactgaggtgtatttctttgtttataatctataatcaaaatcctttgctatgacatacaaaaaatgtatcgagccacggacgttgaccagggttttcttccttcattagttgaaaatgaactgtatctgctattgtttatctggggaataaagagccaaatgttaaaagttgccttcagctaggagcagtgcctcacacctgtaatcccaacactttgggaggccaggaggggtagatagcttgagcccaggggaccagcctgggcaacatagcaaaaccccatctctactaaaaatacaaaaattagccaggcattgtgatatgcatctgtagtaccagct

SEQ ID NO: 30082 - DNA, 1031 bp, Homo sapiens
tgtatgtttatagcggcactattcacaatagcaaagacttggaaccaacctaaatgtccaaatagtctggattaagaaaatgtggcacatatacaccatggaatactatgcagccacaaaaaatgatgagttcatgtcctttgtagggacatggatgaaactggaaaccatcattcccagcaaactatcacaaggacaaaaaaccaaatactgcatgttctcactcataggtgggaattgaacaatgagaacacatggacacaggaaggggaacatcacacaccggggactgttgtggggtggggggagtggggagggataacattaggagatatacctaatgctaaatgatgagttaatgggtgcagcacaccaacatggcacatgtgtacatatgtaacaaacctgcacattgtgcacctgtaccctaaaacttaaagtataataataataaaataataatttaaaaaaagacctaaaaccataaaaaccctagaagaaaatcaggacataggcatgggcaaagacttcatgcctaaaacaccaaaagcaacagcaaaaagaagccaaactagacaaatgggatctaattaaactaaagaacttctgcacagcaaaagaaactatcatcagggtgaacaggcaacgtacagaatgggagaaaatgtttgcaatctacccatctgacaaaggtctaatatccagaatctacaaagaacttgaacaaatttacaagaaaaaaacaaccccatcaaaaagtaaacaaaggatatgaacagacacttctcaaaagaagacatttatgcagccaacaaacatgaaaaaaagctcatcaccactgattatcagagaaatgcaaatcaaaaccacaatgagataccatttcatgccagttagaatggcaatcattaaaaagtcaggaaacaacagatgctggagaggatatggagaaataggaatacttttacactgttggtgggagtgtaaattagttcaaccattgtggaagacagtgtggtgattcctcaagg

SEQ ID NO: 30083 - DNA, 1139 bp, Homo sapiens
agaccatgtggactgtcagttgaaggaaagcccgatacctctcttctctcaaggtataattagataaagcattagggttcaaacacatttttaaaaactaaaaagaaggtattgtattagaagttccaattagagtgtgcaatagatgttcagcaaaaagaactattcctaaaatgttcctatctttggtttaatcacaaggtgtttgtttggttggttggttggttgtagtaattggccaaggtatctgattggcttggggatgtctttcctgaagaattatacagggaatcctctcagattgcttgactttcttctttgttctgggtgggaggaagtgtgtgactagccaatagccttgtcccaccttgtctcaagggtcggagctgctgttgctagcatcacaggccacagcggctttctgccagatggctgcctcagtatctgactcggaaatgctgcaggcaattaaaaacctcctttcagagaacatgtctttcaattctgggcccatatggtgatcagggcctctgggtttgcaatcatttaagaggtcaggctcaagagaaaagcatatggaaagaactggaagatgagaaatgcctgtaaaaaggtgaagaataggtatttaatttcactaactccaaaatgactggagaaagggaaacaattattaaaaactgggttctccacagccttcccactcaacatatagtgggctggcatcacccagggcagcagctcccttcctatctgtaaggtcagtttcgtgtgtacttggctaggttctggtgcccactaatctcattgttgctgtgaaggtatgttgtagatgtgattaacagctaaaatcatttgactttaagtaaaagaaatcattctctataatgtgagtgggcctcatccaatcaactgaacagccttaagagcaaaagctgaggtttctgagagaaaaaatactgcctcaaaactgcagcattgatttctgcctgagttcccaggctgccagtctgccctataaatttcagacttgccagcccccacaataccactatgctacacctgcaggttaaaaatattcccaaagtacttgtgtattaatatttgagaagcagtactctaaaacagtaaattctatc

SEQ ID NO: 30084 - DNA, 1029 bp, Homo sapiens
aaaaatagtggagtttctgtatactcttaactcaactttgcctgttgttaatatctaacctaaaccatagtatggctatcaaaaacagcaaattaacctggattcagtgttcttaattaatccatatacgtatttgtacttccaagtccccagtaatgttcttttctgaaacaggatccagtctaggatcccgcattgatctaatgtgcatgcctccttagtctccttgaccttgtgagagttcctcagtcgatttttgtcttttatgaccttgacacttgtaaaaagtttaagacagttatttagacggtctctcactttgggtttcactaatgttttctcatgattagattgagattacatattttgggcaaaattaccacagaaatgatagtgtgcctatcttcagtgcgtcatatcagggggaataagatgtccatgtgtctggttattaatgttaaatttggtcctttggttaaagtgggacctgctgctatttgtccatttgtaagtaatacatgcctttgacctgtttctaaagatactaaatacctgtttagcaaaggtactagaactttcttattcatcatttacccactaatttgatgatctatgactaattcctgcctataacaattattactataatgtttacttaaggaagattttctgtttttcttgttccttctatatttattaatatgcattctcctttaaaaaagatctgtctcttctgacaccatcccctgttctttgtttactaattatgtatttatatcagcaggggatttggggtatttgtttcattatatgagtatccagtattgtcattatttattttgttgctcaggttgccacagcttgggtcactggtccaaactacccaacattttgcccaaggcagattcagttggcaccactgctggctctgattcttcatcctgttcagaatatgcatagccaattctccagcgtgggtccgggtcaccccctcccatcctgcaccctgctgaacctcacatgttttcc

SEQ ID NO: 30085 - DNA, 1046 bp, Homo sapiens
agattcaaccaagttgcctcttaggtggcagagaattctggaatattgagcttaaatctgagggaaggtcccattgtgttctatggccctgttaaattttgtttataaagcaaatttcaatacagtggataacccaattattataggctccaaccagctgatatgtactctgagagttcacaaatagccattcggaggacatttgccacattttccaagcccccttggtcctgggttaaaacattttgtttgcagcctctgctacttactcctgggccttcacgtcaggagtttatatttgattccctctggattccaaatgttttcttctgggaatcttcagctccataaggaaatacttagcagatgcaaaacaagcagggtttgtcaggcagctgtagtgagaagtgactgtggcatgcagaaggctgtgtacaggtgtttgcaggctgtgctcacagacttgggagaggcctgagtgagcacgcgtgggaaagaggagaccgactcctcactctggaattaaggaaagcaaagaagaggagaatgccctggaaggaacgagaaatctgtctgttgggaacatcctaatggcctcttatttttccttgttaagaaatgctagctaaggctgtccatagcagggcagtcattctggactcataaagaggctgatccaaattgtttgtttgggggcactttgatgagggcaatggtcagagaaaaaagaaaacgataggttgtgagtgagtcagaaccagctatatgtctgacacacccaggaaggagcccttagtgaagaatgagagagaacagtgtggccctatctcactgagaagactgttctttctactgactaaaaccttttattgcctcttttggatgaattccctcaaccatgaaggccgaggctaagttgttggtttccctaagggcaaggcaaattcagataagaaacagaaacaacaaatcaggcacaatcgggaagacaaatggagcaggaagtctggtctgtgccagtcctggcccagagccacttcagcaga

SEQ ID NO: 30086 - DNA, 1049 bp, Homo sapiens
tgcataaagacaacattggttataaacattagaagctcaatataaggatttacatcataatctctgacccagttgttaatgaatatgggctaacttaactagcccttctgtacctaatcaatttttatactctctataagttttgagtgtttgagaaaatgttaacatttatctttattgttatatcttagtattcgtctgtgcacacgtgctctccgaaatgaaggatggaaaggttaatattattctcaagtgaccaaatcatgtttttcccctcaatttgtttacttttaaaacttaatgatcttagggagtgaaaatactgcagttaacttgaattataaagaccccacaattcaacagacctattgctaaactattataaaaattttcaaatgcacaagaaagttgaattttatagtgaacactcatatactctaaccacctagattctacaattaatattttgctttagcatatcttcctatccattactacttttaaatcctgcttgtagacagacattgttactatgatatgaagaatgccatctttgttccccaacaccatgataaagaggatttatttctacatagtgtttgttttctatattatttgaacatatgtatatacatgctgtttcagtatcctcagagtgaagttaggatcagattccatcattccaggttttggttagcaacttacctgagtgcattgtaaatcagtgcattagccccacatctgttaaatgacttgagtttgctgaatctggtgtctcagaagaaactctaaagtggttagatggatattgatgttgatgttggttttgttaggtgtaatttatgtgaaactcctaaattccttgaattattagaaggcttttataggtcagcctgttgtctctgccatctttcatccagaggtaatggtttagctttagtgtgattgcaacagtgacttctgtaaatccctgcaataaataggaaaaaagaaaaacatttccaaatagtataggacccactgatatactatatgggccaaattaatac

SEQ ID NO: 30087 - DNA, 1058 bp, Homo sapiens
taaagtaaattattatacatcttatttatgtaacccacatcagaaatggagtacagaactatgggaggcagcactcttgtacagttatattctttgaaaataagtcttaaatgtttctataaacaagagcaaagaaatgagttctgcaaaggatttcattagaggagaaaagataattcagtttcagtttttaaagcaattttcttttatgatgaagtatgacgcatcctgaaaaatataaatctaaagtatagtgaacacccatgtgactattacccagatcaagatcattgccactaccttagacgacctggtgtgtttctcaatcccttccaccccctgactttatagtgatgacatccttcctttttctcataggtggtaaactctgtgtgcattgctaaacaatacaatttagttttgcctatttttaaacttcagataaatggaattgtggcttttgtgtctttttttttctttttttgtttttttttttttttggctgagcattttctttaagattcatccttgttggtcaaaggattgttgacaatatgtacgtaagtaataaagttcagcaataatttttttgtttgtttgtttgttttagatggagtttctctctgttgcccgggctggattgcagtggcgcgatctcagctcactgcaagctccacctcttgggttcatgtcattctcctgcctcagccttctgagtagctgggactacaggcgcccgcgaccatgcccggctaattttttgtgtttttagcagagacgaggtttcaccgtgttagccaggatggtctcgaactcctgacctcgtgatgcaccctcctcggcctcccaaagtgctgggattacaggcgtgagccaccacgcccggcatttcagcaataatttggctaaccaggtgtcttattcacctgacggggttgcctgttcttttatagcgggaggtgcctctaggaaagagaaagggaaggtatttttcttttcacttgagatttaaaaaaattatctcaaggctgaacccttgaggtggagtcatccttgac

SEQ ID NO: 30088 - DNA, 1024 bp, Homo sapiens
agtacatgatttttatatgtcgatttcgtatcctgcaactttactgaatttgcttattagctctaagagttttttggcagagtcttttggtttttccaaatataagatcaggtgatatgcaaagtgggacagtttagctttctctttttcaatttggatgccttttacttttgtcctcttacctgattgctctggctaggatatccagtagtatgttgaataggaatggtgaaagtagatatccttgttttctagttctttgtggaaaggctttcaacttttcttaattcagcatgatgttagctctgggtttgtcatatatggcgtttattattttgaggtgtgttttatgcatagtctgagagcttttatcatgaagggatcttgcaaattcaagattaagttcaaaattaaaaaatcaaatgttttctccttattgagatgatcatagggtttttgtcttcattttcttgaagtgatgtatcatatttattgatttgtgtctgtcgaatcatccttgcttccctggtataaacccatttcatcatggtgtattatctttttgatgtactgttggattttgttgagaaattttgcatctgtgttcatcaaggatattggcttttagccagttgtagtatccttgtctagttttggtatctgggtaatgcctcatagaaaaagttaaggagaattccctccccttcagttgtttggaatagtttgaggagaatagatgtgtgtttttccttgaaagtttggtaaaatttgacagtgaagccatcaattcctggacattttttgttgggagaacttctattactaattctgtatcattactcatttattggtctgttcaggttttttttttttttaatttattcttgattcaatcttgataggttatgcttatccagaaatttatcagtttcctgtaggttctctagatagttgttcgtagtagtctctgatgatcttttgtatttctgtggtactaatttgtagtgtctttgttttcatttct

SEQ ID NO: 30089 - DNA, 1024 bp, Homo sapiens
cagcaggatgcagtttaatggggcctgtgttctcaaaatggcaccatgttgtagctgcttaggttcgagtgattcgtgggatccagcatgagctgtctctctggagcagtgctttcgcgtggacttcaggcagctccctgttagtcttgggacctgagagggtcaaggagctctcctgtggctaggattttaggagtcctagtggttccagtgggaatgtagaccttagggggtctctcaccctttttctgcattataagccactccagcctcctacctgatcccagccgaacaggcttgtttccctctttttccttgcttttgatgcttcccatcactactctcttgaatttcattgttctctctcaggtgatcttttttactcgctattgtggttcctctccatagatgagacaagtaccagatacatctagtcaactatcttcagcattgatttttattggttttgattgcttatctaaactagtagagcaaattattttagtatgcatggtgagtgcctttaacattcagtcatttaacaaatatttattgtgtgataactatgtgccagacacagtactaagcatttgggatatatacaaggatctttgttgtgatggagcttatttttcagataggcaagcaaacaagtaaataaaaagatcaagataattttagttagtgataaaggctattaaaaaagtaatatgctaactagtgtttgatgtgtttgtagaccatggctatggggccactactgtagattgagaagtgaaagaaggcctttctgagataatatttgaactaaaatcagaatgacaaggaattagggccctgcaaagatctgggttaagagcattcctcttagcagataaaaagttgatatgttgaaggaacagatataatgcccctgtggccaggatagagttagaaaagtggtgtgaatagtgttaggatagagccagaacaagtgctgaaattggtaattgtggaaattagacccttattcagacgttttttt

SEQ ID NO: 30090 - DNA, 1025 bp, Homo sapiens
gaaaatgttaattaaacatacgaaaccctttgccacctcaaaatttgttttgaagatataaaagccttaggttaattttaaggctgagatataatttttaattttttataattatgggtacataatagatttatctatttatgggttatatgtgatgttttggtacaggcatacaatgtgtagaagtcaaatccaggtaattggcatagtcatcacctcacgcatttatcatttctttgttttagaaacatttcaattccaatcttttagttattttaaaatatgtgctaaattatttgttgtgctatcaaataccagatcttttttcttaaatactagatcttattcatcctaagtatatttttgtatccgttacccctccccacattttgcccccctctctaccacccttcccagcctctggtaatcatcattctgctctctatctccatgagttcaattgtgttaatttttagctctcacatatgagatataacatgtaaaattcgtccttccatgcctggcttattttacttaacataatgacctctccagttccatccatgttgttgtaaatgactgagtctcattcttttctttatggctaaatagtactttattgaatacaagtaccacattttctttattcattcatctgatgatagacacttaggttgcttccaaatcttggctattatgaataatgctgcaataaacatgagagtgcaggtgtctctttggtacactgattttctttctttggatatgtaccaagcagtgggattgctggattatatggtagttctatttgttttcttgaggaacctccatactgttcttcgtagtggctgtgctaatttacatttccaccaacagtataggactgttcccccttccccacatcttaaccagcatttgttactgcctgtcttttgaatacaaaccattttaactgaggtgagatgttatctgattatagttttgatttgcatttttctgatgactaatgatgttgaacatctttt

SEQ ID NO: 30091 - DNA, 1031 bp, Homo sapiens
tcccaacactttgagaggctgaagtgagaggattgcttgagcccaagagttggagaccagtctgggcaacaaagcaagacctcatctctacaaagcataaaacattagctgagtgtgatggcacacacctgtaatcctagctacttgggaggctgtggtcagagaatcacttgagacttggaggctgaagctgcagctgtgatcgcaccactgcactgcagaagcatgggcaaccgaaacaaaattctcatatgtcctttgagtttgtgaagtaccagatgctgtgcttggtgttggagacacagtgatgtcttcttaggagtatttatctatttgaatagatattaaggaaacagatgtgaaattttatctatgtcaagatggaaaaatgacagaatctcttagaaatgtgttgaagtttgcaggatgagttaactgggatagggagggagacatcagtgatacaggcagaggggattagcagtcttaacgatcctgtaacaggaaggaatgaggtgagcttggaggactgaaagatggaaagaagagaggtaatacggtgtgagatgagactagagttatgtatgaggtagactgtgtggttttgaccattatgttaagaagtggaggtttttctgctttaattttaaagtgatgaagtctttgaataattcagagagttgcaatatgatcacatttacattttgaaaagaacttccttcttgtggcagagtgcacagattggggaactagaagtgggcagaatggatgtaaagagaccagttagaggctatttcagtagtctagttaaaagatgatagcttggattacagtgctagtagcagaataagaaaatagtatacagatttcagagatatttaggaagtgacaaccttgttatgatttttgtataggatgtgagagagaaggaactttcaaaaatgacacctagatttcttcaacttaggtggcggtaagagaatactgaaagcagatatagtgcatatgtttgttttgggagtggatggtag

SEQ ID NO: 30092 - DNA, 1035 bp, Homo sapiens
ccaaactcaaggataagctagactaagaccctgttttgataaaaaaaaaaaaaaaaaaaaaaaaaaagttagtgggatcagtaaaaaagttacctacagttaacattgttaaacattttgaattttaatcattcttgtttcatattctccctgatctttttatgtattcctccagatatgagctagttctttgtatgcaacacaaaaaggtgtgggtttttttttgtagtttataaagaaggcaaattgttttgagatgttgctttcaaacttatgtaaggtaaacaaaatgtaatgatgaagagtacatacattaatatttttgtgtctcattttatatgtaattaaattttccatttttttcttcctaggtttacccagggttgatgataaccgctggccttattcattggattttaaatacattgaacataactgttcacataagagacgtatgtgtgttccttgcaccaacttttagcggccttacatctatatctactttcctgcttacaagagaactttggaaccaaggagcaggacttttagctgcttgttttattgctattgtaccaggctacatatctcggtcagtagctggatcctttgataatgaaggcattgctatttttgcacttcagttcacatactatttatgggtaagtgacatttaatgttttgctgccattattactcgtgacctttctcctgaaacactttaggctgtacgcagatttgtcttttacaaattatgtagttgcgtacagagatctgtattactgttcataatcaatttaataatggataacattttaaaatatgttaggcatctctcaagttatgtgtaaatatcctttttaaataagtcagaactccaaaagaagagctatcataaaacaatctgttgatatttttgtttctttgttttggggagataggtaagaaatagttacccaggaaagttgaagcatggtttgatggctaagaattttaaattgtttctgaaactagcattatttattttgctgctgccag

SEQ ID NO: 30093 - DNA, 1044 bp, Homo sapiens
ataaaaatgtgatagataagctgcatgtacgccagctttgtgataatgggttttcctgagggtgggtgggtgatactgaggtgggcaatattaagggagcttcacctagctcagctaaaaaaattttaaatcaaatattctgaagcaaatgtataatttttgaatttgaaagtctgaatagctaggttcataactattttaatattctctacacttgtgtatgtttcaaatactttataataaatttaaaaaataaaatattctattttgtggacatttatgcaacagaaaaatacaaagaaaaaaatcacccacagtgaactaccatttgcattttttaattttgagcacattacattcatgaataagtcccagttggtcatggtatataatctttttcatatgctgctgaatttggtttgctagtattttcctaaggatttatgcatctgtgttcataaggtgatattggtttataatattctttacttgcagtgtctgtctgtcttaggattagggtaatgctggcatcatagaatgagttagaaggtgttcccttctcttcagtttttggaaaagattgaggaggattagtgttggttcagttctttaaacgttttagtagaattcaccagtgaagccatcaggaccaggacttctcttttttgggagatttctgattgctgattcagtctccttgcaagttgtctctgcagattctctatttcatcatgacttagtcttggtaggtttttgtgtttctattaataggactttgttgatgtaagctattcaatttgttggcatacaagacttgataatactctcttaaaattcttcttgttccctatggaatcagtagtaatgtcccgctttctgattttagtgatttgagtcttctctcttttttacttaatctagccaaagatttgtcaatcgtgttgctctttttaaagaaccaacttttggtttcattgatttttttctgtgttctttttcttttctctcttttagtgtatatgctgctgaagcaagcactctatt

SEQ ID NO: 30094 - DNA, 1079 bp, Homo sapiens
aaacatagatctagttgtctgtactgacccaattactataacttcattgtacatttttaaattgggaagtattgtagatttttatgtattgatcatatattctgtgaccttgctaaatttgcatgttaaaatttactttttagattccttaggattttctacatacaagatcatgttatcttcagagacagagggtctttgctacttttttcccaaactgtatacctttaattttttttccttgcctggttgtactgactggaacctctaacatcacgttggacagggtactttttcctgccctatttcctgaaataattctcgtaggattggtattacttcttctttaactgtttgtttggcagtatttaccattgaagccatgtggaccagggaagatttttaatatgaattaagctttttaatgacatcgtattattcagattttcttttttcatgagtaatttggtaatatgtatctttttaaaagtttttttattttatctaaatgacctaatttgtcggcagaaattgttcataatatttctttataagtctttggatttctgtacaatctgtagtgatgtcaccttccttattcctggtactgataatttgtatcttctctcctttcttcattagtctagataaagcttatccaactttgggtttcactgatttttttttcctttatattttcaattgcattgatttcttcgtcttcattatttccttctaattcacacttggtttactcttttctagcttcttaaagttgaagcttaagttattttctccatttctacttttctagtataactatttatactagaatatactgtatttacttctttagctgtagtctctgtgttttaatatgtggtgttttcattgtcatgtggttgaatattcttcgaattcatagtttctttgactcatgggttttttctaagcatggtgtttaatttccaaatatttggggttttcttagcatacttttttttgttgatttctaattctgttgttgaagaccatactttgtataatttgtctttttaagtatatggagacttgtttta

SEQ ID NO: 30095 - DNA, 1074 bp, Homo sapiens
aaagaaatccagcttcagaagtgattgtcgtgtttcaacataagtggacttagctataataaaaacataaatgacataaggttttctcaggcctagtcagtttctagttgtgcctttgtgtgttcagtgtttgtctaggatttgacttctcagctctggatatctgaaaggcctgttgatcatagaatcttagtttataattgttgggagggatctacaaatcttgtccaacccacattctatagtgaggaaactgaagcttttgctgttaagtagttgtaagattacatagtgatcttcttctcagtttttaattttctttatactttagtatgcatggttcttttttttttctctctctttcctgcctctgtgactctcctttatcagggcttcaacaggctgatttgtttaaaaaaataatttgtagacatttcgggtcatgtgacggggaaatttttgtttaactttgattacatttgggtttgggtacgtcatagagggtaattccattccaacattaatgtgtttggaaagaacgttatctgatggattatgtctgttgtcttctagacatctggtcctccattagcttgaggtcagtggaaactttacttactttggtccttcctattaaatttatgagcttcttactgtcttcctaacactgtggtcatctcttatcatatagattgtgaggcaacttaatatttgaaccagtagcccctaacttccttctctagatggatttcttttaaaagcaaatgaatattctttctcatctaagttgggtgaggaggaaagtgtgtagtacactatgctacacagtatataggatacacaaatacgtgtattcctaaatataccccccaatctttgtttttgatagagtagtttatttgccaaaaactattaaatgatgtgtaatctgtataaatggggtagtttttacgttaacttatttcagatgggctttatttctaatgaatttttagtttcagtgacttcaaatactttctctctaatcaattgcgtaacagtggtctgtgaatataaagcaggtatttgacacaa

SEQ ID NO: 30096 - DNA, 1061 bp, Homo sapiens
gatttgtcttttataacattttcatctttagtaataattttttattcttaagaattcttaaggatactgtttaattgccatagataggaagaaaatttaattttttctaataccatctgatctaagtttttttgtttttttaaatctgtgaaacacaagagaatatatatctgttgtggtttttttttttaaagtgctgttataaaatgagttaatacatttggttttgaattagactagttcaataaaactttttttctctaaaatgttttcctggagattagaaaatatctattgattataatttatgcccctcctctgttcctgctgttctgtcttgttactccccaggtggctcaataaaaaacaatttattgaacagacatgctttctgatgtgataccagaaggacttgtgtccaggtctaattaaaggacataagcaaattatgcatgaatgactggaactaacaattagacacatacttcaagagttcagcctgtggatcactaacgaatttgaaggataacccaagttgtagaatgttattctgattaggttaaattactaggttaacttgtgcagttatattataaagtaataatataactgtaaaataaattatacagttatatataactgtaaagtaaaattgtaatattataatataacttgtgcagttatattataaagtagtcaattaattgactactttagaatctcagggtgtttcagtaataattttttcagtcctttccatttccttcacctgtctccatgccagcttcatgtcaagcaaggcattattgtgtaaggtgtaattattgggtaaagtatttctgctacaggttgagtattcaaaatctgaaacgctctaaaatcatgaacttgttgagcaccaacatgatgctaaaaggaaatgcttattgaagcatttcagaatttcagattagagatgctgaactggtaagtataatgcaaatattctaaaatctgaaacactgctggttctaagcatttcagataaaggatattcagtctgtagtaataattccaaaagg

SEQ ID NO: 30097 - DNA, 1037 bp, Homo sapiens
ttgtagtgctagaaacttgtacaattataggatctggaccatgagtgacacatgaatcaggaaagaaagaacagcacctgtaggggttcagtttaaaggattgcacactcattgttctctaggttaatggatcctggatgaggccctgttaatactgcatcattcaagaagatttaacttaaacctcatgactcagtaatcccattcctatgtatatatctaagagaagtgagtgcatatgtctaccagaagacatgtttaagaatgcattagtaattttatctacagtaacccctaatagtaaatattccaaagtcatcagcagtagcatgaataaatttttgtatatctgtagtggaatacaacacaacaatcattaaagaacaggatggggaaataagagaagccaatacaaaagagaacatttttatgtggttacattcctgtaaagttcaacaataaggaatactaattctttagaagtctaaatagtggttaccttttttgataggggagggggttgttactgactgagaagaggcatgaggacatataaaaatgttctatatcattatgggttgtagttacacaggtgtgtatatatacaaattcattgagatacacacttaagaatatgatgcgatgtattttttagtcaggaagaaaaatttaattagcatcagataaggtaggagctcacatgactcactgaatttgtaaagttatacatagccttcagccagaaatagttagagtcttttcctgtggttagcacattatccagaaagctctggctattggaaatttgtttcaaaaattttttttaagtttcttggcagtaactttgcaggttcctcctttgattaataacttacgttcttctcatcccgtttttgttttaaagcaggttttatgccagatattggcactggctttttatagattttaaatctataaatttattttgcctggagatgtcatgcacaaatatgtttttatctgccagctatgggttttttatgatgttattgacaaat

SEQ ID NO: 30098 - DNA, 1033 bp, Homo sapiens
caggtgagcgatcattgccgcctgagctccgcctcctatcagaccagcggcagcattagattttcataggagtacaaaccctatcgtgaactgcgcatgcaggggatctaggttgcatgttccttatgagaatctaactaatgcctgttgatctgagggggaacagtttcatctagaaaccagcagccctccgccatccgtggaaaaattgtcttccacgaaactggtctctggtgccaaaaaggttgggaaccactgcttttttgtattagattgtgtcttacctctttcactaaattgtgagcttttagaagatggacatccagcattgtgcttttacatgatgaaggcacaaaagataagagtaattgccactgatccagaataaaggaatcttttgggaaaaatgtatgcaggtgtcgtgtgatgcagatgaagtaaagcctcagatttcctggtcaaatgtcaatgctgtaatgtttcccttaactgtgattagtaaacattatttttttgtattaatcttctgaaatttaattctcccagtatggtttttatttgtggatttgctttagcagtcagtgttaaaactgtgacatgtgatagatcactgtttctaaatgtatgctttgaacattaatattacagaagtcctaaatttctgtgcatcttaaattatttttaaactttgtgaatagataatacactcatatggttcaaaagtaaagtataagaggatatacaataaatgtctacccccttcacgtgattcaaaaataaagtataagaggatatacaaaaaagtctaccccccctaaaaaaaaaaaagttcctctataggtaataacaatgtattgtgtacttgtaagttgctaagagagtagatatttcagtgttctcactacaacaaaataagtatgattgatgcatatgttaattagatcgatgtagccatttcacagtgcatatttcaaaacatggtgtacaccataaatatacacaaatttatgtgtcagttaaaaatgggggggcg

SEQ ID NO: 30099 - DNA, 1046 bp, Homo sapiens
aatatcacttaattgttttaatgtctgcagcttctattggtgttcctttttaattatagatatttcatttttcccccttgaattcatacttctttccccccacctctgccatacacttttttcccctgattttccttggcaggttttgtttttttttttttctttacatcaattttgttagctgttttttttttttctttcaaagaccagctcctcactttagtgctttctacagtgttagttcattattttgtgccatttccttggggtgggcggagggtcatattcttttaaacttggtgtggtgattttttctttcctaatatattgttacagatttactccgagcataatttagcctccattctcacaggttttgaggtgactaaatgtcattaagttaaatgtatatttaatttccattgtacttcttttttaagaccatgagttatttacatgtactttctaaaaatttccaaatatggtggttttctaatatccttttattatcaacttctaccgttgttgaattgtagtcagatactctataattttaatcctttgcaattggttgaggcttgctctgtgactcaacttatggccagtttataaacatatagattattattatattttgccaatgaaacatagtgtcaaatgagcacacggtgctttcagagacataagtaaatgttttttgaatttttggtttttggttttttttttttttttgagatgacgttttgctcttgttgcccaggctggagtgcaatggtgtgatctcagctcactgcaacctctgccttctgggttcaagcaattctcctgcctcagcctcctgagtagctgggattacaggcgccctccaccatgcctggctaattttttgtatttttagtagagatggggtttcgccatgttggccaggctggtctcaaactcctgaccttcaggtgatccacccgcctcggcctcctaaagtgctagaattacaggtgtgagccactgtgcccagctgaatataaatattttacatatatataatt

SEQ ID NO: 30100 - DNA, 1055 bp, Homo sapiens
gctctgattgtttaatgtgcccattagcttgaacaagttaagaaccacccctgaaatggggtaggggccaattccacccaaatggcatggataaaatggggaagttgtagcttttgaaaggaagtttaaggaaacttctagaaagaaggggaatggaggctaggcaataaattatggaagtcctccacacctcctgaagggataagggaattaaacttcagatacattttctttggggaatcctttgtgtgagggagtaactcttagcacaggcattagtcaaggtaataggctaagatactgcaaaagacataataatgtgacaaagaacaagagacttgtcttcctctcacatagaaatactccagtggtttgctttacactattattcttggtcccatgttttttgtttttttttcccctgtaccatctcctaagccttgtaaccctcagtgtgatcaaggctaagttaccaaggttttcagctcacagaaagggggaagagaaagtgtagaggaggcaacccactgtcttgagggctctgggctgtcagtggaaaccacttctccctctcacatccaacaatgagaacttggtccatggccatgtgtagctgcaaggactgctgggaaacacagtccctggctagatgactagcgaccagcttacaggtctgtgattatagagaaaggggagaaggaattttggctgggagttggcaatctccatcacaacccccaaactaggtttcctcagaggctggcccattccgaatgatgttcctgtgacagacacgatttcctcagagaagaatcttcatccaaggcctttcattttgggaaccaggaatgcttaatggggactaagtcagttatagttaggtttaaatacatatgacagaaaacctaaaataacagtggtctaagcaaggtaaatgtttgtgcatttttctctaatgtaaagacatttgtggttggtgtagcatcatggtggcagagacttgtttgattccactgttctgccatctcggcatgtgctgtcctccttctgctcta

SEQ ID NO: 30101 - DNA, 1031 bp, Homo sapiens
attggcaaactggaaaatagatctgaggatattaaagtagcaaagaaaatatttgagaatttaaagattaagtggaagatagaataggacttgaacatacatctgataggagttacagaagagagaaaaaggaggcaatttttgaagaaaaggctgaaatttgtcccgatttaattatgtgcattcaattttatgttattctccataatgtatttccattaaaatttaatcacatggtctttatagctttttatgactgcatataaactaagttgatggtgaacgtttttgaggaaatacgctttatgaagaatctgtgtggataatctaatttactgaagctgtgattgattcaagttactgaagcaagtgatgttacctttggtaggatgggagacagcaggcctggtactgtgggaagacttgttctagctcctgcttaacatttaatatccatgttgtttagccaagtcagctaacttctctttgaggttcatttttctcattcgtaagtgggaataatatctgtgcagcctacctcataggattgctgttaaggtccgtaaagagcaggaaatcaacatattaaaggagaaaaattaaatgatcatggcgatatctgcttgtggcagaaacaatgccatgtgttcactaaattattttttcttttcttttttttttttttgtagatacacagttaaattacatttcccaacctccccagcagttaggtggcatcacatgattgagttctagtcaatggcatagggagagaaaagtgccactttcatgtgttctgtctggttctttattatttcttctgtgcgtgctggttgtatatcaatttccagtatgttctggaagccatacattgaagatgatggacccccttttcagccaggattctacaagacaatatggagaaagtaccccccaatcacattggtctgtgattgataggtacaaaaattattgtattatgccactgagacataggagttacttgttatagcagctagcataacttcact

SEQ ID NO: 30102 - DNA, 1050 bp, Homo sapiens
ctaaaatgacagagatgggccttctaccttggggtggatttgggccaggcatgaagtataacgcctttgggtttttttctgatttattatcgatatgctctgtgtactgcgctttttcaggaaatacaaaagtgaaagaaatgtaagtggcccacaatcccattactagaaataatcactgttgacatgttagcatgtatccttttagatttcattaagcgttttgaaaaagatgggaaaacatgtaagcaaaatcacccttattactactatagtttttatttttgacagagctaattatgcaccttttttgtttgttttgttttgttttgagacagggttttgctctgtctcccaggctgaggtgcggtggcaccatcatggttcactgccgccttgacctcttgggctcaagcgatcttcccatctcagcctcccaagtagctgagaccacaggcatgcaccaacacacttggataatttttaatttttttctagggacggggtctctctgtgttgcccaggctgctctgaaactcctaggctcaagcaatcctcctgccttggcctcctaaggtgctgggattgtaggcatgaaccactgtgccccaccttatgcacatattttaaagattcggtcctacaggcagaaatataagtttctcccagtgtcttcatctctttgagctctaaacaacgtgtttataatgctgtttattggtgttccctcacccacccagtcatagacattatccattgcctttctactctgaaagatgaggctttagctgggatgccctcttccctgcctccaattatacataccctcttcctgtctcccaatataggtccaaacacttctgatggttcaacttaggaattttcagctttacagatgttgtaaaagcagtatgcattcagtagaaatcatacttcgaattttgaattttggtcttttcccaggctaatgatattcggtagatattttttcatgatgctggtcagctctcagccacccatgccatcaccagcgcaaaccacccatcctct

SEQ ID NO: 30103 - DNA, 1032 bp, Homo sapiens
taatcatattttatttccttatatgcagaactatttcttaaccctatcttgttctattcctgtgtgaattcccaggcccttttaattattatagtgttatcatgtattttaatattcaatagggtaagccatacaaaattttctatttctttgctatcgctgtatacttatactaacattcaaggtgatttttagaatcaatgtgtcttaaattccatttcaacttggattgtgatttcattatatttataaactaatttgaggagttgactttctgatgccaaatcttaccatctgggaatgttgtatctcttcatttattcaggttattttatgttcttaaagtgctgagttttttccagatgaatcttaggcatttcttactcagttttaagtattttcaatttctgataaatgggatttgtcaaaaatgaattggatttcactcatttctgattatttgtgatttataagaaagctgttaatttttaaattttggtcttgtgtgtagctatctcgagttattctcatactttttgaatatgggtggttttcattttctttttatacttttttccattattgcataggctaagattgccagtataatgtcaaataattgggatgatgtagatatccttggcttgctcataactttaattggatatttccaatattatgatagtacagttttaactgtagggtctgttattctttattgagttaaggaagggaagttaactgtgtaccctttttaattaggaatgatttgagcagtatgaatgggaatggacctaggagataggattgttttggtggggaagtgctttttattgaggtgatcatttgaggtttgtttacttccattggctaatgtagtgaattgtattaggaaacctaatgttgaattattcttgtactcttgggataacctctacttagttgtattattttgataaactattgaatttaaatgttttttactcttggatttgatttattaatatcacatctagggatatcgtggctatg

SEQ ID NO: 30104 - DNA, 1031 bp, Homo sapiens
ggtgtcagagacgctgcccacttctgtcggttttccctgttctctgcagtgggttccatcttctgatccaagatactgcttcatttcccaccatcctgtctgctccagccttcagtaggatggagaagtagaggatccctttcttcaagatccaacctggaagttacatgtatcatttcctctggcatcctgttggtcagaatgtacagcatggccacatctgactgcagatgaagctggggaaatgtggtcctcatctacgtggccatgtgaatagttaaaacccacttcttactaaaggcagaatgtgagagcggatggtatggacaaactatattctgtgctgtgaggggccttgcagtcacctatttgctgctattctcagctctctccagtcttcccgtaattgaggtcaagagtcattgtcatttattttcttgtaactgatgtgtttcactcatttatgttacctgcttggtccctgtaggcatttgagtttgcattctcagctgtgccctgatcatctctttcaacacacctccatgcttttatatttgttgccgcctctgtttagaattacctggcctccctttcaggcctggcaaactccttctcaggataacgcagccccatgcttcccttcccaaattgagttatctctgttaaccatcctaatatataagctgccaattttacataataccttttagtttacttacctttatatacttgatgcccagaacagcactgggtacataacagactaagggtcagtcctgtttactgagtgttcattcagtgaaagacacttcctagaacttaaaagcatttttaatatctaacagtgaaatagtgtattagtcacagcctgtacagctgtagatgatggaaacgtggctaaattggcttccatgacaacaaaaaggaggagcacttactggctcgtgtatctgacaagctgagctatgtgtcaagcctcaggtatggctggaaccaggagttcaatagatagcaggactcagtctctcttc

SEQ ID NO: 30105 - DNA, 1062 bp, Homo sapiens
gcacttcgtagtggccaccaatcaggaggaagtccctgattgacctagctcaggtcacatggccattctcagtccagtcaatgtggccaggcataagtgaggggggagaatagggtctggaagcagggaacctaaggctgattcacgctgatttcctagaatggaattaaaaggaaaaccccaactttccatgcccaagtaacaaaaggatcataagctacttcctttgcacccccacccactttttcttcgtggcagatggaaaatggaaagtactctgattggtccccttctgcaaccaatcagactggtcgtgggcctagtctttatttgcataggggtataactttgtaacttcacttcagcctttgattggttgccttctgcaatcaatcagactggtcatgggccacttctttatttacataggctgtaaccaagtaaccagtgagaaacctctagaaggtatttaaaccccagaaaattccataaccagcatgcttgagcccactcccatactgtggagtgtgctttcgtttcaaaaatctgtagtttcattgcttcatttgtgtgttttgtccaattctttgctcaaagtgccaagaacctggatgactcacagtcaagacccgtcactggtaacataagtagtctggccatacctgggtcatctgtctacttctggtacctggggtggagtcgaccctactcaaattacattgaaggaaaggtaggtctccaacacgagagaaaataggcaaaaaaaaaaaaaaaaaaaaaaaagtgacaattatatttggaactacctttgtctcattttataaataaagcagctgagggtgagagagattatcgtgacctaaggtcacaaccaggaggcggcagaagtgggattcacaccagatcttcctgactctaaatggtagactgttaattcagtgcacccaactatttctgaagggagttatcctggaactccccaagccccatctctgcatggggacaatcctgaggtttgatgctcctgtgtatgactattagtatgtagagataccttgtagg

SEQ ID NO: 30106 - DNA, 1032 bp, Homo sapiens
agggccgcaggttggacaagcttgctgtagcgtgttgtccaggtgcacttgtctgccggaaagggcagatagatgtgggctccagccctgcctgatagcctctcggctctgagcgtgggcagatctctcaaggccctctgaaacttggtttcttctgctttaaaggtggaatggtgaggtgcagtggcagcctatttgtggctgctttgcttaatttggggttagctaatagctgttcctttttttgtctaaagtggttatactgacccaatccattacaaagttgctttgaggactaaaatgaaacaatttaaggtgtctggcacttacccatcatttttattgggcaccttcttaataatgtttgaatctacataaggtaagatcatctacattctttcagacacacagccatttactcctctgaatttgaagtttttcttcaattttttgtcttcataagaattaaaatgttacagagtcataaattttgttttccaagttttacctaaaaccctcagatattttgctcctaaacaggttaaggaccaatgtgatactgccctcactcttaaaatcttgaaatccttcagctgttaataccattaaactattactaactgatttatttttgtagtgttcaaataaattttaatataggttgggtgaaatctagaaaagttgtatattttgtctttatgtataataggaattacaaggaagtgccaattcagagtaaagttaaatgaaaacatgagagttagggaaataaggctttattagaatacacaaatgccttctgtggtcgattagattgtgagaatccaaataaatattttagaaaattattatttgaataaaagtgcacattattttatgtgtccgccattatttaatgtattccctcaaccatatggagatggcagaagagatattgattcaggctttggttgtgagtgaaggagataggaaaattatctggaggctgctggtaggattataaggaaaaccactaaagaatctggaaatatg

SEQ ID NO: 30107 - DNA, 1028 bp, Homo sapiens
ccaaatgagtaggaaatcaggaagcttcagagagccatggtgtcaaagaaggcttcctggaggaggtgggatcagaaaggagccttgaaggatggatagtagaaaagaagggagagatccttccaggctaggagaggggagagaatatacagtaagtattgagcacaatacctgaaatattacctgaggtaataatattagcagtgatgccagtatgctagtatattaacaagaaagccagtctaactgaaatagatgcatagaaaatgtgggaccagccacccaaacctccagcaaataccatacttagtgatgaaacattagaagctttcttttataaaatcaggaacataaggatcttattaccatttatattcatcgtaggccctggaggccctaaccagtgtagtaagacaagaataagaaatacaaggatgggggaaaaaggaggccagtcatgatggtgcacacctgtaatcccagcactttaggaggccgaggccggtagattgctcgagcttagaagttcaaggtcagcctgggcaacatggtgaaaccccatctctacaaaatatacaaaaattagccaggtgtagtggtgcacacctgtagccccagctacttgggaggatcacatgagcctggtcaaggctgtagtgagctgagattgtgccattgtactgcagcctggatgacagagtgagaccctgtctcaaaaaaaagaaaagaaaagaaaaacaaacagtcattattcataatcatattatctacgacaaaaatccaagagaatttacaaaatagtgttcagcatgattgcttaatataagtcataatacaaaagtcaattccacttctgtacacaaacaataaacagtttgcaaatatttctaaaactttatatattacctttatggagcaaacctagaaacttcattgaaagataaagatctaaataaatgggaagctgtaccattttcatgaatgggaagcatcagtattgtaagatgtcagttcctaaataaacacat

SEQ ID NO: 30108 - DNA, 1024 bp, Homo sapiens
gtgttaagatatctcattcagttcttttccagttaaccctatgctattaaaatcaattcatgttgctatggatccatctattctgttgctttgaattgctttcctggtactccttggagtgtgtagcagttagtatgctttgtgatgaaccatcccaaacttagtgacttaaaacaatggtcactcctttttcgtgagtctgtggggttggttgagtggtttggctgatttgtgtctgggtctgctgatctcagctggtgtcactcattcatctgtgatctgctggagactgcatgatttaagaggtccatggcacattgttgtcatccttcatcagtttggcctaaacttggtcacctgatggcaaggccaggaatccaagggaggagaattgtgcaaggcctatacttggaacttgaccacagtcatttctgccatattctgttggctaaaccaaggcacgagtccaatccacaaatccagtctggattcaaagtgtggggaaatagactccaccacttgatgggaggaactgaaaagcgacattgcaaagggatggttatagggagtttaattagagccattgattagtcagagtatgcatccaccaccttttgcctattcactcttccagtgatggaagccaaagttgattccaactctggaagctgtgataaatatctttgtacatgtcaccttgtggagctgtttgataatttggaagctatattctcaggagtaagattgctgaggcaaatggttacatctacctggaatgtctataggaacagcagaagatgagactggatacttccttgttgagaagttgggatttggtgctaaggtttagtgggcaaccttgagttttaggtaaggttaatgcatttagactcatgttttagagggattatcttggcaatagtgtgagggttggaagagacgggtactacattaggtccttgggtgcctcattggaagctgacttaggccagctgagaatctgaattaaggtcataaaaatgga

SEQ ID NO: 30109 - DNA, 1047 bp, Homo sapiens
ttagaaaagatctcccaaatgcaaatgtgttaaatcaggaaagcaacctgtgggatgtcagcggggattaagtataactttggaaagatacacaagaaactaagaacattgtccacctctagagagtaggcaggaaaagccatggcaaggaagaccccaaagggtgattccagggacaaagagatttctccctgtttaacctcttatacttttccattttttaaccaggtcagtgtgttatctatttgaagaattaaaataattagaaggaattcaacccacccttcctcctctcataaagatgtttgcagcaagcagtagccctgttagcagtgctgagaccctgggagcttctttctgtgtttaggtctcaggaatggctggttttatttttatcttattgtgagaaatgtgaaactgcgcacaataaaatcacatctgcccaccacttagctttagtcattattaattttttttttttttttttttgagacagagtctcactctgtcacccagcctggagtgcggtggtgcgatcttggctcactgtaagctccgcctcccaggttcacaccattctcctgcctcagcctcccgagtacctgggactacaggcacccgccaccacgcctggctaatttttttgtatttttaggagagacggggtttcaccatgttagccaggatggtctcgatctcctgacctcgtgatccacccgcctcagcctcccaaagtgctgggattacaggcatgagccaccgcgcccggctagtcattattaatttatggtcagtattgtttcatctatgtccttacctattcttctttcagcaggattttaagtgaaattctagatggcatatcatttcgtccataaatattttcataggtagccctaaacaataggaattttccttaatttttttgaaaatattaaatttatatatatgtgtgtatatacatatatatatatatatatttttttttttttttttttttgagacagagtcccactcttgtcgcccaggctggagtgcaatggcaca

SEQ ID NO: 30110 - DNA, 1033 bp, Homo sapiens
cctttccttctggtgcagggagggcatctttttatctcctgctttcaggaagaaaagggggcagtcagagcacccctcttgcacctgttgtttttgaagtgtctttagctcaaattaatcctatgccaaagtggcatatttcagggtagcatattctgccatccttcagtgaactatttaaaattttagctcatttggcagcagcacttattccagttttagtgggggcattgatttatgaccatccccggtgggtcattacatgcctatttaaattgtgaaatagaccaaggggtgcttctgtgcaactcagttacaggggggaaagttccaataatagaggtgcattattatttgcatgcttaaaaagcctccacaattgtcagtgcagataaaaggccatgctgagccatgaataatcacttgctcctagagtaggggaggggacctctctttttttaagactcaatggaacagaaacgtcacagtaggcatctaaattaacaactcttgtttctgtaagcctggactttctaagcttttcagccaaactatctcacgcctctgagagtgaacttactctctcaggggtcttaaggcgaggcctgaaactacccaggttaaattttagtttgaagttttgtcttactttttaaatttttgtgagctgtctcctcccctacaatatttctggttgtgattttcaatgaaaaggtatttatttatttctctgtgacagtgcttcttccctacctatctcccacatttttgaataaaactgattccccatagtccagcagatctccaaaattagttgtgcactgcagttttccttctcatcattcattagtcacaaaggaagcccaaaggggtgagcagctaactgaaatgccagtggagctttcgaacccaccaaggggagggatattcctctcccaggagcagtgctgtcagtggcttcaaccaggatgggggcatttattaatgagacttgtgaagcagccagctcaggatgactggcatgaaaccttct

SEQ ID NO: 30111 - DNA, 1041 bp, Homo sapiens
ttttgtgtgtgtgtttttggttgttctttgtttgtttttgtttttgagatggagtctcactctgtcacccaggctggagtgcagtggcgtgatctcggctcactgcaacctccctctcccaggttcaagtgattctcaagcctcagcctcctgagtagctgggattacagggcccatcgccacatttgcctaatttttgtatttttagtagagatgggatttcaccatgttggccaggctggtctcgaactcctgacatctcaggtgatctactcgcctcggcctcccagagtgttgggattacaggtgtgagccactgcacccagcggaatttttaaattactatattgtccttgtagctctctttcactgtggcccagggaactggcatttcagttggaggagctataagatttttcaacttgaatagtctctgatccagggcctatttctctatagcaacaagacctcatgtttctatgaaactcagtaacattctagaaccctctgaagcttcacatatccctccttcatttctgtagcccagatttctttttttaacctttatgacgatcctggtttctttgctcttctcttttctttcatctctccacttattttcactacatttcctccaacccaggcattccccggacatgtttacttttgggagtgttaaacaagactagggaagtcacaaagttaggcattgtgagatagtgcctgagagaggcttgtaataaactggcagagcccccagtgtggggggcgcacagagggagaatgcccctgccttctactcacgtctctaccaaccctcttccccttccccatttctttccaagggaaatagcagtttcttgtttctttagagttcagaaaaaatgggccatacttactgagagatgggatcattgcatgttcacaggtcgtagactcagagagtctttctttccccatctcctctctggccccctcgtccacatgggctcgtgcacaaggcccaggacgtcagggcagttctggccaggctgagctttc

SEQ ID NO: 30112 - DNA, 1031 bp, Homo sapiens
ggcccactcgactcatttatgtgaactgacactgtagcaatccgagattgtaccccggacctagattgcctgtgctacattagaaatgatacactttcctcagatgcactgccgccgtattcactcctaagtgaactccctgaggttatttgagcaaaactacaggctttcagatgttctccgaaataaaaacagcataaccagaaatcatttgagaaggatagtaattgaaccaataaagtagttttagatggcaaagcctggtatcaagaaaaggtagtgagtgggtgattcaatggaggtgaaatgataacttttgctaattaggatgtgccctaaaccccacttctattatgctttgttttctccagttctttgccttcctggtcaccatctgctacgctggaaatacatatttcagttttatagcatggagatccaggaccatacagtgatttaccattttgataattaaaaggaaaaaaaaaggaagactctcactgtaaaaacagctgtaggtataatgtatattcccagagaattgtatttaactaattaatgttttttatattcttaaatttgctcacaaattgtggtttgttacaattaaactggatacttatttgcaaagtgttgtagcttataatgaactcttaagtatcttattaatgtattaatgtcttcatagatcatattttcttagacaatgtttaaatagataaattgctaatattgagaatgtgtcaagtttgtaaacctaacttttaagatgccagattcttttttgattaaatgttgcaaaatcccaagtaatgttgtgtttgattggagaaaggagacctacctgttgaagccagaggctaggctgtcaaggctggtgggaggctgggaagtctccctcttcacagggctgcatcgtatgatattgtcaggtgacacttatccatagtcttagggcaaagaggcgggagattcatctccccaattctggggatcatagatcagtgttcatgattttcatatgctaacag

SEQ ID NO: 30113 - DNA, 1031 bp, Homo sapiens
tggtcttgatctcttgacctcatgatccgcccccgcctctgcctcccaaagcgctggtattacaggtgtgagctgccgcgctcggctaaatgacttttttttttttgagcgagacagagagggtcttgctctgtcacccaggctggaggacagtggtgttatcatggcttactgcagccttaacctcctgggctcggcgattgtcccacctcagcctcccgagtagctgggactataggcacccaccacgatgcccagctaaattttgtattttttgatacagacggggttttgctatgttgcccagactggtcttgaacttagagattcaagggatctgtccacctcggcctccccaagtgctgggattacaggtgagccactgcgcctgcatgagactcttttttttaatagctatttttttttagccctattattgttctagtaattacatactatataccatgtgtgtataatctcattaaatgtttctaagaatccagtgaagtaacatgtttgatagataaggaaacgggctaaagagttaaagagacactaaagtcacacagctcttagcagtagtggtggaaccgatccaggcctaatggcctgatctccaaaactcataactctggcagagttgttgcttgttaatagttctagggatataaaagccacagtgagataacacttcacacccacggagatgacaacaatagaaaacaacaagtgatgaagatgtggaggatgtgaagaaattggaactctgatacagtgctgatgagaatgcaaaatggtacagccactttgggaaactgtgcagtttctcaaaagttaccatgtgacccagcaattctactcccagctctacccaagaaaatgaaaacagatgtccacatgaagacttacacattcatatgtgttcataacagcattattcataataaccagaaaatgaaaacaacacagttgcccatcaaatgatgaatgtataaacagcaactaaaactaagtgctacattcatacaatt

SEQ ID NO: 30114 - DNA, 1095 bp, Homo sapiens
gccctggcgcttcctgtgcagcgccactggacagccatctgtttcctcccctctgccatctgcctcgcgccgggcccagcgtgcggccctggaagcctggctcggccgccgcccgcgcacgctggccttctttgttactactttggctcagtggtttcctgggctcgctgctcattccctggcagggctcgcggcgtccgcggcgactcctgggatcggcaggggcctggcttccagcccagcgccggcagcagcccgggggctgcggagcggaaagggggctgggacgcggtcactgctccagccacccggcgctcctgggcggaaatcgcgagcagagcccttctcagcctcctgcagaaaacgcgcctcacctgacttgtgtttaaatcagcaagggcagtgacgcggctcttccttttcctggggcagtcactctcctccctctgctgagcccgctctctttagtttactttaagcaaaggttttgtttgtttatttgtttgtttggttttggtttttttgagacggagtctaaaaagtcttcagtctgtggcccagactggagtgcagtggtgcaatcttggctcactgcagcctcctcctcccgggttaaaatgattctcctacctcagcctcccaggtggctggggctacaggcgcgcgccaccacgcccagctaatttttgtatttttagtagagacggggtttctccatgttggccaaggtgatctcgaactcctgacctcaagtgatccacccgccttggcctcccaaagtgctgggattacaggcaccagccactgtgcccggccagtttactttagatagttagaaagaccgattgataaccagagaggcggtaacccgcagtttccacttactactcccaaagggttgccctgaagcttcagaaaaaagctgtgtcatgctcatttgttttattttattctattttgtttattttattttattttatttttcgagacagagtctcactttgtcgcccaggctggagtgcagtggcatgatctcggctcactgtaaccttcgcctcctgggttcaagcaattaattatcctgcctcagcctcc

SEQ ID NO: 30115 - DNA, 1033 bp, Homo sapiens
tccagcctgggtgacagagcaagactctgtctcaaaataataataataataataataaactttggctgaggggcccagggacctgcattttaacgcatccccttgtggatacactctctaaaggatgagaatgtcaagtagtgactttctcactgccatacagatcacaggccaccttcataacttcccttgccttgtgtcaagcaaaccagcagggacctgagaccatcagcacctttgtgacacctgcaggtcgtcttccactgtcatgctgccttttcagtaggccctcccgttgggattaagtactttctttcatgctactcttcatctcctgataagggagggaaactgaggcagtggaactgctggattcctactcctcagtgaaatcttgggtacatcacctgccttctctatgcctcagttccctcttccgtgagatgggggtgataatattacctgctcagggttactgtgcagatcttctctgaagtatttaagctctgagtgaatgttagttatttttttattacctcctttcagtagtctagtgagatctttaatcttttctccagaagttagctgggtctgttcttgctattccatattcataatattttctacaaggtcttcatttcctttttccctttgcacatctccaacttgcctctgcaaatctatgctagtccctttgataagaatattagattagcacaggtctgtgtctgcatgaggagagagcccacttggtctttgtccaaggtttctcagacgtttcattttgtatttagctgtcatctgtagagcatgtcatacatgccaggcctgtgtttttgacttagcatagacatcaaggtgatgaagaaagactattgggttggctcttggctctgctgcccactacatgggtaggtaatcttgggtaaatcacgtcccttctcttggtctcagttttctcttgtgaagtaggggaaaagtttttgagatcagcattgttctaattatgatatatatgtgcacataagtactt

SEQ ID NO: 30116 - DNA, 1027 bp, Homo sapiens
tggaattccactgagggatggagtctctcctctgaaggtcagcatgggggcagaaggtcactgtagagggtggccaaacctcccaacactgatgctccacatggccctcccacagcccaccatcacacctctctgccccctctctctgctgtctctgaagagagggatggttgccccctgaagcttaacacctgcccagctacagtgcagggtactggaagaggcacacaggagacctgtgcccactgtgtttccgggcccacttgaggagattcccactgtgtttagtaattcaggttgcacataactgtttagccctggaatctctatagctaacattcatcatatgctgtctgtgtgcctaggaccaaacctgggctatgaggaagttagaagaaatttttaaaatatggtccctgcttataagaaagtggtcatctagcttaggagacaagacacatgaaacaattagtaaacaaggcgttgtagtctagaatagcattctgtagcgatataataaactgttcaattatgcagtgcagacagttggggaccgggatggtatataacgtgctaattgtgcagaacagacaatgagaggccgggacaggctctaataggctaattatgtgctgtagacaattggtacaaaaggagcccaggaaaagaaacccggggaagaagtggatgtgggctggtgggggcagctgtttatgtaaagcagcatctgggcttgaaaagaaaaccaaaccttgttgaaaatcctacccttagctgcccctgcgccattctcactggacaccagtggcggtgtagtgaagtggaggcctttgtgtgggtctgagaacacctaggcacccggtactgcagagtgcggactctggagccaggctccctgggctcccatcccatatctggcccttgctggctctgtggccttcggcaaaacagatgaccgcctgtacctctgtttctttagctgtgaaatggaggagcagggtgggtaatcctagcacccacccagcag

SEQ ID NO: 30117 - DNA, 1050 bp, Homo sapiens
gtgtggctgggaaagaatggccagatagggcagtagtggatgaggtcaaagagaagggaatttcaacatgggagaactgagcatgtttaaatacttaggcagaaaccagtaagatgggtgggtctaaagacataggtagaaaaatggctctctaaagataggattcagggctcaggtttggggctaactcttctctagaaatagaagggaagagagtgaagaagagtattttgcttgggcagtttgtgtgggttttgtggaagctgagggaatttcctgctgagggccgaaaccatcaaaatgactgatgacctaagtcagaggctaaagggaattcccttctcactccagtcaggccagtagaagcaaccagacaggttaatggcaacaagattgctaccaaaatcaacagatacatttcatagtaatagtaaatatcttatcctacaaaacattttcattaaaaagggacaaacaacagttcagcggtttctttaaaaactaagcatatatctaccatatgacccagaaatagaactcttgggcaactatctcagagaaatgaaaacttaacatttgtacaaaaaccggtacgtgaatgtttataacaattttattcatagtagccccaaactagaaacattccagatgtccaatggttaaaacaaactgtggtacatccataccatggaatattagcaataaaaaggagcaaacttgatatatgtaatgtcctagatgaatctccagagaattattcaaaggaaaaaaaaaatccaatctcaaaaggttacatattgcatgattccattcatagcccattcttagaataataaaaataataatgatggctaacaaattagtggcagccaagagaaaggggaaaggtgtggctacaaaggggtagcacagggaagcctctgctgatggcacagttctgtgtcttgattgtggtggtaattatagaaagctatccacatggtaaaattacatagaattacacacacatgcacatacaaatgtgggacctccctgtactttttttttttg

SEQ ID NO: 30118 - DNA, 1985 bp, Homo sapiens
ccgcttcttcgtgggaaaagcagacaagagaaagtcaccctggagcacacatctgcctataatatcgcgtggctgaggctgggattcacctgggctgttttgaccacatgtggcttcctctggtcattgactcctgtgaaattaactttgtaaaaaccacttttttttttcttgatagagacgggcgggggtctcgctatggtgcccaggctgatctcgaacttctgggcccaagcgatccttccgccttggcctctcaaagtaaaccacttatttaaaaaggcataaaatcctattgtctctctacagtctgtgctcctaaaatcttgcatttggtacttaattgctctagttcctcgaaattacttaatctcaatggttttctttatggattattgctcccattcctagaatcttccacattaaggaatataaaattatttcctgaccttgtccggaatgtttcccgcaagaaattcatattctttgtggcatccaggttttattggaaagaacttaagtgacaggatttaaaagtgatggaacttaaaatttttacagtgaatttaatttaaaattaaagaaaaactcagtgtgctgtggattttagtaggttctggtcacaataactgacaaatgaacttcacttggaaattaagccaattctattttaggtacagaggaataaaaatcattagaggatctcttcaataatctaagaagaaaaacaacagaacaaaggccttgagagggtataaggaatgtgctgtgaaattttggataggttgttcagggaaggcctctggtgagatgatatttgagcagagatatgtaagaagtgagggaatgagccataagaaatgaggaaaggtggatgagggagagactattagacaggaaaacggcatggcctgtccaaggctggaccaggggaccaacatcttcctccttattttagaatagtgtctgtgttccccacatttaccattcctacttgctcataccattgcgcttgcccgaaatcacccttttagacctaaagcccatccagttttcaaatcctcagtcataaagccttctacttgttcatttattcattcgcaaagattgagtgttgaataatggatatgacacactccctgcctttgaagacctgctgttcagtctgttggaggagacaggcatatcctagctgcactcctgtttggtaagagctgtgtaatgtgtgtagttgaagaataaggtccacagtgattaggggactgtttttttcattggtttaagtttataggccatattgaaggaaacttcctgctttgatataaggttaaatttgaataaaatagatgagtgtttagtgtagctcctttgaatctctgctcatctccatctcatctgctgtgtttctggcctttatcttttaatatgatctatgtcgcattgagtagtcttctcactggtgtttgtctcttgtctcttcctatcccatccattttcctcactgtcgccccccgctttttttatgtcctaagacattcattgaatcctgtcattccccttcctataaagtttctaagactgtacatgctttgggcatcaagtcatcattctttttatttaatttttattgtattttctttctccttttaagtcctcacggttttttttttttgtttttttttttttttttgagacggagtctcgctctgtcacccaggctggagtgcagtggtgcgatatcggctcattgcaagctccgcctcccgggttcacgccattctcctgcctcagccacccgagtagctgggactacaggcgcccgccaccacgccctgctaatttttttgtattttttagtagagacagggtttcaccatgttagccaggatggtctccatttcctgaccttgtgatccgcctgcctcgccctcccaaagtgctgggattacaggcgtgagccaccgcgccctgccgtcctcactcta

SEQ ID NO: 30119 - DNA, 1114 bp, Homo sapiens
taatttttatgtttaaattacagacataaatatatttttaaaaatataagtacaagaatttttagttctggtgaaaggaaagtggggaagggagctatatttatttagcatctctaattaaaaacaggccaaaggacgactggactgaagatgtgactgattctaagacttgtgctcttttaattatgtcatattgccttcttggaaaagggaagttgggaatcttcactgactgctgacatgtgccaggctaggacttcccaaagttagttctgttgacaactggttcttttatttttagtttattaagatggggtcttactctgctgcccaggctggagtgctttggcacaatctcagctcactgcacactccacctcctgtgttcaagcaatcctcccaccttcgcctcgcttgtagctgggactacagatgcatgccaccatgcccagctaatttttgtattttttgtagagacggggtttcaccatgctgcccagactggtcttgaactcctgggctcaagtgatccacccgcgttggcctcccaaaatgctggaactacaggtgtgagccaccacacctggccaacaactggttctttgagatgctcctgttgtctaggcagttatcaaaaagtgcccagatcataagtgcacatacagtttggtgaatagtttgctgtgtatccttgtagactttatacttattcagaggtacatatttgtgtatatatttttataaaacatgggattcagttgtacaaagcagtttgcaatctgtttcttttatttaacaacatgttgtaaatatttttccacatcaagttatatagacttaataactgttaatgtgccattgtattcctataccatgatttagttatcaaatctcttgaagaatatttatttctagacatttagtattatcgttttaatttacaattatttaataaataatgaggctgaatttcatttcacgttattaagccattcatatttactcttctttcagcaagtttctggtgtttgaggaacactgtgaaggactgtggcagggttcttgaagataagggagtttgtttatctaggcaactcctggaagccattataga

SEQ ID NO: 30120 - DNA, 1074 bp, Homo sapiens
tctgttctttaatttatgaaacacaaatagttaaggaaaataaatgtgatttgtctggtatttcttgtcagaaacatttgttagcattaattttatttccgtaaaattattattccaggagataaaaggtatgttgtgggatcattttttttaattggggttttaatgaacttgaacagaatagactaatataccaaatttgaatgagctttggagttttgagaaagaactatatgaagaagcttagctgtggagatatatcttgtttataatgaaaaaaatatgattaatcctaatgtcaagtcgttttagcatttggatcaggagatgattgattaaatagaagatattctgctttgtatctggcttggggcttgaattggggattggtctggtgataatggcaatgtttcttgaatcctggggctagacttttggtgttcaagagggctgataacagtgatggtgctgataggatcagctagcatatgttaagtgttcactgtgtgacagggctctgccaagcgcttgtatgcaacttctcagcttgttcttctcagtagccctatgaaatagctatataatttttcttattttaaaagtggaaaagccaaggcacagatagctgtgtaaattgtccaaaaacacaaagtttttgagtagtaagagctacatgaactcagttgtatttaactctatagcctgtaattttagttactgcttcatgctgttagggagtcatgagacctttcctgtaatcatgagtaccatgatactctatagtatcaccctaaagtgtgacacaggtagagaagcaagttgtcccttcaggctctctgtaatcctttataggcataaagtaatttttaaaccccattaaaattcaaaaatgagaataatagctaccatttattgaatgcatactgggtgccaaattctgtattaagtgccttttatgccttatctcatataatcctcacattcaactcttgaggcagtaggtgcttattatctcagttttaaaaccagaatttaggaagtctaatttaaatttacacaactaggaaggggaag

SEQ ID NO: 30121 - DNA, 1031 bp, Homo sapiens
ttgaaacagatgtgacagaaggtttctataacatgtaaaacaactagtaaccaacagaaaaaacatctgtaaccaaataaagcaatagatcagccaggaacggtgctcacacttgtaatctcagcactttgggaggtcgaggcaggaggatcacttgattccaggagtttgcgaccagcctgagcaacacagggaccctgtctctgcaaaaaaattaaaaaattagctgggcatggtggcccgtgcctgtagtcccagctactcaggaggctgaggcatgaggattgcttgagcccaggaggtcgatgctgcagtgagccctaattatgccactgcactgtaggctgggcgatggaatgagaccctgtctcagagaaagaaaaaaattaatacgggtgaaagacaagaggcaacacaggctgaaaaatacaaattcccaaacatgaaaagatgcttagctgcagtggtatttaaagaagtgtgaattaaaatcagtggagacttacagtttaatagacatactctgttctgttccttttttttttttttttttctttgagacagtctcattctgtcacccaggctggaatgcagtggtgcgatctcggctcactgcaacctctgccctctagggccaagcaattctcctacctcagcctcccgagtaactgggattacaggcgccctccactacgcccggctaattttttttttttttttttgagacggagtcttgctctgtcactcaggctggagtgcagtggtgcgatctcggcttactgcaagctctgcctcctgggttcccgccattctcctgcctcagcctcccgagtagctgggactacacgcgcccgccaccacgcccggctaattttttgtatttttagtagagacggggtttcaccatgttagcgaggatggtctccatctcctgacctcgtgatccgcccacctcggcctcccaaagtgctgggattacaggcgtgagccactgcgcccagcccaatgcctggctaatttttgtgttttta

SEQ ID NO: 30122 - DNA, 1031 bp, Homo sapiens
gtaaagatgactttcggttgccataacttcatgaacacacacaatttgtgctgctaataggaaacttgccaccagtaatatctttgtgcttttcctcctcctaaaaaaaaactttagggtaacctaaaaaacagtaaaaacaagcccaaaacactaataaaatcagaggacaaatcccaatacgagtaattgtaaactccaaataaaattccataaaatttgttttatttagtcaggacaggaggtatgctgaacaaagtagtttgtaccttcagaaataaattcattttggatttaaaaaaattaacttgtttatgctaaggaggacattttgtcctgaatatctggtacatattatttcagacttggcagaggcaaggcttatatttacctgggcagtgtataaatatgggaaaagatctgctaaacaaaaatagtcccaatattttaattatgtatgatccttttaccttaaaacttatctggcacactttctggctatcggtgcttgaaggtatggattattattctacgttttttagttccattccatcgtgggccagtttgttttcatctgttgcatcttcgtatctagccatttggatcagttttcatggccttagcaataagaaaagagaagagaatatggatgaatccatgtaaattgattaccacaactaggaaaagaagtcagaacggaagtcctcacaataatggtttaaaatatccactttttcattaatattgcatggccttctctatacacaattagttttgatcagagaagttttattgtattttttagcactgtgtagtatgttctttattaaaagtcatatatggaagtgcaactataataagttacattcaggagcaataagtaacagtacagaaacatttgtgtttagagaaaagactttttgcagggcagagattagttttgcaaattcatattgattgactccggtttgttctggtatgtgagaatttggatgtcattataagataactacttgggattccacctgcag

SEQ ID NO: 30123 - DNA, 1026 bp, Homo sapiens
tggcgtgaacctgggagacggagcttgcaataagccgagatcgcaccactgcactccagcctggacgacagagcgagactccgtcttaaaaaaaaaaaaaaaaaaaatttgtgtaggtgtggggtcttgatgtcctgcccaagctgatctcaaacttctggcctcaagcaatcctcccaccttggcctcccaaagcactgggattatagttgtgagccaccgtgcctaacccagaacatttttattactacgaaagatccctcatattgccctcttatagccatacccacttccactcctgctcctgccccttatttaacccttggttacgactaatctctttttaatttctataattttgtctttcaaaaatgttatataaatggaatcatacagcatgtaaccttttgggattgatttttttcattcagtataattcttggaaaattcatttaagtttgctgagtaaatcaattgttgttcctttttattggtgagtattattccatggtatgattgtacctcagtttaatcattcaccttttgtaggacatctagctttattccattccagtttggggctgttacaaataaagctgctagaaatattcacaggtatttatgtgcacataaatctttgtctctcaggatgaacgtccaacagtgctgcatagtaggggagttacatgtctaatattttaagaaactgccaaggccaggcgtggtggctcacgtctgtaatcccagcacttagggcggccgaggcgagcggatcacgaggtcaggagttcaagaccagcctggccaacatagtgaaaccctgtctatactaaaaatacaaaaaattagccaggcatggtggcgtgcacctgtagtcccagctactctggaggctgaggcaggagaatcgtttgaacccaggaggcagaggttgtggtgagccgaaatcgtgccactgccccccagcctgggcgacagagcgagactccgtctcaaaaaaaaaaaaaaacagaagaaaagaaactg

SEQ ID NO: 30124 - DNA, 1025 bp, Homo sapiens
caggcacctgtaatcccagctacacggggggctgaggcaggagaatcacttgaacccgggaggcggaggttgtggtgagccgagattgtgccactgcactctagcctgggcgacagagcaagactctgtctcaaaaaaatcaatataataggcttggcaggtggctcacacctgtaatcccagcactttgggaggccaaggcaggtggatcacctgaggtcaagagttcgagatcagcctggccaccatggtgaaactctgtctctactaaaaatgcaaaaaaattaagcgggtgtactggcgcatgcctgtaatcccagctattaggaggctgaagcaggagaatcgcttgaacccaggaggtggaggtggaggttgcagtgagcccagatggtgccattgcactccagcctgggcaacaagagtgaaactccgtctcaataaataaataaataaataaataaaataaaaataattttacgtgtttcttttaatgttattttttaaacgtgtctgttagaaaaatttaaattacatttatggcttcaattatatttcttccttttttttttgtcttttacaaaaaaatctgtaccacaaactttcactacaccacacacaaacttctggcctcaagcaattctcccacgtcagcctcctggataactaagaccacaggcatgggctgggctcggtggctcacgcctgtaatcccagcactttgggaggccgagacgggcagatcacgaggtcaagagatggagaccatcctggccaacatggtgaaaccccgtctctactaaaaatacaaaaattagctgggcgtagtggcgcgcccatgtagtcccagctcctcgggaggctgaggcgggagaattgcttgagtgcaggaggcaggggttgcagtgaaccgagattgtgccactgcactccagcccagcgacagagcaagactccgtcccaacgctccccccacctccaaaaaaaaagactgcaggcatgtaccgccatgcccagctactttt

SEQ ID NO: 30125 - DNA, 1029 bp, Homo sapiens
tgagccaagatcgcaccactgcactccaccctgagcgacagagcaagactccatctcaaaaacaaaaaagagtaaagaagtaatttcatagatttagtcatataacaatatttcttttttctttttctttttttttgagacagagtctcactctgttgcccaggctggagtgcactggcgcaatcttggctcctccaacctccgcctcctgggttcaagcgattctcctgtctcagcctcctgagtagctgggattataggcatgcaccaccaggcccggctaatttttgtatttttagcagagactgggtttcaccatgttggtcaggctggtctcgaactcctgacctcgtgatctgcctacctcagcctcccagagtgctgggattacaggcgtgagccaccgggcccagctatataacaatatttcattgttgcatagtggtttaataactgtcatgggtatgaactgactcttacatgttgcttattatagaacatctttgttattcgttctgagattgtgatattagctgaacttaatggaggctattcaagagtctgataaagagtgtaacagaactgaaaaaggtaggaaataatgttggagccaacatgggagatgtctgtacaagaaattaaaatcaaagcatacaaaatttcaatgaaaaaaaaattttttttgagacagggtcttgctctgtcgcccaggctagagtgcagtggcacaatcttggctcattgcagcctctacttcccaggttcaagcagccctcccacctctgcgtcccaagtagctgggactacagatgtgcaccaccatgctctgctaatttttaattttttttttttgtagagacagagtctcactgtatcgcccaggctggtctcaaactgctgagctcaagcaattctcccacatcagcctcccaatgtgctgagattataagcgtgagctacagcacctggcctgaaaatgaaattttaatttaattggtcatttctaaaatgggaggccacaaaagggat

SEQ ID NO: 30126 - DNA, 1047 bp, Homo sapiens
cctcccatggtagtataaggcataaacctcaatttcgttatgcttctcaaggaccactctacttttctgtgttgttaagagttgaggggctgcctttctaagattctaggaaccaaattctagggtagttttctaagattctaggaaccaaaagttagcaagtgaagaggaaacagaatacttttgaatttgcccagctgtgctttttataggaagagccatttctagtcagaggatttcagaacatttcaaaactctgtggtgatatactggttacattcttccttagactaaaattacaacctgaatgcacttaatgatacatatgtgtattgtaatttgtaaacataactcaaaaccctgtatctgagtgaggtcatttgtggttagccattcagacttcatttctatttgacaagggtttattttaagattgctttgtggagcagttgtttaacattcaagtgatctattagtattaagtctttaaccagacttgttttaaatgagctgtctgtgaagtagaaaaccaaatattatagaaacttagatttccaatccaacttagcgaaatcaatgtaacttaaacgttgtcttcacatatgtttgtttaacctgttttttttccttcagtattcctttagaagaatagtaactgtgtgaataaaactttttagttactcttgatactatggtttagcaagaactgtagacttaattggttgagaaaagaacatttaaagtaaatgaatgctttagtaagttaattatttcttagcatatcacaaatatatgtagaaagaataagatctcattctatagctttattcctaggttattaaaagcaaacttctatggaagttagttctcattaggctatatatatatagtgtgtgtgtgtgtgtgtgtgtgtatttatctatacatatatacatacatacatacatacaggctatgtattgtaatccattggttattttgttggggatgtgggtcaattggatgaaagctaaagatgacttatgtaaatagccaaactgtgtttca

SEQ ID NO: 30127 - DNA, 1069 bp, Homo sapiens
cctcagccccccaagtagctgggactacaggcatgcaccaccatgcccagctaatttttgtatttttttgtagagacggggtttcaccatggtacccaagctggtctcgaactcctgagctcaggcgatctgcccaccttggcctcccaaagtactagggttacaggcatgaaccaaccctcccagatgattgtttcttttatacagcccacctataacaagttctctacctgggctataccttagaatcactgggaagctttttaaaattccattgcctgggccatgccctacatcgcttaaatcagaatttctggggataagatggaggctttatgggattccagtatacagccaaggctgcagatgacagctcttctagatcatcttttacctccccagcaggattttcatgtcttgctttgtgtgtggcagtattgttctgtgctttgttttttaacgggaagtgtttttataggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaattttgagtcaattctacccctgacatttggccaaaagcttacttaaaattaaggatttactaagtcatcatcagctgtttttcttaatttcagccagactattaattttgagccattatgtaatatatgccataggcaattaaaacataattttatcagaagtcttttacacttttattgactattagattattttagcatctgaggttttgtgttaacgttcaaaaattgacaaagaacatcagcagtagatgaaatagccagttcagaagctgacctgggggtgaaggggagggaaagagagttgacgtgttttatgtctagttatgactg

SEQ ID NO: 30128 - DNA, 1045 bp, Homo sapiens
ttctacccctttggtaggactttctgtggtgctgtatttgttcatcaggagtcatacaatgtttggttttatcttttttcagatgctagtgtcgatgcttattgtctacatcattaatttattggggctgcaaagtggtgatactcttaattctttttcttcccacttagtggaatacttttataaacaggcacttcagttctatttgagtgcctagtgttatattttatataggaaaggtgggggaaatgcttgattctatccttttatttgccagttttagaaataatgagatatataaaggtatgatgagaaacaaaatatttacatagtttcaaatagtctttccactagataaatgttaattacaaaaggaaaaatgctaactataatagggcagtctggcagacaccacttaagcaaatgatcaaagttggcatcactggtaacaatacagatagacatcatatgcctgctcatgcgatgtagagcacaatatcatatctgtggcattcctgacaaaaatttataacccgaatctaatcatgaggaagtatcagatatacacacaaggacattctacaaagtaattggcctatttgcttttaaaaatattgaagttatgacagataaaggctgaggaagtgttccagattaatgggtactgaagagaagccatgacagccaaatgcagtatatgatcctgaattggatcctgggtcagatttttttttcttttgcattaggaccattaatgggacagttggcagattttgaataatatctgtagattagataatagtaatatattactgttaatttccttattttgataattatactgcatttgtaaaagaatattcttgtttgggggaaatatttgagaatttaagggtaaacgggcatcatgtctacaacctactctcaaacatttcagagaaaatgagagatatatatataatatattaaatatgtagagaaaacgataatgcaaatgcagtataatttagctttggcaaatttgggtgaagaatatgcaaaaatt

SEQ ID NO: 30129 - DNA, 1090 bp, Homo sapiens
aaaaaaaaaaagataagacaatattataaacaactttatgccaataaatttaagaagttagatgaaataaattccttgaaagtcacaacctaccaaaactcgcaaagaaatagataatctaaagaattctttttttttttaattttaaactccatcaagtcctggtaaactaaagatttctatacatattaaagaaattgaattggtggttacataacctttccttccaaaaacatgcaaaaccagatggtttcaatggtgaattctgtcaaacattaaaaaacaaaacaaacatcagattctacataaactcttccagaaatttgcttgtttgtttagagaatagggtctcactctgtcacccaggctggaatgtagtggtgtgatcatggcttactgcaacctcaacctcctgggctcaagcaatcctcctgactcagccttccaagcatctgggactacagatacatgccaccatgctcagataattgttttattttttttgtagtggcagggtcttattatgttgcccaggctggtctcaaactcctggcctcaagccatcctcctgccttacctcctgaactactggggttatagacatgaaccactgcatccagcctcatttaacttattcagtactcattatcagtccatattcaatttccatgttgtcattttgttttgtgattgtgatgcttgttctccagaagatatctcaggtgttaatgggaacaatattctctgagtttttatacattgataatagtttgtgccttttatacttgaaggtcaattttgctggatattaactagtggttcatattttcttttcttgattatcttaattatgctattccattttcttctggcataaagctttgctgtttaaaactctgatgatgatctaatctttattcctttatgtctctatatgcttttttatattgtttatatatccttgatatcctctttaatttttttttgctttttacttattgtgaaatatttaattgataaataaagattgaatatattcaaggtatacatgacaacatgatgatttaatatatgtatatattctataatg

SEQ ID NO: 30130 - DNA, 1032 bp, Homo sapiens
agcccgccttatcctagcagtaggggtatgtttctgttctattccattccattccctattttgtttactggagggggctcccttaccattggtcttggtgacttttaactccagcctcagaaaggtcttacttgctcattattttccatgactacatctgaagtggatgttagggaatatgcccttactggggactgtacatgttgaaaatccctaatccaaaaatcagaaatctgaaatgctccaaaatctgaaacttttttgagcacagacatgaaactcaaaggaaatcattggagcattttagatttcagatttttggattagggatactcagcccatacttatttcacagccatttcttacctgtgtagttttgggaaccttaggattagttgataatcacagcatgttttgggccaggtttctgggttttttttgtttttttgacagaatttaagaacttagtagtcttctaattaccacgctctaaattcattcttagactgtagccccagacgtcttttgttttgttttgttttgtttcctgttccccatggctgtttctcactggtatctatcttgagacatctgaaacataggtgtgggatgaaggagagcaactttaatctgatctttgctacaggtcttggttgttctgtttaacagagatttgcagctcaaagtgcttttcaatcttatttttactatgtggcatttagaaatagttgacttttctaacaatctgaggctctaagtttctcttttctcttcccttttatttctgcttgcaaaccaactagttatttgttgagtactctttcttttaatgccttgataaatataggaaggagaaaccattatttgctaaccttttggcacttcgtaatctcttctctagatctgcattctttgtctgctgtccagataatcataagcaattatattacataacatgtctttatcttgccagcttcagatgcatgtttcctgtgctgttacccactagatggacacactagacagatgtca

SEQ ID NO: 30131 - DNA, 1031 bp, Homo sapiens
tattacaaagacttctgcttctacttcagaagaacatgaaagacttttgctcccatgataatcataaaagttaccaagttttaaaatcatacttgttatagggcaagtaaagagcagcagacaagaggaggtctgaaaagtctgaatttcacagaaaaataaggccttcataaatgagtagagagccacagcagcttcatacctaggggtgggtgcctggtcatggtacaagtgggtctgacttagacactaaatcacccatgccctagaggcccaaatgcaaagaggaatcatttagcctagaaattcttccccttccccaccccaccaacccatagagatttctctagagagaaatcgtctagttcttcacattctcgcagagattgattcagtgtacttgccacatttgaaccaaaaagcaaacaaaaagtatcgaaactgcagctaaacccttctatatcacttactaacaagattttttttttaatatagtggctcaagggtttgggtattgagccaaacacagctgatctaagtgtacttttagctgtgacccagctccagctcaactctagaaggattacaaatgagcagacactaaccttaacttccggacagagggaagggcttgtactctgggaaataacaagccaaaataaaattatactacattcttaactattctgtctggaatgtgttctaaaattatgagctacacaaattagcagaaaaatgtgacctattaacaagagaaaatagtcaatgtagtctgatgttttggtgacccagttttggaatttagtagatgagggccttaaaacatctgtgacaaatatgttaaataatttacaggaaagatggatgtaaggattgaagagatgagatatttcaagggattcatggaagttctaaaagaatcaaatagaatttctataactgaaaaatctcaaattttaaaaatcattgaataggcatttcagcaattattcactacacaagaaaggattagtgaacttgaagacaggtta

SEQ ID NO: 30132 - DNA, 1364 bp, Homo sapiens
gttgatatatagattcaccaaaatccaaatcaaaattttactaaattactttgtgagcaacaggagcaacaagaactcttattcattgttggtgaggattcaaaatggtaccgccagtttagaatacagcttggcagtttcttacaaagctaaccataaatgtatcatttagtcaagcggtcgtatatttaagtcacaaaactggttttgtggatgttcgtaaaacctgcttggaaaagcaagctaggtgcagtggcttgtgcctataatcccagcaacacaggaggctgaagcaagaggatcacttgaggccaggagtttgagactgtcctgggcaacatagtgggacccccatcacttaaaaaaaaaaaaaaaaaaagttaatatggagaagccaaagactgagaagaaccagcacagtactgaataagaaaaaagtcagaggactgacactattggactaattttaagacttagtataaagctccagtaatcgagacatgtagcattggtgaaagaatagattaatggaccaatgaaacagaatagagagcctaaaagtagagccacataaatagtcaactgatctttgacaaaggagcaaaagcaagtcaatggagaaagtatacatttttttcgacaaatggtgttggaaaaattggacatctgtatttaaaaagatgaaggtagacacagacctttcacaaatatcaactcaaaatggatcatatacctaaaagtaaaacacaaaatttctagaagaagtgtaggagaaaatctaggtgaccttagatttggcaatgaacttttagatacaacaccaaaaacactactcatgaaaggaaaagtgagtaaattggactttattaaaatttaaaacatcttctctgagaaaggcactattaagagaatgaaaaccacagactgagagaaaatatttgccaaatgtataataaaggacttgtgtgcaatatatgtaaagaacttttaaaactcagcagtgagaaaatcagctgggctctgtggctcacgcctgtaatcccaacactttgggaggccaaggtgggcagatcacttaaggtcaggagttcaagactagcctggccaaaatggtaaaaatccgtctctactaaaaatacaaaaattagctgggtgtggtaatgtgtgtctgtaatcccagctactgaggaggctgaggcagagaattgcttgaatacgggaggcggtggttgcagtgagctgagatcacaccactgcactccagcctgggcaacacagtgagactctgtctcaaaacaaaacaaaacaaaacaaaacaaaacaaaaaaacccatctcaatagtgagaaataactcaatttttta

SEQ ID NO: 30133 - DNA, 1050 bp, Homo sapiens
aaaaggaaaacacatccagtgactcacctcataaaaagggccaaagcctgccactatccctagagtgccccagtgattggctgcatcctaaagggctggggggaggctaagccagttttccttggcttgtattccatattatcactaggatgcctgaaactcttggttataagttcttccaaagtgattcccaactctctgaaaatgattctcataagtattttcaaaagaggtcacagaatttttctacagttctacaattacatgtataaaagtaaataccagtctgaaaaggaaaaacaaatgatttgatttacctgatcactaacaagaatgtgaataccggtgggaccctgtctgtaaacctgattaatttggtggagagggatattaaacaccagcgcaagttttcgagcaacttctgaggcaatcatttcttccaagtagattgcatgataaactgaaattaaaaaaaaaaaaagaaaagcattttaacagtaatctttgatctgttttctgcctgatctgtaggatctgtacgaaggtcacacctttcaaagtaccaaaaaagtaaaaaaacattttaaatgggaataaactatttctttcccccatcttactaccttgaaatcttgaactaccaatctaaaacgtaagaatacattatttatatccacaaatataatttaataaacattaacagaaatccctggacaaaaagatttgaggtttgaatttttcttcatatttttattcaatgaatatagtttcatgtattcaaaatttaaaaacaggaattggctgcaaatggacatgggggatcttcttgaaataatggaactcaaactgaattttgacaatggctgccaaactctctaaattggctaaaataccattatatacttacaatgggaggactttatggtatgtaaattatgcctgaagaaagctgtttttaaaaataatatatacttcatgtatttctagcaatatacaaaaagaaccctaaaagagtcatagttctttttgtttatttttttaagacagtgt

SEQ ID NO: 30134 - DNA, 1082 bp, Homo sapiens
ttttgtggtgatcagtttctttagagagaaagcttctagtcttccatgaaaaagtctgcttatcagctttctaaattttatcctggggaatggaggttggggatcttaacaatcatgtatgcagtctatcaggtacatctatttttagtatgacacctgcattagggttaggttcatttctgtgtggtagatcccaaattatctgagttaagattttattttgtaaaaagttggcaggtaggtagttctggtagcccagggctggtgtagtgtttctgtggagttaattggggctcagattcctttcagctttctgctgtttgaaacctagaatattgttctcaggtccaggttgcaatcatatccaagttccaggtagtaggatggagaaaggcacggggctcgccctttagggtgtttcctggcaactgttccacaacaccctgcctatatgttaccggccattttgtgtgtccttctgataggatgctaggaaaaggaattttcattatgagcagctgtatactcagctaaagggacacagttttgttaataaggaataggatagactgataatgatgtagtcaattagcactccctaccccacttagcagtgcttgatctccaccttagttatatttgatatctctgacatttttttcttttttcttttttttttttttgaggtggagttttgctcttgttacccaggctggagtgcagtggcatgatctcggctcaccacaacctccgcctctcgggttcaaacgattctcctgcctcagcctcctgagtagctgggatttacaggcatgaaccactctgcctggctaattttgtatttttggtagagacgggctttctccatgttggtcaggctggtctggaactcctgacctcgggtgatccacccgcctcggcctcccaaagtgctgggattacaggcgtgagccactgtgcccggccaatctctgacgtttttttgagagtgaacctaccttcagagtagaggatctgggagcctgaagttttctttgaaggattttcaaccataccttctcgttccagcctcacattgaact

SEQ ID NO: 30135 - DNA, 1156 bp, Homo sapiens
aatctccttcaatctggaccagttcttcagtttttctcgtctttcatgaccttgacatttttgaagagtacaggctaattactttttagaattttcctcaataaaggcttgtctcattttcttgtgatttctgcatttttgcataggagtaccagcgaagtgatgctgtgttctttctagtgcatatcaggaaaaataagatgtggatttgttctgtagtggtaatgtttatttttatcgcttggttaagatggtgtttgccaggtttcttgaccttacagttaataagcttgttgtactaattagtaaatattttgtggggagatactttgggactatgtaatatcctgtttcattacacacttttcattattttatcatttattgatgaatcttaccagaattagatattatactctgaaaggtaccaaatggtaatttttctaatttcatctagactatggtaccgtaggatagagttttccctattcacctgtttatttacctccgaatggtggtcttttcctcaatgggctcttattttttactgttattttatttagattggttcagtgcttagccattgggagccccttaaagctacctcctgtgcccttttgacatgtcctcatcattttttgagtacttccttaactttctggcatagcaagatgttttagacttgaatattgaattttttcagtctcagcccttgagtcagccatttctctaaggagcacttggctcattttaatgcaaaagattatctgggcagtaggtgtgcttattgctactgtgaagtgttactgcttataggccctcttagcatatacatttaggaaatacatagttacacatttatacttgtttttatttctctctgctacctttaaaaaatgagttaaaaactagctgggtgtggtgacatgcacctgtagtcctggcagctcaggggctaaagtgggcagattgcttgagcctgggagttcaaggttaccgtgtactgtgattgtgctactgtactgcagcctgggcaacagaatgataccctgtctgtaaacaaacaaaaaaagttcacattgatatctccagttccagtttaaaactgtggagttattctaaccttctgccttctcatgtttgtggattttttttt

SEQ ID NO: 30136 - DNA, 1031 bp, Homo sapiens
cagtttaccagagatactaatttgtctaatggatacaaacttatttattttagtaagaaatagtatttttaagaaatattttggttttcagagcagatgttagtttgcttttagccaataacagttgataaatatttttctgtggtggtgggtatgactttttgttcatagtttttcactgcatatattttttaagcttctggtttacgtattaaaaaactttttttcatataaaatagctgctcaaagtaagcatgaataatttttgtatcattttaaaccagttgtaattacataaatgcatgtaatatttagctctggtaattattaattctgctctattttttagatattatgatcagatttgttctattgaacccaaattcccattttctgaaaatcaggtaagtcattaattctgtcttaaaattatatggtaatagcacccatttccttctgccaatatcttcactgtctttagagttttatgagatagtgttataaaaataggagcttttagatctgtctaatgcgaatatatgtgcttctgaagaaagaatctcctggaattctgttcatgtcattcttcagtcacttctggggctcatgtagagcaatggtttgtttttctttggacttcattttatgtcagtaggatctgttgactgattaatctgctgtgtcctttcctttgactttttcagaattaggaaggaaactgcacaattcaggaattattagtctcagtttatgtgctttaaaaattattcgcacaagttacatttgcatgtaaaagttgcaaatgctgttttgattaaatgttaattacatgaatgtcaactattttctccttaaaggctagatgttgaaaatgctgataatttcttatagttttattttggagattggataaagattttaaaattagtgatacttttaaattttaaaatagttataagaaaagtactttaaacattcttgtactaaagtttttacaggtgaaataattatatgttgagatttcctttaat

SEQ ID NO: 30137 - DNA, 1048 bp, Homo sapiens
tgtagggcatttctttttggcccttttagtttgaacacttatatctcccttaagctctgggaagttttcttatatttctttgataattttcttgtctcttttgtctctctttctttggaatactttattagatgttggttgttctgagttgttcactcgtaatttttatattttttcttgactttctgttctttctgagattgcctagatattaattttaaaacttgaaaaaaaattttttttccttcctccgcccttaaaacttttgaaaaaaatttaacaatcaagtttttaatttttaggagctttgtcttattaatttaaaaaatccttttcttttatggatgtactgtctttgaatctctttaaggaatgctaattgtgatatttggaatataatcttttatgactggaattgtctttatttattttgggcttagtttttcagttcgcattgctcttcctttattttgctgcaggcttttttcacaacctggttattttggattttccatatgtttaataaagtaggttagagtagctggtgtttatgtctgctttagtttagaatgaggagactagaactggtttggaagcaagttgaaaactggcctttattacctaggaggccaccaaagtactgtaacaaggagggctttactttatggtacaactctgtggcacaaacatacaaatgtagtgttgttctgattctcctagattggtttgttcagtgttttttgtaaggagccttattttgcctagtggtcaatgccttgcacattatgcaagatcttgaattccaaactgattgaattctgtgagtaatagggagctattgtagattcttttttaaaagttatttttcaattgtgatacaatatacacaatatgccttcttaaccattttaagtgtacacttcagtggtattaagtacatttacattattgtgcaaacatcatctcgagaactctttttcatcttacaaaacaaactctgcccagtaaatgataacttcacagactgggggcggtggcttatgcctgt

SEQ ID NO: 30138 - DNA, 1026 bp, Homo sapiens
tttttttaaggctagcatatttaaattgtaagtttagtttctttattttctggtttctgggactattagatttaagtaagcccatatttagtctctataaatcagtcagagaaagaactccttttgaaatttaatctcatttttaagtacccctgaaaaaggaaactatttcagattcacacaatgggagggaggtaaatacttttcctcagttatagacacatagattttgcagctttagttttacagctttagttataggttaaagttaagacagaagttgggtgtgatggcacctgcctgtagtccagctacttgggaggttgaggtgggaggatcgtttgaagctagtagtttgaggccagcctggacaatatagtgacaccccttctcaaaaaaaagttaacacagaacacactcactgatccatatttcagaggacagttattctttccggtaggcatgaaatattttttaattgatttgcactcccaagaagacaaacagaacagacaagaagttgaccaataaaccatattcgctgtagtttctcacttagtagagaataataccccatgattctgacggagatcttaggaggtcacactattaaaccaactttctagttatggctactagcaaagagaaataacttattggtcctgtgcaaaccagaaatgaaaataaaatcacaatcaggaaaatcaaaacaatagataaaatggcagcaaaggtaaaataactgcttggaatcaatcacttctggggccaagaaaaattgtacctgagcttaatacagctcatgagttgcacttcttgaacagtgcagtttatgtggccccagaagatggatcttcttggtcatcttggtggatcttcaaagatgatgaaatacagttttcaaaaagatacagaaacacacacacacacacacacagatataaaaacatgactcacatagaatgactacatgtcaaagatttatttgactcattaatgagggacctagcaagattgtaaatctga

SEQ ID NO: 30139 - DNA, 1036 bp, Homo sapiens
tagcctctagctgagattccaaggagaatattctgttactgggaaagggtgattatatgtttatttagcaaacacaaagtgtttaccatgtgccaggcactctttaagcactttacaaatattagctcatttgttttcagaagtgccctgagatgggtactgttattatccctatttgatgaggatactgatgcacagagtggttaagtaatttcctcaaggtcacatagctaggaagtgttggagccagaaatggaatcctgctgccgtgacccactcagtcaattttttttttttttttgagaccgagtcttgctctgttgcccaggctgtggtgcagtggtgcaatctcggctcactgcaacctccgcctcctgggttcagacgattctcctgcctcagcctccccagtagctgggactacaggctcctaccattacactggctaatttttgtatttttagtagagatggggttttgccaagttggccagactggtcttgaactcctgacctcaggtgagccacctgcctcggcctcccaaagtgctgggattacaggccttagccactgctcccggcccctcattcagtttaatcaacagatgaacagtgtcactgaagatccctcaaactcagtgatgaacacatctgaaaaagaaagaaaattaagttcaaagaagaaacttttcattgttgccgttgtccatgaatgtagtgatctaaaaattctctttatcattgtgctttaaatagtgatttagttttgatctttaaatgtcaatagacaataaatatttatagactatgtgaatattggaaagaaaatataaacagtcacttttacagttcgggtttttgtctaaaaattttgttgtaatttctcttcctaattttagatctgtttgagaagatggttcccgtgtcagtacagcagtctttggctgcctataatcagaggaaagccgatttggttaacagatcaattgctcagatgagagaagccaccactttggcaaatgggtaggtagagctta

SEQ ID NO: 30140 - DNA, 1093 bp, Homo sapiens
aggaagtatgttacgaggatttagatgaagtacttaaatttcagtaattttggagtagttctcttcagaggcttcttaagagattggcacattatgagaacagagtggataggcagaaaaagtaaacgtgtaggatcggagaagggctgagtagtggctgtgtctagagagttatccgaggtacagaggatctgcaaagacagcttttactcctgatttcttgtgacagaaggtttacagacatgttgagaatggctggaatctgtttgtttatttatttattcactaagtgtttgaaggcctactattccagaacagtgctgagcaccttggtccctaacataaagagacaaaaaactgctctgggttacctttagtgtagagtaaatgcacaggtactgggcacctctcaaagggaagagaaggctacatagttgaatgtgcattgaacctggatctaacgggggaacccaatggaacaaggaatgtgagttattgttttgaggacataggggagaaaaggaggtggtcagaagattaacttgtgaagaacaacgaacctgaagaagaaactgcagacccttcgaacagcaataaattttggtaccttttttattttagaaaaagatttctggttagtactttctttgtattctttttggtgtcttgtacatgactcagaattatgtggctttcgtcctttgattcttctgctttcagtagaaaagcaaaaatggtttgtgctaagcaaaatctgcattagtatgcactgatatattgctattttattcagttatatcagttttattaatccttacttgtgttacacaggagaaaggaacttttatagtcaatacgaagtaattttatggaagctagattttcttgacggggtaaccacaaaaatttcagtactctctgtatattcgtttgtcatgtgccttaatcaaataaggcaagcatcaggtttatcaaagctatttcagactggttataatagttgatgacggattttagccagaatttttatgataaaaactcagttttttgattgctgattagagtgatgcaaatgtacatgttttattaaaaa

SEQ ID NO: 30141 - DNA, 1031 bp, Homo sapiens
tcaagtttctgcgttcgttgctgtagacatagttgcttatttgccttttctgaaaataaaatgacaaggttataaaagtaaaatagaagattttgttgagggcatttctttctttcttttttttttttgagacggagtcttgctctgtcacccaggctggagagcagtggcgcaatcttggctcactgcaacctctgcctcctgggttcaagcaattctcctgtctcagcctcccgagtagctgggactacaggcatgtgctactgtgcccagctaatttttgtatttttagtagagacggggtttcaccatgttggcctggatggtctcgatcgcttgaccttgtgatccacccaccttggcctcccaaagtgctgggattacaggcgtgagctaccgcgcccggcccattgagggcatttcttgtctcatattgtacttggtgctgttaaatgccacagaggattttaaatctaaaactggggtcaggaagctgtggcttgtgggccaaatccagcctgcctcttctctttgtatgttctgtgagctaagaatgagttttacatttttaaaatgtaaaactctactttctacttcattttttaaatggctgaaaaaaagtcaaaagaatgttttaatatgtgggcattatataaaattgagatttcagtgttaatacatttttgttgaaacatagctgcgctcattcatttacacattgtctttcacactacaaagcagagttaaaagagttgcaacagagactgtggcctactgaggcaaaaatatttcctgtttggtcctttaccaaaaaagtttttaagttcctgatctgaaagacaaagtattgacaacctaggtgatgccattcctgccattctgtttgacctcatctcctgttctgccttttgtttactatgcttcagccagagtggcgtttttttctttcctttgatcctgccaagcttgtgcctgccacaggacttttacatttgcgtttccttctgtgcagggctttcttcccatttccg

SEQ ID NO: 30142 - DNA, 1028 bp, Homo sapiens
gggtgggcagtcttttaggattacttgcccagtttgacacgtttcttactctagctgtaactgtgatctctgaaaatgtttactttttcccccagtcttcagaaatataaaaaagatacaacttcattttattaaacaataggaagaaagaggatttagattctagtcaagaataaaaatgtagtatattttgtttttttcagtttttgttatattgataaataattatacatattatggggtacatgtgatactttgatcatgaatacaatgtgtaataatcaaatcagggtaattaggatattcatcacatatttgtggggcacatgtgatattttgatacatgaatacaatgcataataatcaaatcaaggcaattaggatattcatctcaaacgtttatcatttctttgtgttgggaacattccaaatcttctagctattttgaaatatacaataaattatcattaactatcatcaccctatgctgctattaaacactagaacttatttattctctctgactgtatttttgtacctattatccaccctctcttcatccccaccccctactctttcttgactctagtaaccatcattctactctgtctccttgtttttagctcacacatatggaggagaacatgcaatatttgtctttctgtgcctggcttatttcacttatcatgatggcctccagttccatccatgttgctgcaaatgacagaatttcattatattttttatggctgaataatattccatggtgtatatatactacactatatccatttatctgctgatggacacttaggttgcattcatattttggctgttggaagtgctgcaataaacatgggaatacagatatctcttcagtatatggatatcctttctttaggatatatacccagcagtgggattgttggatcatattgtagatctagttttagttttttgagggacctccatactgttttccatagtcactgtactaatttgaaatgtagtatattttaaaataccat

SEQ ID NO: 30143 - DNA, 1074 bp, Homo sapiens
aaggaaggaaggaaggaaggaaggaaggaaggaaggaaggaaggagggaaggaagaaaggaaggagggaaggaagagaaaaagaaagagagagaaagaaagaaagagaggtaaagagaaagagagagggaaggaaggaaggaaggaaggaaggaaggaaggaaggaagaaaggaaggagggaaggaagagaaaaagagagagaaagaaagaaagaaagagaaagaaaggaaggaaggaaggaaagaaagaaagaaagaaaagaaagaaagaaagaaagagagaaagaaagaaaagagagaaggaagggagggagggaagaaaacagtcacccatcagatcatatcatctgacttgaaggagcctccttctgacatacaggttgctgttgctgtggaaggtattgagttcagattttctatcatcccttattcctcacctctagttgaggtctctaaaaagcagagcctgaggttcagaagcatataattcatggaaggtgtgctgtcaggagaaaaccctaggtaggatacagcaggagagagggctgaacaagaatgtggtctcacgtgaagtcttaccttggcctgacccacatggggtacagagtgcaccagagttgcccctcccttaaggaaatatggcaggactttttttttaactttgtgtcagctagtctttggctctagaaatggaagagggaggggagtacaatctcccaaaggggacagttcccattagttgagggtgattctctaaaggaagagagatctgcctgccaaagccactgggagacagggcaagggccccaacagggagggtctggattgggcacccacagcaccctctacagtgggttcctgtctgtgcctctttagccagagcagtcgtttcccttttccatgctccaatattcggaattttattacaatttttgcttcaaaagaagagtgctgcatttgacaatgggttgatagacacctgacataagtctataagggcttttggccctaggaactgggtggttacccctagcacgacactgagtaacatagcagaaagtgtgaactatagat

SEQ ID NO: 30144 - DNA, 1033 bp, Homo sapiens
aattttttaatagaaaaaaattttaaaaattcagtagaaaaaaagttatatgttcaaattgaaaggactcaataaggaatgagcaatgaaagtaaaatagaagtgccacacagtaaaagcaaaaaatgtaaaaatgatatgtgaaaaaatgaaaaataaaatggaaagaattctgcatacacaattagtaaaatcatgtgacatttataaactacaaaaatagataaaatccttaatatttccagaaattaagaaacaggtgaccttatcatgatgaaactcagaggggcatcaaactgagagtaaaagtcaagggtgccatggtttcagattctgagcagaaagtctattcattctggaatctggaatccaatactgagtcatttgaatgactctgaaaaaaacaagtcatcaacatgtctcccaaaagagcatagatagaaattaaatcctggataaagcactaacaaagcaattttgcacagtgactctgacttgaaaggtattttatattttatcttgtaacacaactctgtatgctacaagctcaaaatacaaaacacaaattccattaaattcctttacaccaacaatacctatgacacacctatgaatatctctaacaagaaatatgtaggtcctatgtgaaaaaacatgcaagcattatggaaaaacaaataaggagatctaaacaaatggaaaaacatgacatttagatgagaagactcaatattgtaaagatgtcaatcaccctaaataaatatgtaagctcaagttgattccaatcatataccaacaagtcttttttaaaatgcaaattgacaaattcagtctaccattcttctgaggaaattaatggcagattacttaaactttctaaggcacattctcttcccgtgtagtattgggatcataatgaaacctatttcaaagggtaattgtgagaattaaatgagataatacatgcaaagcacttagcacaattaccagctgataatagcacccacaaatcttagtttacatcatattatgc

SEQ ID NO: 30145 - DNA, 1028 bp, Homo sapiens
aacatgcttatttcctaaataatcatctatgattatttaaggtgaggagagtctcttttgaagaattacaatagttgtagtcatactatgagaattcaataatttttggtactgtaaacttctgacaggatactttaacatgctggtaggaaaagagatgtctcttttcaccacacgacctgacacatgatgattcccccaccgacagatttgggtcttctttcttcatttaacccagaagctctctcttatcttgtttttgaacagtgcttatgccatagtcattctgaagtcttcttcgggatccaattattcatttatatcttcctgaatttctttaatgattttcaacttattgtacctttactgtgcattccatgaaagcttcccaaacatacccacacataaccagattacctttctgcagacagtctcactttcacctttcctactgtttcaaattttactatgccattatattactggttgctacaaattctttcctgaactcttcaagacccctacttttctaatctagtttggtcatctcagctttcataccttattttgaagattatgtttattcatatttattgagagaaaaaaagtagagagtatataaaatttactttttattccaatagtaagcattttcatagttatgttcctctttactacctgagtgttatgatcctgacttcattttatgtttcagaagttttcactggcactagagcattgattgctttttatgttaatttatttctaaatgaaaaaagagtttcccaagatctacactttgtgcctaaatatagtgagaaaagtctcctatgatgactttagtattcatatggatgttttaagagtcatgttattcttgatcttactttccaggtctaggaaaaaaattttttaatcaaaattaaaaaataaatttcaaaggagtcatattattttttaagctataagagatgtcagtgtaagtacatatcaccagttgggtgatgaaacaacctcagagatcaaaa

SEQ ID NO: 30146 - DNA, 1050 bp, Homo sapiens
aagtgctgacagcttcttccagtttcctttgctgtgtagaagctttttagtttgatatctgagcatcttttttctgcagctctgggccatacatgtttattccaggcaaaagaaagaactcccatggatattcaattacaaaaagaaaccaccttaaaggtgaagtgacttgttgctgggtgaaaagaaaaactatgtactaaggactagggatgagaaagcagagtaaacaggagagacttttaaaaggccactgtggggatggacagagcaaggtgcaccatggtgcaagctgtcatcagagtccagaatcttccagttcctggagccagaatagaggggtagattaaactcaaacccagtcctgccagaatcttgtgcttttccaaacctgttttggtgcttttttataagtcccagaggcaaaggagaaatggtctagtttgtcatggccaaaacaagagggagggcagcaggaagagcagataaagtcaaaaggataatacaatatgtcctatgtcctacacacacacacacacacacacacacacacacacacacacacacacacacacacacacacacagaggttacttatccatatgcttcagacccaagcagacttgagagttcctggtttgtgtcctgtggatagtttagcgagatggattttgagccagacaatagactcttctgctttgctgtgtgcagagacaagtggctgttaagtgatcataagagagaaaggccagctttacacatgtagcctttgagcccatgagtttgtatacttaatatttccaatgattcaaattcaaaaggcaaattatatcaaaatccaatgtggtgggacacttttacagcacactggtaggactttaaggaggcaggggaggaggagcaggggcagaatcaaaggcaaaataggacctctttctgctcatctggcttagtggcaggggcgggggaaattccctctttactaggcactgccatcaccccacccacacagggacatttatgagcctcctcaagacggagggtgtcagt

SEQ ID NO: 30147 - DNA, 1030 bp, Homo sapiens
ggtcatatcagtgacatccaatatggcctggaagtcagggttctgcagttctccttaccctttgccaaggctcagttaaggggtaggatattcaaaatggtgggcaatattaacccttcttacaatcacacacaaggcttgttcttgttttcagaaaacctttatgtactcatgttctcatggtctagtccctatgactcattttcttcttttaaatggccacatttaggaacagtgcttgtatcggtcaaagatttccaccagaaagttgcctaaaagccaccctaaaaagtagttttaaagtgctgaaaagtttagaagttctttaaaaatggccatgttttactctcactcaggcatcttcagatcagctgagatttggctgatccagactcagctttgttattgcatcttctctctactccttatctcctgctctctccttgaaccagtgggctagtcacatcatgcacttctcatggcgaggacaactgggagcatgcaaagcctcttaaggccttgggccggaggtggcacactgtgacttagtctactggcatttcgttagccgaattaagttatgtggccaaatccatagtcaagacaggggcaaccccctagcccccacctgccgtctctagtagcaaggactgcaagccacctgacaaagggcttggatacagggaggggtggaaaatgggctcaatatgtaatctaccatttaggatgctctctggattactgatctttttttgtttggtagagtctgctaagtcttggcgctcccacccttctacttcacatctccatacggacttaatgcctagcatctgactgtcagcttggggttgctgggccgggggcgatggagggtctcatcacgtctcatgctcaacaatacttcagacacttcagcctctaacttagtttctgtgcctgcctggcttctgaatctgtgtcactttcaatttccacacacatttccaccaggccttttcaaggcagtgttattcataaataacccttaaat

SEQ ID NO: 30148 - DNA, 1022 bp, Homo sapiens
tataaagaaagaaaaaaaagaatcaacgagtctcactgctcttttcaaggacagaaacaaaataaaccaaatattaggctcctttcaggaaagaacaaaggggtttagaaaggggatatggagcagaagggaaggggagagaaagaaaaggcgggaggaaggaggtgagaagaggaaaagaaatggagatgaagtaggggctggtgtatgctctaacttcctaaaacaataaatagggtattttaattatctgataatggagcacaattgatctgcctctctcgctttcttgacccttcagacatagcattctgtctccatatagattacctaaagatttctttccttcaagccacacgttatcctcatattctagattttagggaaagactacctgctattatccccttagaatgacatcccagaaaagatattaaagctgtttgttttttcctttctactgggaaccaaaggctgtataatgatagccaagaagaatcaaacctcatctgtgcactttccagctgacagatacttctttaaaaataaaatgaacctgacaccctccgtgtacactcacagttcagtttacaaggactcacatttgcgccttcccaacacctgtgccttgaagatggaaaggccacacccttgccataagatccctgatcaataaaagtagaccaggaccccagtctcatccagtgcccatccatttctaattttcttagcttcttattgccagctaggcccttgcccttggacttgatgcctgaaactgctacttaccaggctctcagacctgttgtgttaagcaggcaccgtggcatgccctccagctaacctaaccttgccttcaacacactgctaccctttatgatcatctcttaagctatcccttcccagaaactttggtcacctaagcaagccaaagatgctcaacccagctcttcatggagacatgagagaaataggcagttaggtgtgtctgtcagcttcaatgctgaatgcccctgcctttg

SEQ ID NO: 30149 - DNA, 1045 bp, Homo sapiens
aattccagacacacatatatgctaatcttagaaagacatggatactatctcccctctccactccatccttaaacatctcatgactattaagaatgagaaagggaccaagtggcaagagaacatcttcatatgcatacaactttccagaaaataaaaatttgccaagttgtcagacactgcttgtatcttatcagtgtaagaaaaaaaaatacagaacttccttcctgtaaactgtttattttactattaatagtaattgactgaagtcttatatgatcaaattcagggaggggggaatattttttaagtcagccaaaggaaagaggctgtctctctcaaattacagctcatgatgtttgcaagtgctttggtgatttcttgaaccactgtgtagagatgatctttcaggaaagtaatgtttttcctgcccctaaaaagagacttgtattgtaggagccttttcagatcataccttagcagaaagaagtgacccacagaaacatattttcagtgactaaataatagaccagaaaggggagagtgtctgatcatttaaggtggtcttttgttatatttttagtcattccctagagttcaccaaattgacactatttagtaatatcacagcacatatattctgaatacatattttcacgttcttctgagacaagttgtgtttcatatattttatccctgttccatccaggaagaaatagaaatattgcccaggtcagaaggacaggaggagaaattatctgaggtggagttttggtgaagtttgaggtggacagaaagtagacacagcaatgaatcctggatgcacttaagagttttctttacttgaagctgcaaagccttttcctgcctgtgatattgctgattcctgccttcctgcctaaggttcagaccaagccatgacagacaaagttgagaggctgcctgccttttgactcattcttacttctgtgtgtaaaggctaggaatccacaggaataggacatctgcagctataaacacaaagaagatggagaccagttggaaaatg

SEQ ID NO: 30150 - DNA, 2029 bp, Homo sapiens
gtgactcttctttctgtacaaggtggactttgttttgctaacattggatttaaaatttttacacttataagtaagattgatctgtagtttctcttctttgcttcgagaaattttggtttcatttttagtgcaacttataaaattaattaagaagcttttttgttatattgtgcaacttcatagaagggaattctctcaatgatttgataaaaagctattcttacaattgtgtagacaaggtaccttttggcaggggttcctgaaataatttttcttttaatttcatcctcagtcattaggctagtaaagtcttctctctgtcctccttgcacctttgatggaatatattggagccgggctttgaatccaggaatgtgtggctctaaaatccatccaaaatcctgaaacacaagaagcatacgtctgtgtctataacaaaatctctcattttaattttttttaattttttttggtagtttttctttttttttttaattatactttaagttttcgggtacatgtatgtgcacatcgtgcaggttagttacatatatatacatgtgccatgttggtgtgctgaacccattaactcgtcattcaacattaggtatatctccaaatgctatccctcccccctccccccaccccacaacaggccccagtgtgcgatgttccccttcctgtgtccatgtgatctcattgttcaattcccacctatgagtgagaacatgcggtgtttggttttttgtccttgcgatagtttactgagaatgatggtttccagcttcatccatgtccctccctacaaaggacatgaactcatccttttttatggctgcatagtattccatgatgtatatgtgccacattctcttaatccagtctatcattgttggacatttgggttggttccaagtctttgctattgtgaatagtgccacagtaaacatacgtgtgcatgtgtctttatagcagcatgatttataatcctttgggtatatacccagtaatgggattgctgggtcaaatggtatttctagttctagatccctgaggaatcgccacactgacttgcacaatggttgaactagtttacagtcccaccaacagtgtaaaagtgttcctatttatgcacatcctctccagcacctgttgtttcctgactctttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatattatttgcccactttttgatggggttgtttgtttttttcttgtaaacttgttggagttcattgtagattctggacattagcactttgtcagattatttttaatttatttttttatttcaatagattttcagggaacaggtggctttggttacataataagttctttagtggtgatttctgagattttggtgtacctattacttgagcagtgtacactgtaccaatgtgccgtcctttatccctcacccctgcaaactctttcccccaagtccccgaagtccaatgtatctttcttatgcctttgccttttcaaagcttagctcccacatattagtgagatcatatgatgtttggttttccattcctgagttatttccattcctgagttattggaacaatagtctccgattccatccaggttgctatgaatgacattattttgttcctttttatggttgagtagtattccatggtgtgtgtgtgtgtgtgtatttttttttttacacattttctttatccactagttgattgatgggcatttgggctggtcccacatttttgcagttgtgacttgtgcttctgtaaacatgcatgtgcacgtgtctttttcgtatcatgacttttcctcagggtaaatagccagtactgggattgctgaatcaagcagtacatctacttttagttctttacagagtctccacagttttccatagtgttt

SEQ ID NO: 30151 - DNA, 1062 bp, Homo sapiens
ccctgccttttccagcctggatgcagaaattcctcattcgataccacatagcagttttgtcaacagctgtctgatgaggtatcacttttacttccttcactctgggaattcatttatggctcttctttagttaggactatgcctgtgtgattcccacaaggcaccatgtgctcagctgccccaggattttccttcctaaataagtgccagtgttcaccatgcccccccttgccagacccacacacatctactaaagctcaccactggggtaaggattctttggcatcacatgagggaaactgtacttttagataatgcaaacaaccactgagcacttagcagtgccattagagagacaaattagagggtattggcttcgaggggaacttcatagcaggtcagcagcacagcagggccatcccagcccaactgtctggcactgcaagaccagcaactgaatttaaacagcaaccctaaagtttctcaatatctgactcaccagagacttgcatgataatgctttaagtgtgatcagctgctcagtcctgagtctgacctctgctttcccctttcccctgacactcttctcatcaacatcactgctggccttctcctcactaactgcgctggaaacatttggtccttggcccattgttgctctggaagcagagtgctagacttcacttaatgctcatgtgatcccaaagcagtgacctagcctctctctgcttcaatcacctcatctctaaaatgaagataataacaccaaatccatagggttcttatgatctttggatgacataatgaatgtaaatactatccatacattgatgattcaaacttcatcttcagtattaggcttccttgctgcctccagatgcctatcacctattggacattgccatctgaatgcagaatagtcatctttaagttaacctacccaaactttactcttgatcccctcacccagccacacattcagactggctcttcccacagttgtctctgctcagtaaataggaacttcattcaaccagttgattaggccaaagtctttgacat

SEQ ID NO: 30152 - DNA, 1103 bp, Homo sapiens
aaggatgtggggcaagtggaaatttcatacattgtttgtttgtttgttttgggacagtctcttgctctgttgcccaggctggaatgcagtggcatgatcttggctaactgcaacctctgtctcccaggatctagcaattctcctgcctcagcctcccaaatagctgggattacaggcatgcaccaccacgcctggctaatttttgtatttttttagtagagatggggtttcatcacgttgaccaggctggtcttgaactcctgacttcaggtgatctgcccgcctcagcctcctacagtgctgggattacaggcatgagccactgtgcccagcctactttcatacattgttaaaagcagtatcaaatgatacaaccatgttggagaactcttcagcaatatacactaaagctgaacacattcatgccccagaatccataaattccacttctacttatgtacccaggcacctaaaatactcttccttaatgggtttaggcctggggccacaaactcaaatgcacacagaaagattctatcatatgatcaattgtggtagacagtagggagtgtcaaggactgtggttaaactggagagctccctattaagattatgttaaaaaaaaaaaaaaaaaaaagacagcctggccaacatggtgaaaccccatctctaccaaaaatacaaaaattagctgggcttcctggcaggcacctgtaatcccagctactcgggggccaaggtaggagaattcgttgaacacaggaggcagaggttgtagtgagctgagattgccccactgcattccagcctgggcaacaaagcaagaccctgtctcaaaaagaaaaaaaagagaggagttcttatctatacctgtagccattctttccaagggctcattgcactttgtgcaggtcttcagatgcaagaagacagccacagctgtggcacactgcaaacgcagcaatcaaggtgaacaggcggcccctggagatgatcgagctatacataccaatatatgagctgctggaaccagttctgcttccagacaaggagtgatttgctggcatggacgtgtccatgtgaagggtggtgatcacatggcc

SEQ ID NO: 30153 - DNA, 1085 bp, Homo sapiens
cagttactgattagaccatatgaggccaaggtgtaagacgtaatgccaatttttcagatttgcagtgaggtatactttttaagcagttggaaggtcactgtctaaggtagccctttcctggcatctggatatttggaaagctgaattaataacccagagatttcttagacatgatagaatcacaacagagagagttgattagtcaagaggtatttcctgtggtctagtagtacttttctaactttttaccacccagtgaccattttattaaaggagttcttagatataatcatttataaatacatagatacaaaaggctgcccccatagtggcagcctttgaggcacctacagcctttgaagctggcactggcatggtttgcaaattatggctctaggtgtgggaagggtttattgaatttatctcaactttaatgaaagctatttctgatgttctttgaacatttgtaatttgaacgtggtgttcaaggtaggctcaaacttattccaagactgagactaatactacacagtgactgtgctttcccttgccattttctaagtacaatgttgacttttagtcacatattttctagacatttaaaccattgctaaggcttcaactttatttcacattgattgattttcttgtttatatgcttttttttttgagacggagtcttgctctgtcacccaggctggagtgtagtggtgcaatcttggctcactgcaacctctgcagttgaagcaattctcctgcctcagcctcctgagtacctgggattacaggcgcacaacactactcttgttcatgtttttaagtccttattcttcctgttttgtctttggtgggagaggatatgtcatcccttaaggtgacttctgcacatagctaatttcatctgttgtattgatttttctggttcatcttttagaaggtgttggagttcttggttgtaagcaacaaaaagtcaatctaggtaagcagaaaaataatttattgaagactctttaccctacagaatttccctgaggtcccaaaagtctgagctgattgctacgtccagttatactggggagactact

SEQ ID NO: 30154 - DNA, 1049 bp, Homo sapiens
caacattattgtacttttttttggtgtacatgtacctgcatttctgttggtatgtactttggagtagaatcactgctccattttaacacataagaagataatgctgatggttttccagagtggttgtagaaatttaaattctcaccaggagcttatgaaagttgcttttgccctatatttttgagagtctttatttttctactctgtgtaaatatgctggaaaacagtctttttcatttcagctgttctggtggtggtctttcattttggttttaatttacattctctgataactaacgagattgagcatttacatctgtttattgcccatttgatgtcttttgtgagtgcttaagtcccttgcccattttctattggattatctttttttaaaactgatttgtaggagttttttaaaaaatatagaatactaaggagttttttgttgaatatatatcttgcagctatcttccactcagtggcttgccattcattttaatgatgtcctttgatgaacagaagttcttagttttaggccaagtatggtggctcatgcctgtaatcccagcgctttggaaggccaaggcaggaggattgcttgagtccaggagtttgagaccagcctgggcaacagagtgagaccctgtttctgcaaaaataaaataaaataaaattagctaggtatggtggcatgcacctgtgtggtcccagctactcaggaggctaaggcaggggcattacttgagcctcggaggtcgaagctgcagtgaaccatgattgcaccagcctaggtgacacagtaagaccctgtctttcaaaaaaaaaaaaaagcctggttcccatccatttcccatccctgacagtaccttctatcttagaagtttaacaaaatgagaaaccgcatagggtacagggaaatgatgaaaaaattaatttaatgtccttttaaccaaaaacttaattatataattgaaaaatcctttatttattataaaataagttgaagtaaggtttagattgcactctgtggtcaaagtacctgttaaagt

SEQ ID NO: 30155 - DNA, 1104 bp, Homo sapiens
acatgagagatgataatcaagcctttgttgcctatgagtgaaaaggaatctaaaaatcactgaaataaataataatagtttttcaaggaatttcaaagaagttttttcacatgggaaaggactgctaggctggatgtggtggctcacacctgtaatcccggcaatttgggaggctgcagcaggaggaatgcttgaacccaggagttggagaccagtgtgggcaacatagtgagaccctgtctctaccaaaaaaaaaaaaaaaattagccaggtgtggtggtgtgcacctgtggtcccaagctacttaagaggcttaagtaggaagattttttgatcccaggaggtcgaggttgcagtgagccatgactgcgccaccgcactccacccttggtgacagagcaagaccctatctcaaaaaaaaaagaaaaaagtctgctggttgttgttggaaataatcagtcacagtggcatgctgcctaacatgctaaatcctcacctggaagactttaggactttcggtcaaatcatgctgtgatttgacccttgaggcacccttgctgtttcagtcatggaagtagtagataaaacttaaaaaacattgagacatgtatctgagttcacaaacaaggtaaacatctccttgggctgagagggaatgaatccttggtcctagagggtttggggttgggacaaaggcagccattttcaactagggttttgtgagagaattaagccctatggaaaatgatttgagtaactgcagtttttaattcttccaagtatggtatgaaactagtaccatgctatatatacacagtagatacattaattcattgtatacaggcatttggatttaattttctctttgaactctggttgagaaggactggaaatgttctatacagaggagattttgtgttacaagctgagagctaatgtggggctcctagcactggtgaaaggaagttgaaaaaagctgtcactaactgctgcctagagctctcagtggtccattatgggaaactgctgtccttagggaggcctcatgaccaagaatcgaatccagcctcacattatcttagtgattgagtttgtgataacccc

SEQ ID NO: 30156 - DNA, 1033 bp, Homo sapiens
agtaggtactgacttttgcttagttaagttttttgaaaaatgcagctgtttaccccaaattctaaaattaccgtaaccttggtgctcagcagtcaatgcaatggttgttgaaagattgaaacaatatgtaattgaagacaagtctgtcagggaacctgtgtgtgcttttaagttgaatatactttaaaagagtttttatctaattttcccctgtagaaagtattggtgagttttgagtattgacatgtattgagctagttctacaggcacctcgctaggggaaagccttcagaggaagcaactgcataaggatttaataagcatttattgagcccttactactagtcaggcaaaatattaggtcatggggactaagatgaaaatggtagcattctcaccatgggacacgtttacctatgtaacagacttgcacatcctgaacatgtacccctgaacttaaaagttgaagggagaaaaaaagagaagaaaatgtagggctctgtcctcttgagagtttatagtttactttggagacaaacatgtcaacatacacttaaagtacaaaggaattaaggcttcacagaaaaaaaaaataggcataaggaatgtgttagccttccaggaaccgtataaaacttcacatacagagcttcacaaaatttgaaagctgaaagatgtacaaaagtttggcacaaatggagaaggcattacaaatagtgacagatctctaattttacttctaaatattcgtaatgtaaattcacagggcaacttaggccagtacttttcataagctatcctgcatttatttagatatgtggtttagtacataaattgaaatatatatatgaggagaagtttttaaatgttgttctctgtgtgcttaatggggtgatatttcaaacaattgtagggtagcttttttttttttttttttttttttttgaggcagagtctcgctctgtcacccaggctgaagtgcagtgttgtgatctcagctcactgcaatctctgcctcccaggtaccagtgat

SEQ ID NO: 30157 - DNA, 1024 bp, Homo sapiens
atggggtaatggaagtctaaatgtatgtattttaatccacacattctgttgggttttggttgcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgaggtaggagcatgacctttttgcctgtacaaaaatttcttccccttgttctctcattcatattactgtattgctttactcctgtgattggctaaactgttaattctctggatatatcctggttactaatggtatgtagtctgtggcattatctagttaaagactctcaatatctagttaagtaaagacagaggccctttggcaagactcagtaaaattttggagaagattgttgtctgtagccttctggttcttatattctgttcccctctcctttcgtagtccctctgttcaaggtcacttggacacccagtgtggagttcatcttctggctcatatcctctcctttattcctctctaactgatgcggctccaaaatgacctcatctgccagtgagagtcccattattactgattctaaaattgttttaggtagcctgattatttgacagatttggttcattctcattgtacctacatttaaacctttgccttggatgaatcttttcattgctaaacccttgagaatgacactccctgtttggtctaagggaggaaggaagtcaatgctagtccatttcacttttcaatcctttaggaatgtagcaccttcctttcaggctaaattttatttgttgccctccctc

SEQ ID NO: 30158 - DNA, 1037 bp, Homo sapiens
gttagctgtttaaccagcttttttttctctctcaattaaagggtatattaagtcagagtcaggataaatcacttcggagaatagcagaattaagagaggtaagtttcagtgatgagtactttgaaaatagtaattaaatctcatatttatcagaactgttgtatgtgctagggtagtttcatatgcatctcattagttatactaataactaaccagtccagcctacaagaccaggggtcagttcttgaagtttttatttgtatggtttttctaagatacattgttggaattaatgaaatgaggtgttagcaacagaatatcaattgtctgcatgaacagtcagcgtcaacttccaagggttaactgggttcttctgttatgtatttcaggcttctttttgtttttcctaaccctaagtcttttttataaaataaattatgtttactgtaattttgaggggggtgggtaatttttcatagcacttagactgtttgaattcctttatgtcttcctgagggccatgtgtacccacttgccatcggagtaggcaagaccactcctggtttgacctgctgtctcaaattattttgtaatgagtacctgttgacttttggggttctcctgctgtcaggtccatctgataccttgtcgcttccctctgctttctcctatacagatcccaacaattgcatattttactgctattggtgttttctctccactcatttgtattgtttgttgaagaatatcttgttacctatttttgttatgagtgttcttcatgggtttttgttactttctgttaatttattaacaaaactagtgttattttgagaagtttgaaataggtagctttaggacaaatcaaagtaagtttaatgttttaggtattctaactgtgtaatttatcagtccaagatacagatttaaaaagtatagatagccttaaaagggtcaggtaaattaataaatctataaatagtaattgagaaaaactagtataattgtgggaggaggcaaagaagaaaaacaaggga

SEQ ID NO: 30159 - DNA, 1027 bp, Homo sapiens
tagatttgcaactctacctaaattttttaggagctggtgaaatgttgggggcaaagaccagaggtaagggaatatggaactaaagggcctaatttaactttcctgcctaaatccataattttatgcattaactttatcttcctctattaggaaatattaatacttatcagagtcacagattgatgaatttgttggtttttttttttaatccacctacatgtattagttttctcttgctgctgcaacaaattaccaccaacttaatggcttaacacaacacgaataattatcttagaagtttgacacaagcctcactgggctaacatgctggcagaatagtgtataggtagccgggagagggagaagggtacatgattaaaagatgctcccttgtaaccaaggactttttgtctagatgaggaaatgaaaacttgcaaaatctgaaaactatagtataaatcgaggagtgttttttggtttgttttttttgttttggtgggctgttaggactgctatgtaacagagtccagcatggaaggttgtaggttgtaggaaattatttggaagaaatgaagtttaccttccagttccttccagaagtgggggagaagggagttgtcatagggccactaactgttgtatttcggaataaagacatcaggaataagtacccagattcttttattgccattatttcattaaagtagttgtggccgggcacagtggctcatgcctacgcctgtaatcccagcactttgggaggctgaggcaggcagatcacgaggtcaagagatcgagaccatcctggccaacatggtgaaaccccgtctctagtaaaaatacaaaaattagctgggtgtggtggcacgcacctgtagtcccagctactcggtaggctgaggcaggagaatcacttgaacccgggaggtggagtttggcagtgagcctagatcgcaccactgcacttcagcctggtgacagcgagactccgtctcaaaaaaaaaaaaggttttagtaccaaaacaat

SEQ ID NO: 30160 - DNA, 1050 bp, Homo sapiens
cgtcctctctctgttttaaataaagtacaataagccatccacattgatgtgtttttgtatgtgtggattcaaccaactggatcagaaatatttagggggtgaaaaccatgtgtagtgaacatgtagactttttttcttctcattattttctaaaatatatgtagtacaacaactacttgcatagcattttcattatttaggtagtttatgtaatctagggatgatttaaattatactggaggatgtgtgtaggctatatgcaaatactacaccattttatataatggacttgagctcctgcggattttggtattaacagggaatcctggaaccaatcccccacagataccaagggacaattgtactactcccatagttttttttgacttttttctaatgaagcacatttatattaggtttctctactgaaacaacgattacgaaatggcccgatgaatgttgatgtactgaaaccacttcctcagctggaaccacaggctgaagtcttcactaaagaagagaatccagaaagtgatggagagccagtaggtaagcttcattttgtcaaaaggttaatttaaaaactagaggagagccaggctccttggcttacacctttaatcccaacactttgggaggccagtgtgggaggatcgcttgagttcaggagtttgagaccagcctgggcaacatagagaaaacccttctccacaagaaaaacaaaaacaaaaatgaaaccccaagaaaacctagaggaggattttgagagattccaggatgtgagctgatagatatgggctgaggtagaagtgtccgtggtcctaatagtttcagaaagatgcaagggtttgttttgtttttttggttctttgttgttatttaggagaaaataagtgttttttgtttgcttgttagtttgagatggtgtctcactctattgcctaggctggagtgcagtagcatgatctcggctcactgcaacctccatctcctgggttcaagcgattctcctgcctcagcctcccgagtagctgggattacaggcacaca

SEQ ID NO: 30161 - DNA, 1050 bp, Homo sapiens
cttcttgtgctgagtcacttcctgggtgggagccacaagatcagatgagccaatttatcgatctgggtgttgccagctgatccatcaagtgcagggtctgcaaaatatctcaagcagtgatattaggagcagtttagtggtggtcagaatcttgtagccttcagctgcatgactcctaaatgataatttctaatcttttggctaatttgttagtcctacaaaggcaatctagtctccaggcaagaagggggtttgtttgggaaatggcttttattgtctttgttttagactataaactataaactaagttctcccaaagttagttcagcctacacccaggaacgaacaatgacagcttaaaggttagaaccaagatggagtcggttagattagatctctttgactgtctcagtcataattttccaaaggcagtttcatattccttactgatgggcccttcttatgttgctttattgttagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggtaaaagagcagatgagttttgttctaatttaatctataaagttagatccacaggctccacagcatggcttgtacctccgggagaggagagtggatggaaagggcatttttgtttgccctggcctacataacaccaaaccttgagacttactgtgtacttttttccttctgcactgtaacatgtatataaattagataaatgtttagagttctcaaatgagaagaagctttattagagatggaaatgaatttaaaaattttttttaggaccttcatatggccgagaagactaaacttatcactcagttgcgtgatgcaaagaacttaattgaacagcttgaacaagataaggtaaaacaacaaaacctatgatactaaaatt

SEQ ID NO: 30162 - DNA, 1035 bp, Homo sapiens
agatgtgagttttgaattggacctcaaataatcaatagaatgggcctaacaagagaggtgtgggcagcacacatttcagatgctacaatgccgtaaacaggcacagtgatcatagtgggtgtgtgaatcagctgaaaaccattcttgctgaagtgggaaatgcagttggattgtaaaggaactgactattgaaatcttaaaaggtaggtagctgagtttagactttgatatacagagtaacaggaaaccagtaataggaaggcataatgtgatgggagctagggttttatgtagaaaagaaatgaaataggaagtcaaacttagaagcaaagacagaaatccagtttgagggactgtgagctttagccgccttgctaggatggtggttctgggaaggagaagaaaggtagaatctgtagaatttggtatctgatcaactcagggaggcagaagaaaagtaaggactctaaattgactccaaagttttaagcttaggacacttaatgaatagtagtgtggaattagaataggaaatctaaatggggaagttgagaattggagtgaaatgatgggttttttagatacactgaatttgacccagtcatgagcttttcaaatggaattgagttgcaggaatttggaaataagaaattggaacatctttcaggagtcatcagcctaggatcgaagcctgtggttaaatctgtaggagaggcggatttctacaaaagattaagttttacagtagtagtaatagtcatagtggtaacagcagcagctgcttctgctgacgcttatttagcacttgttgctgctactactactgctgctactattgttaatactactgctagccattacttactttagtaatgctctgctctaagggctttgcttgtatttacttgtattgcatcctcacaagtgtatgaaataatactattatcttcattttacaaataagcaaacctaagaacatagaagttaagtaatttacctacatttatgcacagagaataagtatatactcaagat

SEQ ID NO: 30163 - DNA, 1130 bp, Homo sapiens
cgccctgccagatttaaattattaatggatacatttattttggaaagtctttagataacaaagttgtaagtgcttttatagatttcttaaaaattatatttgtagtcataataattgagggctatgatgcaaagttgtaacaaactgtctctacattgaagataatgccttttacatctataatgaaagctagttttgcacacaaactgtatttcatttaatagtcttagttgagtctaaacagaactgttcaagtaggaagtgattcttagttcaaatgtaaaggtatatgccaattgaaagaaaacttccaattaagtactaaacataagaaaaggtcaatgtaaaggaagtaggatttctataaatagtctggctattggaaaattcaattgctctattaaatatttgttttattctttgttagatttaaaattcaaaggctaaatataagaactggccatgtgaaggaaacattaatatcattacagcttgctattaggattttagaagtagatatgtctacataaaactcttatctagaaaataaactctccaaatgcattttcaactgtgaagaaatttaattctgatattgctggtaattcttgatgtgaatattagtagacaaatcactaattcctttggctcacttattctggatgtcaaaatcagctcaagaacgttccccactacttttcttgggaaacagtctcttaagctgctcctcatatttttttctagatgaattgtggtgcctttcatatgttggaggacagaggaaatctgaatgtctttgattttaaacagaatgattgtttattttctttgttttatttttctgtttttgcatgctggcataaaaagaataattctgttataaaatactgagactgtgaatacagtggtgtaccgatttcaggatggtgtatcaacctgcagttcttaaatagtctcctctctagtagaaatgttaggcatagtttttgacgtatgagagcatagcattcttgttttgttaaaaatatgtattttagtggataaagaaaacaaaaaataagtttattggttataagcgcttctgtaattgttgatagtgtttctttctagttgttacttaagaacagatg

SEQ ID NO: 30164 - DNA, 1098 bp, Homo sapiens
atgagccaatgtgctgggtcacatgtatgtatttttggtgccaagttacacacctgttgcacccgtcctatctgattttgtttgataatgttgagctgtttggcttccttaaagacctggccagatgcagtgtctcatgcctgtaattccagaactttgggaggacaaggtgggtggatcacttgaggtcaggagtttgagaccagcctgaacaatatggtgaaacccaatctctactaaaaatacaaaaattagccaggcatggtggtgcatgcctgtggtcccagctacttgggaggctgaggcaggagtattgcttgaacccgcgaggcagaggttgcagtgagctgagatcgcaccactgcactccatcctgggtgacggagcaagactccgtctcaaacacacacacacacacacacacacacacacacacacacacgaaaaaaaccttactactctagccaagatgattatttttgcagagcctgaattcttccttatcttacccaaaaactccctgctgtggtagtgcctttctgtaatactgttgaatcaggtaaagatttctttctggtcacctggaaacaactctggtttgaaacttatacaaatagtaagtttcatttcaaaatattcagccagtaaatgtttaaaaaagaaacaaaaatctctgctcttttattatatagttaagaagtttttaaaaataaaatatgcctaagaatagtttttccattcttaaaagtgtcatagtgagtatataatagtgttacataattattgatgataagaactttagagcaaacgaaaaacaattgaaattatacagtacagaaatagggacatatcttcatttctttaaatgtactatccataaggaaactggtagagaatggagagccttcagtaatttattttttccaaacttctaagcttaggctcatataaacaagtcttaatatcctaatccagaactcagtgacaagttggttttggtgaccgaacgtttcttgtggctttgttcaacaactccagtatctcttggcttagaacagtgatgagttttttaacctatcctgctactgctgctcttag

SEQ ID NO: 30165 - DNA, 1036 bp, Homo sapiens
aactgtataaacttaaaatctagtttctagacttagagtagaaatatcaaactctggagtgtagagatgaggtagtagcaattgtatgacctttcacattcagcagtgtttcgtaaaacaagtagtggaaaaatagcagacatagtggggttattggaacaaaatttttcatatcagtagtaattgtggcaattaccccactggaaaagccatagtgccttgtttctgcagactagagcatgggaggagagagatgatgacgttacctatccaacagggctgggtgcagatcaaaagaaatgaatgattcctggggaagtactttgcgaatgctgaagatttatgtgcgtttaaggtggtattaattatttttggcacaggaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactgtaagttttaataatattcagattctggagttgtgaaattatttgcatatgaaaatttgttgtctctagtcagtataaagtttcgaagattactggattagatttatgtatacatgcccttcatttttaggtagtgtgagctatgcatgggagtggatttggctttaggctctgtgtttattacatggtgctcctggttctgcctttagctggctgtatttctgtcagccactcagtctgctgcttttcactgaccctgcagcatctccattgcatactcacccttgatgtctaggaagtgggctcattttgtaggcaatacttgccctggcacctttctgcttgtccaggtttatcttatgccatgtcctgaacgtaatccagcctctgcttatatcacagtttaattacactagtgtgtggcttttgcatttggtttccccagtttttccatactaaacatagtcccgtaatgaacatatttgtgtgtatgtcccaga

SEQ ID NO: 30166 - DNA, 1023 bp, Homo sapiens
aaacatgtaatcttttctttccttttgtctttttttttttttttttttttttccaagacagaggagtctcgctttgttgcccaggctggagtgtagtggcatgatctcggctcactgcagcctctgcctcctgggttcaagggattccccaacctcagcctcccgagtagctgggactacagccgcatgctaccatgcccggctaatttttgtatgttttggtagagacagggctttgccatgttggtcaggctgggtctcaaactcccggcttcaagtgatctgctcacctcggcctcccaaactgttggactgtgccttgccataatcttttctttgttatatgattcctttagtaattgagcatagattctttgtcttttctagtgtttggtatgataattttgatcttcaggtaggtggtagacatcatgtctgtgtatcattgttagtagacaagtacgtactttaataaaaatgcatctgtttttaattaacagagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaag

SEQ ID NO: 30167 - DNA, 1050 bp, Homo sapiens
aggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggta

SEQ ID NO: 30168 - DNA, 1030 bp, Homo sapiens
ccatcaagaagagacaaatcagttacttaaaaaaattgctgagaaagatgatgatctaaaacgaacagccaaaagatatgaagaaatccttgatgtttgtaccttatttcttctctctcacttttgaaatttagctgtaatagatttcatggtagtgccaaagatttccttttcaaatgtgttttttgaacgaaaagggtttttttttttgactcaatattattcaaattagtactgttatatgcagatttataaagttgagttgatttctgccaggattgtagtttcctgatgagattctgctaactaggcagcacagtccccttgctagtattgaagcaacagtagatactaaaaggaagaatagattctttcccatctgcctcacagattctgactgaactgtgaggggaaccagactaagaatcaagaccctgtgcttcggtgaagtctaagtaatgggatagtgagtgtgtatttaaatgtggctgcttaacttagctggaatctttctgggagggacaatcaactttactcttatctctacccagtgtgtggaggttgattggtctcaagagaagaaagctgggaaaaaatggaatgcataagccaaatcttttatatttagtggaaggttatttcaaaatacttactctactaatgccatgttgcaattcacagaatatgccactaatgcattgccattagcaaaataagataagccatgaagatacaccatgaagataaatcataaatgctagttagtactttggactaacatttgaaaatgttttcaaatgtaatacaatataaattgttcttggttgggttacagattctgtagttgctctaagccttatttcactatatgctaagaatcttttggtgattaagaattcataaatcaaagaatcatacctcagctgactatgtcagcagaagtctgagtcgggaacagattctaataattattttaaatgtaattgaaatggctagaattccaagatataacacatgcctataaatgcca

SEQ ID NO: 30169 - DNA, 1052 bp, Homo sapiens
gcctatattctgtcttcagcattaaaaaaccttgtggtgacagcaatctttctttttcttacatacagtttccctgtgaatcttatatggtctgattatttgttatttttagattcacaatttagaagaccgtttgaagaaatatgaaaagaatgtatatgcaacaactgtggggacaccttacaaaggtaaggatgatctcgtgtcatgttattaactgttatcttttattggtggatttgtgcatgatttttatttttgtttttgctaatttatatttttttctcattttaaaatttttaatgattttattttttcttaattgacaaatgcatatatgtatagtgtgcaacatgctattttgagttatagattcattgtggaatggttaaactaagtgcattacctgacatactaccttttttgtgtgtgtgtgatgagaacactttaaaatctactcttttcacagttttcaagaatacaataaattgggtggggaataatacaatacattaactgtagtcaaccgtattttacaatagatctcttgaacttattcttccttattgaactgaaattttgtatcctttggacagcatctcccaccccccacagtcccttataaccaccagtttacccggcttgagttcagctttttagattccacatgtaagtgagattatgtggtatttgcctttcttcacctagcttattccacttaatataatgtcctccaggttcatccatgttgttccaatggcagagttttcttctgtttggaggctgaatagtattccatgtggttaatctgttttttacaatgaatatattttaccttttaacagctgactttaaggaaagaaagatagtaacctggcgggcgtggtggctcacgcctgtaatcccagcactttggggggctgaggcaggtggatcatgaggtcaggagatcaagaccatcctggccaacatggtgaaaccccatctctactaaaaataaaaaacattatctgggcatggtggcatgcgcctgtagtcccagctacatggga

SEQ ID NO: 30170 - DNA, 1093 bp, Homo sapiens
ttctcaccactctagcacctcatcagtgctggatatataattttttttcttttttgagatgaagtctcgctctgttgcccaggctgaagtgcagtggcatgatctcagctctctgcaacctccacttcctgggttcaagcgattcttctgcctcagtttcccaactagctgggagtacagggttccacacccagctaatttttgtatttttgggagagatggggtttcaccatgttggccaggctgggttttttgtttgtttgtttgtttgttttcaagacagagttttgttcttgttgcccatgctggagcgcaatggcgcgatctcagctcaccgcaacctccacctcccgggttcaagcaattctcctgcctcagcctcccgagtagctgggattataggcatgcgcctccacgcctggctaattttgtatttctagtagagatggggtttctccatgttggtcaggctggtctcaaactcctgacctcgggtgatccgcctgcctcggcctcccaaagtgctgggattacagacgtgagccaccgtgcccagcctggccaggctggttttgaactcctgaactcaggtatctgcccacctcggcctcccaaagtgctgggattacagacgttagctgctgcgcgcggcctggccaggctggttttgaactcctgagccaaacagtgcccatacattgcatttgattgataaattacttaagtctcttttgaactccaggtccttctccacctttgcttttatcatttatttgatgagaaaaccaacttacttgtcatatagagtggaccacattcttaattttctggattctgtctccctggagtcctctgttccctggtaggtagaactagaggcttgagcagagttaggtttgattagatttagctttgcatggacaatagtacttcataaaggaagttgtgtaattcttgtcttacatcaaacgttcatgacatatttacgattttaagatctgtcacccagttccaggtgtgatccatcacttttcgccagattttagcatccattggtaaattccctgatctgttacttcagtagtgattgcat

SEQ ID NO: 30171 - DNA, 1050 bp, Homo sapiens
gaaatgtatattgtgcagcatttctattaattgattaattgattgtctcctcaacttttagtttgaaacatttcagacataagatttgcaaaaatagtacaatgaacacccatatacccttcacctagtaatgtttggccagattttctgacttgctgtcactcttgttctctctccatttatattattccccatttgtaacatttggcaattacttgccgacatgcttgcaagcatttgacaattgtaaacataaactaagtactttagcatgtatctttaagaacaaggacatttttctacatacagtacagttattacactcaggaagtttaatattagctaatactaatatatagtacataatactcagttttttacagttttccaaataatgtctcccataattttttagaatccaggatccacttgagatttcacattgcatttagtggtcatattttcctagtcttttttaaactagaaaacgtctagcttttttgtttttaatgatgcagcattgttgaactgatcttgaattttgtttcccacaacagatcaagctacggtttcaaaataaaaactgacaaggaatttacgtataacagaagatcttgttggtgtcttctttaggttcctaggaccaacatgattattgaactagttttataaataatatactattagtagtacattatgagtagtgaaatatttgttcatttacaaattcagaagactaaaactccccctatccacttaatatatatggaaagtttgcctctattaatcttacttggtaatttatttttatgggattttaaactcatatcttgatgtgactactggttttagcattttcttttccttttcttttttttatatttgagacggagtttcactcttgttgcccaggctagagtgcagtggcgcaatctcggctcactgcaacctccacctcccaggctcaagtgattctcctgcctcagcctcctgagtagctggggttacaggtgcccgccaccacacccagcttattttttgtatttttag

SEQ ID NO: 30172 - DNA, 1053 bp, Homo sapiens
ctccttgcagtaccttgaggcacgttcttacctcagggcctttgcatttgctgttccctccagctgaaatgctcttgcactggatattatgtgttgtgtttccatcatctttgtcagatatctgctcaaatatgacattttcagccaggcgtggtgggtcatgcctgtaatccgagcactttgggaggccgaggcgggtggatcacctgaggtcaggagtttgagaccagcctggacgtggcaaaaccccgtctctactaaaaatacaaaaattagccaggcatggtggcaggcacctgcgatcccagctactcgggaggctaaggcagaagaatcgtttgaatccgggaggcagaagttgcagtgagctgagatcatgccactgtacaccagcctgggcaacagagcgagactccatctcaaaaaaaaaaaaaaaatgacattttcagagaggtgctctttgactatcttacaaaaaatagtgctcccactcttgctgtgcaaactcaatttcctgtatcctactctacgtattttcgaagcagtcatcgccatatggtatactctctctagattattttcttgggcatttgcctattgtcaccttttcttctcactagcatgtggctccatgagggcaaatacttaatctgttatgttcactggggcatctccagaacttgcctgaaacccagtaggtgttcaataagttctggagggatgaatgaatgactcctctcactgtaaggaagtttgggatatgtagtctatctgggcacatttctatctgttctctttgcaggggagaaagggatgaggatgttggataagcagctcagcatgttccccaacatgtaagggaatcaggtcgagttctacactctccttcttggtacacatcctcagaatgcaggaagtgcctgtgcttgctgtgagtctttgtggacagaggcaggatcatgctggctagaatctagtggacaaggtaaggaaacataagcattgaagaggggtaaacatttgttgtatgaggttatgggaggtcctgtctca

SEQ ID NO: 30173 - DNA, 1034 bp, Homo sapiens
tattttatatataatgtccaggattttcagttgtacttagtggcaaacaggaagacgtatgtctactccatcttcttggaggcagaagtcccctgatttttagacctacccaaattaagtattttaaggaagactagaattagaaagttgtcattttaaaggtttatttcaatattatgctaatgactgatgtaaaagtcaaattcagttagtgctttgaaaatcttaattgtccattgaaaagagaaaagataattcactgtgaaatcaagtctagatcagtagggcatcagtgacaactgtgatttaagcaaccttaatgagatgcattcataaactttggtcttaatatcaaaattttagcttcaagttcatgagtgtcctaacttaaatgtattttaaatctaatattctgtttgattagcaagcatgtttaacctgatagctttcactttgtttctcagttaaggaagcatccatttaagtaaacagaaatgtcttcttggggcaaacacaaaggaccttatatctggatttagcactcatggtgcgtagacagggcttgctggccagtgactagaagagtttgcttccagtctgggctaccctgaaagtaggtctttgggctctagaaacttgccccaagctgtacttaactgtagcatcccaggttggggaagaaccccgtttggcatggcagcactgggtgttcagaagggaccacaccacttcaagtttaattctgaagtaaatggctttttcccttttggtgatgttgagggtgtggattgagggggtacataaaagtgccagtgggttcaccaggctgttcagctaggagttggccatggtcaggaaatgctctggccataaatgagtctagatttaaatacagacacaaggccgggcgcggtggctcaatgcctgtaatcccagccctttgggaggccaaggcaggcagatcacgaggtcaagagattgagaccatcctggccaacatggtgaaaccccgtctctactaaaaatacaaaaat

SEQ ID NO: 30174 - DNA, 1043 bp, Homo sapiens
atttgctagtgacatattatcattttcatatacttttctggatttagttccctcatattttattcgaggctttgctcctaagaaggattttttactataatttcactttttgataatgtccttgtcagatttttgtgtcatggtttggttagacttgcaaaatgagttgggaagtgttttttgttgttgttgttttctggaagagtttatataagatatatatgttctttttttttttttttttttttttttagagaaagggtctcactctgttgcttaggctggattgcagtggtgtgatcaaggctcactgcagcctcaacctcctcctgccctccagcagtcctcctgccttggccttccaaagtgctgtgattacaggcatgagctgccatgcccagccagtgttattttctttcccaagagtttgtttaacattgttatttgttctttaaaagttttgacattttctcatggtattttgatgatattctagtgtcttctggcttttagtatattcattaaatgaattgttggtctaattgatactccattgatctgtttttcctcccctctggctgcttttaagattttctctttgtctttggtgctgagcagtttactatgatttgcttaggtatagttttatttttatttatctatttggggtttatccatttaagatcttgaatctgtgtttgatgtcttcagttttaaaaaattcttggctgtgtcttctactcaattctctcctctcctgtgactctaattatatatctattagtcctgctcactactcctttatcttttaccctctcatctttattttctgtccttgtgtctttctgagtttcaaactagatatttgcttttgacctatcatttagttcattaatttttcttcaagctataaagtgctattaaacccccatattgaattcttaattttagttattttgtttttaaaatctagaattactgggttttgttttgtttctagttctctgagaaacttcaattttatcttttacctctttggactc

SEQ ID NO: 30175 - DNA, 1030 bp, Homo sapiens
tgtttgcctttaattgtaatagaatttgtggcaatgggattatttatcatgaaaaaaattatatgtaatataataaataagttctgtgtaatagtggttgttaaatgactctgaaaatctctcgttggctgaatggattccatgcagttcttcctgacccctagtcgctaccagggccttccccctaccccccaccaagcagctcttttcagtttgtgttttatattaactgtccttataagaattactgtttaaaaaggctatccattgatattttaaagtttggaaactatactatagaagatgcttcatcatagactcctggactctcttgagaagctgcattttgggatcttgtgagcagaggattttccttctcaagaagctgctctgagatgggacccctctccttggaatatttagaacagtttccagcatagaatttacagctttcccttctcagaaaaacagtattggaattttgcctcaagttgattattaacacaacatgacagaaagacaggttctctgaatatattttcacctccaactttttttaaaaagtgaagtgtaaggtagaaaccagaataggaaataggtgaggcaggtgttgagggccatttccagaaaggattacttaatagtagtaggagttttctaatccaaaaccaggtcctggagaagttgaggaattggtggaaggctgcagtttcaagagctggagaactggttagcgggaagaagcctacagcggaggaaggatcagcagagatggaatgggaaagggggccagggtttcccttcctcaggatagtggagtctccatcagcatctgttcctggggcctctcctggattccaggagttgtgcttcgctgggccctgggggaaacagagaagaaagttgagtttgcctgagtaagccaagtgaaaagcccacaggatagctggagaagggaaatggctagaaggtcaggagcccagagagctaattttaaaggatagggaattatggaagccctggggatgtt

SEQ ID NO: 30176 - DNA, 1050 bp, Homo sapiens
ggccaggatctcctattgctccactccatggggagattctcccttctcagctcagagtgtctttttattaaagcagctagcaggcttccttacattagatgccagataagtctttactaaacagaccaccattctttttccttgcaaatgtggctctgttgaggtatggattaaatcagcccttatgggctagcatgggcactttgtcactccttattacatgatatttgtgggaaatagcattccaggttccaaacaagggattggcaagggaagcttgggaacacagctgagtcaccaacaagggccttgccactcctggtctgaagcactaagtgtgtttctgtgtgagggctaccttcaaggctgcagtccagcacaggctcagagcccacaggcttggcattctggcctgtggatgtttgacaagcagggcagtgtttccactggggacagtaaggggtgagttcaccaagcttccttcactaccctgtgttaccttatcttgtgtaacatgacaagaacccagtctgagccatgtagagctaccgaggggctgtaagcaggaagggggcctaaccacatctgcatttcagaaaagatcgttctaggggaggagaaacctgtaatcagactgttgcaaaggttctgtggagggagggacagtggcgtgggacaggatgactgctgagcatatggggagaagagcctgggcctggcagctggctggctgtaggagatgcaggaggaaaagctgagggtggtatccacatttctggtgttcttggagtgacattgaagtagtcagctggagagaggagccttgagctcttcttttgggaaaccctgaaaatgctgtgaagacttccacagaactgccatcccaactgatagttcaaatgcgttcttaaaatatctgatcttggcagagtggaactctgtgtaggaagaatcacatggtacttcttattccatgttcagtccccagcgtgtggtgtctattttgaaatatgtggtttatgcaattttatcaagagaggtttcttaggg

SEQ ID NO: 30177 - DNA, 1075 bp, Homo sapiens
ggtccctatctgtgcctgtcacctcacccctcttttttcattcgcatgttgctctgtttgtatgtgtaggtttggtcttttaattttttactaaacagtaattcaagctcatggttaatttttaaatattgacggatttgggattaacacctgtgggaatacatacatacacacgtacgtgaagttgaaagattaaagcaaagagaaaatatctctcaatgtaatcctactgccttctaggcagtaccactttttaatatatgtcatttatccttccagaagttttccagacaaacacaaacatatttatataaatgaaattgtgttgtattcaccattctgcaaattgcttgttactttctaacaagatgccttgaacatctttccaaatattagtaggtatatatctgcctcattgttttatatttcattgatggcatttactttgtttccacttctgtgctattacaaatatttctcttaaaaatatcctcttttctgtgtgcttatggacttgtgtgatagttctttgtgatcagtttctatttgtggaaatgctaggtcaaaggatatattttacagtattggtacattaaaaccaaattatcctccaaaagcttatgctaatttacattctcatgaattatctatgagagtgcctcatacccttactgaaaatgataatcaaatgtttcaatctttgctaatctgaaaataaagaatagtatcaggccaggcgcagtggctcacacctataacccaagcacttggagaggccgaggagggcagatggcttcagctcagaagttcgcgaccagcctgggcaacatggtgaaaccccatctctataaaatatacacaaaattaactgggcatggtggccgggtgcggtggctcacacctgtaatcccactgaggccgaggtgggcggatcacctgagatcaggagttccagaccagcctgaccaacatggagaaaccccatctctactgaaaatacaaaattaggctgggcgtggtagctcacgcctggaatcccagcattttgggaggctgaggtgggcagatcacctga

SEQ ID NO: 30178 - DNA, 1094 bp, Homo sapiens
atgtggccatgcctacctgttttgtttttttaagaacagaaacaactattttaaaagaactcttttaagaaatttcataaagggacatgcattttactgggtttgcttttcttaaaacataccaaaaaagaaaaaaatagaaaaaaaaaaaaaaaaagcttgatctctatcagacttcctttcaactgtcctcccctccaagcagaccacctgtccccttctatcccagctcagagcagctgacccaactcagaatctctttcctacaggatgaagtgccttttgaatgttattttaagccgagagttaatttttctacacaacatatttccagacatcttttagtcttttattgtcttagatactataagaagatgaacatgacaattttctagaacctggtagcgtgtgtgtgtgtggcggggggtgctgagggaggggagtgagtcacaggagcctgtcccccaacaggtgtgactgctctgacaacctgtggcatgctgcagggtcaggctcctgataggaggatttcatgactatgtcattgtctccactcatttttgacccagtttggaatgtatctgcaattgtgtggctcaacactttaggaaacaatagattattttatattattatttctgatggtgacaagtttgtcttgaggtcacattttctccttgaaaagtgacatcctgtcacttctgctctcacactactgccatacatttgtgttttttgttgttattgtttgggtagagcagttacaagaaaccctaaaacccttggatataaaagaaatctgtttattgatttttaaatctttcctttccaaaagctggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctggcattggccactgaagggtacaaaggcaaaaggaccacagcaccacttaggtgta

SEQ ID NO: 30179 - DNA, 1050 bp, Homo sapiens
cttagtcttagattagaatttctgagcatgtgttatactgtatttggcatgtgttgaagcagctgtaaaaatttgggctttggggttagactgacccagattcaaatcctgacattgcctcttactagttatgtgatcttagacaaattatatgattagtttccgtgtcagctttttgtctgtatagtggggagaatagtacctatgtcactggggccgttatatagattgagtgtaattatttgtgggaagtgtttagcttgtataaaatgatagttgttattatctctgacttttttttacccttccccttgtcctcatatttcccaatttttggtattgccatgaaatatgaaatactatgtgatgtgaaagcttgtgacacttaaaatagtttgaatctgtttttaatgcttagtggaacattattgcatttattttattttcgcatctttttttttcttagtccaggcctcattcaggtttagatggatttagggatttatgttggacatcgtagtataactgtaaggaccatcaccatgatattgctaataatacaatatgatggcagagagggctgtgccagttaggttttattgccctgcatcttgaaaagtctcaataagtatttactatttacctcagactagaaaattgaaaacttaatactaggtttaaggtgtgattcacctagctttgacactttgaaggcagtgcaatatatttctattcttgactttcccttctttttattttcattgattgtttactagccacacattttgagtttaaagttgtggttttcaaatacagattccagggccttacctttagcgcctccataaatgtgaaggacttcgtgctttcaatagagtggtgcttaatagtgtatttttccattgattgggagactcagctaaggtgacattttctatgaggccagcattgggccaacaacctcatagtgttgtatcaaataaggcttacatttctctgcatgtggggaaaatggaaataatagtggcttaataaaatcctttttccccc

SEQ ID NO: 30180 - DNA, 1026 bp, Homo sapiens
gaaggggtggaattcactttatttatttattttattaatttattttttaaatagaggcggagtctcactctgttgcccaggctggtctcaaactcctgggcttaagggatcctcctacctcggcctcccaaagtgctgggattataggtgtgagccactgtacctggcctataaaggaattcactttataggtggttgaggaagctgctgggtaatttaagtcagtattcatataccactcttgtgaatcatttatatatttatttttctttttgaaaggaggaaaggataactctactggtagttaaggtacaagaagattcccccttccccctttaaaggaatagaaggcaagaaaaagaatatttaagccccttttcatctttggattttgtgtttttttgatagtcttttgctagaaaaccctttgtagtactccccttttcagattaaagctcaaaacccttagcttaacatttaagaccttccacaatttgaccctaactctttacattgtcactctctcatgtgatttttctttccttcaccttccctatcagttagtcaccaaatcctattgtttgtacctctctattattatctcgactcttcccttttcattcatactgtcactaacttttttaaccttttcttttgaaatagcttaaaacttacagaagaattgcaaaagtagtacagagtttccttatgctatccacccaacttgcgctaatattaatataactgtagtacagtaatcagaactgataaattagctgtttatcatttctccatcatctctcactcacatggtggcaacagcttaaacagaagctttgtctccagtcttgtcttcttcattgattttctatgtggtatccaagggtaatttatgaaaatgtataatatagttaaacctttgatatctttccgttgctgttaggatgaagcctgatttttaaatatactttcaaagtcctttatgatctagtcccaggtaattaaacaatcaacaatcttaaaaac

SEQ ID NO: 30181 - DNA, 1050 bp, Homo sapiens
acgtccggcctcttctttggtttcaattgagcatttcatatgattccatttcgtttcctctcttaggatatcaattatactttttttttttttttttttgagacggagtctcgctctgtcgcccaggctggagtgcagtggcgcaatctcggctcactgtaagttctgcctcctgggttcatgcgtcagcctcccgagtagctgggactacaggcgcctgccactacgcctggctaattttttgtatttttggtagagacggggtttcacccgttagccaggatggtctcaatctcctgacctcgtgatccacccgcctcagcctcccaaagtgctgggattacaggcgtgagccaccgtgccccggccaagaagttcttttaacatttcttgcaaggcaggtctgctcactgcaaagtccctcagtttttatttgtctgagagaagtacttctttacttttgaaggataattttgctggatacaggattctaggttggttttttttttttcctcttgacactttaaacagttcactccactctgcttgattgcatggtttctgagatgtgggatgttaattcatacctttgttcctctataggtaaggtgttctttttcctctgacatctatcaatatttttgtctcccttacccagctcagtctttttagtgagcctgtgctcctgggctatcaactgcacaagtgcttctcagttcccccccaaggtgagacaggaaggcttgatgggactgagactgggtatttcccttcccgtagatgggttaggttctggtaaaaccaaggtggttaagctctgataaaatagtttcccttgagggtaggtttttgtttaggagaatagaatgcttagggcatatttcaaattggttacttttttcttcctcctgtgggaaattaggggaattttctcctgtctataccccgagaatctcatggggctgtaggaggtaaagctcatccagctcatccaagtgtatgagtctcccttagactgggtctgcttggggtttttaactctcaagctgt

SEQ ID NO: 30182 - DNA, 1068 bp, Homo sapiens
tggattcctgaacataatgccccactgtaataaggtcacaatccaaaattaagaaacacacagtgaaacaatgcattatgaactagttagcagacacaagcagaaggattagtgctccagaagatttaggtaatgcagtgaaaatctgaaaagatacaaaattaagtatattgaaaataattaaaattagaagaaatcagacccacaagagaagactgtgactatgacagaagaaccaaatagcaatgccagaaatgaaaaatacagtgattaatgtttaaaactttccatgagtgtgagctggacttgttgactcacttctgatgagtagagtatgaaaaaggaaaaatagcaactttacaatgcacctcctctacccaatgaccaaggttaacatcactattaataatacattgataagactgatatgtgcctcttgatatggtgcaatgagaagggcatatatataacctgtgaggtattcttcctccaaatccgtaacttcggtctataatgagaaaacatcagacaaacccaaatcgaggaatatgcagcaagatacctgaccagcactcttcaaaactgtcaaggaagagagactaagaaactgtcacagattggaggaaattaagaagacgtgaagacggaaagcaagagtatcctatactagatcctgggacagaaaaaggacattagtggaaaaactggagaaatggaatgaagtctgtagtttagttaatagtattgtaccagtgttgatattttagttgatttctttattattatactgtggttatgtaaaaggttcacaatagcagaaggtggtgaatggcatgtaggaactctgtactagctttgcagctcttctgtaagtctaaaattattataaaactttaagaaaactggaagctatagaaaatctattccagtttgtaaaccaaaattaaactttgtttagaacattgctaagttaaaataacacgcacaatggactggttaaacagaacaaccaataaaacaaaaaagagattatttactcatcaagtaccaggcactgtggtaaacact

SEQ ID NO: 30183 - DNA, 1033 bp, Homo sapiens
tatatctttttcagtggctataatgcatcgttacatatcagaatcacttggggacttaaaaaaaaaaagaaagaaacatggacaatgtcatcccaaaccaattaaagtcatgactctagtggatgagacctggacaattattctcatggatagctactaggttaaaaactcacttggctcattccttcactttatgtcaagtctactcaattggcctttcctcagaataatattctctgattactaaaacagtaccctcccatgactctctatccctttaccctacttatcaccatctgacattttacagtgtttctttaccattagaataacagcttaatgagaacagggactttttttcattgctgtatcttcagtgtgcctagaatagttcctgacacacaggatattcttaaataatatgtatatatttttatgcttattaataatatgtataaaatttctatgcttattattgtttataataaatcccatctgagatacgtgttgatttatatctgaaatctgattaatttaagaagagtaagttgggtgcagtggctcatgcctgtaatcccagcactttgggaagccaaggcaggtggatcacttgaggccaggagttcaagaccagcctggccaacatggtgaaacctcgtctctactaaaaatacaaaacttagcctggtgtggtagtacatgtctgtaattccagctactcggaaggctgaggcatgagaatcatttgaatgcagaagagggaggttgcagtgagctgagattgtgccactgtactccagcctgggcgacagagcaagactctgtctcaaaaaaaacaaaagaagagcgagcctcagaccggggatatggtgactcacgcttgtaatcccagcacctgtgggaggctgaggtgggaggatagcttgatcgcaggagttcaaggctagcctgagcaacatagtgagaccccatatctataaaaagaatttaaaaattaatgagctatggtggcatacacctctggtcccggcta

SEQ ID NO: 30184 - DNA, 1030 bp, Homo sapiens
accactgtacttcagcctgggtgaatacctgcatatatttccaccctcctgccaaaaattacctactaaaagaactgttaagagaataaaaagagatcaagcacggtggctcacgcctgtaatcccagcactttgggaggctgaggcggatggattgcttgagctcaggagttcaaaaccagcctgggcaacatggcagaccctatctctactaaaaatacaaaaattaaaattagccaggcatggtggtgcgtgcctgtggtcccagctactcaggaggctgaggtgggaggattgtttgagcctgcagggcagaggttgtagtgagccaagatcatgccactgcactccagcccgggtgacagagtgagactgtgtctcaaaacgaaaagaaaaaagagaataaaaagaaaaggcataaacctctagtggacaaaaaatgagagaagtgaaagctgcaaccaaattttcaaaactttgatgcccataaattagtggtaaaggacttggcaaatcagcagactataattgctaagccagtattaagaaaagcttgaaagctaccatatacaacagaaccctgaaaggtaagggaattaatagtgccaggtacctccagaaatgagagtgaaagtagggctaaaaacaggaagattggttgacaatcttaagatagagttagactctggtccctcccccactccatgctgcactccaggagatgtctggaggtttattctgcagaagggtaaaagaaatggtctctgaactgaaggacaccaggcacagttaaacatgggaataacttactgaaaagggcatttaagtaattgtttacacattgaatgttaagaatctatccatatcacttcattcaactcctggaacataaacattaaggcttattaccccatagacaagacgttgaaaaatccttatttgatcaatctgactagcctaagaggaaaaacagaagtattgacattggaggtgggaaatgctcacccacatcactctgcagtgaagcaaa

SEQ ID NO: 30185 - DNA, 1050 bp, Homo sapiens
tacaaaagtttttttttcttgtagtctggatgaattcattatttacaaagttgtttgtttttttttttaaaaaaaaggttttgggttggtcacttacttggtatgctacattagctattacctgaactttgattactccttaatgaaatggtgataaaagtgttaaaaaaaaaaaaccatcaattgatctttgacatattctgactaagtccatcattgtcagaatttaccataaattgttattcgtttagaggtaagttttttggtaaactacagtgcctgtatccagaattactgctaacttttattatttaccaaataaacagcttaaattttcatatggcagattgtaattggtcatttcctaataaatgtggtttacaccagatatttgagacctcacctcaagtatcagtttatttccactacctttatttttgctagtggtccatgctttatttttggaccacccgtgtttctttagataccagattcccaaatatccaacaccaagaataagggtagtagactctttacatgcagctttcagatcatttttggctcaagagttttctccattaaagcttgtaaacagaattactctgctttgagaatgtgttggataattagcttaaaagtttaggtttggtctgggatcttatatacataatatgttcacgattagtagaaagaattttactttggagaatgtgacagtcccattatgtatgcttataaagctcacaattttaaaatacggaattttaaaattgataagtacattgatgtatttgttacaggctacctggacaaaaaatacaatactatcatgacagttattttttccagaaaactttcagtagacttgctggtgagttaatatatggatcagaattaaatggagttgatttgcatttaacatcacttgcagtttgggactgactacaagtaacctgagttgtgagttaacaatcatcctttttgtatttcgtttagtctccccgagtgaaagaatcaatatcaaattctgaggtaagtaattgtgattat

SEQ ID NO: 30186 - DNA, 1033 bp, Homo sapiens
agagatcagagtgagtgaagttagccaagcgatggaagggaagttggccaggtgatggaagagcattccaggcagaaggaacaacatgtgcgagggccctgtggcaagaaagagcatggttcattccttcatgcaattgaagaaagccaatgatgctggggagcagagagaggcggaggctggtcagagctccataggccatggtatagagtttgtctttattctaaaagctatggtcagccactaagggccataaggggtaggggtatgggtgaggtatgaatgacaggttgtatttttgttttgaaaatatctctctgggggcattgggagaacagattcggagcattgctggaatggacgtggggaactattaaagaggtttttgctggtcattcaggtatgaaatgatggataggagagagctgagtagtaaaatggacaggtcctgttacaaaattgaatgtgagatgtaagggtgggatttctggctgtccttcagagtggatgttggactgtgggaaagaatgagttttggagagaaagatcatgagttcagcttgggctgccataacaaggtaccatagactgggtgggttaaagagcggaaatttatattctcacacatctggccgttaggagtctaaaatcaaagtgctgggaagattggtctcctctgggacctctctccttggcttgcaggtgaccactctcttgctgtgtcttcacatggtggtcactcggtgcaggagtgcttggtgtctctgtcatctgtatcctaatcttcttataaggacatgagtcatactggattaaggcccattctaatgacttcattttaacttaattgcctttttaaaggccctgtctccaaataatcacaatccaaggccctcggggttaggatttcagcatatgagttttaggggcagagggggcacaattcagtccgtaacactgtggacttgctggttttgaggcaccctcgtgagggcctggtaaaagtgtccttccctgtctgttttagacacac

SEQ ID NO: 30187 - DNA, 1024 bp, Homo sapiens
ttatctttataaattaacttggcagaattgacaactttatgagattaagtcttcctgtctaagcacacgttatgactttccatttgttcaagtcttcttttgaatacttcacatgtgttttaatatgtttaacatacagcttttgctcactttggtagattgcacaaatgaccacaatactccacccatccctgtacccacaccctttgcaatgtgactgtaattcctcccatcaaggagtcgtttccctacctgttgatttgctttatccagtagaacaggggaagtggcattgtgccagttctaagcctaagcctcaagcagccttatgtgcttctgctgtcattcttggaactctgcctagccaccaaatgaacaagctcaggctatactgctggagagttggacatatgtggcctagttgccccaacttcttcccctaagagccagccagcccctagctactgttagctacctatgaagcagagccttctagctaccgttaactgactgcagatgtatgagtgagcccagctgagccccatccaatgatagcaagtagaattgtgagcttaatggttttgagccactaagttttgaagtggtttgtgacaatgcagaaattacccaatgtagataattatttttaagtttatttctaacttttttatccttttactactgtaagtggggaagggaggtttctagcagaaacttatcagctgtcttccaaactcatttccctttcttcctaggcactctcctgccttccttgtagttatgttcagccatgtgactgagttctagccagtggaatataagaaaatgtgatcaggcctctaaaagacctagtccatcaaaacctccttctctgacttttctcccatttttggctgatgtgggtgtccagagcaaccttggaagcacatgtggaacatgacagagccaccatcaacctggttcctgaatgactgcatggagcagaactccccactccccactcatgttcctaaccacctactga

SEQ ID NO: 30188 - DNA, 1877 bp, Homo sapiens
ttgcatagctaaagaaaaagtgcacagagtgctgaaattctagggactactgatgaagcttgaaggaggcagccttggggaaaatagaaataccagcggggctggcacagcacaggccctggcactggacagcatgggactgaattctggttctatcagctttgtgactttgtgtctcggtttcctcatctggaacaaggggaatgatgctattcatcttacagggctgttgtgcaaattagatgagttaatacttttaaagcacttaaaaaatagtgcctggtcccacaggtaatgggaaaaacatttacccatcacagcggccccacccatttgcagtggacactggctgtgaatgccctggggtgttctacttggccagccctgttctccattgtcctgtggggacagtggagtagagagagagagaaaaagatctgggtgctgcccctggggccctttggtgggaaatgcttaccacagagccagaacaaccagaaggaactctgggtgggacagagtgctggtgtgaagaagggacaagggcaccctgaggcctggagggagtcgtgtaactgggaatcttgggccatgtggaggaggggctgctgtgaggacttcgcgttgggagtctcagccacagaagcacttttgttttcttttcagagacagagtctcaccttgtcacccaagttggagtgcagtggcatgatcatagctacggcagccaccaactcctgggctcaagtgatcctcctgcctcagcttcctgagtagctgggaccataggcttgctccaccatgcacagctaatttttttttttttttgagacagagtctcgcttttgtcacccaggctggagtgcagtggcgcagtctcggctcactgcaagctccgcctcctgggttcacgccattctcctgcctcagcctcccgagtagctgggactataggtgcccgccaccacgcctggctaatttttttatatttttagtagagacggggtttcaccgtgttagccaggatggtctcgatctcctgacctcgtgatctgcccgcctcggccttccaaagtgctgggattacaggcgtgagccaccgcacccggcctaatttttttttattttggtagtgacagggtctcactatgttgcttagattgggcaattctgcctcagtctcccaaagtgctggaattacaggtgtgaaccaccgtgctcggccgtttttcttgtatgattcacactgacatgctgaaaacagcctctgccaccatgaggcagaatgtcaaagccaaaccatcagcatccaaagtatgccatgaggccagtgcatggagctgaaggaacagccatgtggccctgtggaagctgacagcacagctttctgacccgctttctgacgcaggtcagaaaggcagagaaagggcagacagaaaacagccaagccaccgggactggtaatccacacacggcttttagttggatgtgaaattcagagcaggctttgtttgccttgtgcgagaacacatgcctccaagaaggagcctgtgcagacaagcagcttgaggatcgggaaagaactgactctgaaaaggcattttcatttgtcacgtaggtgtcacatgtgggggaaccactcaagacccatgtttttcgtcatccctctttttgcaggtagtgctcagatagccctccctgcactctgtcttttttggattactttccttagaacattgctctctgcacgttcacgtccaattattgttaatccagtcactggggtgatagagtgagtgtgtgaggcattatctgctcccatgagtttgcttactggtgtcctgttacctttttttttttaatgctatatccagaat

SEQ ID NO: 30189 - DNA, 1219 bp, Homo sapiens
acgtttattgagcccatttggtgccaggcattgtgctcatggttttctataccttcctcatttacttttctttttttttttttttaattttttgagatggagtctcactctgttgcccaggcttgagtgcagcgggacgatctcggctcactgcaacccccacctcgtgggttcaaacgatcctcctgcctcagcctcctgagtagctgggattatagatgcaagccaccacacctggctaatttttgtatttttagtagataggggtttctccatgttggccaggctggtctcgaactcctaacctcaagtgatacgccccctcccaaaatgctgggattacaggtttgagccaccatgcccggctatcatttacttttcaaagcaataggcactattgttcctctttctagatggagaggttgagactcagaggctcaggctaaataatctgcccagagtcacaaggtcatagatggtggagggggctcaaacccattcctctctggctctgaagctgctgttttctttctcctccacaatgtgacctttctcgggaaggatttagttggttcttgctcctcaaaattgacattgctgctggagagtcactggagagtcatcaccacattttgggttgtacctgagagatgtttctgaccccagtaaatggggggtttatgtaagacactctgtctggaaactgtaactgtcagagttggcgttggattcagtggcagatgatggcactacatgttggattatgaatggaaagctttgtataaagtaggaagttcatctcaatcttctgatggaggatcagtttggtttcttttgttagagtgagaagctatgcctgttctctttcatgcatatcaatcctagatttgtcaaggagaaagtagtgttcttcattcattcattcaaccagcagatatgtatgattggtgccaggcaccggggacacaaaggagaacaaaacattggtggcccttgctccccagagcctgctgtctaggagggagagggacagtagacgactgaatgagcatgtacatgaatgcagcaggtgctaaggctaggttgcagaagaacagagtgccgcaaaggaaagcagctggtgggcgggttggagacttaccctgggtggggtgatcaagcctgggcgtctctgagaaggtggcctttaggttgagacctgaaagtactcaggatctca

SEQ ID NO: 30190 - DNA, 1031 bp, Homo sapiens
aaacttgctggtttttgtggcttgtggggcatcacggatcctaccaacgtgggatgtctcccccagacacccagctttaaaatttctctcttttgtactctgtccctttgtttctcaagccagccgatgcttaggaaaaatggaaaagaacctacgtgattatcggggcaggttccccgataatggtgaaaccccttctctacaaaaaatacgaaaattagccaggcgtggtggcacatgcctgtagtcccagctactcaggagactgaggtgggaggatcgcttaagcctaggaggttgaggctgcagtgagccatgagaccctgtctcaaaaaaaataaaaaaagcagatgaaactatttactattgttggaagtcgggataattagtagttacctttcagaaggggcctgtggggtgctgtcaatgttctgtttcatgttccatgggtgtgtttagtttttaaaaatttatgaacattataggcttatgatgtgtgcatttttcaggatgtgtgttctaggtcaatacaagattttaacatgtgtaaaatgaccaccatgagcattctgattgccctcatcccaccaccctaagtgtaaaaagacgtttcctaaaggtctgcaaagacttccaagttccctgaaaatgagactgggtgagcagggcagggttggtgctggagttggtggagtgcctggcaggggtcctccggctgtcagaagagaaccccagggaacggaacagcccagcatacagggagaagcagttagggcaaaaggcccccatgggctcaggaggagctgatgggattgtggcattattcccagcctctaaggcatttcttgtgcaaaacagcatagagttacttatcctcttagcaagcttaaatgcagaatcagacctgtcttgccgctctgctgagtgatcacttaaatagacatacttggaaccaacagaggttgcacgcacgtgaggactcattctccaggctgctgtgtggactggccagctctttcgttcttgcccag

SEQ ID NO: 30191 - DNA, 1034 bp, Homo sapiens
ccaacacttaacagcaacaacctttaaatctgttgccagtctgatgggtgcaaactggtatctcagtgttagtttaatttgtgttttcttaattaacgatgattttgttttgttttgttttgagatggagtttcgctctttttgcccaggctggagtgcaatggcgcgatctcggctcactgcaacctccacctcccggttcaagtgattctcctgcctcagcctcctgaataactgggattacaggcgcacaccaccatgcccagctaattttgtatttttagtagagatgggatttcaccatgttggccaggctgatctcaaactcctgacctcaggtgatacacccgtctcggtctcccaaagtgctgggattacaggcgtgagccaccgtgcctggccaattaataatgattttgaacagctctttgtaactctggtttctttctctgaattggctatgtacattctttcccatttttctatttgatttcctatctttctcttattgatttgtaggattttattgtatactttgaatattaggtttttgacagttttttgtgttgcagatatctctcatttatctgttgcttatttatagtgtcagcaatttaacagaattttgatgaaattcatcaatttttcatcttccattttatgcttttgagatattgtttaagagatttccccccactccagtatcacagaagtactgttttatgtttctcctgttgatgttacaattttaccttccacatttaggactttgatccatctgaagtctttgcgaatgatgtaacttgggatccaatttgattttttccacatgttgatccagttttccaaacactatttactaagtggtctgttttaccccattacttgtagtgccccctttatcatttatccagtccctatatatacatgggtctttctctgtactccctttcattttttttttcctttttttggagacagggtctcactttgccgcacaggctggagtgcagcggcgcgatctcagctcactg

SEQ ID NO: 30192 - DNA, 1055 bp, Homo sapiens
catctgaactgagaaaaccataactacctggtgagaagtcttcctcagggcctccttgagtgcagtgactcctcctggtcctgcctcctacctactaagttgttacaggagatacttttgtagggcatatgaggttttgaagccagggtcattcttttgtctgtatgatgtggatctcaactctttttttttttttttcttttttttgagacagagtcttgctctgtcacccaggctggagtgcagtggtgcaatcttggctcactgcaacccccggctcccaggttcaagtgattctcctacctcagcctctcgagtagttgggattacaggcacctgccaccacacccagctaatttttgtatttttagtagagacggggtttcaccaggttggtcaggctggtctcaaactcctggcctcaggtgatccacccgccttggcctcccaaagtgctgggattgcaggcatgagctaccatgcccggccagatctcaactgtttgtgcctgggctgtaacctggttgggaggcaaagagaccctctcctggacagctgtgtgaactgctgtatggactgctacatggtcttccattgagaggagcacctcctgccactgtgtttctccaggctgtcttcccttggctcatggtggtcttataagtctgaatgtttagtggtatcaaagaagacccttggtggacttggcatcctacatttaggattatttccttaggagagcttcaccaaagtagaataactgggtcccatactatgggctccttaatacagatataaagtcaagtctatttcccaaagagttgtatcaccagctttcaccagctgtgcaatgaggcagccatttctaggtactctcaccagaatttttttgaaattttgtagatttgatcataaaaattggtttcttgtcataatttacagttttaaaaaatcttaaactgtaggtttgagaactgctagcatttcctcttttgtgaattgatgctttctttcgcccagaaaaaaagttaaattgcaagtaaacgggatttaaa

SEQ ID NO: 30193 - DNA, 1978 bp, Homo sapiens
tcttacttgccccatgctcaccctttccatgctgtccccattctctcctttcaccatctctcctctccccctccttcatctctcctccctccccaaactcacttggcataattcacaacctcccacccaaacaatgggcctggtggacgtgcttcctgtgccctccctttagctatgcccacagatcactgagagggaccatctcccaagtggtgcagtttagaacttctctccctttttctccctcattccctctctcttcttgcagtccacttgctgaagaagttgtgtcatttctctggaagaatttccaaaattctggatttcttttttattttggagtatttcatcagctgaaaagtgattctcactttgagttttcttcctatatttgtatagtgagttcctttttccttcctctttatccctcctgttttactttatacctctctattccttgctcaaattattgcaaaagcctctatagaaagtcctctgtgatctgactcctgcagactcttccagatttttctgcccaaggcctttactgagctcaggactccagctaaatcaaaatacgcatgttctcacccagagtgacaaaatcctgcagataggtttaagacctagtggctcagagcagtagctactgggaagttaaaaggaaggggcttagaaaatgaatgggaccaaaggcatcacttctgatggagatgaagccatcttgaaagtgagtggtgtcctttggaggcatggtggatgaaaggcgcaaaggaagcaagaggttaaagataatggcccattagatacaacagcaagcccaagattccgaagaagacagacaactccccctagtaccacctagacattactttttaaagacattttacattattgtccagcagaaaaaggctgtcttggaccatgaaacagtaaactgtaactaaacacttcaacatgaatttgaaaataaataattgtggatataaaagaacaccagagatcagaaattcaaaaactcagaataaaaatgaaaaagctacaagcatatatgagaagagaactgactgaacttgggaaataatttgaacaaaaagataaatcttcacagatatgaatactaaattatatcttaatgaaaatagatatggtcacaagtacattaaggcacgtagaaggtaggagtaagaaaagctaagagaagcaaaacaaacaaagcaatattaaaggaagagccaaaaagacccagaaataaaatgacagataaagaagattgtcaaagaaaagatgatacaggtaagattggaactcatgaagacaaaagataagacagtggcatagagttaatatttaaaattcaaatattaaaactcaaataaaccccaaagaacttttggaaaacaaaagaaaaccttaaactttatcttgaaagggtctatcttgttacttagaatattgaaccagaatgattagctctgagacatagcctaccaactatactttgaagccaaagaaaaagaactatgtaagcctctaggccaaaagacctagtctcttacaaaggaaagacctggttggcctcaaacttctcaacaaagcaagatagcaatggggcaaccttttcaagaaactcaaagtatgaactgaggatttcatatttcaccaagctgtcctttaagtatcaaggatataggaagaagttttaattacacaagagcccagggactattatactcacaacttcttccttagaattctactaaaagacaagcttcatccaactagatgattggggaaacttgagcaaaaggactggacatgaccattgaatatctttgtagatctgaggccaaatggaagtggggataagggtggaagaaccgtattagtcccttctcacactggtataaagatagtacccagctgggaatggtggctcatgtctgtaatcccagcactttgggaggctgaggcagga

SEQ ID NO: 30194 - DNA, 1051 bp, Homo sapiens
ttattgtctgttatttataagagacacatctaaagtaagtgattcaggagaggctaaaaaaaaagagatgggcaaaaatagaccagacaagtaggaccacaaaaggcaaagattacagtatccatatctgaaaaggtagaattcaggaaaaaatagacaagacaatgaaggatacattaaaatgctaaaagccacaattcacaaggaggatatactatttatgagtgttagagcttcagttatctggtttgtcaactttaagtgatattctttggctcctgcctatcccctgtacaacaaagagctctttctactttcctctttctctctccctcctttttcattgtttccgttgtgttacttctgccttgtcaaagcacataacatttgcataacaaattatgcaaggaaaaatgaatagaaacctagaaataacagagaaatttaaaacacctctctctcatccaagactgaagttaaggagacaaaaaatacatataacgatataagtgatctgagtaacagtatctataaagtagatctaatgaatatatgttgaactttctaccttgataatagagaatattactctagggcaagcgtgatggcccacacctgtaatcccagcactttgggaggctgaggcaggtggatcgcttgagctcagaagttcgagaccagcttgggcaacatggtgaaaccccatctctacaaaaattagccaggcatggtggcaggagcctgtagtccctagaaatttatgactcttctaggaatcaagattgttgtcccacagcagcctcacacacctggcatagcagtgattaaactcattgggagctatctcaaaaataattgtgagtgaggcttttggtacatagagtagactccaatcagacacataaaacccacagtacattttaggaagctatactaatggcattaacctggattaaaagggactaaatgttaaaagaccctggacccccaactttctatgggcaacaagcaggcatagttgctcaaaagacagtttctagcccaggcatag

SEQ ID NO: 30195 - DNA, 1055 bp, Homo sapiens
taatttttgtatttttagtagagacgggatttcaccatgttggccaggatggtctcaatcccccaaccttgtgatccacccgcctcagcctcccaaagtgctggaattaacaggcgtgagccaccacgcccagccataagaatcaatttttgtttgattttgtgtcttgcaactttattaaattcacttactagttatggtagtattttgtattagtaggatatgtagggtttctatccatcatgtcatgtcatctataaaaacaaagacagttttcttctcttcaatctgtaagcattttatttcattttcttgcctttctgcaatggctagaatgtctagtatagtgttgaatagaagcagggagagcaataatccttgccttgttcctgatcttagcggacagcattttatcactaagagtgtgtgtgtgaatacgccctccatcgggctaagaaatttccctttcatttcttgctggaggtggggaggaatatttaaaaagaatgtgtaggtttgtcttgaattttgttaaatgttttgcatgtatgtgttatggttttggtattatgtgttccttaaatatttgattgaattcaccagtgaaaccatcttagttagatgttttctttgtggaacttttaagtgaaaactcaatttacataaaaatatatggcccttcagattttgtacttctttttgtgtcagtgttaataatacgtatctttcaaagaatatccccctttttttttggtagagatagggttttgccatgttgttggtagcaagccctaaccctgtcataaacaggccttaaataaactggccataaacaggatttctgcagcaatgggacatgctcatgatggctgtcatgcacactgctaaaagttgttggtttactagagcagggcaaggaacacctggccccgcccggagcaaaaaactgctcaaaccacaaacgatagcaggaaaggcctgtgccttggcagcatgtttttgctgcagataatcagccagagcctgtttctctgctcctcgctgagattgctttg

SEQ ID NO: 30196 - DNA, 1034 bp, Homo sapiens
aaccctgtcataaacagaccttaaagaaactggccataaacaggatttctgcagcaatgggacatgctcatgatggctgtcatgcacactgctaaaagttgttggtttactagagcagggcaaggaacacctggccccgcccggagcaaaaaactgctcaaaccacaaacgatagcaggaaaggcctgtggcttgacagcatgtttttgctacagataatcagccagagcctgtttctctgctcctcactgagattgctttgtttcccataaagaatgcttttagctaatctacaatctatagaagcaatgcttatcactggctttctgtcaataaatgtgtgggtcaagctctgtttgtggctctcagctctgaaggctgtcagccccctaatccccactttatactgtattcctgtgtctttgtcttaattcctctagtgccgcttcgttaggtctccatgactgagctggtcttggcaccatgttgctcagactagtcttgaactcctgcaatcctcccacaaagtgctgggattacaggcgtgagccactgcacctggccacaatcttccattttaacttgtcaaatttattagcataaacttgtttaaatattcctttattatccttgcatgtctgtagtacttgtagtgaaagaattccctttcatttctgaaactggtcatttgtgttttttctgaatcagactagctagaagtttatcaattttattgatcacacttttttcctattttattgatttccattctttattatttacttcaggtttaatttgctctgcttttcctagcttttcttttcttttctttttttgagacagaatctcattctgtattccaggttggagtgcagtggcatggtcttggcttactgcaacctccgcctcccagttcaagcaattcttctgcctcagcctcctgagtagctgggactacaggcgcccaccaccacacctggctaatttttgtatttttagtagagacaggtttcatcatgttgggcaggctggtc

SEQ ID NO: 30197 - DNA, 1014 bp, Homo sapiens
ctgaacgacaattgagtcaatgaagaaattgagatggaaataaaaaaaaattctttaaggaaatgaaatataccaaaatctgtgggatacagcaaaagtagtgcaaaaagggaagttatagcagtaactgcctacatcaaaaaatagaaagatcacaagttaacaagctaacaatgtacctcaaaggactgaaaaagtaagaacaaaccaaactccaaattagcagaaaaaaggaataaagatcagagcagaactaaatgaaaaacagactaagaaaatacaaaggataaacaaaacaaaaagtttgctcttcaaacagataaacaacatggataaatcactagccagactaaccaagaaaaaaagagagaagacccaaataaaatcagaaatgaaaaaggagacattacaactggtaacacgaaaatataagagatcatcagggactactatgaacaattatacatagacaaactggaaaaaacagaagaaatggaaaaatttctggacacatacaacctaccaagtttgaaccaagaagaaatagaaaacgcaaacagaccaataacaagtaacaagattgaaacagtaataaaaatcttcttaacaaagaaaaaccctttactggatagagttacagctgaattctaccaaatgtaaaagaactaataccaaccctcctaaaaactattctgaaaaatcaaagaagagagaattctccctaactcattctatgaggccagcatcaccctgataccaaaaccagaaaaggccacagcaaaaaagaaaactacagggcagtatatctgatgaacattaatacaacattcctcaacaaaatactagcaaaccaaatccaacagcacatcaaaaagataacacacctgggctgggtgtggtggctcacacctgtaatcccagcactttgggaggccaaggcaggcagatcacctgaggtcaggagttcaagaccagcctggtcaacatggtgaaaacccatctctactaaaaata

SEQ ID NO: 30198 - DNA, 1021 bp, Homo sapiens
aaattagatgtacattggaagagtcattagagtttaaaatatttaagttccaatgagggatggtagagatgttgatttaggcttttagtataagtgtacccattaaagtttataggcctagcttacaacggaataggaatgagatgtataactttaaaagtggctaaaataggaaattttaaaagataatccaaatagaggtaacggtagaaaagaaacaaatttaaacatacccagtaatcatatatataaacatacccagaaatcataaatgtaatgagaccgaactctaattaaaagatggtgttagattgaattggggggagggaagagagaaagattttttgtttaagttagaaaaggtaattttctctaatactaacacacgaaatgtcatatagctatgttaacatcagataaaatggactttttggcaaagagcattcattacaaatgaagagggttactatatagtaagaaaaattttattaccaagaatatataaaataatttctgtaactcaaaggaaaagtaatccagtagaaaaatgagaaaagatacaaacaaacagttctcagaaggaaatgttagtaatcacaagaagatgatcagtctcacaagtaatcagggaaatgcagatccaaattgtgtaccatttcacactcaccaggtgaaccccaggtgggggctgtcatctgttgggaacttggattggcacatccactttggagaacagtttaacagtatttagtcagttgatctttagactctatgacctagccaagaaacgcccacacatgagtgcacacacacacgcacacacacaaatgtaaaaaagaagtcatgatggcattgctgagatcaacaaacataaataacctgagtccagtaggtgagtggatacttaaagttatgtgaggttataagcttctgaaataaatgcacttcagggctgcaggagaggcagcagtatataaagaacatgcactctagagacaggctgcctggggtttgaagcctg

SEQ ID NO: 30199 - DNA, 2579 bp, Homo sapiens
tgaggtgctgagctgtggatgcagaaccagcgccatgctgaagagcctcagccacctcctgtcctttgggattcgtttttcccgctttctctttgtttgtcgtctcagaatctgtgacacaaagaaacccatctcctgtcttaggaaacctaatgctgcaaactctacctagaggaacctttgaagactgttacataagaacataccttcctcagaagaggagtttcctctgccctctgcccttctcccctgcctccctccctcccctccttttattttgttttagtgagcttaagaaacagcagatgtgtctttcacggatctaacgggtgttgtcctgatcgagaaaaaaactgggatgagaatggtttggactggagttggaaggggaggacggtactgggggtagggtttggaacagagctacactggactcgggcacattcggagcagcatcctttagtatggaggctacttctcaggtaaccaggaattgaggggaaggaccttgtggaggccgagcattaacagcaagagcggggtttggagaaagtctgagattgggtgcagccctgacttacctgctggccctgaccagtttcttttcactaacttggccttgggcataggatgaaacattttttctgccctaattttaaaactaggtgagggtagaatcatcacaggttaggaatacattcttcataagacacgatgctgtaaatacccttaatggacgaaaagttgaaatacttttgtttcctcttggagcagttcagggaaatgcccacaggggattgtcctgcacagatagggcaagaggatttcctgggtggagtctgccaaggcctgcctcgctggggaccccagagtcctgcacctctggttccgccccaggtggtgacattactgtccccgttctgtggctcgtggacaagactttctccagaccccttaaagtggtacatattctaaaaaactgtttttctattatgccataaccttgctctagtcagtgaatgttcctaatgctgctgtttcaacatttgaattctttttaatttatgaaacatgctaaattttttttttcaaacaaaacacacacatccacatatacacatgcttcgctatgtggcttccaaggtttaaattttgaaaagtaaaagaattaaaacttcacgaccacagatcacctcaaaccagaaatacctcagaattttctacttatgtaaggtttattatatattttgttagttgtgttgtcttgtagtaagtatattttaatgtaagttggcttttgtgacaaggaagtttaaaagaaatagagaaaaagaaaaaagtttgcatcttctagggagtgctaccatttttgtttgataacgcccccttgtaaataattgtcatcaactgtaggttggctgtctgggccaagtctgggcatttatcagtcttgtttgtgaaggcttttccttctggtttctttagatcattttatttaaaaacagtgcatctcttcatcgtgagggtaggcaaggcgggggccgtggggagaggttgacctgggtgagaactgaagaggccgcctcctcttgggttgtttggagcttcacatgtaattcacatgtaacatgtaacttgatcggtcagtgttcagaatgacaagtaaccccgcttaaacttggtagaaggatggcccttagacctgaatggggtgattttacttgggatttaacttcttcagcaaattaacagcaacgttggaagagatctgtggcgcctctgtgaagcacaccgtgactcaggccagtcttttagtgcagcgtgtctgggagtgaagggttttgcccttgctggtcttggagtccacagtgtgaggggcactgcacatgcctgggcatctacctagtgtgctatgttcagtgtctggggcttactgccccggggtcctttcctctgggtgttggggcacagggtgctatgggaggcccatttgcttccctctcggagctcagtttttgcttcatgggtcaaaatgtgggctggccaagtggttacaggaacagggtttcggtaagctatgttgtctttttttttttttttttttttttttttaatggtttgattttgtgctgtggtattttttttcccttagaataatttttaatggcaaaacaggccttacagcagttgcttttctttaccatttatttctttaagaagctttaaaatatttattgaaaagtgccatatctaatttctttagctttcgcctcaggcagtgcaggcatctttacttttcatcctcagaagaaacaaacgactaacaaatgtagcaaatttactgcaggaatagttaggtcatgatactacctgaacactaaaccccagcctctttgtttggttttagttcctctgggtggtttttcttttgtgtgctggcttgattcttgtgagaagttttgacctggccaagggagggttgagccatggttctggtgtgggactttgcggtcaagacacagtacagacaggtcaggcctgcgtgccttttctctgggtggcctccccgttaggcccac

SEQ ID NO: 30200 - DNA, 1028 bp, Homo sapiens
ttaatctagaatgatttccctgccaaaaagtgggaggagtgtctttcatgatattgacaattgttgcgtaaactattggtgattatgtcattaagatagtaattctcaaccttggacactcattataatcacctggagaagtttttgcagtcctgatgcccagacctgaacctcatacttacaaaactggaaactctcagggatgagacccaggcatcaatatcaatatttttaaagctccctagattattccaatgtgcacccaagattgagagcgactgcttgaagagaaggtacttgtagcattggcagttagtatagatcagtgaggaaattacagtgaggtagagccttgtatatttgggtgaaaaatgtgaagtgaatgaacacatagtggccagatattcagaagaacaaggacgttttctctgccacttttgaactagtatgtttgtactgtactaaaataacttttgtgaaaattgatctctattgagaaactctttgccagaggcttaaaaccagaatttgcccttaagctttgtgttggaaatatttagttcttagaattcacgttataggtttggattttataattgataagcctacctgactacttactttatagtcctcattttgaataattattataagagctttctgtcctggaataattatggctttcatttattgaaacaagtagtcaataattgcctagcactaatgtttaaataagaaagtgtttttctgtgtctttttaataaaatatcttttaaaggggaaagcatttcagtgcaagttactatgtttctttctttacagaaagccatggctgaaaccttttacctttctaacattgtgcctcaggattttgataataattctggatattggaacaggtgagggatgagagttttaaaaacatgattctatggaagataaatgaagtgacaggagaatgtactgatgtgcctattagctgtttctgtctttgtttttcaaaagctaagcctctgaaggtaagtatg

SEQ ID NO: 30201 - DNA, 1089 bp, Homo sapiens
ttacattaaagtgtgacatgctgtaatagaggtaaacacacacagtgtggtcttgtgaaaggactgatgggctctactcatatgagtcaggaacgcttaaaagaggaagtgatattgagctataccttgacagataagagtcaggagtggaccctgaggattccagaggatggagcaggatgagcacaggacatttgtggtcaacatcagggttttgagatttatatatcattcataaaaattggagcttatggtacaaaacagtgtgggtggctcaaggggtatgaagagttccataacaacaggtggacgggtgagataatatgcgactttctattctatgatgaagacttgggttttaatttttaggcactaagaagtcatagatttgttttaagcgtgggagaaatatgatatttgggttttataaagagtattttggcagcagcgtgtaaagagataggtgggaaaagggagcatttgaagaagagattagaggcaaggagatgagttaggacatacaagcagttggagtgaggaataatagaggaacacaggaaagagtaaccatgaataaataacttgtttgagtgaggaagagggagaagttccaggataacaactagattgcagaccaggctcagtggctcatgcctgtaatcccagcactttgggaggccgaggcaggcgatcacgaggtcaggagttcgagaccagcctggccaatatggtgaaaccccgtctctgctaaaaatacaaaaattatctgggtgtggtggcgtgtgcctgtagtcccagctacttgggagtctgaggcagaagaatcgcttgaacccaggaggcggaggttgcactgagccgagatcgcaccactgcactccagcctgggcgacagagcaagactccacctcgaaaaaaataaaaataaaaataaaataaaaacaaccagattacagtgttacagtgagttgaataaatgggaagaaaagcttttcttctagaagcttcttttttttaatatgcaagatatgtgagcacttttatagactgaaagagagattaaagataggagagtgtaattagtggtgt

SEQ ID NO: 30202 - DNA, 1426 bp, Homo sapiens
tctgggttcaagcgattctcctgcctcagcctcccaagtagctgggattacaggcatgcaccaccacaaccagctaatttttatatttttagtagagatggggtttcaccatgttggccaggctggtctcgaacccctggcctcagatgattcacccacctctgcctcccaaagtacaggcgtgaactaccaagcctggcctatttctatttctttttcctgttccagggccactcattgtattcagtttccatgtctctttcacctcctttaatctgggagagttcctcagcctttctttgtgtttcttgaatttgacaattttgaagcgtgcaggccagttatttgaagaatgatgttgctcaaatcctgttggatgcgtcctcattatgactttcaggtgatgtgttttggggatgattgctgaaggtgatgtgtctttctcagagtcttacatcaggaggcacattatgtcaacttttccacttgttagtgatattatctttgatcacttagtttaagtggtgtctgttccccctcctgtagaattactattttctctttctaagtaataagtaattgtggggagatagtttgagactatattcctcatcaaacttatacccactagtttttgcccactaataattttttacaccatcattacttctaaacttactagttggcccattcatactggctcctgtgtcttttgacatttatcttcatccgtctttaagcacttttttgctttctggcacaataagatgttccaggttttctggtgttttcctggctctagccctgaatcagccatttcatcaaggagccctggttccttttaatggagaatgatatttagaaaccaagatttgggtgctgtaggtgctcattcatatggtgtgttattgcttccagttggtcctttttattatccattcatttggatacaatggtgagggcgccactgaagaaagtgtggcttagggatggaaagggggaaaggagccagatgacctaggtagagactcccctctccccctctagctctccaggtcttccccactttctctttcctccctttccctcttcatcatgacctcatttcccttttcttgatcaaaattcctctggagattccagctgtgggaacctctgaaaccacttctgcagctacacgtgtgataccagaggcagacaactatgtgacctttgtgtgtgaaaagccaaaggcaaagacaatttatgagaaagtttttgctgagaacaatctggtgacagggtgattggggaagacacatttggaagatttccacctggacgtgttccttttccctgcctgaaaagcactcagagcagagcctgtgtggaggctgggatagggtgctgtgggaggtctgttctccagataagcctcttcaaggct

SEQ ID NO: 30203 - DNA, 1680 bp, Homo sapiens
gagaaagggtggcaggtagggctggcagaaggcagatgtgtggctttatagtgatcctatgcttggggctgggtgggtttcagctggggtgtgggagcagagaaattggctttgggaggctctgtgatgggggccttgcagcaggtgggtggtgagggcagcatggaggtggtggctggcctggaagggaggaggacactgggtggctggggtgccaagagagtcctggtgggggctggtagctgggaaggctgggcagggctgcccgcaatcaagagggtgacaatgagtatgaagagtatgcttagtggaagtgaaggcctgggaggctgggaggaccagaggttcgtctcccccagccgcgcccttgctccttgctctcatcttcctcacccttcctgcaccctggccgcttgggacctcctcttctccctgatctggtctttcagaaatctctggcctctaacctctataaccccttcctctcccagcctcccagccctgtccactccccgagtcacatccccaccagccctcctgccctgcctgcagcctgggccctgctgagctgccgtgcccttctctcatcacctcctcctcgctccctgtggcaccttggcaccagccccagatctgtgtgcactgatttcccaacattcctgtcctccttcccaccccactgccccaaagggaggggctcaaggacttgagacgcttcccttggggggcccagctttcccccagagtcagggagggatgaaggcagggctgctggagggctgggcccgcagacctgtggagctgcctagtgggaggtagagggctggagtgggagagcatgcggagccaccgtgggggcaggagatgcagccctgcaaggccacactgctctccccagcttcccactgtctattggtcttgcctggtgtcacctgcccttcccagctctgcctctgacttctgcatctcccctgatcctttcagtttctcatggtccttcttatgggtgattaaggagttgggccctaggccatttctggaaggcaggagttggaggtgagcttcctgttgccttgtgtgtgtaactctagagtcccgtaggtgggtggctgctggacgtgccctgggaggggaaagggacctgtaagggtgtgtccataaacagagcgattctagaactcagggatgctactgtggacaggacttagagattgttcagcccccaccctcttccacaaccatttatagatgaaaacattgggctttaagagggaaataggattgacatgaacgagtcacgtaggggttagtaatcatcatcactgtcatcatactagacatttattaagtgcttactatatttgagggatcattgtaaattctttacaaatcttaattttcatagtcctcacactaccctgggaagcagctgttgttattttccccattttacagacaagggaacagagactggaacagtgaggtcagtttccccagatcacacagaaagcctgtgtcagagcagtggaagtttatcacacacagggaggcttgctccttccaatgatgatgtaagcgtataagcattgttgagagctctttaaaacagtggcagacatttcaccaaagaagatagaggaatagccaataagcacatggaaagatgctcacattatgggc

SEQ ID NO: 30204 - DNA, 1064 bp, Homo sapiens
cttagcacattttcaaggttcatccacgttatagcatgtgtcagtacagtgtgtgtgtgtgcatatatatatatatatatgcacacacacacatcacattttatttgttttgtccattgatggatatttgggttgtttccacttttgtaacattattgtgaatgccacaatgctgtgaacattcttgtacatagaaaaggttttgacttgtatttggccagatcaccattgctcttttccttcgtaaagattaccatctttcttggcatgttggaagagttttctctggcaagggactatgtaaatattcacctgtcttttaaaaattatttttatgctggccaggtgcagtggctcacgcctgtaatcccagcactttgggaggctgaggcgggtggaccacttgaaacccagcctggccaacatggtgaaaccaccatctctactaaaaatgcaaaaatcagctgggcacagtggcatatgcctgtaatcccagctactcaggaggctgaggcacgagaattgcttgaacctgggaggtagaggatgtagtaagccaagatcgggccactgctttccagcctgggtgacagagcaagattctctcaaaaaataaaaacaaaaattatttttatggttattaaatttcagtctttaattcatagaaaaattcgtttttggtttaagatgtggagaaagggtataattgttcctaatagaatcactataggtacttgagataattttttttaattattatacttcaagttctagggtacatgtgcacaacgtgcaggtttgttacataagtatacatgtgccatgttggtttgttgcacccatcaacttgttatttacattaggtatttctcctaatgctatccctcccccagccccctaccccccaacatgccccagtgtgtgatgttccctgccctgtgtccatgtgttctcattgttcagctcccacttacgagtgagaacatgtggtgtttggttttctgtccttgtgatagtttgctgagaatgatggtttctggcttcatccatgtccctgcaaagga

SEQ ID NO: 30205 - DNA, 1065 bp, Homo sapiens
acatgttttgaatatatgcatttggctcagtttgatcaaaggaaggggaaacaagaacttagaatttcacatcctcatgtgtaacctacagctggttgaggaatcattgagtcccatcgactgaggcttactctgctgaagattctctgctggccaccaggagtgagcaacaatggcgagtacctcctgccagggactttgttctggctgtcagattcacccataatgatatgtggaatttaaatctctcacatgaggatgacatgcttccttgaaaaccagtcttctgatgttcctgtcagagagagggtgctgttgccccacccatggtggcttttcttttacatcacctgacacactttgatccctgtcagaattgtacagtggactttgagctaaagaaactgatggaaaaatctttccacagagggtcaagaaagctaggttctggggtgggctctgctgcttaacagctatgttgctgtgggcaaatcatttccagttagatgggatactctcagccacccaaataagcaataaggattaagttatcaaaacagtggtatagtcatgcaccctttggatctaggctttgggtgaggagtataaggaagacatcaccagaaatcacgtcatccttaacatcagactgcatgggaaaggtagggcagggcatggctacttcctcatccagagctcagaccacagcacctgcagcatactcagtggacactctggagttgttcagatggtgcttggtgagcagctctactattcaggggcccttaccaagtttcaggtgggggtactaaagacacatgggtatggtccctgtccttcaggagctgatgttctggtatggcagagagttacttatggaaagcattctgagatagaagggtgctaggagagaggttccacaaatgctataggatttcagggggtcagatgcttccagtttgatgaggaaagtgtcatgaatgaattggcacttgagttggtatcacccacctgtgctgggtcaaaagtttatgaagaaagcagaatggagctaggcgtgatggc

SEQ ID NO: 30206 - DNA, 1035 bp, Homo sapiens
tgaaatctgttgccctgcttggtttctgccaagggctgctgcttcttactattctgcagtaagatgaagtcctacctggaaaaccaggcagaaattgtgttgcctttgccttcagtaatccccttaaggagaaaatatatggacctgatttcagccttcagaatctccaaaagaggagtcatcaattcatagagcacactagggtgttaggagagagctttgcatactctgagaggctacttggaaaggcattttcccaggagagctctgtcaggtggctgcgcttcagccccacccctacaccacagggtctccttgggtatgttcttgggcaagcaatcacaaagccagagaagctgtaagctgcctgccgggcctgaggagctccaaccagggaagactggatgtgaggagaggagtcactgtcaccaggtcacagactgactgaggtgatggtaggatgaggaggaacagatgcccttctttaattggttctcagttaacttctcagaggctctggagaacgggacagtggctttctagcctctgaatgttccaaataaaattttttggtcttggcccctgtactgttttacctctaaattctggcatttttttttccctgcaattaaagtgctgtactttatttattgaactttatcattgaaagctgtttggaaaacctaaaagatgttgtcacacttctgttttctttacctgtgccttataaaaatggaccaaacccttttctaaaataaaatagttctagggtggctggttattgacctatgtaggtccctaaaacctaatttctgttcaaaaaagcagctttactgaatgatgcaaccatcactataaatcagtttaagaacatttttattccccaaacagatctctcatgccttttgtaattaatcctcattctcagccccaggccaccactgataggctttctgtcttcataaatttgccttttctggatacttcatataaatgcagtctgtaggccgggtgcggtggctcaagcctgtaacc

SEQ ID NO: 30207 - DNA, 1050 bp, Homo sapiens
ttacaggtgtgtgtcatcacgcctggccttctaacttattgttgatattaaatgtaacaaccaggctgggcacggtggcttatgcctataatcccagcccttcgggaggctgaggcgggcagatcacaaggtcaggagttcgagactagcctgaccaacatggtgaaaacctatctctactaaaaatacaaaaattagctgggcatggtggcacgcgcctgtaatcccagttacttgggaggccaaggcaggagaatcgtttgaacctgggaggcagaggttgcagtgagctgagatcatgccattgcacaccagagggagactctgtctcaaaaaataaataaatacatttaacaagcagcagggcacagtgggtcacacctataatcccagcactttgggaggccaaggccagtgagatcacttgaggtcaggagttcaagaccatcctggccaacatggcaaagccctgtctctactaaaattacaaaaaatcagccagatgtagtggtgtgcacctgtagtcccagctattcgggtagctgaggcacaagaattgcttgaatctgggaggcagaggttgcagtgagttgcaattgcaccactgcactccagcctgggagacagcaactctgtctcaaaaaaaaaaacaaaaaaaagaagaagaagaaaaaaaaatttaacaatccactgtgtcttaaatttcagcttttgtcaccactccctccaaaaaaaggtgcctcaatgcaacagcctctaggtagaactagcttctaagttcttctctgctcctgggagccattagcttaggtagtcaggaaataccctaggccgggtgcagtggctcatgcctgtaatcctagcacttcgggaggccgaggcgggctgatcacttgaggtaaggagttcaagaccagcctggccgacaaagcaaaaccctgtctctaccaaaaatacaaaaactggccagatgtggtggtgcgggcctgtagtcccagctactcgggaggctgaagctggagaattgcttgagcctgggagcagaggttg

SEQ ID NO: 30208 - DNA, 1582 bp, Homo sapiens
ttccgtaatacacgacatgtatgggttaactttctgtttacccttcactacactgtaagctcaatgcctgacactatagcagatggagtttttggttgcttttaagggtgtgccctacttaactcaatggaatgaaaagaaataggttgctctcttatttcagattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggttagtcattgctttaattttttgttactccagctgtaagtacaaattttgagcttgctattctcgtggttagttctgggtaatttctttctatcttccttaaatgaagccagacccctacgttgaaaacatactttaaataaatgttcttgttattgagagaaaagatttctgctccaggggaggaatatgtcagttgtctgagttacgggacttgggttgggtcatgaacatgagaaagttcattggctgagtttctaatagctcgcatagtgccttcaacttcataggtacttacacaggctattgaactgaattttgagtggaaagtggggtaagaggtgggaatgaacaatatggtttggaagaaccagaggatggaaggcattaagttggctaaggcacttacttattttagagataaagctaccaaggacttgggagtgacatgctgtaaaggagttttaggatgaatcttgcatcagtgcagattataaaagggaaagagtggcagaaagccaggaagtggattattaagaaccaatgatggaataagtacagggaaagagaaaggaaagatggatttagccaactgaatctaggctgcacactattaaagctcagggtggaggccagtcttggctcatgaacttctgagtgtcggaagtgtgctatatcaatggcaggattttcgctaacaccagtagagcttgcctctatgactggagtttggtagtactcgctgccacatagagtaaacttgagaagaatgtttgcacagccaggtcaagtgttacaaatccttctgccctcacttaggcatctatatcataaatctcaagaggacctgggagaagcttctgctggcagctcgtgcaattgttgccattgaaaaccctgctgatgtcagtgttatatcctccaggaatactggccaggtttgtggaacagtggttagtttttatattatagaaataaagcttacagacattgtgagacatagaaagacataagaaaacagaaataactcaggccgggcgcggtggctacgcctgtaatcccagcactttgggaggtggagtccggcgtattacgaggtcaggagatccacaccacggtgaagccccatctctactaaaaatacaaaaaattagttgggcgtgggggcgggtgcctgtagtcccagctactcaggaggccaaagtggagaatggcgtgaacccggtgggcggagcttgcagtgagctgagatg

SEQ ID NO: 30209 - DNA, 2615 bp, Homo sapiens
taatttgtatttttaagaaatgactagttagtaaaacttgaatcttttttgccacagctctattttaataatttttctgttgagaaaactagtagatttcttgaattctaagagttctaacagggattttattcatcttaactattttgacagatttaaaaattatgtagtaagactttatttcaatgttgacaggacgggttcccatgtgtgtttttgcagagggttattcctgaaactgacttgttactaggaccacatagtttggtacacagtagaaaaaaggcagttagttattgctgtagaatgaactgagtgacagttcttgcttgcttgagaaaaatatactgagcatctagattgggccaggtagtgttgctaggtgctcgggatatatagtagaaaaacaagcctgtcttttttaatgtatgcaggaaatctctggagaagtaagagaggttaaggaaagctgggtatgtgcctgctttacatggagtagtagtgattaagttggccagtgcccagaagtgcttactgggtgccaggattgttgctgtggaatatcgagtaccactaacttttaaattcttcaaagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaaggtaatgattttaggatctagagtttgtgaatgcgtgctctagaaaaaacattcctgtgcacattgttagagcttggagttgaggctactgactggccgatgaactcgcaagtgtaggtagtgtgctacatgaggggcaagttttcgctaacaccacaagggtctctggcccaatgagtggagtttgatagtaattcttgctacaagtataacattactgcatgacagctttgtggagaaatgaaaacatttggaaaatagtgtgttcttctgcctttgtccatgtttcttgctcaggcctcaggcacttggcctttgttttcacaccaacttgatgggttctactataagatgctaaaaaggtgggttgtgtgtggttcagattggttgatttgtaaccctagttgtgcataagaattgcccagatattttttttaaatgccagtgtccaggcatttttttttcaatccctatgattccagtgtgcagacaaggttgaaaatccctatttataatgctccctgttacaattgcttttcaactaagagatgtctgtacttttggtacctagatgatgtaagagccaggaaggtgcttgctgtttgggtttgaccaagtgtcactttttaataatctgccactcttggcagggagctcactcagtgggtttgatgtggtggatgctggctcgggaagttctgcgcatgcgtggcaccatttcccgtgaacacccatgggaggtcatgcctgatctgtacttctacagagatcctgaagaggtaagcttctccaaaggcttgtggttacataagcaaattggacgacttggactgtgcttctaggaagcaaaacttgtcagtccctgtaagtctttcctcttttttttttgtaacccagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactggtatgtatcaggatagaggtgaatcaagctgatattttgcaacttctcagttttattctaactttaatgatctctgtgacttttatactagctttaagaggttttcattccagtgtgctacagcatctgatagactgctgttgggagtggggtaaggaaaaatactacattgaggacagagctgatggctttttttggtattctcttaacagaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaagcccactgtagatagtgtatattgcttttcacttcagaatttccctgagcttccttcctgtgtggagaacatgtgtgctgtgaaaatagatgtaagtggttacacatacttagttggtaacctcaggaatacttttccgaggccctgatgatcttgcttttattaccatttgcgtaggtaagttctatagagcttaggtttttatttttgagagtcttcctgtcacttagg

SEQ ID NO: 30210 - DNA, 1030 bp, Homo sapiens
ttaaatacgtgaagcccttgaacagtgcctggtttgtatctcattccacgtgtttgctattgtaatttttttctagggtatttgttctaatttcttcttgtctttttttagggtagtccatccatttcccgactctattaaataaaataaaataaataaaaatgctccctgtgttgtgatccatgctactatacatatgtatagtatatatgtagtgtatagtatggaagttcatactatacttccagcttaccctccgaagtggctcttcaccaactatgtgtgagagttcctgtttgtctacggactctcttaagttaatgtcaggctatttaacttttacccatctgattcttgtagaatggtatcaattgttataacctgtgtctttttgataattggtgagtttgaatgtatttttatatgcttatgggtcatccatgacttcctcctctgtaaactgcattttcatatgatttgcccaattttctttcgggttgttttttcctaatgatttgtacgagttctttaaatattctgaataggaattatttgtatattatatgtgttgcattctcccagtgttccttaacttttgactatgtttattgtgtcttttgatgtacagtagcttttttttttttttttaacttctgtttttagagacagggtctggctttgctgcccaggctagagtgcagtggtgtgatcatagctcactgcaacctccaactcccaggctcaagagatcctttcatctcagccttctgagtagctgggactataggcatgtgacatcatgcccagctaattaaaaaaaaaaaaatgtagggatagtcttgctgtgttgcccaggctggtctcgaactccatcttggacctcaaatgattctgcctcagcctcccaaaatactgggattacaggcatgagctaccatgcccagcctgtagtttttaattttgatgtaatcacttttccttgcaagttaattttatcaacattatttgttgaagaatctatctgccccct

SEQ ID NO: 30211 - DNA, 1026 bp, Homo sapiens
agtgacctaaagaacattaaatttgacatgaaactttttaagtatagaactccaaaatccaagcaagcaagcaaaaaactaaacagaaggaggaacatatcctcccaaagatgaggtatatgggccaatgcacctatacttcctgctacatttcagtcatcatttgtaaacctacatatatgacttaactcactggagtcctgataaaatagttgagaaaaatggtatttctaaaacatttctccagccatagatcataagatatataatgactatcacatttgcccaaaatgtaataaaaaaatttatacagttcccaaagacattttccccttcctataaaggcccctttgcagcatgacacttagattttattcagctaccaccatcacaagaatgcaaatgtgttctaatggtgatttacatattttgtcattggatcataacatttctacatggaagaacaaaggccttaacagtaagtaaaattatctttaaaaaattattctaactcgaggaactcccctggaacttcttagcaacagagtcacttgctttactagacagacaattcaatcagtacaatcagtatataaaatctggctcgtcctccaacatatccattatacttattatccccagtcatctggttagtaaaaaacacaaactaaataataaaactcaattgacaaaattaactgaggctttaaaaattccttggccaaaagctcttccattgattttgtataacctaagatcaaccccttttaatagacatcagttgtctccatttaaaattataacagataaacctataaaattcactcaaaaaattatacatctctgatattaaatggagacatattcaactattacaatggcagctaactaaaaattatatactaataaaaaattattttcatggtgagcttctgggagacaaaaatttaaagaccatgaatttcaaccaagagattttatttactaaaagcagtatcttttaaaagactctctccaaccaaagta

SEQ ID NO: 30212 - DNA, 1035 bp, Homo sapiens
agggaaaaacagaagttttgttaacatgtatatttcatacatacgtgggagatacctagagaaggagtaactatcaaagaggtgactctgaattgcactttatataacatcttcaaaaagaacagtaaatttttagagaagtgacaaaacaaagtactttgagtctccagcggcagcaacttgtgggaaggcaaataaaggctagttagtaaagcttgttaatgtagattcctctggtgccatctccaggtccataagggtctaaagttgttttcattggttaccctttgttcttcttggtagaaaagggagatgagatatattatgtttttgtaaatttatgtcctgattttaggcaaatagagggagggcagagagctctcaggtatctgcttctttcttgccttcagctcaacaatgctcctgtcaaaaaggtgtattgggggtggcatattatgacctctcacagttacaatagtatagataatagatagtgtatatattgatagtctagattactgtgctttacttataagtacaatttagatcataaatcaaatagaaaaccagatggaagcattttaaaaattcatcttggagaaggttcaaaaggtatctgttgtccttgcacaaaagaaatctgtaccttcaaggtcctgggaacactagcaatagcacactgatttggcataagctgaccatgtgctaattgggaacaggactccttagagatcaccaagaaatcacctcattattcagccttggtcacataattaaatttgagtctaatgctctaatctttagatgattttgaattaaattcttatttattccttatgacaagcactccgttctgtcttcgtggatgagactcccagctgggaataaaaccaggttggaggttttgttacagtttatcatattatacctatgaatgattcatgtgccatctgttgaccataaatccagttaaggaattctaatatatgtactatttctacttcctagaataaagcaaaattggcatttacaaca

SEQ ID NO: 30213 - DNA, 1033 bp, Homo sapiens
actcttcctgcctctgtttcaagtctctgactttgcttatctggtttcccaattctgtcttaagtctccacctttgtccccacctagttcctgccgaagtttgtaggattctgccttactctctgttgatgcgcatgctgcggggctcagtgatcaatacgaatcctacctaatgacggtgttgctcattaccaccatccctggaaggttctttagcagtcaaatctgtatttattgcctctgcgtatctcttagaaatttcccttttgcccttcttattagcatgtagctatattctgacaagttaattacagagtaagtgattactgggcatcttaagggacgtttcagaacattcctttctgcataggtagtttcccacctctctgctcatatctagcagcatgttttggttggtctctgaggcgtgaggttttccagagctttcgcccccaggggctccccctactgcttatgtctagctatctgcctactctaacactaaggacctttcaattctactctctacctgtatagatctgaggtccaaagaagagcatgacaatcactgtagttgatagaaatctggaattagaacccaatactctttccattcttgtactcctttagcaactagtagtttagtctgtagcacattttaagactgaaatatttctgcttgaatatttagaaactttttttttttttttgagatggagtcttgctctgtcacccaggttggagtgcagtggcgcgatctcggctcactgcaagctccacctcccgggttcacaccattctcctgcctcagcctcccaagtaggtgggactacaggtgcccacaaccacacctggctaattttttgtgtttttagtagagacagggtttcaccgtgttagccaagatggtttcgatctcctgacctcaagatctgcccaccttggcctcccaaagtgctgggattacaggcatgacagaaactcctacctatgcattcttatgtcaaagaaaaactcacaaaggaatttgcaa

SEQ ID NO: 30214 - DNA, 1050 bp, Homo sapiens
catgatgtccctatggaattgttacctttcttcagatgtagttgtagggaaacagactacttaatgccctttctaaaaccagcataaattggattttattgtatgtatacacaataagtgctttcttacattgataattttcagaggaacagaataatcaagaatgaagttaagaagcttcaaaaggcagctctcctgaaagcttctcccaaaaaagcacctggtactaagggtactgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctggagttaggaggcagattgatagtaggattataataaacattaaataatcagttcctttttttttttttttttttttgagatggagtctcgttctgttgctcaggccggactgcagtggcgctatctcggctcactgtaagttccacctcccgggttcatgccattctcctgcctcagcctcctgagcagctgggactacaggtgcccgccaccgcgcctggctaattttttgtatttttagtagagacggggtttcaccgtgttagccaggatggtctcgctctcctgacctcgtgatccgcccgcctcggcctcccaaagtgctaggattgcaggcatgagccgccgcgcctggcctaaataatcagttctttaatctcactctctgcccatacttggataggtagtgcaaaatcattgcagtcataattgatcatgtcatgagaaatcatgataacttagaacaccaagtgacacaagtgacatttttttcttatggtcaccttggcttcagaacatctttttt

SEQ ID NO: 30215 - DNA, 1049 bp, Homo sapiens
caaggaagtgacagtggtaatgccatttaggtggtcttgatcatgcattggactgcagaaataagggagaaaacaatgtgtcagggtttctggtttgtacctctggttcattggttgtgagggaacatgaggcagggtaaagtttatctaggtaaaatgagttagttttcatgtagactatctgggtgtatatgcaaagactgcagacaatctatactaaaatcctggctctgcctcttgaaagctatgtagtttaggcacatagtcaaaatccagtttcctcatctatgtggtacgcttcagagtagttaatcatgatatgtagtccagtgactggttcccttggtaagagctgtgataatgacacaaggaggagaggtttcaggacagacttgggattcatgaatatgtaagtggtcactgattccccaggggtaggatgacaacaatcaagagacgaatagaggttggaaaggagtcatgaggggtgggaaactagcaggggcacatggaagctagggaaagaattttgcttgagatcgtcaaagtgaggggaagagggtagtaagcaaaggagaaatgttatatggggttcggaggttttgtgtttgtaaatctggagtgatgggcatgttcaaatgcttctgggaaaggagctaataggagagaaacttagcccttcgaaaaacaggaagggatggatcctaggggagaggaggaaggattggctttagaggaaagatgtcctttacgtgaggaaaaggaagaaaaggtgggtttagatactaaatctgtaggtttgctgttaggaaattaaggacttttcacctttatctctgaaatttctctggagttagcaaggcaaggtcatacactgagaaggagggatgaggcagtgtagatttgcagacatacaggttgtaattccttatggaggaaaggggagagcacttttgtcagactgcctgtggctttgagagccctttggctacagtccatgaggtgctcagaggatgagaaagcttcagggtagaagcagtattcaagct

SEQ ID NO: 30216 - DNA, 1035 bp, Homo sapiens
gaatgtaaagagtgtggaaaacgattaagctccaacacagccttgactcagcatcagcgaattcacactggggagaagccctttgaatgtaaggagtgtgggaaggcattcaatcagaaaataaccctgattcagcaccagcgagttcacactggcgagaaaccttatgagtgtaaagtgtgtggtaaaaccttcagctggtgtggaagattcattctgcatcagaaactacacactcagaagacacctgtccaagcatagggctatccatagttaggcccactgtgcctctccttttttctctttattttcatgctttttatcagtgtcctcgctgtccttcctggttagacacttggctttcatcatgaactcttctttaagttttttgaacctgtttccccaacatgaagtctctttatggttagagaagaccaaaaaacaaacaaacaaacttagaaacataaaaggaaatgtaagtttccagatttaaaggacatgctgggtgcccagcaggatggattcaagggaaacctacattaaggaaaattgctgtgaattatgaaaacaccaagtttgaataagaggatcatggagaaaaaatgagaccctaaaaagtttctagagagagaaaacaaaagatcagaaatgaaagcggggccaggcgcggtggctcgtgcctgtaatcccagcactttgggaggctgaggcgggtggatcatgaggtcaggagttcgagaccagcccgcccaatatggtgaaaccccgtctctcctgaaaaaaaaaaacacaaaaattagccaggcatggtggcgcatgcctgtaatcccagctactagagaggctgaggcaggagaatcacttgaatccctgaggcagaggttgcagtgagctgagatcgcaccactgcactccagcctgggcgacagagtgagactttgtctcaaaaacagtaaaaaatgaaaatggcattagatttttcaagagcaaccttcaaagtcagatgacaatgtgtatgccttcagacttctcatg

SEQ ID NO: 30217 - DNA, 1044 bp, Homo sapiens
ccaggttcaagtgatcctcccacctcatcctcccgagtagctgggattacaggtgcacatcatgacagtgtcttttaaagagcagaagacattaatatgcatgaaatccaatttatcagttttttatttttaaatagagatgaggtctcactatgttgcacaggctggtcttgaactcctgggctcaagcgagcctcttgccttgacctcccaaagtgctggaattataggcatgagccactgtgtctagcctttttttttaatggatcatggtttcagtgtcaaatctaagacatctttgctgtacccacatttgcaaagatttttttcctaaagttttccctttagaagttttatagtttttgtgttttttttttttttttttttttgacagagtctcactctgttgcccaggcttgagtgcagtggcaggatctcaatgattgcagcttcggaggttgctcactgcaacctccacctcctaagttcaagcgatactccagcctcagcctcctgagtagctgggattacaggcaggtgccaccatgcccagctaatttttgtatttttagtagagatggggttttgccatgttggccaggctggtctcgaaatcctgaccttaagtgatctgcccacctcggcctcccaaagtgctgggattacaggtgtgagccatcgcacctggccagaagttttatagttttaggttttacatttaattctatcatctattgagttaatttttgtctgaggcatggatccaagtttttttctttttcttcatataagtatcctattgtagcaccatttttttcttttttaagagatgggtctcactatgttgcacaagctgaagtgcagtgctattcacaggcatcattacagtgtactgtacccttgaattcctggtctcaagtgatcctcctgcctcagcctcctgagtagctgggactacaagtctgtgccactattgcctggcctgtaacaccattttttgaaaaaagttcccccactgaattgcctttgtaccattgttgtgaa

SEQ ID NO: 30218 - DNA, 1044 bp, Homo sapiens
ccagccggtcgccgcaacctcgcctcttccgcagggcggggccagccatgaaaggcggggcgggtctggccacggggcgaccgagatggcggcctccgggggcctagagggaccctgggcgtgcactcgcccttccggctcggcctttagttagtgaccagctcctcggcgttctgcagagcgtgggtttcagcgagttctacgtgccaggtccgcccggtgccggcttcctcgctgcccctggcggctcgtcagcccccactacccctgaacttggtcccaatggcggcccgcccctccttcacccggaccgtgggcatctgggcctcgccgaagccgtcaaggtggctgctcgggcttctagagcccgtgtccagccctttgccaccgaggcctgatcctcttttctgccctaaagaacttgccctgacagcctctggctcccggtactgacgtttctgatgtttggggttgcctgttttcttgggtggagtgttaagatcacggttgggtggggtctccggtcagcatcacccactgggacgctgagtattttacccttaatccgcattcagccaccccagtccctcttctcctgaggttctttcttttgggtccacgtcatcgtccctgtaagcattctgtaaagactctttacgtttgtagagacccaacacaatagggacagggctcttgggtccctcagtttacccgtacgaatgggctcaaaaaaagctcttcggactgagcaggcaggtggaagattgtcctgaagactaggcagaacaattcataagaagtttggggctatcagcgtgagaacaattagagggagtcctagtagaatctccgtgcatccagtgctggaaatgtggaaactgggagggccataggttgctgtaggtggtggacgacagggtccttagcactcatggctctttttctcttagctcttgaggatcttgcttgtccaaacccagaagacagtgcatgaagccaggggacatccgccatgctccaaacaacttggcctcaggtgagctg

SEQ ID NO: 30219 - DNA, 1061 bp, Homo sapiens
tagtaaaaatacccctacaatcattttggtagggtcttctgtcttcagccagggtgtacctgctcggtgggagttggttatatatgtatgtccaagttgcaggggcttctgggaaatacaggttttggattctgcctgggaagagagtcatagtatgaagaagtctgaaaatggggaagggattttcagaatatgttgagcagctgtaaaatatcagatacccattataggcattgaaggttacctaaatgacagaaggatgcactatattcatgggtaggaaagattagtttcatcaagatttcaatttttatcaattcataaattaaaaacaatataaaaattccagaggggtgtgtgtatagagaggcaaaggacacagagtagctaacctagttttgaagaacaagatggggggttttatgctaccagatattatatacaatgatcatcaaacacagaacaaagcaaaaaacaaactccccaaacccaagttgaaacaaaaaaaacccccagactgtaatagtattattattattttttaagatggaatcttgctctgttgctcaggctggagtgcagtggtgcaatcttggctcactgcaacctacacctcccgggttcaagtgattctcttgcctcagcctcctgagtagtgtgtgccaccacgcccagctaattttttaatttttagtagagacagggtttcaccatgttggccaggctggtcttgaactcctggcagcctcaagtgatccacccacctcggtctcccaaagtgttgggattacaggcgtgagccactgcacctggcctgtaacatgatttgctgaaatttttaaaaatcttaaataatgtactgtttagaaatatacatattttatacaaaattataaagaaagcatagagaggtaagcattagtggcacagctgagaaaatataaaaggtagttctgtctctatcctgtctcctttattctgctactgctctcattctgtctcatcccaggaatccagtcccaagtgctgcctgccaatcgtccagcaccctccacctttgc

SEQ ID NO: 30220 - DNA, 1050 bp, Homo sapiens
ggttcaagacttcagtggacgaagtaactgcagatgtggtggaaatagcaagataactagacttagaagtggaacctgcatatgtgactgaattgctgcaatctcatgataaaacgtgaacaaatgaggagttgcttctaatataagagccacaaaagtggtttcttgagatggaaactactcctggtgaagatcctgtgaccattgttgaaatgacaacaaaggacttagaatattacataaacttagttgataaaacagcagcagagtttgagaggattgacttcaattttgaagaatgttccactgtgggtaaaaggctatccaacagcaacacatgctacagataaatctttcggaaaggaagagtcagttgatgttgcagccttccttgttgtctcatttaaagaaatctctagagccacactaaccttcagcaaccaccacaccgatcattcagcagccatcaacagtgaggcaagactgtcttccagcaacaaagactcactgaagacttagattatcgttaacatcttttagcaataaaatatttttaaattaaagtatgtacattgtcagatataatgctattgcaaacttaatagactataatatagattaaacataacttttataggtactggaaaataaaaataattgtgtgactccctttattgtgttaaacattttattacagttgtctggaagcaaacctgcaatatctccaagatatgcctgtatttttcaaaatgtggtcttttaacattgctatgaagtttatcagtaataatatcttatttcatggttgtccagaagttacataacttgtcttaatctaaaaatcatatcatttaaaaagcctgatgatttaatatttttcataaagaaaacttttgacaatttgtttttaagagacaaagttttctatgttgcccaaacgatttgaactctggggtcaagcgatccttctccctcagcctcccaagtaactgggactacagggcatttgacagttgtattacatgaaacccaattgtaaggctagctcat

SEQ ID NO: 30221 - DNA, 1025 bp, Homo sapiens
ggccgagtttgggggagggacccggtgcctcgggatgcgccgggccctgggtggggggcggggtggggacggggggctccgccttctcagctcttgcggcgagttggggttcgggcgctgaggcagagacgccaccctaagtcccatcagtcctggggatcggaccagtggactttctcttaagatttcctctttcattcttaagaatagaagtgttattattttttttaatgccctggctatgtgagtttgaatcgaagcaactttaaaccttagagcaactaaactctaagtgcagcgggtgcgatgcgtcagtagggtgagcacataaaaaatccatgtcttgcacctgtattttagcgtactatgcaggtgagtgaaagcagtggataatgtactgggagtcttatggatttatggtagtgggtatgagaccctggtgaaataagggggtggaggaaggcgaaggtgatggcttactgtttcttaccaagtgaactgcaggattcagcctctgactcagaccgcttcgagaattttgttcgtagaaataatttaaatttattcaaatagtttgatggcagctaaaattgaattatagagcacgttttcttttcagcggagtgaatttttccttcgctccaaagctggccaaatggaattcaagcattgcaacttctttcagtgttttgtctggagagaggactttgaaccgagacttttcgaagttaagttcctatagcctgcttctgaatctgccaagcttgaaagctttggcagttgggtgtatgtagttgttgccttcgttctcttcccttttggagggagcgttgtctcctactttgtatcttccagacatctgtggtcttccccccacccctcgagtttgtgagtggtgaatgaagaaagactaggctgctggtatgcagaggtcggcaaaaggaaatcgaggagtggttttagtgaaatgagagctttgtatcatgaataatggtggcttaggctagacatcaacttgaagagac

SEQ ID NO: 30222 - DNA, 1061 bp, Homo sapiens
gcagagttgagtagttgtgacaaagagtttatggcccacaaaacctaaaatatttactttctgatgctttacagaaaaagtttcctgaaccttattctagctatatgttgttcataaatgaatctttcgtggttctgaaggcatttaagaatctcttaggttataaattggctgggcgcagtggctcacgcctgtaatcccagcactttgggaggccgaggctggtggatcacgagggcaggagttcaagatcagcctagccaagatggtgaaaccctgtctccattaaaaaaaaaaaaaaaaaaaaaaaaatagctggggttggtggtgggcagtaatcccagctactcgggaggctgaggcagagaattgcttaaacccaggaggcggaggatgcagtgagccaagatcgcgccactgcactccagcctgggcaacagagtgaaacaccatctcaaaaaaaaaaaaaaaaaaaaaacactcttaggttataaataattgttgttagctctccaagcctccatattacattttgtgtgttctcctgttcacattttgagcattttattttttattagcacattcagttcatcaggtatttaagagcttaatatatgccaaagcatatattaagcgagaagctgtttctaaatgtactgtctcagccctcacagagttcacttcattaggctctttaaaatttctttctttaaaaggtcagcgtgctggtatagtggggaagggaaactcttacaacacgtcgagtagaggaaggttatcattatgggatataatttggaagtcattgagtacctgccattaattctgcctgtagtctgaatgtagagattaacatgtagaaacttttttgaaataaaatcttcaatttctttggcatatctagtactgtctagctaggcatatagtcaaagtatggtgtatatttcaagtattaaaagtttttttgggctgtagtcactgttgaaaggatatagttctttactattacatgtgatacctttatataaaattggctaacccctgtctttcatttatctgca

SEQ ID NO: 30223 - DNA, 1040 bp, Homo sapiens
tgaaaaataatttttgatggcactatatcagaaaacaacttgttaaagaaaatgtggagtttttaaaatcccactgtacctctgttatccaaaggggatctgtgaatttttctgtgaaaggttaaaaaaggagagacctttaggaattcagagagcagctgatttttgaatagtgttttcccctccctggcttttattattacaactctgtgctttttcatcaccatcctgaatatctataattaatatttatactattaataaaaagacatttttggtaaggaggagttttcactgaagttcagcagtgatggagctgtggttgaggtgtctggaggagaccatgaggtctgcgtttcactaacctggtaaaagaggatatgggttttttttgtgggtgtaatagtgacatttaacaggtatcccagtgacttaggagtattaatcaagctaaatttaaatcctaatgacttttgattaactttttttagggtatttgaagtataccatacaactgttttgaaaatccagcgtggacaatggctactcaaggtttgtgtcattaaatctttagttactgaattggggctctgcttcgttgccattaagccagtctggctgagatccccctgctttcctctctccctgcttacttgtcaggctaccttttgctccattttctgctcactcctcctaatggcttggtgaaatagcaaacaagccaccagcaggaatctagtctggatgactgcttctggagcctggatgcagtaccattcttccactgattcagtgagtaactgttaggtggttccctaagggattaggtatttcatcactgagctaaccctggctatcattctgcttttcttggctgtctttcagatttgactttatttctaaaaatatttcaatgggtcatatcacagattctttttttttaaattaaagtaacatttccaatctactaatgctaatactgtttcgtatttatagctgatttgatggagttggacatggccatggaaccagacagaaaa

SEQ ID NO: 30224 - DNA, 1086 bp, Homo sapiens
attttatggtatctgtttttaaggtggatataattaggaaaattaaagggccaaatgatgaggagttaagtgccagttctggttcaaattttcagtgaatcagttttgatataactttcatcttagggcattactcttgcctaccaacatagtttctaaatttttttcttttggtgtgatcactgtgggaagaaggaaattgggcccaaactgatacattgtttggaggactgggatgtctgaatttgagtggaatgctttaaaaggacaagttggatagggccccagtatgggggtctgagtgatggggtccaggaatacatttaggtccaatggcaagctggctgaaattcttgtataataaaataggttggtaatatggctcttctcagacatgtgatcaagattccttgactaacaagatatatatatatatctttctagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtaagtatatgtatctattctgagtcttgtgtatagcatctgcagttctaattagattacttttcttaggaaaaggtggtagaactttaactactgaaaataaatggtcctattcagtttgcagccaagatttacattcagagtacctgtcatctggattgtagctaaatatttaaggctagtttaggtagagttcttattatccatcaaaaatgatggcatatgttttgcttaataaaatttgtttgtaatttcagttttgagtaaacctaagatttgctaacagagctgtgaatttataggagaaaagacaaattctaatatagtacagttttatgtaaagtgattgctttattagtagatgctcatgagcagtttttgttttgttttaacttttaggttccgggtaatgtgcaggcttgttatataggtaaattgcatgtcacaggggtttcgtgtgcagattattttgtcacccaggcagtaagtattgtacc

SEQ ID NO: 30225 - DNA, 1040 bp, Homo sapiens
tttaacaatattgattcttcctgccatgaaatagaatgttttttcatttgttggtgtcatctctgatttctttgagcagtgttttttgtaattctcattgtagagatctttcacctccctggttagttgtattcctaggtattttattctttttgtggctttggtaaatgggattgcattcttgatttggcttgcagcttggatgttgttggtgtctagaaatgcttctgacttttgtacattgatttttatatcctgaaactttgctgaagtttattggatcaaggagcttttgggcagagattatggggttttctaggtatagaatcatattgtttgcaaacagacttcctatttggatgcattttctttctcttgcctgattatgagcagtgttttgccctgatattctgtattctcagtgaatagatgtcgtctaagtatgagaaacaatttttttctattctgagtatttttaagaaggcaacttatatgtggtactttgtatattgtgtatgttggcaattggggaaaagaatagatggtttgtactagggcctcttgggttctgtgtgtgtgtgtgtgtgtgtgtgtgtgtgtcatgaaaacagttactttttagctaccaagcattttttctcctttcagtaacccacctaacaacatttactcagaatttcaaagcaagcttcaaatcagtattgaaagaaggaaaaatataaaggcatttaatggaagaaaatgttgggaataaagtatagggctggcaacacttacttttctcacttattgagagtaattttacttgggaatttatgagagagaaagacattatgattgctccaggtaactactggcagaggaaccatagtcttggggatagacaaatgtggctgagttcatatagaatgaggggatgggatgtaaattctgtcagctgttccagcagtaacctgtaatgtaggctaaaaatacagattttgagatttatttaatcagaatccctggagtgttaatttttatatcaagatctcatagtg

SEQ ID NO: 30226 - DNA, 1055 bp, Homo sapiens
tccctgacagtaagtgttttcatgccgtctttctggattgttcttaccccaggaatttacctagcttctttaggtctttagtcagatgtcaccttcacagtgaggtgacctaattatctatttaaaatcgcagccccactccattatttttctccatagccctttaatatcatctgacatactgtatggttttagtttattgtatatttttctgcctcttccaactagatcataaattctgagggtaggaacttctgaatatttttgttcactggtctatctgcagctcagaacaggacctggtactgaataaatatttttgaaatgattgaatggatgaaaagaaatgagtaataagaatattacctaagggggacagtggagataacaaaggctttttcggcttaggaaaggaacagtagctatttgagagtttgtcactagtgaggtgaactggcaaagtgaaggaaactgagcaacattctagaaaatgagaggaaatcaaatacttaggtgaaaggaagtaaactctggaaatacagaaggacacctcctaaggctagaacagatatttaggattgataggcacttctagctaatgactagggccttatatcctttttaattttctaggtggaatgcaagctttaggacttcacctgacagatccaagtcaacgtcttgttcagaactgtctttggactctcaggaatctttcagatgctgcaactaaacaggtaaattctgagtaaactggtgccatgggaatagagtcaagatgagtatgtgcttgtactgaccatctgtttttatctccataggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagc

SEQ ID NO: 30227 - DNA, 1019 bp, Homo sapiens
cagtgctccagagcattaaacaccccaagacataaaattcagagaatattatttactacagtgtgaatgcctcttgcactctgaattgggaatgtttgcaccacagtggggggcttgccatgttttagctttagatttaattaggttttgtttgtgttttctccttagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtgggtaagtaaaaaggaaccaaagcctttagcagatgtgtacattgaagtctcagtttttcctcaagggcctttttctccttgtctcttagcgacatatgcagctgctgttttgttccgaatgtctgaggacaagccacaagattacaagaaacggctttcagttgagctgaccagctctctcttcagaacagagccaatggcttggaatgaggtagggaaatgtgagcagttatttatctggtagtttcctagagcaggtatggcagcttgttctttcctctcaaaacacttagtacacattcatttgcattgatgtttccctggcttgagtatttcttctttatgctgtctagcaactgctctgaggaagaactataatacaagctttaaagagtctgttcagaatcattacaaataagttgtgttatttaaaattataattcataagggagaaagatgaaaaatgttaccagattaaagaagatttttcaaaaggatgtaaggaaagaggcagtgttaaacactgttaagaggacagtttatcagtattttttactaaactttaataaaacttttctatttgaatttctgctatgaatttttcttcagcatttgtcctcagtacaggtggttccttgaaacattgtttctaataaaactagaacatcctgatattttatccattctatagagatcattga

SEQ ID NO: 30228 - DNA, 1012 bp, Homo sapiens
gttccaacttgagcccttaactttctccacctacccccttccacaaacctgttttcactgtcttctctgtcttagttaatgtcagctttgtctgtccagctgctcaggctaaaacttttctttcatataacacatcctatcagcagctcctgtttgtgggtaggcattttgcctttttttttttttttttttttaaactgctatatctctagcatgtagaacagtgcctggcagcacataataggtgcttaatataatatttgttgaaagaacaagtcagtgagtatttttaatgtgaggtgcaaagagaaaaaaaaatgtatctttgaggtgtggagttttgaagaacttccattttctaagcatttgtgtaatgttggagttacttgttccttttgtaatctgaaagtatgctttaaaaaaaattagtgtacttttgagaattttcattttgctttctattcttccttgctttgtgcatgtttatctagactgctgatcttggacttgatattggtgcccagggagaaccccttggatatcgccaggatggtatgtgtctcatatttctcgattaactccagatcaagctaaagttctaaaacttttatcagaagagccggtttgctcatctgggaaaccagtgttggcagaaaagtagtggcttcaattaaaagcagttcttaaattccagtcagcaacagtatctttaatggagcacagggaattcagagccacacaatgagtagcagtaggattacaccaccaacaaatacatgctactgctaggcctctgcagtgcaggatgttacaatttacctggctttttattctctttttggccagaggactcataatacctttgtctacaagctacccaaggaagataggaaaactcctgtttctaggctcagatctcgggtgggtttttacatagttgcattatcatcagggttttcttgaaaagctaatttaaatctgggtaatgaacatggaggatggcatagaccac

SEQ ID NO: 30229 - DNA, 1048 bp, Homo sapiens
caagggcttatgtgggttcttaggttttattttattcttggacagagatacactgttgttagacagagatacactgttgaatgaatgggtcttctggcttctcacctccttttccccccttcttttcaaacaaatgttccctattctgacttgtcttcttagatgtatctaagtggaggccacttgcagtgttgaaaagtgcaaattttagtgaagagacagtaaataattgcatatgtgtaaaactggatgtctcctgagttacacagaataccaatgatgttgagctgcttaaaggctatgataggcattttatgaaaggctgtgtagtatgattcattatagtgagaaatttatttaattattattgttaatagtgcacctgaggtgaaacagggtggaatggggtgggaggggagctcttgaaatccttgtttggacttaatttttttgttttcaaaatttattatttttattttacagtgctgttccttgcagagcagggctaactcataggcagtgtgcctgtaggcagcctgtttggacttccttaaacactttttttttcttaaatagagacaggttcttgctatgtaacaggtgaagctgggaatagcccttcctagaatgctgaggtgggaggatcacttgagcccaggagttcgagaccagcctgggcaacatagtgagacctcattgttacaaaaaaaaaaaaaaaaaagacaaaagaaaaattagtcaggtgtggtgatgtgcacctgtagttccagctactagggaggctgaggtgggagaatctcttgagcccaagagattgaggctgcagtgagccattattgcaccattgtactctagcctaggtgacagagcgagaccccatctaaaaaaaaaaaaaaatattgctgtctgagtcaaaaagtgctcttaaggaaaatgtaccttgttttccctgaggttctggggaatccccagcataagcacatgtaccccagtttgggaatcgtggagctggattatttctagggtctcctctagttccaggacattc

SEQ ID NO: 30230 - DNA, 1030 bp, Homo sapiens
tcaatttgttttctctgtgaggtgctaacttgaatctttatcttctttaattgtacctcttcttttttttttttttctttcaaattccattagcaaataatccttggatgctttttcattcacttattgagaagtggaaaaggcttaggacggggatcattcctggtttatatccagatgcttttggtattctctgtgcaatcctgggcaagtgacttaagccactaagacccctttccttgtctccacaatgagggagccattaggtcgcaggggtctgaggagtaagtgagatataaagtattaaatgccaggtatacagtcagcactttctaaatggggcagccgaagatgcggtgactaaggaatggctgaccagtggctgtgaggcttacccgagacggctcctgggacctgtttttattcctgactttctagtggcagtgatggaggagtgtcaggtcatggtagggaggaggctgctttttcggctgcagtaaacctgggccgagggagggctgtaaccctcaggagtgttgggactcttggtgtgaaggaaagtggatttgatgtcagatagacttggattttaattgtgaaactcttcacagagctatggacagattactttgtctttccaagcatatgaaatacttttggtgtagttcactttgaaattgcttgaagctcgtaaaaatcacccctaaatgatgctgtttcctttgtgcttatttatacattgttttgtttctttcctattttcttaaaaagtgaattggatatgtgcagctttggacttaattcaagctgtgctcaataatgtgttgtcactgtttagaaatggtgcctcgctccctacctcaccccacctgtcactcctgctcattactgtgaactcagtgcctttgaatcagttatgttggaaaaagcttataaatggcatttctacctcatttccctaattgtagcttaggaatttgtaccccctttttaattgttcatttcctggcttatttcccttaaaaaaaaa

SEQ ID NO: 30231 - DNA, 1042 bp, Homo sapiens
aagattgtttgagcccaggagggtgagggaagctataattatgccactgtactccagcctgggcgacagagtgagatcctgtcttaaaaaaaataaaaaaaaaaggaatggtattttgaacaaggtacagcattttgaccacctgtttgttgcttcagtttcttttgtaatcagacttgctctccatccccgctcacctcccccttttataacctgatagatttgaatgttggggtaggaggtggtctagttcatactgatttcacaaatgaagaaactcgggtagattgtcgcagaagttattcttacagcttcttactctataatgaagatttatggtatacgcaagggcagtctggtgcgctctgttcctcacttgatttcagtgatctctgaaatgtcacccaagatggcggtggctggttcgtgagtgttttttttctttttgtgcgtgagtgaagttttgttagaggtattttaagcattaattgaaaagctgcatttctgaactgagttttcgaattttcctacgtgttgacgcaaacagatccccatttctttgtcttgtgttttattgtgtgatgcgcccgtgaaggtagaggttgacttctctctttccacacacagcactctcctctgtggttattaaggggattaaaaaaagaaaaagaatgaaatgtaaacagttttataatgtaactgtttttattatcactggctatagtaaaatagagataatgtcctctctgacataggagctgaggactagagacttggcaagaaagccaaagcaagcctggaacccaagtttttggagctttgtggtgctcttgtttatttaattttaattttgttttatttatttatttctttttttttgagatggagtcttgctgtgtcatccaggctggagtgcagtggcacgatctcagctcactgcaatgtctgcctcccaagttcaagcgattctcctgcctcaacctcctgagtagttaggattacaggtgtccatcaccatgcctggcttatttttgtgttttta

SEQ ID NO: 30232 - DNA, 1071 bp, Homo sapiens
tagtatactcatttcatttattcttctctgcttcttaaataacttgtattggtgtcctgctcttagcctgcaaggcaagggaaagtgagccagtagaatagtcacactacaacttcattaatagtgatactgataagcaataaaaggaagccatagctgtgctgttttggcctctgtccttggcaagtggcaccatgctcctgcctcctagtgcagagactaggcaccacacagacatgggtaatggctgtacagaccattgttcgtacggctctgggtcggtctctgcccccactactgttccggccacaaggctgcctgcaaaaacaaagtgacacaaagaacaaggagatggggagttgctaagacagatgcattaaaaggatggcatcaattaagtggcgtagtcctaggccagaagcaaacgggcagactgctactgctcctcccaagtaagaggcgctggcttatcatgccccctcaggcctgtctggcgttcagatgacttgtggccgggatagactcaccaggactcatgctcatcttgagggcatgcactgtgcacccgagctttgtttttacccctctctggggtgtcgattagaaatgagctcttctttgcaagtagaacagagttttgttttgctttttgagtgtcaactgtggcccaaaatgagaaagactcagctgccttcatgtgacctaaacagcccaggtgggaagggacatttgtaagcatttgttgggtttgttctgcctgccctgctgtaaccatttttgacacgaggacactgagataagaataaaaagaaattgttctttctttttattgtaattgctgagaaatgagcattgttttctattaccaagtactgtgggccctcaccccgttccagtggccacttcaaagtcttcatcaaaatagctacattttgttttgtttttaaaaccaagtaatgggccaggcacggtggctcacgcctgtaatcccagcactttgggaggccgaggcgggtggatcacgaggtcaggagatcgagaccatcctggctaacatgatgaaaccctgtc

SEQ ID NO: 30233 - DNA, 1811 bp, Homo sapiens
gagaatttacagaagcttctaggctggtgttgggaatcacaggaggctaactaggcaaaggggagaggaagtgtgtttcagatggagagattagcatgtatataagaactctgtggaaggcagcagagctcctttgagggatgaaaagaaacccagaaagggggaaatggaaagttagtgcttaataggtacagaatttcagctggagaagatgaaacagttctggaaatggatagtagtgatgatcacacaacaatgtgaatgtaccaaatgccacagatctgcacacttaaaaatggttatgtacattttaccacaaaaagaaaagaaactcagagtttagagaataaaggagtggagtgagatccactagagcgaatagaaggggcaggaccatgtaggattttatggaccatagtggaaagtttaggaccatagaacactggtcaaaattgcattttataaaactcactttggctgctaaagtgcagatcaaaatggagaagtctcaacagagctatggtgggactggcctgggagccagtgcagtcatctgggcaagagagaatggagctggagtgtggactagggtgagagtgaagaaaaagagatctaagaaggctgcagagaaatgtaggagcaaaatcaataggacttggtgatgagttggatgtgaaggggcgatgaagcagcttcaaggatgatgccactgttcagccttggataaatggatggatggtgcagggattcacagatatggagaacactggaagaggagataagattgatcttgagctccatcttagacaagttgaatttgaggcacctttgagacttggttaggattttgcgatgattagttttagatgtcaacctgactaggttaagggatactcaggtagctgggggaacattacttctgggtatgtctatgagggtgttcccagaagatattggcatttaagtcaatggactgagtaaggaagatctgtcctcatctaatatgcgcaggcaccacataatagaacaaaaaggcagaggaaaggcaaattctctactctggagttgggacacccctcttctgcccttggcatcagaattccccgttcccctaatctcctaactctaggagattaggtagtagagtccgtccatttattcatttagcaagtattgagcctttggactccaagacttgtaccagtggttccccaggttctcccggcttgggccttggactgggagatacaccattcagcttccctggttctgaggccaagtctaagacagggtagtcttgaactgaagcagtctaccagcctccctggttctccagcttgtagatggtctattgtgggacttctcagcctccataactatgtgagccagttcccctaataaatcccctcccatatatctatagatatagatctatattgtagatatatagatatcacattggttctctctctctggagaaccttgactaatacagatgtcaacacagcaggtgcatatacaggttgcaggtcaatgtagaggtctgggctgaacacagactttttttgaggctgagtctcactctgtggcctaggttggagtttagtggcacaatctcggcccactgcaacctgcgcctcccaggctcaagtgattcttctgcctcagcctcccaagtagctgggattacaagcatctgccaacacgcccagctaatttttgtatttttagtagagatgggggtttcaccatattggccagtttggtctcgaaatcctggcctcaagtgatctgcccgccttggcctccct

SEQ ID NO: 30234 - DNA, 1352 bp, Homo sapiens
gagaattgtgatacagtctaagatagcctccagggttcaccacctcctgggatttatacccttgtgtagtcccctcccacaatgagtctctgataatgagggtaggtcataacaggcacaaagaaggagaaaaaccaggagattcagggttggtaaaggcaattgaaaaccctgtagcataagtgctcttcaaatatggggaattggggccaggtgtggtggctcacacctataatcccagcactttgggaggccaaggtgggtggatcacgaggtcagggaccagcctgtccaacatggcaaaaccccgtctctattgaaaaattacaaaaattagccgggcgtgatggtggacatctgtgatcccagctacttgggaggctgaggcaggagaatcacttgaacctgggaggaggaggctgcagtaagccgagatcgcaccattgcactccagcctgacctacaagagcgaaactccatctcaaaaaacaaacaaaacaaaacaaaacaaacaaacaaatatggggaattgggctctcaaaacttgtggtgcgagtgctttagaacaggaccttacactctctgactggtgcaactggtgtggttcaggcaccatggtagattggacaacaggggtgagatgtagtacctaaagtcctagctctcatctccaatcattgttcactttggctccaggttcacagtcaactccagagtctttctcttccagtcctcttcagtcctccactcctagggtaacaccctggaccacagaagagctccacctctgaagttataaatgcagacacctgatctttcatctgtccttctgctattctctgaattcctttcatggtttctctagcctgcagaaacttccagttcatttgtccctctactttgttttatttataagctccatcgagtcttcatttccttccccatcagctgagagttcagggtttatcacctccatcacattcttcccaatatacttatattccttgcacagttatctttctggcataactagaaggatagtaacacccatctggcagcactacaatcctggaagaatccaaccttctgtcttctctgaatctgcttcttggctctaagtgctgctggacaaaatctcacaaccacacagatcagtgctacatacattgtcaacttcaactaggtcctcaacacctttcagcgctcctatttgccaaggcagctctctctccagctctcccccaaaatcaacttccaaatatcctgcatgctccccagatctcccactcttcaaccccccctcccccgcttgctctcccaggaacctccgttactgaagaaagagcaaccat

SEQ ID NO: 30235 - DNA, 1028 bp, Homo sapiens
aacaacaataacaacaacaacaacaaaaaccggggccaggcacggtggctcacgcctgtaatcccagcactttgggaggccgaggcagacagatcatgaggtcaggagttcaagaccagcctggccaacatagagaaaccccatctctactaaaaatacaaaaaaattagctgggcatggtggcttatgcctgtagtcccagactactcgggaggctgaggcaggagaattgcttgaacctgggaggtggaggttacagtgagctgagattgcaccaatgcactccagcttgggcaacagaataagactttgtatcaaaaaacaacaacaacaaaaaaaccccttcactttattcctcaaaacatgtatgtcccagttccctccatttcagagccataaacataaagcctacaggtaagatacttaatacccaggacagatctttgtgtgtatatatacataccatatgtagcattatgttatatagtattatataaattacatgaaattttgcataagattggtaagcaagtcacttaaactttatgaacaaaagtataggccgggcatggtggttcatgcccataatcccagggaagctttcacaggtgggaggattgttgtctggaccatctcatgttattgtcattcctcacttgtctaaacaggaatagggctgagtggaactacggaagacctgtatcctgctcctgatgtttccttttctgcccactctgtgtctctgaaagctttggggaattttcctgaggaggaagcctgatgtggagttaacagtgcaggcttggtaaccaggaagccctgagtccgccccagctcaggtgttacctcacttctctcaccgggtttacctctctgtgaaatgggatgaaagcaggccgggcacagtagctcacacctgtaatcccagcacttttggaggccgaagcgggcggatcacgaggtcaggagttcaagactagcctgaccaatatggtgaaaccccatgtctactaaagatacaaaaaaaa

SEQ ID NO: 30236 - DNA, 1024 bp, Homo sapiens
ctaacataaaggttaaataacagtacttacaacaatataaaagttttgcttttctgtcacacagcactcagaatcagcagatcagggctgtccatgtgagggatccaggctctttttgtgtcgatactgtgttacttttgacatggggtgggtgcgtgcggctcttaacagaaagattcaagtttaatagatacagaagaattgatggaatcagaagaatcatcattttgcaacccccatggtaataactggttcagaaagtagtcatcagtggccaaaccataggtgaaaagttgtgctgtgtgcaaagtatccaacagattatttatttaaaatggaggaaaattcctttacaactaagatgtggctaatatctcagttataaaggtactttaatgggtccgactgacatgctttctaatggggtgcaaaaaaaaaaagatggagactgttttagattaaaagaggccaacaaatgaaaaccaaatgggtatataatgcttgaatgagattcctggattttaaaaaatagatgtatatttgtcagtaaactagaaggaactcaaatgctaatcagttgaggattggttgagtaaaatttgatatagccaaacaacagaattccattcagccattaaaaagaatgaaaagggggaaaaaacatgtaaagggcattgtaggggtagttgggtaaatttgaatatggattattatgaggagttttttcccacagtaacagattcttcaaagccaactaagtgtccaacaattcaatttgattctggacactatctacctggagttagtgtcatattccacaagttaagagaaatcagttccacaagactgctcccactgcgggcatgccaatcgcaagtcctgagtcgctctttttttttttttttttttttttttttttttttttttttttttgagtttccttcttgtcacccaggctggagtgcaatggcgcgatctcagctcactgcaacctccgcctcccgggttcaagagattctcgtgc

SEQ ID NO: 30237 - DNA, 1035 bp, Homo sapiens
tttttactgtattttgttctactagttcttgtttgtcataatataaatatcaacaacttcagtatctgttggtatttcagttggttcttttgggctttctaggtgtatagctaatgtttcaaatggtgataaatatgctcttttttacttgtaaatctctcctattgtcctcttatctacttacattgactagaatttcctttttttttgagacagagtttcgctcttgttgcccaggctggagtgcaaaatggtgcaatctcggctcactgcaacctctgcctcctgcgttcaagcgattctcctgcctcagcctcccgagtagctgggattacaggagtgagccaccacacccgctaattttgtatttttagtagagacggggtttctccatgttggtcaggctggtctcgaactcccgacctcaggtgatccgcgccccccaccgcctcccaaagtgctgggattataggcgtgagctaccacgcctagcctacattgactagaatttctgaaagagcattaaacagtagtgatgctaacaactacttttgacttgtttcctgcttcactggaattaatgctacaggagtgtttcaccattaacgataatgctgattgttgatttgaaaaatatctgagaatatgtgtgtcatataaaggaatgaatgttgaatttcttttttttaatttatatttttcttttttaaaatttattttgttgtttctgtagtagatatgaatgttgaatttcaccgtgcacttttggtttctatcgtgggattttttttttctatcatgggatttttataggatttttccttcacttcaataaactatattagtagatttcctaatgttgaatagtgtctcttttaaaatgagattggcatatggggttttaaatttgttttatatcatctctcccaggctttggtttcgattttattttgtttcaaaaaaattaagcttttcatcttttgctgtgctctagaacagttgatatagtgttacactttaatgttacttgaagat

SEQ ID NO: 30238 - DNA, 1097 bp, Homo sapiens
tcacagggctttcttccttagataattttgtgatacaattgagtatacacatacttaatttagatatgttcctgtaacttaatataacataatttttttgtcttacagtctagcttcaattaagttgaataataaatttaccgtataaaaattaaacacctaaaaagattattgaacttcttccatgtatagcacattaggcaagctaattggaaatttggaggaagtaagctagagatttttctaaaattttattagttttccctgaaagttaataatttaaatatcatttagccaaagtatgttactactaaaagtgactgttctaaggctgtttgtgtgaagtattaaatatatgttcttttcctcaaggctttaattagtatcttttggcctttttatgcttttgttatttgattagcttaaatttttcttttctgagtgttcagtcaagttatctgtactgaccagaagaggaatttcatcttttgctttctatttattacttgaacattactttaaagtgacttataattggagactgacaaatttgtgttttcttcaaacagatgaaaactttattctcaaacatgacagagcgttccttttatcaatggcaaatcgagggaaacataccaatggttcccagtttttcatgtgagtaggcataattcagagatgagcttttcttaaacagagaagcgctgttcataagaaagatggtatagttaaaccaagtttaatgctaaaattctgtcagctttatttttattattaatttctaatatcatagtaacttataaggtctaacaactgcctcagcattcagcatatatcctgaattggaagaatgggacttaaaaaatttaaaacttatacattgttttcaaaatatgccgtcatcttcagaaaagatgacggcatatttaagcccctgtcaaattcgagtgctgactttaccaaaactagattggaacataaactattgatgaacatgtaaaaattgttcatagacgagtattcagttactgtaccccctcaacagggaaagcagtttgagtaaaccattgcatggttgttttttcctcttactgttg

SEQ ID NO: 30239 - DNA, 1621 bp, Homo sapiens
ttttgaagaaattcaaagatttgggactaaagttaccaagttaatttggtatttattttgtcctttgtattcttattttttaggttaaagaataggaagaaaccacaataaaagctggaattataaagtcatagagtggaaagggatttagagattatctagtccaaccttttcattctgtagattatgctaaattcttgaaaagtcatgtaaagtccaggttatagaaattttatttacaatctggaagaaactgatagctagaaaaagaatgctgcatacttattcatattattaatgcctttactataaatttaagcttatttaagctcaaaattttattaaccactctgctctgaatttattttagttaaggattagaagcatcaaacattttgctggaaaacaaaatgacatttggggaaacattctttccccttttgctgttactgatagcttattaattctggctgtaatttttttgtctttatatacattaatcaaaaagacaaagatgttgtataaaatagtcatgaaaaagattgagtaaatagtttatagctttgtagtaacttctgggataggacactaatatagctgtcaggaaaccttgattttagtttcctatgtaccttcagttcgtttttcttaaacattggtataaaaatatggatgtaaaaggaagaaggtattttgtagggtagttgtaagttcctgaatgtgtggaatgatttatgtgcaaacattgtcttgcctaatggaaatagtcataattgcctagttttcattagtctgaaaaatgtcttaaagaagtattgggctcatcttaaatcaagagcaacagaagtctcttcatcagctgctgttagaacatgagtctgcgcagccatagagtagggatctgcagaccctgcaagaacagttcctgtcactggccactgtcagtggtcattaataattataacaatgtaagaaaacaagataatatagaagagtcaaactttgaactttaaacaaaacatgtttgctacattttaacagtcataaatagggcaatgggggggcggggcataagttttagaatatgttttatgtcatttaagaatctgacttgcaagtacctgaatgggagagaagtgctgattattacaaagtagtggagcaaggagagttgaggagtagttggttttaaggggtttgtaaagctgtgttgatgttttgggtaataaaactagattcggggtagaaatgctttttctacccacgtattcataaatttatgtaagaagaaatgctagtaagtgttaataacctgagaagctctagctttttccttcctttttttggggtaataccttcatatgttaatttcagattttttcatgagcaaagatgttcgtgaaacttagccataaaccatattctctgaatatcaagtgtcatccctaacattcaggcttaataacttaatgtttatgtgacttacgtgctagcaatgtggaagaaattttttatctagtaatgtttggtgtgtattatcttaacattagtgctgaattttagaaagcacttctattttggtgacttttggaacacatgggtagagcattgtcaagtggct

SEQ ID NO: 30240 - DNA, 1041 bp, Homo sapiens
tactttacacctacagtcacttattttttttttttgcaacattcattgaaaactccacattatttcaaacattatgttcttttttgacttattcatgttgtcaatgcctttatgataattttaagcttatttttaaatatttcaagatttattacattcaaaactcttataaagcattttgttcatggtataatagtattttgatctgagtagtaatagatttatttgtttaaatatagataaaaattggtcagtgtgtgttctccaaaaaaaaatcttgataatggggaaaatcagagattagacaggaaaagaagatattgtggctaagatttgactgcacttacgctttcatctctcttgcctttttattctctgagaaggtccctaaaattgtagttaatgctgctttattattatgttcagtgacttaacttcaatgtgtatctaatatcactgaacagtaactagggtccgaacatttgctcattaactcctgaaagtagtctgttgtgatacgtcaccaaacaaaggtttcaaatgtagaagcatgaaaggttctttaattatttgatgtgaattagttaaaagttccttgaaattttattttggatgatcttaactcacttttttctaatgaaatttttgctttcaactggtagtaactggtcctgggcattcagatttttatatttatgtatgtatgcaagatacactattctcttttgagaaaatgttgtcttagctaatttctgggatttgtgaaaggaaatgtaatatgttaatagctattattggcactctatgttacaatattaaggatctaaatagattcccacttagccacgatgcttttcttaagcataattcatctctacgtaaatatcccatatgaaagaaaatttagagccctccatttaaaaaagctttcttgctctgcataaaacttgaaaataattaatttcaaagttatattgatattaaaacatagattcagtcttgtcttaaaagtgtattacaatttatttcttgccatttttg

SEQ ID NO: 30241 - DNA, 1697 bp, Homo sapiens
tttacagcctttctatcagccaagatggcaaattgaattgggctctttatgttttaagaaaaatttgcaggctttccccaatactgcaggatctgtgagtcatgggaggaacggatcaaagaaggagaaggaatgtatctaatcaggaaaccatacatcgtttttacttctaaatatttggggctgatcccttacactgtagaaaaatttacttttttaaaagcccttttggctgggtgtggtggctcatgcctataatcccagcactttgagaggctgaggcaggtggatcacctgaggtcaggagtttgagaccagcttggccaacatggtgaaaccccgtctctactaaaattacagaaattagatgggcctggtggcgcatgcctataatcccagctactcaggaggctgaggcaggagaatcacttgaatccgggaggcagaggttgcattgagccgagatcatgccatcgcactctagcctgggcaacagagtgagactccatctcaaaataaacaaacaaataaaaataaaagcactctttacatctttcatataatagagtcactagcttctgtaccaatttcttgtctttagtgtactttggtaaagttttataattaaagcacatttctatcttgaagttaccatccaaggtggtttctggatgctagtttaatgatttaaacactagtggctcactaattcactagatagtttttgttctgttttctttttgctgcctgtttttatttttataattacattggcatgaatttccacttttcaatcttctaaggaatatttgagatttttgcttttaaaacttaatatttcctttaaaattctggaacttcttaagttgacattttaatttttttaaattaaattctgtagtgctcttacagaaccgaatattcttaatgtaagtataagcattacaaatccttgtagaataaatatttttagcattgttacgaaggttaaaaactgggttttgttcacttacatgtcttaaaattgccttaaaatgaatacagaaatttatatggcagcttctagtacagttgactgctttaacatggcctgacatctagtgatatttttctctctttcaaatttctgttttctagctcttaaatatctgtttctcattcttataaatcaagatgcttgtagtatataattctgagactaattatctgcttttgaattttttccactgcaattcatataatgtgaagatctgtgaaaatgctatgggaaaactagcttgggttcaaaatatcttaaccaaatataccctgtaggcttcccaagagtgactgtctgacagttggtgactgtagaagaagctggttgggtgttttctgggccaaggaaatttaaaatgtctgcaatgttatccatcattactttttgctgtcagaagggatggcagattgaagcttttctccctatcgcattttcagagttgccgtgtcagagcttcaccttgggtgaaggaagatgggcaggaattctggaaacagaactcctgagacctacctctgcctgcctaaaaatgtggactgactcagtatgagaaataacaagaaaacatttaagtgtttggggcaaatgttaatcactttctttccatagggcaaataggaggtgcttttcttatttaattacgctgataaattttgag

SEQ ID NO: 30242 - DNA, 1051 bp, Homo sapiens
gagtcactgcaccgggcctatttcttgttacttgacccaacaagaatataggcttcataaagacaagggacttactaccttacaatcttgccagtaattttattataaacttgaaaaaaactgtctacatttcattttttgtttgctgtatgtaaagcatattttatgatattcagtaatcacattttttactctgaaaggtaggcactgaatttagtactaatgtttttattaatgtttcttaaaagtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaagggtacgtgtaaaacaccaatgtactcttacctaaaaacaaacactctggaatgggaaaagtatgtataattctataaactcaattttattacctgttattgaaaaaggatagcactttttaaactttaaattgaaatctggcaaatctaggagtaggtagcataggcatttcatttcaaagatttgtgtgttttcagttttcgggtgaaaatagtcctaagaactctttttttaagagatagggtcttgctctgttatccaggctggaatacagtggcacaattatagctcactgcatcctccacctcctgggctcaagagatctttctgcatcagcctcctgagtagctaggactacgggcgtataccactatgcttggctaatttttaaattttttgtagagacagggtcttccgctatgttgaccaggctggtctctgactcctgtcctcaagcaatcctcccacctaagacccctaaagtactgggattacaggtgtgagccacaatgcctggcctcctggaactcttaaaataaaaaagttaggatcatttaacaattttcctatcaaaattctag

SEQ ID NO: 30243 - DNA, 1057 bp, Homo sapiens
taattgcatgatgattggagatacaatttagtatcataaataagttacttttgttaacttgttcaacaattacttcctgcattggaaaagtgaatgtgtcgctttagatttggtctgagaaaatagtatttaatgtattttgtgtgttagactcaagtttagaattattgaaagaaaatgtttcatgaacagaaatatcataatggctggtgtcattgataagttccctatgaagagttattttgaaagctgaaaagtataagagtccttatttataattagctctctgcataaagttatcatttagttcattaaatattttttaaagcctgatattgtcttgttttaaaaagctattgcaaaatggcatgtatctttgaattaatagcttaacataatgtgttttcattattaaaaattctagcttctttgcttatttttaattttcatcacaatcttcttttcctaggaagattcctgatgttgcacccattgtaagtgatcagaaaccatctgtatcaaagtctggacggaagattaaaggaaggggcacaattgtatgtgtgataagactttttttgatattatgtatctaataaaaaatttttacctattttcaaagtcctagcgttaattttagatataatacaaaatctgttcaaggaactaattgtattttccatggttatgggaaggtattgctgttagatcaaagtatactgctgtgtttgaatgggtttaattgagtatgaaaggaggaacatgtgaaaccatcagtgagtatgctgagaaatcattaagactttaaaaaggaaaattttatgtggattacaggtgaatctcagccttgcccatctcttttaatgccttgtttgaaataacttcacctgaacctaaaataaaagttaaaaactaaaaaaaaaaaaaaaaaaaaagaactttagaccatccttttggtaacttcaatcattacctttgatgggatgatctgagattgggtcttttacttaactctgtcacatagcagactgtcgtggagaggcattttttaaaatac

SEQ ID NO: 30244 - DNA, 1072 bp, Homo sapiens
gaaaggaataagaagtcttgttttgtgtgattcagagagtagattgaaaacttagggagagggaatttcaggaggagaaatttgggctgggtttacaaaactattactatcagtttaaagctctctgtcactagaaatgagttcccatgataggtggtaaattctccatctttaaaggtgtgaggctgcttcttgccagtcaagtgatgccttagaagggaatcctgaattgacagaatatatagaatttgcagatcattaatctaaccttccattttacacatgtggaagttgagggccagagagacaaagttacctgcccaagacatgcatcttagtttagatggggcatagggataaaaatgatcatctttagatttttgttgttgtttgaaaagcaataaaagaatttaaaacacctttttctcatctttgtcactctgcaccttcatgaaaaggttttttgttattgttataaattgcatcataacttgtcagcatagaatggataacagagatgagaattaaaaactaaaaatatttgtgatggtaataggaagttagtaagcagttgtgttgcattctttttcttgtaaatattttatggttttacctgtttcttaattattcatatcccttattttattgtgcttgatattcatcatttgaactgaaaataccataagaatctttgacgtttgtttcctttctagttattcatcagtctttcttcccttgcctacccagacttcctaaaaaaggaaccgccacgtgccatctatactcggtctcccattttctcctcggctgtgtgcttgctgccttctgtgccttcccctccccgcatctcttagtttactgactaagactttcaggtacttctgatggccagtaccatggcgtattttcagcctcacttctggagccctctgctagctctcctttctcccactcaggccatttcgtccctgtgttctaggcttctcttcttcctcatggccttttctctctgagttcctgttgatagatgcagttgcctattgagcgactccagcttcctgtctgcttatga

SEQ ID NO: 30245 - DNA, 1026 bp, Homo sapiens
atctttatacaatgttatgtttgcactttttattaagtaaaatacttttatatatatagatgttctacatttgccttcttcattcaacattgtgttctagagatatatccttgctgaaacatgtagctgtagttcattttcttcagaatatttcgttatatatctctaccttaatgtttttttaacccattctaccattagtggagatttggtttattttcttctcagtgttattggtgttataaatcaggcttctatgaacatacttgtgccaatcttttcttgtttttctttattttcttctgtttgattttaaccatggttgttttgagagttcctcattagctgacactgtcatatccactgtgaggagtttgtgagaggcctttcttcttgttgtgttttcccctttctgccctaccagtaattaattttaatatcatgatgagtcaacataattatatattttttcaattgctttaattgtagatcaagaagctactctagaagtcggagcagaggatggtacagcagaggccgaaccagaagccggagcagttcctaccggagttacaaaagtcacaggtgagcttgtgatctcaccctgtgatgtggtctccatcatgtccactttttaaggctacataggcagagggggtagttgttgagaagaatcatgtcattactgaatatactactggcctattttctcatgtagttttttctatgtaagagctgtggaattcttgactattcctctgttgggatcttatcagagtgaggcaagaggagcagtagaaatatttaagaagccttgacccctacctccacctcccccacatgcatcttccttaacctaagttttacatctgcattcacctcttgacatgggttagagattgggataggaagattgtagagaggggaccaagaggaagaagtatatatatggtgggaagggtggccccagatttctagttctcctagcttctttccctcttttgcatctgaggtattttctactgc

SEQ ID NO: 30246 - DNA, 1050 bp, Homo sapiens
tctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggca

SEQ ID NO: 30247 - DNA, 1038 bp, Homo sapiens
ggggcatgaaagaggagaagtcctgaaggcaatggccacaagaggccagggcctgtgcaggtgtggtttcccatgagcaccaggcatggagccacagtagctctgggacagcagggaccggtgctcccacttatgtgctgagccctggggatgctgtgatgagcagtatggactcattcctccctcggcaggcaggggaggtcagaaggggccagataacagagatgctgactcaggcacccgggaagacaaaagctcagatggaagacaggtggtagcctccagaggagcagatggctctccctggggaactcagaattgtttcatggcacaagtagtatatacagagagcactcactccatgccaaatggaattctaggccccggggacacgtgcagaatgagcctccttgtggcacttaactctgtatatgtagaaaagggtcagacaggactgggagggactgggagagaagtctcatgggtggatttgttgactggccagaaaggaggtgcaggttcctaggatgttggcactgcctttctgcacagtcctgctatgaatggaagaaacacaggcttgctcaagagaccctgaaacaaggctggctgacaggcctgggggcctggctgctcccccaactcttgtgcagattccactcatctctgtgtttccactctgttgacctcctcctatatcaggttgcatgacacctctttttcctccagccctccccccacctccctcattctcacagcatttccaccttcacactccagagtcttggacactgtcatcctaggctctggggcagaggcctctgggtggctgtgggatggtgggcaccacgattggtgtctctggagcactcactttccctgatcttgctctttgggaccaagcagctcactaacatctcatgtcctgaagcatgcataggtcagagcagcactgccttgctggggaaggccggactttccttctttctaaaggatcaatgaggggaggtgaggcaccctggcttagtggtgcttttg

SEQ ID NO: 30248 - DNA, 1044 bp, Homo sapiens
gaatccctctaaccacataaggtaacttgttcacaggtttggggattaggacatggatatcttaacggctgagcagtatccagtagtacccttggtttcactttccacagtttcagttacccaaggttacctgcagtctgaaaatattaaatggaaaattccagaaatacacaatttatgttttcatttgtgtgttgtactgagtagtgtgatgaatcttgtggcatctcgctctgtcctacctgggacatgagtcatccctttgtccagtatattcacactgcagatgctctctgcccattagtaacttagtagctgtctcagttatcagatggctattggagtactgcattgcccatgttcaagtaaaccttattttacttcatcatggcccaaagtgcaagagtagtgatcctgcaattggagtgtgacaaagagacgctgaaagtgcttcatttaagtgagaagatgaaagtttctctacttaagaaaaaaaaatcgtaggctggggttgctaagatctgcagtaagaatgaatctgctatctgtgaaattgtcttctgaagaaagagaaattcatgctagttttgctgctgcacctcaaactgtggcaaaagttacagccaaagtgtgtgataagtgcttcattaagatggaaaaggcattcaatttgtgggtggaagacatgaacttctagaaatgtgttctgatttatggcaatgggatttggtactgtccaaggtttcaggcatccgctggggggcttggaacgtatcttccaaggataaggggtagggactgctgtattatattatgatcacctttcctttcctgggcacctttctgtttctctctagttagtaatcatcttttttgtttccttagtttttttcatgtacttatcacaagccaacttcctcttaatagactcaagcacacatcaatttctttctttggaaaccccctgcccagagccttttgacctgctccttctgagctggtcgctttcttggtcggtgcacagccgttggcttaggatcctcc

SEQ ID NO: 30249 - DNA, 1071 bp, Homo sapiens
atggggtctggctatgtttcccaggctagagcacaatggctattcacagatgtggtttagcacactgtggactcaaattcctgggttcaagtgatcctcccaccttaggcttcctgctagctgggactgtaggcatgcaccactgtgcctggcttaaaatgaatgttatattaagacaggtaccacttcccacccccatttgtggaggaatatggtggataatttttgttgatgccattcttagtcctataataccagatgtctagttctggggacccaagctcctgaatcatcacctttttttaaaaaaaacctgaattactaagaataagaagctttccctgtttcttctctctcccatctcaaactgtgttggctttgtgcctgcttgaacttacctactgtctgtttcccacatctgtttcactaatttccactggagcatccttagtggcttgggaggcttgtaagggcaagggcatctcttactcatctctgtctgctatgccaagaacagtgcctgccacagatgaagcagggcagggcagcagcagccacctttgaatgttttctctgtgctgaatacttagcatggattctgttttaattcatttaatgtccacagcagctttacaagaaagtagattactattagtacttccattttaaagattgggaacacattttaaaataatttggttaaagtcgtagcgctctgttgagtggcctgtttttatctctttcctttggcccttgggatgaaaaagtaaaattattcaaagacaaaagtaaagtaagaagagaaataaaaagtctggaaaatgaggtggatggatcatgaggtcaggggatcgagaccatcctggctaacacagtgaaacctcgtctcaactaaaaatagaaaaaattagccgggtgtggtggcgggtgcctgtagtactagctactcgggaggctaaggcaggagaatggcatgaacctgggaggcagagcttacagtgagccgagatcgcaccactgccctccagcctgggtgacagagcgagactccgtctcaaaaaaaaaaaaagt

SEQ ID NO: 30250 - DNA, 1057 bp, Homo sapiens
ttatcatgcctgttctttagtttctggaatgaatgaatgatttgtgatgcctttcctaagtccttttcatcttaaaaattttttttcatctgaacaaaagatcattttcccatatgattgatgggtttgctttttatttaatgatgaaagaggtaaggagttgtttgttactgtcagagttcgtctaatgctagagttgagaggtccttagatgtcagctagcccagccttaccattggtgcagaaatgccttatgcaaaattttagacagatgtttgccctgcctttgctggaatacttttagtgatggataactcactgccttttctggtattgtaacggctccattgagtagttccccattttttagctgaaatgtgtctcttaagtaaccaagtttcatcctctggagtaatatataaccagtctttttcctgattgactatattgatggccatgtttctttcctccttgagctttaattttcttgcgtataaaatgacatgagttacatcacctggttacctcactagcgttgaggtaaagaacaacttgacataattgtgaccttaggcaaaattcttttccggtctcagagtattaatatattagttttatttctggtatatattctaatgggaaaaatagcagtgtgttgtctgttggcttgggcacctggatacttttcagttgatattattgctctgttaccaaaggcattaatttgtctcttcatcgaacatttattgaccattcactgtgtactagcaattactgtaaaaacattgaagaagatagacaccttccctgccctattggggcttcttttccttcatggatgtttgtactttgagatataaatgcttttgactgctcaagataaaataatattgttagcgcacttttaatgtttttggttttctaattagtccaatattttaaagtatgtctttgatttatagatatttggagtctgggagtgatccttttcatgttggtgtgtgggcagccgccctttcaagaagccaatgacagtgaaacactgacaatgatcatg

SEQ ID NO: 30251 - DNA, 1047 bp, Homo sapiens
ggagtctagtggtgttcccaggctggagtgcagtggcacagtctcggctcacttcagcctccacctcctgggttcaagcgattctcctgcttcagcctcccagttagctgggactagaggtgtgtgccaccgtgcccagctaatgtttgtatttttagtaaaggcaaggttttaacatgttggccgggatggtctcaatctcttaacctcgtgatccgcctgcctcggcctcccaaagtgctgggattacaggcatgagccaccacgcccagcctataatatcttttagttatattttttaagtctataagaagtgtggatatattgtcctttttaatttcaatagtgataatttgtgccttatcttttttttgtcttgatcagttttgccagaagtttgttattttattagtctttttctaagaactaccttttgcttttattaacaattataatttttgttttatgttttattaattttcttttctcttgtctgtagtatttcgtgccactcacttccatgggctaattctgttcttcctctttctgttgttggatacttagctcacaaatttcccttttctgttgtaataatttaagggtataaattgcctactgataccattttagctgcatcccactagttttgatttatagtccttttgttattcagttctaataagtattttctagtttgtgttgatttatttcatgtgtgagttgtttacaggggtgttttacatttccaaatgtatggcgtttttctaattagctttttattgatttctaacttaattgtgttgtggtccaataataatagcctctatggtaccagtgttgtttttgtttttttgttttttcaaattgctgagacttgcttatggcctagcataaggtctttttgttctggaaaatagtgtatattttccagttttggagttctgcataaatccttaagatcaagcttttttattatgctgttcaaaattatttgcatcctgtatgagtttttctttctcctactggatctatcagttactgaggtat

SEQ ID NO: 30252 - DNA, 1636 bp, Homo sapiens
tgttactactcatatgagatttgaagccttctttttccccaaaaaatggtcgatctcagattttaataaggtgccccttttctcaacccccatagaggtaccttttatattcactgtgaaactgtcattcaaatgaatctactcctggtctttaactttttttgcacttctaccccaataagaggctgtcttgcagtggggaggaatgcattttttgtgttttcttgttcttcccattttatcctctttttgcttatttggaatctgactatccatgaataagatggactttgagatctacttgtaagtacacaggctgaagttgaatatctgtatcccagtacttaccaccatgctttgtgcatgttaggtcacttttgtcacacatagctttaccatcacacaggtagtaaatttcctgtgctgcctttcttctgtgcatgtgacaattggtagttgagaagagcatgaactcacctatttgttattttgtttttggtgctctaggtcaggatggctaactggttggctccccacatggtgccctacgtctatatcacaccttaaagaagctgaagagaagatgttaaaatgtaaggctttcttcttgtaagttaaatgagctgtgtactaagataggtccaatatatctcattgccctgaaactggaggtaagattctgtggtgtgttcattgttggcaaaataacttttttccttttccttgtcattagaaagtacagaaatgaatgtcgggggctggcaggtaggagttctaaaactttttggtcttgggcccctgttatactcttaaattagtaaggaccccaaggagatttgtttatgggcttattatcaatatttatcatttctaatacaattagaaattaaaattgaataatcaaaaatgttaatttattaatttctttaaaaataatagtaaacccattacagattaaaataaataaaatttgtaccaaaaaaagaaaaaaaatactttccaaacattgtttacatgtttacaaatgtctttaatgtctagcttgacataaggttgctgcttctgctttcagtctgatgggtaatcacatatgtgacttctggaagactactttatacctattagagaatgagagtgaaaaatagaaagtcttagtattatgatgaaaatagttttgacttcctggatctcctcgaagagtctcagggacaccccccctgactctgcttgagactatgctttgagaacagattctaggtgtttcagagcaagcagccttgtatagtggaagtactagactggacccaggtaacttggtctaggcccagatctgccactaggtggttacaagatcttggacaagtcactttgctcagcttctcatttcttataaaatgaaggggtaggattcttataaaatgaatgggtccatagaattccttctagttctagcattctaggattctatatttatagtggtgtggaagccccttttttttccttcttatgagcactaaaatttacccaaacttgtaccatcagggcattccaaggtatctgtgggtgtagttctaagtagtggtacttattgtgcaattttgttctgctgattctacttaaaggagtggattaggta

SEQ ID NO: 30253 - DNA, 1864 bp, Homo sapiens
ctgttttattaaatgcttttactcactaactgtctgaatgcttttccttatccaggctattcttggggcaggacattatgtatatgcagatcaaccagaagaattcaaccagaaagtaaaggagatctgcgacactgtggactgaacacactgaagctctgatgggaaaacctggtgactgatatagttgttcagcaataattcatagtctgtgatgaagagtagtgaatacaacacacaaccaggcagccttcttgactatactttgcacatgttttctttaggaattcactcacacatttaaaccagttagtgccttctagaagaatggctttcctttctcctacacaaaattgaaatatacaagtctctaaatataatacctttaaataaaaggttatttgtccctctgatgtactgaaaaactgtaatttttcagctgaaaattttttaatctaactttgctagttatttttatattgcaatctatattaccaatttaggaagtgatttctgagtctcttacactgtaaaggtgcactttattttctttgtcttccccatcatgtatttattgtgtcttgataactgatattaatctaaattcaatgtgtttttatgtaaaaatttgtcagttgtttagaatatttcactttgtttttgaaacggagtgacaaggcagatttttggttagaggacgggagttgatcactatcattactttttctagtttacctgttttttatatttaaggctgctaagccatgttcagcattttaaatgtggtctatcctgacatacagtgtataacaacataactccttggaacctcctatgtgtggtataattctactcttccaaggaacatgacttcaatactttcagtgattcaggtactgaaaagccttacctaaaaggctgttctttgtttccccctttcatactattcttttccatgacccaggatgcagcaaatgaaacagatttcttctcttaaggggatattaagactgttacttcctagtaagccaagtaataccatatttttattaacatctaacttttgtagatgggtgctaaaattgcatacattttaaccactaaaatagaaaaacaagtggtgctattatgtctcatggcaccagaaatgagctagcacttgggtttgttgttgctgttgtttattaagagtattgtgttaattaaatcattacatacttgaagttatattacaaaaattctagaaggttgattgaactatttttttaggaactaccatcaagtgtagcattttcttgcagttttaaaatgaggaaaacttctttgaaactgtgaaatgctccatgtggtaactggctgctgagaaaacccttcaccaaaaaaataaataaaaattgaataggattgtcatcaagaaggcatctttcgctaacgttgcttgtctaggagaaaggtagctatgtaaataaaaacagtgaactagagcaaatagtggtttaatggttttgttattgcatttttaaaatggttaattagggaatttgtagttgttaggaaatgtaaggttgtgtcactgttgattaactgccagaaagactgaatgttctattttcaacatttctcccctataaaagaatagacaaattatactgaagcatgatataaacatcttcccaatgaacaatttgtctcacttgtcagattaactaggttagtgcaggaagcaacatgagcgccaagatgtgttgtctgatttctctaccttaagaacaataatagtctttttagttagtattttggatggccaggtttcaaacctgtatgtggtacaaataatttgggtaatatttttgtatttttgttt

SEQ ID NO: 30254 - DNA, 1031 bp, Homo sapiens
taaataatataataaagaggaccttcgatgacagggctcacaaaacatcatgactgggccaagtaaaaaaaattaaaaatacatgtgacttcatgcctctgctgacatgtcatcttgagaggatgacatccatcttgatgagaccgtacaagtcctggagggcagaccagaacctctgagaagggccctcatggtcactgcagggttgcataccatctcaaggcgataatccagtgacgtacacagcatctctggctgccatgctgtccttccctgcctggtcaggccccaggacctgcccactagctcctgtggcaacagcctatagagttcagtctccagctccccagagcttctccaggagtgccagggagcagagcccaagcctcctccaattacagatcccttctcccaggctccactttgcctgttcaagcctttgagatgccgcctcccttacctagctagctctttccctgttggattggaaaacataaccaatagaaacctcttaacctgtctctggatgccaaagtccctggtcttcttgcttcccagctcgcccccaggagaggggagcaagaaacccctctcatgctttaataatcttcctgctggccaagatgaggcagccgagttaatactttaattcaggcatcctgccacgtgggtttgccacatctgccctgtgagagtgtaagtctccagagggcagggacaaggtcttattttcttttcttcctatcagctcatcacattttatcaggtttcacacgcctctttgaccggtagccccggtgtcttcatatgcccatgcacagaaaccttcacgttgtgtccctataagaatcactcccatttttccagcgaagcttcacgtccctgggagaaaggtagacagtaggcagcagagagcagatttagacatgacagtggcccagggtccagcttggagccatctgaccccaaccctagagtaagtgaaggggaccctcaatgctgaggatcaaagctggggtgctgagagtttt

SEQ ID NO: 30255 - DNA, 1052 bp, Homo sapiens
caggagttcaaaaccagcctgagcaacatagtgagacccatctctacaaaaaatacaaaaatttagccaggcatggtggtacacatttgtagttctagctacttggaaggctaaggcaggaagatcccttgagcacaggagtttgaggctgcggtgaactatgattgtgccactgcactccagcctgggtgacaaagtgagaccctgtctccaaaaaataataaataaataaaaagtagagtcatggtggcatagaggttgccgaattgaaaattttggtatagaaaaacagaagagataatttaaggttaattgcacacagaggctacagtgagaattgaagtagatttctctgagcacaaactggaagagaagttctcagccttgccttcaagttttatgtgggacacggcacatacaacttctgcttacacccgcgggagaatattgttgtacttatcttgcgctgtgtctagatgaacaaaaagttggggattactggcctaaagagtatagaaaacagtgagattgaatacatcaagccaaaacagcaaaagtaacagtttttggacttcactcaagttaaaagggcctaagaagaatgtattaaaggatttcatagaagcagttggtctgtggttcagttgagtatttcgtagaacacagtttttatttggagctggatgtgcagccatcatgaaaagagtgccccaaggacctagaactggacttagacaccggcaaagtagtgaaaatacattgaaactatagaaagccaactcaacaagataagtgtattcaactgggttccttacctaagctcagtatttataatttttttatttgtatgtcatttatccagtaaaattccttagtctttagtaaaaggagactttcttatattacattcgactatatgagttcttaagagtagggaatatgttttgataatctctgtgtctactaatctacttcatagattcatagaatccatccagtattttcattgaactgaactaaagaattgttgaataactaaatgtgatgtgcta

SEQ ID NO: 30256 - DNA, 1686 bp, Homo sapiens
gaactcacatttcctcatttcaaaacttactgcaaagctatagtaaacaaagcattgtgatactggcataaaaacagacatataggccaggtgtagtggctcacttctgtaatcccagcactttgggaggctgaagcagaaggattagttgagtccaaccagcccaggcaccgtagtgagaccccaatctctataaaaagagaaatacacaaacatatagactaatggaatagaatagagaatacagcagtaaatacttgcatatatggtcaactgattttcaacaagaatgccaagaccactgaatggggaaaagataatcttttcaacaaatggtactgggaaaactggccacatgcaaaggaatgaagttgaacactgacttatactaaaattaactcaaaatggatctttgactgaaatgtaagacctaaactataaaactcttagaagaaaacatagggcagaagattcatgacattggatttgccagtgatttcgtggatataacacctaaaacacaggcaacaaaagaaaaatagacaaattggatttcatgaacatttttaaagtttgtgcactaaaagacactatcaacagagtaaaatggcaacccacaaaatgagagaaaatgtttgcaactcatatatatgataaaggaattgatatccagaataaataaagaactcctaaaactcaaccagcaaacaacccatttcaaaaatgggcaaaggacttgaatagacatttctccaaagaaggtatataaatggccaataagcacatgaaaagatactcaacatcattaatcactagagaaatgcaaattaaaactaatgggtgtgaggtacctaatcacacccactagaatggctactatccaaaaaccaaaataacaagagttgatgagggtttgaagaaactggaacccttatgcactgttggtggaaatgtgaaatagtgcagctgctatggaagatgatatggtgattcctcaaaaacttaaatatagatttaccgtaaaattgagagcagtgtctcaaatagatatttgtatacccatgttcatagcagcattattcacaatagccaaaaggtggaagcaacccaagtgtccatcagtggatgaatggataagcaaaatttgatatactcctacagtggaatgttagccttaaaaaggaaggaattctgacacaggctacaacacatgaaccttgaggacatcatgctacatgaaataaaccagtcacaaaaagacagatggtggatgattctacttatgtgaagtacaaggagtagtcaaattcatagagacagaaaatagaacagcggttgccagggactggagggaggggaagggggcgttagtgtttaatgtgtacagagtttgagttgggcaagatgaaaagagttctgaaaattgatggtggtgatagttgcacaacaatgttaatgtacttaataccactgaactgtacacttaaaaatgggtaaggggctgggtgcagtggcttatgcctgtaatcccagcactttgggaggctgaggcaggaggatcacttgagcttaagagttcaagatcagcatgggcaacatggcaagaccctgtctctacaaaaaaaaaaaaaaaaaaaaaaaaatttaaattagccaagctaattagccaggcataatcacaccact

SEQ ID NO: 30257 - DNA, 1071 bp, Homo sapiens
gattaaactaatagtaaatcagtagccaacatttgtggtgtatacactgtttgccgagcactgtgctgggtacttatatgcattctgtctttagctctcacaacctcactgtgcagcaggtcacccctggcatgtgacagataaggaaggtcagagggcttgcaagtaggtcgtgatcttctgaagaagtgtgtctttgggggcagcaaagctttaagtcaatgttgctgtacttttgaggtggcttttcttgatgatttttttttattttcctgaagactaataaaatattttctctggtgggggagaggagagggtcagtggtttttcctttaatgtatattttattgcagtgacagatatgctccaagcttgcatgaactcgggcattttaatattccaacactctgtgatccagcaaatctccagtggtttattctcaccaaagctcagcaggcaagagagaacatgaaaagaaaggaagagtaagtactgccagtcttctgtaaagtcagatcattcagtctaactgaaaacctcagatatttggaactcataaatatgggacctggaaacagtatgaagcttaggaaattgactaattattagatattccatatttatttcttccctacctaaattatattaccaccacggacctcagtttgagaagtacagcttcttaatataaaagtcaattcagaaacagaatgaaaaataagaatatcagcaaggaattttccagatggaaaagactgacaacaaggaaaaatattggttatttcttgattaacaggaatctttattgttttaaaattttcaaactgttgatataaaaagaactttatctgtatcttgattaagttgagaagaaaacttaaagtacaaaactcatcttaggcccggcacggtggctcatgcctgtaatcccagcacttggggaggccgaggcaggcagatcacttgtgaggtcaggagtttgagaccagcttggccaacatggtgaaaccccatctttactaaaaatacaaaagttatccaggtgttatggcggtcacctctagtcccagc

SEQ ID NO: 30258 - DNA, 1051 bp, Homo sapiens
ttactcatcccctgctattgatagaagtttaagggttctttctgtctaatcctggagagattagaagcaggcccagctgtgaaacatttgcagaaccatcagccctgactgctgtctgtctgcttgaatctctaagcagcatattctaagtaagaataatcttacagaaaaagcaaacagcacttaagaaagtgatcagtattataggccatgataactaactgctatgaccatttctgttttttactgtctagtttatggaaattttatagtacctacttttctatgcagtgtttaagggtgattaaatgtaagatatttggacattttaaaccaatgaagtattttaaatagactggttcagggacacgaccatggcagttttgctttattcacgttgttaaatgggcttgctgagtaactcatgtgttggtctagatgtagcacattgaatccacttatcaaaacactgtatccctaagcacttgccacctgtgggagaaagtatttgagacactgagttctgcctagagttgtatactttgtagacctgaactgaagcccctgatggaataagagagttgtaacctcaggcagaggggagggaacagacagggggctggtgaggtaggagagtaagagtgaagagaacctgtcctcctcaggatcctggttttctgtgagcctgcttttatctgggaaatctttagacagcattacttcccaagggttaaactttaggtgggtcctaaaactaggggttttatattcttcattttctccttccttcagtcactaacagctgctaggtaaggcaatataagagcttttttaaatttatgttatttttagccctttactgctaaaaacattaacaaatacttttagagatccatgtgacagtaactcaaaagatttaacaatgatggctattggcgtgtcttccaaacgtataatttggcctttgtgggtggcattttcagtgttgtgagtgcacagttagggccccaacatgtaagaatatatttacattgtgtgttcttttgtttgg

SEQ ID NO: 30259 - DNA, 1047 bp, Homo sapiens
tcactgccttacctacatgggatgcacctctgcatttcacatttttactctgttatgcaagatggagacctttgtattccttggaattggaagaatggagaagccattaagtaacacagaaatctgttttatttttttaagagataagaaaggaacttaaattaaaaatatttaaatccacaatttgatataacagtattatttacataagaacaaagtttctaactgctgctttaaaagtagacttttttaaaaaaattaatttctgctaggagaggttttatatgccaggcgtggtggctcatgcctgcggtcccagctacttagggaggctaagataggaggatcacttgagcccaggaggccaaggttgcagtgggcccagattgcaccattgccctccagcctgagcaacagaacaagaccttgtctcaaaaaataataatgataatttaaaataaataagtaactaataaaaagattttatatcccagtcttatgatgttggttggcaaggctagataaaaagatgttagaatgaaagaacatatttttagtgatatgtaaatgaaggattctacaatagtcatatatttttatatgaatgaatgttgggttgggctggagaggtatgtgtgtgtaaatataaaggtctcacattcagagtatagctctgaaataatggaactcatgtctacaattcaacatgcatctgtatagttacatctcatgtaaatatacacagacatattttgcagccagtaattgacagttaatgtccaaaacaggtgattgataggtaacagaaattagataaccaccaattttgcccaagagaaagactagaaggactaaaagcagttgaatgtatggtactgacattgtcataagcagtctgataaccagtttattgaaacgtgtgcattaacagagaatttaattttaaacccataatttctcctatccattaaaatattataattgttagtagtatgaaaccaacaggaaatgttttttaatcatttagtgaggtgattcatttgtttc

SEQ ID NO: 30260 - DNA, 1083 bp, Homo sapiens
tggtgatgtaagcctagagtataaaaggcaatagcaggccaggcacagtggctcatgccacagcattttgggaggctgaggtgggaggatcatttgaggccaggagttcaagaccagcctggacaacatgggaagaccccatctctacaaaaaatttaaaaattagccagatgtagtggcgagtgcctatagtcccagctacttagaaggctgaggtgggaggatcacttgaacccaggaggttgaggcagcagtgagctatgattacaccattgcactccagcctgggtgatggagtgagatcctgtctttaaataaataaataaataaaatggcagtagcataacaagaatgaagctttccacatcttggtaagatctcctcttgtgtgccctactagggatctgcaagccaagggattgggttaagatatttgcttctgataagatttatatccttgaccattagattgggatcttaatgtagcctctcatgtgtgtgagatttctttttgtacatctgtagctcactagaaacatttctgtataagacgtctgaatcataactcaaacttgggtgtggcattaaggatgggcttgtttcttttaataataacgtgaacaattttagagctatatatttcgttacaaattactaatacatcctcatttgagagataaggaaactgaggcagatgtctagctggccgcaaaaccaagtgtcttggtgccaattttagtgttagttgtatttgagcacaaagggctaggtaaaggggtcaataagtagatggtaaataagtagaagagatgtgactgaagtccgatctaaaacttaagtctgaagctaaaatccatgctcttaattactgcttattacttcccattccctccttaacccacacccaggtctggcttctgttcccaccgttgtgtacagtctcctctgggagaggtcaccagtgccatgagtggggctcgagggcagctccattgttctcaatgcaaagctttactgctgttttgatgctccatacttgaggtgggtctctctgatctcacagttgtagattgtgggcagaaa

SEQ ID NO: 30261 - DNA, 1027 bp, Homo sapiens
ccttgaattcctgggctcaagcgatcctctcacctcagcctcccaagtggctgggattacaaatgcaccccaccagcctggctaattttaaaattttttgtagagacagagtcttaccgtgttgcccaagctagtcttgaactcctggcctcaagcgatcttcctgcctcagcctccccaagtgttggcattacaggcatgagccactgggcctggtgacttttcccttacttgatggtatcctttgaaggacaaaagtcattaattgtgatgaattccagttttttttttcttttgttgcttctgcttttggtgtcatatctaagaaaccatcactaatctagggccgggaagatttatgtctatgttttcttttaagttttagctcttacatttcggtcttttatccattttgagttaatttttttatatagtatgagataaggatccatcttcattcttttgcatgtggcaccatttatcccaggcaccatttgttgaaaagactgtgctttccccattgcattgttttggcacccttttaaaaaagcagttgatcataaatatcagggtttatttctaaagtctcaaatctagtcctttgatctatatgtctacccttatgtcagtatcaccctcttttactattttggcttcatggtacattttgaaataaaaaggtgtgagtcttccaactatgttctttttcaagattgttttagctactctaggtctcttgactttccatctaattttggtatcagctggtcaatatctttgaagaagcaagctgagattttagtagggattgcaatgaatctgtagatcaatttgaggagtactgccatttatcaatgttaaatcttttaatctttgaacatgaggtttctttccatttatttaggccttcagcttctttcagtaatgttttgtagttttcagaatataagaatataagtttttcacttcttttgttaaatttatcctaatcttattgtttgagactattataaatgttttattaatt

SEQ ID NO: 30262 - DNA, 1084 bp, Homo sapiens
aaccttacgactgcagcgaatgtgggaaagccttcagtcagctctcttgccttattgtccaccagagaattcacagtggagatcttccttacgtgtgtaatgaatgtgggaaggccttcacatgtagctcatacctacttattcatcagagaattcataatggagaaaaaccttacacatgtaatgagtgtgggaaggccttcagacagaggtcgagcctcaccgtgcaccagagaacccacactggggagaagccctatgaatgtgagaagtgtggtgcagctttcatttccaactcacacctcatgcgacaccatagaacccatcttgttgaataacaagtaaggaagaggaagacctccagcattggtcataaccttctgcctccctaatgagacacctctttgctgttttcttcctcctctataaaagtgagggctgtgtccttaaaagttatagttttcaggaatgcagcagaagacacaagaaaagcatttcagaggctaatttaaaacaaaaagtaagcacctaaaggcaaggactttgttttaactgtaccttaagcggtcatgttctctgaagtggaatgtggctttcctaggaatgggtcgtacaaagctaagtggtaatgatgctatttggggaaaggtcttttttgcttaattttgttttttaaaactctgatgattgcttgagcaacaggcaggttatctgcctggttgaattctggttgaaccgtgtattctaatatttctggttaagtggtgactgggtaaggaaaccacttggggtagcagttcaacaattcacttacgaatgtttataagctttccatttcctaggtaattttttaaaagccagtcaaaacaaaaactttactgaaaatggacagaaataggaaatggactttttccttactgtctatacctcctgaaccttggtattgtaaagatctggggacctctgggtctgttctgaccattccctagtctccatggccaagcactcaaggattgatggacaccacacaccagctatattcatttgccaagatcaacagctccttctccaaacaactcaagcc

SEQ ID NO: 30263 - DNA, 1033 bp, Homo sapiens
tgccatcgagtagatatctttttgaatgctttatgtgaattaactcatcaaggattcacagattatcagagctggaatgacccgtaaatattgtctaatttgtcacccttttcagataaatagcctgtcatgtaggcccactcacatgggctattggcagagcaaactttcctgagtcccaatccagtctactatcatcttgtgaatgggaggccaataccatagccattggatctggcattttgtttttgtttttgtttctgggtttttaaaaagtaactttttctacctataaaagtaatatatgtttattgaaggagaagtaaaaatatagaagagtataaaggacaaactaaagtgacccattaactgacctagagataaatgtgttaatattttggtgggttttctttatgtcttttttaaatgtgtgtgttttatctgtttattaacaatagtttctgtttattgagtgcttaatgccagtatatgtgtgcatatttcttgttttttagtgttttgtatcttcctgttttaacatattatattttctcatgaatattctttgaaattatgatttttgataccttcataagctatctttgctagtctatcaatgtttatttgcctgtttatttaacaattgtagtaatagtgtgatctttgtacataaatctctggccatctctgattatgctttttcactttttctttgattacagaagttagttattcctatgggaaaattttcaaacattacaaaaagataggccttaaggcaaaagtttaccataattttattcttcagatatgatcacaataaataatttgttatatattcttatagatttgttttttttttaaagtggagcaaaatatagataatagaggacatttgaggaaattattcacaattcattattttaccacagtgatgattatttttccttcttgatcttattcagatgtatttttaatttttaatttttgagagggatctcactctgtcacccaggttggaatgcaatggtgc

SEQ ID NO: 30264 - DNA, 1034 bp, Homo sapiens
agatatttttgagtgaacagttttggtattgatatttttaagaagcagcatttacagaaactggtatttttgcaacttttttgtaagtcaaaacttatttcacagttaaatttatttctgtttctttttaactgcagcctgttctctgacactgagctatacctgaagaaaaactgtttaattgatatgacatcttgaagaagggacaatcagtgtgtctctagtttgtatcaagtagatagcattccctaacactatctcagctccttggcatttggtagaagtgggtaaatcagacttaatgcacaagctttgctatgaggacattttgctatacaacttttaactatattaactggcttttcatatagattattgtatgatggccagagtgtactaattgatgtgaatattcctattcgtttaatctttataattataaaaaggtaatgaataacattctgatttacttatcaagtgcttaaatatttgatagtatgttagtctgatgttaccacttcttgaacagctggcaaatggggtgtgaacctaggaggctacaagccaatgctgatttttgcggatgcttccacattgttatcctgagagttattgtgtgtgttattagatagtgtccctaggcaacagctctttgttttcgttctgtttactgggacagtaatattccctccctccctgcaccttttctccccatgagcagggttcccagttttccagacctgaagtgttttccaatcaaagcgaagagacgatctgtggatgttgaatatgcaaggagctgaagagagagacattagaagagagacttgtccaggtgagtgagcaagggacaagcagtgggagaaatagtcagccaataggaagcctttggaaattttagaggacaagctgggtgaggctcaggagataaaataactgtctcttatagggatgttggggacaggggtgggtgaacatgtctggggccaacttttccccagtactaattttatcattctcatttctagcatttt

SEQ ID NO: 30265 - DNA, 1131 bp, Homo sapiens
caccgtgcccggccaactttctttttttaaatttcaccagtttcactggggagtgggtcagtggaattcctcataatgtcatgtcagaagtcaatctctgaactcttttttaacagaattattctgcccgctaggttgagaaaagatgagagtgggggagaaagagaagcagaaagactattgtaataacacaataaagagatattgctggcttggttctacactgtggcagtggatttggcaagaagttgttggattgtgggtatattttgaaattagagccaaagctttgctgagattggatacgaagagtgagaaagaacagggtcagggatgactatatggtttttggcctaagcaactggaaagatggagttaacggagatgtagaaacacatttgggctagaggtggggtgatcaggagctcaattttggacacattaaatttgattcattgcccactgcatatccagttagagatatcaaataggtaataagttgtaagagtgtggagctcggctgggcgtggtggctcacgcctgtaatcccagcactttgggaggccgaggcgggtggatcatgaggtcaggagatggagaccatcctggctaacaaagtgaaaccccgtctccactaaaaatacaaaaaattctcagggcgtggtggcaggcccctgtagtcccagctactccggaggctgaggcaggagaatggcatgagcccgggaggtggagcttgcagtgagcggagattgcgccactgcactccagcctgggcaacagagcgagactccatctcaaaaaaaaaaaaaaaaaaaaaggagtgtggagctcaggacagcagtccaggaaggtttaaatttgtgaatcatcaatttgtacctagtatttaaaaacaggccaggcatggtggctcactactgtaatcccagcactttgggaggccaacgcgggcagatcacaaagtcaggagatcaagaccatcctggccaacatggtgaaacaccgtctctactaaaatacaaaaaattagccaggcgtggtggtgcaccctgtagtcccagctacttgggaggctgagggcaggggaattgcttgaatctgggaggtggaggttgcagtgagccaaga

SEQ ID NO: 30266 - DNA, 1058 bp, Homo sapiens
ggctgccagatttgttaagggaaagaaacctcactgtagcttctgttttccttcaagaaatggtcttttactcaccagtgagagagatattcctagagaagcctacaacattcaggaaggttctccaaggagggagggagggatgtctctctggtccaggggctgcacacagaaactcaacttattatcctcacctggtcaggctcacagagatagatgtattatctagaatgtaattttcttactttatatattggaacattccttttccatgaagacatatctggtgcttgggacatctggccctggtgtccacatacacggaaaggcagagtggttatcagaaaatgccaactgactatggaacctgagcaaaagagagtcaaggactccactagcctgaggccagagcgaccctgcctacccaaaatgtgccccctcccagctgatcacattcataccaggctcttggctctttctttcagcccccttttgttcacattcgatcttcagatgttaccacttttaactaagtttctactgtattttactttcaaccaatccttgattatatttcccacctcatctcatcttgcttttgtactgggaggaatcctgagttctggggaagtgccttatttcatccccatgtgtcaatcacatttatcaactgtactgacttgacccaatcacaatagagttagcctttctttgtacaccttggcattgctgcatataatggatttgaatttgaaattgatacttgaatatacttagcagtgttttcctatgcctcctcccacccctgttaatctatgcagtgatcagaatcatccagataatcaacagctgaagaatgaacaagaagaaagtatcaaagaaagacttgcaaaagtaagatttttttttatgtaatagtttcttcttgtctgagcaatgcttttatagttagtatttatggtagtatattttagaaatcattttactattgaaattcctgtcttttctgcatttccactgtttagcatgatatttaccattagtatttagacacagct

SEQ ID NO: 30267 - DNA, 1195 bp, Homo sapiens
ggggagattgaatagagtgacttgatgaaggtgacagctaggtttcaagcccaaggcttctggctccagacctttcctcctggcacccttagaaggaagtcagtcccaggagagtgaggttgtgcccacctgctgaagttgagtccctcacagctatctttgtctcgcaggccttcctgggctatgtgctgtatggagagtgccaggaggtcttgtggtggggaggagtgttccttattctctgcggactcaccctaatccacaggaagctcccacccacctggaagccccttccacacaagcagcagtagcaccacttggctagacggaccagctggaaagatcatgatggtggcccagccttgggatgtcatgtgggactgtatcctagggcgatccagttgtgcagccttctgaccatcagccaagggaagcaggcctctgatggagcaggctctggctctgtaaggagaggtgcagctgcagcagtgttctaccggaagtgttttgatcatctgtacagtgctttggattcttcctcccaggcctaccccagtgagccttcgcagatgctggagatcctggggttggtctgctttgtgtatggtacttgaaaccacgctgtaattattgtcctgttgccaaacaaaagccagtcatgtaactctagaagcagtgactggtggggctttctgacagttccatgctgatgtatcaggccatctgtgtcatgcttatgtattatggcaagaagaggaaaactggattaataaatacgttttttgtaagttaaaactaccaggtacggtatcttaattctttccttccctttggagtaagagggagccagagtgagctgaaatcccaatgtggaggaggcaggagagtgaggcaggtacagaagccttgtggcttcggttgctctgacacctgctagagcttgatcttgtggttacttcctgaggtcacacaggctaaggctctttgaactgcacagggtctgttcattctcctggtgctctcaaggagaaaagtttgacctccctttggagaccttgttttacttgggaaagaaagtggttcagaggtccctccattccctgccactctgttcctctagcgtttacctttagggctcttctgtcatttgcttttctttctcagattcccctttggtttttttttgttttttgtt

SEQ ID NO: 30268 - DNA, 1027 bp, Homo sapiens
cagtagatcttgttgagttttaggggtaggagggcttcagttgagatgattgtactctgtagctctgacaacatatacttcttggtgcaatttaagaattgcagatttagagagaggtggcttattttgtctcttgttcagatcttgtttttgtgtgcatattctatatagtggtatgtagtatagattttgcaatcagacacaactggcatggaaaactagctttgttttcactagctgtaggaccttggacaagtcgctcaacttctctgagtctccatttcctcatatgtaaaatagtaatgttgttgttagctacaaggacagaattttagatgatccactaagaggaaaagagatattctgcatatatcttctctagggggaaaatgggtgagtccgtttaggagttattgttgatctggggtgactataggactgtggttgttaacacctaggaagacctccgtgtggatggccgtggctgtgaggactaccgatgtgtcgaagtggaaactgatgtggtgtccaacactagtgggtccgccagggtcaagctggtgagtactgtgaccatggttcaagcccaggtggagaaatgagtaggccctaaggaatgagctgctgacgctgtctggcttttggaatgcaaattgctcttggggaaatcgaagatccgagccaaactcagggagggggggtctatccagatctgaaaagactgctcacctcctccaaagaccactttccaagtcttagcactgctcctaaaagagtcccccaggggtgtatgtccagaagaggagggaggtggtggagtacctggctgcatactctgagtgaggactcttcttgcatgtgtctgcagggtcacacagacatcttggtgggagtgaaagcagaaatggggacgccgaagctggagaaaccaaatgaaggctacttggagttctttgttgactggtcagtactgtctatgcagatatttctaaagataaatgattttaaagatgaagattcagaaaat

SEQ ID NO: 30269 - DNA, 1028 bp, Homo sapiens
ctgaggttgttattaggatgatgtgaggtgtagaggagaagcacatgtcacagtgcctgatatgtcatcagttctcagctaatggcagctcttattctctgtgctccatgaagcaccctgagttcaaatttctccagacttaatgctgcataaattctaccaaagtcctctaggcaagggactgtcaaaccttgttttagaaggtactcttccccctcccaggagagtttatgagaatttctttaaacagcaacaacaagcacagtaaacaaatagctggagtttattgtgtgcgtactatgtgccagatactgttttcactgctttaaatatatcatttagtcctcaacaacctgtgaggtaactattattattgtcctcatttttacagatgaggaaactgaggcacacagaggataagcagcttgcctacaggcctccctgctcataaatactggagctaggatttaagccaagactgtgtgcgtccagagcccctgctcccagccactgtgcaatgtcagccttataaaccagatctgccctggctgtcatagatggcagaaccagagctctgttcagtgagctgagctttgtcctcccctcaggtttggggagtgaggtctgctaactctggacaggggactatagctctgtggccctgtcttactgtttatctcacacagggatgcagcaatctggaaaatgacttggtggagctgagagccttgggggtagttgtgcaggctgccacccctagcctctgcagttgctttcctgcatctggattcagaggcgtcaaggccctctcaagtcctggcatcctgtccatctcatctcctcttgttgtcctctctccccaccctcatgtatatgaataatcagtacccctgtttgacagattcagacttttttttctttttctaatgttatgggaaaatctttccaaaggccctttttttttttgagatggagtctcacactatcgcccaggctggagtgcagtggtgcgatctcagctcactgca

SEQ ID NO: 30270 - DNA, 1282 bp, Homo sapiens
ggatgagttggttctctatattgatgtgtgccccaaagggactgctcctgcattacagccctgcaggacagcagtgagagaactgagtgcagccagtgcacttggttgttaagtttgcacaaagggataagggtacacgtggattcccggatagtagggagtaacttggctagttggacaagggcctgaaaggagtaagatgggatgatcagagaaaagggatttgtatggacctgtgggaatgggccaaaaaaagcgcagatagtcgggaatcgtgttaatgcccatcagaggacattttccaagggaggtgttcaacaagtgttttgacttcagttctgggtaggatatgtaggtcatggtggaccaccattcatgctgctgcagctaaaaatgctgaatgcatttcaagagtcatatcattaaagattttgggaagctctggaagtaaagaggatttcatggcctaaaattccagagaagggggagactttctgaagtgagcaggctgtcactggcatttccttccctgggggcatttgcagattctggacgtggaataagaatcaggcttgggaacatagaggaactctaccggggaaagggaaacctgcaaaacctccagcaaagctgtgtagggatagtgtgatgatttagaaactcaaagatccctaaacacacagctgggtttatatttgccaaattctcagacatgatgggaagtcagggagtttcagctaaagaagattgaaatctcctgtagcattctatagggctatctgtttttctcctcttgtgtgaactattatagctgagggcatcaggtaagtgcatgcccagtttattattcccaaagttacaaatcaggtgattaagttactgtcccttggagtggaaggaatcgaggtgtggaaagaggctatcaagctccttgacacactgggacagcgtggtggctcagaccacccctcctccttcccacaaccttgcaggttgctcagctgtctcccatgcgagacctcagtttgctccttgaaagaatcccatgtgcaagcagggtagagattattaccccactttacagaagaggagtttggtcttgagtaactcatccaaaacgacacaagtgccaggtatctcaaccaaatttggaactcgggactccattctctttccactgccacactacagagctttaaggataaaacaacaaggactgtgagccccttgagagctaagatttggttgagttaggacctacctaactcagggcccggtacac

SEQ ID NO: 30271 - DNA, 1017 bp, Homo sapiens
tattcgggctaatatgggtggagtgaccaaagcctgttttgtataactgagacttccagcagctttgagaaaagaaacaacaccaccacacacacaaaaaaaccttgaaagctgaaatatgcctttagagctctcttcctctgattttttttgcctgttttgttattaagatcattctttgtacagggagattagtatgaaaagactgggctgtgagagtggtgtgttagtgaacagacacttccttgagggttggggtcgctcatgaacattaatgcagcatcactgtcttggctgaagccacccccacttgccgcgccatgggccagttgaggtcttgtggacagtgtcagcagatctttaatgcaaggaagatgaaactgatatcatcttccatatgtagaaggtaaaattggctccaccagggctatcggtgaatccattgcaggtggctgcaatggcagtccacacctggccagggagagttgggggtggacaagaggatctggatatttaatggccataaactcaacagtggcaacaaatgaggcccaggtgctacaaagagcccatgaatctgtggcttcctgaatagagggtctagtctgctcacaggaggcacttgccctggcccagaggaaggcccgtgaaagcaagttttgttctgggatctgcaccacaatgaagaccataacaagcacagttttatgcagtgaggattctctggaagattgaagtagattgaaatctgtagcatccaggaaccatattgtagaggatccattgagaagaaaaaaggaacggaacatggagaaaggacagtcaaagaaggacaggctggcctctcatgtgactgctccacaggccagcactaggaaccatggggtggtttcccggaggccaacctgccccaccacagggggatcctgaggacaagccaagtgtctaacgatgaaactagttgcttttcaggtaatgagcttcctgttcctggaagggtttaagcaacatatggag

SEQ ID NO: 30272 - DNA, 1028 bp, Homo sapiens
tgcattagtttgctgaggatattggcctccagctccatccatgttgctgcagaggacatgatcttgttctttttttacggctgcatagtattctatgctgtaaacgtaccacattttctttatccagtctaccattgatggtcatttaggttgagtccacgtctttgctattgtgaatagtgctgcagtgaacatacatgtggatgtgtctgtatgacagaacaatttataatcctttgggtatatacccagtaatgggattgctgggtcaaatggtaattctgttgtcagctttttgaagaatccctacactagcttccacaatggttgaaccaatttacgctcccaccaagagtgtgtaaacattcccttttctctgcaaaggttctatttcatgaaaacaaataagcaggctcctatatatgtgtacatatgtttgtatgtatgtatttgagtggggagatagatgtggaaggaaacaaaggctggtgttattggttacatcattgacgagtagtgaccaggagttaaaaataaactttgcctttatttatcattgtattatgccatttcatttgttaaattaagcttgtattacgtttgtaatttgaaaaaacatcaacttatgtaaaaagaaaagcagcctattctgattgacctcaggatgggtgtggatgcaggaattgaagatagtagcttgggatcatctcagcctggaaatccaaggtgtcccagattcccaaaactgggaaatgcagcataggatgtggcaagccagcctcccctggggcaacagcaagcttgagaggtccacaggactgcttgttcagtaagcacatatcccttacagaaagcagttttcagtgggtcacatccaccaccaccttcaatatggcaaagtctactgtagggcagagtccttgcctggggcaattggaggcaggccccatccttccagtgcacagatggctgccttctgctgatggactgctcctggtccaatcagctgtggcaagaacagccgggct

SEQ ID NO: 30273 - DNA, 1003 bp, Homo sapiens
cctggagaacaagccttggttagcatttcctgtgcactagccaaaggagtaagagcagctctattttagagagatggtctcagttctttagatggaattgtttcatcggactactaaaaatcaacttaaaaaatattaatgtgcatagtggaagtatgcctttaaggtaagtgactccaaccactggaaggggtatgcctgttctcttactgctgcctgctaagacaggggcttaggagagaacagatctggcgactgggattgcaagatgcacctaggttgggacactttgaagtgtaagtgcttatgggacctgaggcataggtggccagtgggtagtacaagtgtgcttgtgctggacataaagatggaggaaaactccaggtgctcatgtgcaggtggaagtgtggttcgctgcagtctttctggggatgccatttggctgtatatgtcaaacgtcttaaaatttttcatacccttttaccctgtagttgcacttctagaaatttttctaaaggaaatgttaagagtatatacaaagatttatgcccaagaatgttcatcctggccttttttataatgctgaaaaatggaaataacttttaggaaaacaaatatagctggtcattcaaagcagtcactaacaggctgcattgacagcaggtacagtgaaaaaccagagataaaaaatacatatataaataatatattctcaatttttaaacattagatacaaatttaccacatgtaactggtacgtatggctgtatggtagaataacaggtgagtcttattttcttctatttttctctacttaccaaattatggtgaatatgtaattatggaagaaaacaagacctatttctttagttgaaaatgtcccattctgatatgcgtgtgtggtgaggtggtgccagtaagtgcctctcagtattcgtcattattttaaggaaatgtgtgtgaacataagcctagcttctctgcatgatcaaaaagcaaagta

SEQ ID NO: 30274 - DNA, 1073 bp, Homo sapiens
cctggcctctatccactagatgccagtagcacacatacagcatacacaccccagttgtgacaaacaaaaatgtctccagtatttgccagatggtctctggggaacaaaattttcccggttgagcactcttcctttagagaagggaagaaaggactattaacatcacctctgtgggtactgaaacccctagaagacccttgtctacagaactgggttttgaataggcacttcccagtgaaaatatgaaaatagactcttgatttctagccaggtgactaaaataaaagcttttcagcagtttaatttcagaaagatggctttgattattttgattgagataaagcattagaagactcaaaatagctgtttttgttttgctttgttttaatgagaaaatcagggaaggttccagagggctctatgactttcaggagatgtatttctaagtggtgtctgttcccaactgtgtttatgatccttgtgagactgaactcctggtgagccttgcgagtgtctgttctggcatttcttcatggagtggacattactgaaggtcggtcggtggctgggccctgtgtgcagcagatgggaataaaagggacaggagcacagtgtcttcctcagggcactcccagcctcctctgggcaggtgagtcacgcatttcagtacgacggaacttatgagtgctgtgaatatgcctggaaatgaacccgccagtgattggaataatggtccggaagcagtggttttcaagctgtactcttttagcagttgaggttgctttttcttcaaatgacatgtgcagaaatgtaatataaataaaatagatcagatccaaatttgaagccagggtgaaagcaggggcctgtaattccccacccctccctttgcctcagagctgacacttccaaagagaatgccctttcgttacaggtttgactgaaagtaggctaacgcttggttggatgaagatcattgtttttcctgactagatctatcctcttttttttttttttttctgagacagagtcttgctctgttgtccaggctggagtgcactggcgtgatctca

SEQ ID NO: 30275 - DNA, 1072 bp, Homo sapiens
tgggtgcagtggttcacacatgtaatcctagcattttgggaggccagggcaggcagatggcttgagcccaggatttcgagaccagcctgagcaatatagtgagataccccatctctatttaaaaaaaaaattaatttttaaaattaaaaaaaaggaagtgttcatatggcaagaataccaatcctgaaaatgttacatgtgtaataagcatttatatacacatttttgcatttttggagacaaggataaaatatacctttttttctaggttgtataattatgagtagtttttcatttcctgtatattctgtgctgagtgtgtgttagttttttaatcagaaaaaataaagcaagacactgaaatgaaactgtaatgaatttctgtctttccattccggaatttgggaagtccttaataataacacacagagctaaacacaactatgtttgccggaattgaccaaaggtatttcagagaataggggtccctaagtagggtatagaggcccccctgccctaggtgtttcacagtttaacacctttgagcaggtctcagtgcatttctctgtggacctgcagcacagaggaaacctagcagagtgggtaagagtttggctacagtgtgcctgggggcagattgccctcccttgctgatccttagctgcttcatctgtccaatggggtaagaataccaccctcaaagagtggtgaggactaaataagttaacatcatgtatttgttgttgctgctgctggagcttttttttttttttaaagatagggtctcactgttgcccaagcttcagtgcagtggtgcagtcatagctcactgcagccttgacctcctggtcttaagtgatcctcccacttcagcctcctaagtaactgggactataggtgtgtgcaactgtgcctggctaatttttttttattttttaatttttcatagagatgaggtctcactatagtgcccaggctggtctcaaattcttggcctcccaaagtagtgggagtataagtgtcagctaccacacctggcttgctgtagtttatctcagtgctatcattaagt

SEQ ID NO: 30276 - DNA, 1110 bp, Homo sapiens
aggaacctctcaaatgaacaattttgttcctatcaaaagttccccaaagggatcactgtcattccaaattgtctttggaaatttgtggcacttaaaaagatatgcacaggagttagggctgtaattagaaaacataaagaaagcctgtgcttgtggtggaggaggcagttttagattgaaaagaccaagacatgagccgcaacatatccatgggttgctgcttgtggaattttgcatcttggtgcttgatcaaagtcaagtcatcattgatcaggagccagacaaagcctcctgcttatcggtagacaaaactaacataaaagcagttctcaggaacacaagaacaagactgagggagaagtcattatgagattttgcaatggtgactcgggcacagcgtgtctccaagaagtaactgactgaccactttaccacttcacccttagggctagctcaaggacaaatttatgggacctattcccatcctctcccagtggacaaacaacattcaagatagtacacaagcagatagatagggcattaggccagcagatgttagttactagaaaacattttcaccaaagaacaatagaattctgatcaaaaaaccaaatgtccaaaatgggacctattcttaagaaaataagataaatgcaacagtaaaatcttcagtgaaatcctggagttcaattcagcatgaacgtagttcccagccaagggtgagtggcacctcatccaggtagagacacaagtgggtctcagatgcatgcactgtttctgagtcaaaggttccagtcaaaggtagtgagagtctcagttgaaattccatgaacctgcaattctatcagcatcctccagccagagaccaccaggaacacaccttcagataacaatttgggtttattaccgggggaaacactgggcatctcagagggtgctaggaaggacctgttatataatgaatttgggctttggtagaataatttggggaagggtctcaggaagtgaggatttgctctggattgagtgctgtcagtaagtggggacagttttgtgattgggtatcttaagaaatcttatcttgccgggcgcggtggctcacgcctgtaa

SEQ ID NO: 30277 - DNA, 1052 bp, Homo sapiens
cctgaagcccctgtgctcaccctccctgctgtgggtgggcctggggatctgtcacggctaaagctaaccaggagagagccacattctgctcgctgttaggaccagaggggtgggaaaggcaagaataagcaggttccagggtctcctgtacccaggaagtggatggacaggcctgctcctcaccagcatggagaaaggaagggttggcattgtgtttggtttttctgtctttggtggatgtcctttcagcagtatcctaacccagaaaactgcagtgacagaccccccttagcctgggatcctgaaagcaggtgtgactcctcctgagaatggccctgccctgaccggggccagggagcctgtcttacttgattttactttcctggcaatgcacagggttaaacgagcagtccaagcaaggaacatgtggatgtcctatctatgtacctacatgtcctatttgcatgactacagatgccctatctgcatgtctacatgactacagatgcccttccatctgacagtctgttgcacactgagctgctcctcgttttcatgactttttttttttttttttaaattgagacggaggctcactccgtcacccaggctggagtgcagtggtgcgatcttggctcactgcggccaccgcctccccgggttcaagcgattctcctgcctcagcctcctggatagctgggattacaggcgcgcaccaccatgcccggctaatttttgtattttcagtagagacagggtttcgccatgttggccaggctggtcttgagctcctgacctcaggtgatctgcccgccttggcctcccaaagtgctgggattacaggcgtgagccactgcacctggcccttcatgactttttaattactgtttatcagactttattagcaatagatgcttgaaatatggtgcttaattccagcctagattaaaaaatcgagcatttttcacataaaaggaaacaacatgggctagtcttgtaataaagcagcccctccagaattccagaacagaggtctgtctgtgttccccaga

SEQ ID NO: 30278 - DNA, 1956 bp, Homo sapiens
atggggatgcccaatcctttagacatcgggcagtctctgtgcattcttttaaaaaattgaggcagagtctcaccatattgcttaggctggttttgaactcccagcttcaagtgatctcccacctcagcctcccaaagtgctgggattacagtcgtgagccactgtgcccagcccatgcatttttttaatggaccaggcaatcttcctaagtcaggaagacatgtattcttaaccttttattgatgtacgatgtacacatatcatagatgttcacaaagtgaacccatctgtgtagccaacacccagatcaaggcagaacatgaccatcacccaggacgctccttgtgcccctgtacagtcaccaccaagtgtccaaggatcagctgtctgatttctgatagcaaaaatgggcttttaaacaaacatgggatttgatgtaacttttaaaaacttggaaaatgtaaaaacacattatggcatgtttggggatggatgaatggagatcgtgtggctgacctgggtgaagcttgggctggagacagcaaggagttggtgccgtctgcccagggccacctccactgtatgtcctcctgggctggaagctcgccctgtaacagcggtgactcctgtgtggtcagtggtcaaggactggataccgtctcggtcctctgtgttctctgaagggatgtgactacatcatgtgcctcagccccgtccctgcatgccatctctctccacagcacttctcttcagagttttccaggggcagaggtgaggaagctctcaaacttcatttagataggttcatctttttgctcaatcagcaggtcaatgatgcatacgtgtcaggtcacactgtgttctcagcactgggttgagtgctgtggggaaggacagccagtgcgatggattcacactcctctcactgtgaccttggagaccctcgctctggcccacccctcctgtgcctcaccttgctccttcttccccgtcatcccagccttgttttctctgagcctgttgaggtccttgccttggtggctcccaacggatgttcttctggccagtgctgtgctgccaatgccaccaatcccttccaagcaggctgatctgctgggagctgtagccctggcgcgtcccgacatggattcccacagcgtctgcctgtcccgtcatgctttctctctggagtcctccctccttggtatggtatgtttctgctctgttcttttgtgaccaggaaagaatgtcttgtttcttccatccagccctcctgctctttccattaacagtccagaacatgaaacggttattttgacatgatcattcttgccaggggtcttaaaaagttatgtttctttacatctgttgatttgtgactgtcacataggagacagaactgtgcaagaaagacacatatttgggagtcaggaaaccaggtcttctgggcctgataccaccagcagctcagggtgtgatgttgggcaagtccctctagctctattgagccaagatgacctctcagggtccttcccggcccaaagtcctgtgacagtggcattaggtataactagatgcctgggtttcagctaaccatgtaacagggactgggcagcattattgttggcagtggcagagagcctggaaaggcagaggccaagcggcctggcatcccagcccctttccagacctttacggaattaaaaaacaatttttatttttagttatggttacatttgcaattgtaagtggtaatcatttttactttagatattctggaaaatacatacaattaaagaagaaacatgaatcactcatgtaccttccattcttagaataatcagtgttaagactgtctgcagaaagtatccagtacaaagtagtggctgagcccactggtgatacagaatgtatcaggcactgtgattcttggatctctggccaaatgtagaatca

SEQ ID NO: 30279 - DNA, 1029 bp, Homo sapiens
aatggtgtgatctcggctcactgcaacctccgcctcccaggttccagcgattctcacgggtcagcctcctaagtagctgggattacaggcatgagccaccatgcctggctaatttttgtatttttagtagaggtggagttttactatgttggccaggctgatctcaaactcctgtcctcaagtgatacgccttccttggcctccctaagtgctggcattacaggtgagagccaccatgcccggccagccaatgtattgtttatctcagacattttggttttcatctctagcagctcagtttgagccttttaaatattttccatgttgctacttaacatttccaacatattgaatatagaaacaatagcttttaatgtccttctctgctaattctaatatctgtgtctgatcggggttgatttccatagattgattattctcttccctgtgggttgtgctttcctgcctctttgcatgcctgggaatatttgattggctgccagacattgtaaactttacctttttgagtcttggatattttgtattctttcaatcttctgagcattgttctgggatgctgttaaattatttaggaacagtgattctttctagtcttgcttttatgatttattagatgaattcaaagcagagctcagtctagggctctattattcctcattctcagggctggtgggaataggcactgtttccagcttttgtgggtgccaggcactgttcttgcgaatcctgcagatgtttgtcctctgactttggttagtttcctcacaggcaagagctgatccatgctctgctgaacacttaacggagaccctctgcacatctctgggttgtctctgtgtgcagtattctcatctctgatccagacgataatagcctggaataggggaaatggaaaactaactataagacaaagactttggagtggcacgtgagaagagaattggagcgtgaggcagcagtgctcagaacatggtccttggccagcaccagcaaaggccgagaaagaga

SEQ ID NO: 30280 - DNA, 1055 bp, Homo sapiens
aaaaaattcattcactacatctacaggaagtgtctttttggagtggattctctgtgagtctgcacatttatcagtcaatttttttttttttttttaagacatagtctcactctgtcacccaggctggagtacaatggtgcaatctcagctcactgcaacctctgccacccgggttcaagtgattctcctgcctcagcctcctgagtagctgggattacaggctcacgccaccaggcctggctaatttttgtatttttagtagagatggggtttcaccctgttggccaagctggtgtcgaactcctgacctcaagtgatctgcctacctcagcctcccaaagtgctgggattataggcatgagacaccacactcggcctatcagtcaatattttataaacggctgatgtaaataaagaaaataaagaggattttgactactgtcttctaaactgtaaaaatggtctattgagtatatatttagtgtgacgatcatcagctatttcctagtggagggaattcctttactggaagcaggacgattctgaaactagaattataaagatgtaacactgacactcccacccccagtttatgtttgatgctgattattcagggatggtttaggtcttagcatttttgaccaagatgaacagcatcaaatggaagtgccagttcagagacaagcctgaggcatagtctgacttggtggttctcaaagtgtggtccctggactagcaccatcagcatcactagggaacttaactagaaatgcagagtctcgggccccttcccacacttactaagtcagcagtctgtgtttcaacaaactcacctggtggttctgaagcatgctaaggtttgagaaccacctaagtttttggtgtttatccctcggctattccattttgtcctctgtccttattagctctgccaaagccgcagcagctccctagtgttacgtctctacgtatgagccgccataacaagtcagtgaggacagtgaaatttgcctcttcaagggagcagaaggaagtttaattgggaatgccaggaa

SEQ ID NO: 30281 - DNA, 1071 bp, Homo sapiens
tgtatttttagtagagagggggcttttccatgttggtcagactggtcttgaactcccgacttcaggcgatctgcccgccttggcctctcaaagtgctaggattacaggcatgagccaccgtgcctggcctcaccatgcagattctaaatatgtccactcagaggcgttgccactcatgggcagatttcctttccagtctttttttctttgaatttctttatatagttgagatgcacaatttttaaatcttgctttttacttttcacattataacataagggttttcttttaagattaaaagtattttttcatattatacatatttctagaaaaatttaatatagaaatatgtgaagtaaagtgaaatttctctctaataccatctgtcactgtacctaatactagaaagaaaatttaaaatattaaagtatataaagtagaaagtgatgtttcactgttatacttctaccagtgttacccactgtttgtttttttcccttttgcatatcagtggtatctgcaaattactgaaatggaattgtactataaatacacttgtcaagtttgcttttttcacttgttaatatattttcagtctgggtgcagtagttcacacctgtaatcctgagatgggctgatcacttgagcccaggagttgttgactagccttagacaacatggcgaaacactgtctctacaaaaaaatacaaaaattaggcagttgtggtggtgcacacctgtagccctatctactcaggaggccgaggtgggaggattccttgagcctgggaggctgaggctgcagattgcaccactgcactccagcctgggtgacagagtcaggctccatctcaaaaaaaccccaaacatatatatatgctatccccaaacatatatatatgctatatataagcattttccaatatgactaaaacactatttaaatgacattttaaatagctatgtaacatttcatcatttatatgtactctggtttatataaccattcctctaaggctgccagtttggatctaagtaaatatttattcactttttaaaattctttcccaa

SEQ ID NO: 30282 - DNA, 1034 bp, Homo sapiens
ctgcgaacgttcaaggatggggaccttctagaagagagggcaacagtaactttgaggggaggacaagagagcagctttggagacctaaagagttgtggccttctatgtaagtcctattatcccttccatgcacccccacccacattcccctactccattaaactttgtttcaggttataaaaataatgcataattattgcaggaaaaaatggtaattgaaaatcacctatttcttacactcaaagataatgacttaaaatttggtgtacatcttatgtgtatgagtgtacacataattttgtcatcatatatgtgagtgtgttcataactgtaacccacatacttatatacttcctttaaaatattttaagtatttttccctgtcaataaatatttttttgaaaacacaatctttttatggctgcataatattccaacatgtatatgggttatcatttaataggaattggacatttgatgctcatttttagcaagctattataaatctgagatgacgatttctggaactaggataaattcctgaaatagaatttttggggagaaaatatctgaactttgtaaattctactgacatttaatacaaatttctctcctaagagcttgttttagcttctgctatcccttgcagagtgtgaacaagtatctgtttgtctgtgtcattactaacactggggttatcattctttttaagctttgctagtctgataggtaaagcatagggttttttgttgttgtttgtttttggagagacagagtctcactctattgcccaggctggcgtgcacagacgtgatctcagctcactgcagtctcaacctctaggcacaagtgatcctcctagctcagcctcctaagtagctgggactacaggcgtgccccactacacctagctaacttttttattatttgtagagatgggatcttgctgtgttgcctaggctggtcttgagctcctgggttcaagtgatcctcccaccttggcctcccaaagtgttggaattacaggtgtgagc

SEQ ID NO: 30283 - DNA, 1073 bp, Homo sapiens
tagtgcctgcaaatgaaaacgcagttttactttattctgttaatattttgtatatcctgagtcagtccctcaccatgctgagttgcttgcctgaactatttaagttgtttcttgagaaaccaactgttatttttgttagactctaattacaaagttgcataaattttaagtagtctctctcaaccgtgtttctacctcctttattttttattttccagagtgagtttttttcaggaacatatatatgggtttctaaaaaaacaccccacctgaatgttaaagtaatttgtttttaaaaatttcctggaaatattttatttaaaatgcatttcttactgtttttagctaatacctcttgcttactatgcgtcagatgttcaaagtacttaccaaagattagctcatttaattcacacgatgctgcgtgatgaatctggtattatcgttattttacagaaagggaataagaggatcagagagaatgagtaacttgtctaaggtcacactactggtagtctggttctgtaggctctggtcctactatgctacattgccttctgtaccctgttgaatataataaactagatttgattatggcatttttttgtatatgttaaattgatggtttcatagcaaatcaaaacctagtcagcatcaaatatacaagtgaaaagagttgcagtgaactcataaggacagcaaacttaacagattcatccttttagaagctgggaaaatgatgtcaaatttatactctgtaattgtcataataagtagttttttagaagtcttcatttcatttggttagttatttatgttttacatttcttcttaggcatatcacacctgaaaaattttatgtggaagcttgtgatgatggagcagatgacgtacttaccattgaccgtgtgtccacagaggttacccttgcaggtattttacagccagatttagaagtttagggagaaagattttatacataaattacagtaattaaaaaacatcactcagaggtgtgtcagtgtgtggatctctgagtgcattcttattaaaatttttattcttgctacctc

SEQ ID NO: 30284 - DNA, 1664 bp, Homo sapiens
tataaatatttaaattatatttataaattacataatgtactccagtaaaatatgtaactttttcctctctagatggacggtttccaaaggcattttgattcccaagtaattatttatggaaaacaagttataatcaatctggtatgtttcttatgtttcttggggggaaaaaaaagccttaactttttcttgacagaaaatttactattttaaccattttttaagtgtacagttcagtggcattaagtagttcataatgtgcagccatcatcactgttcatttccacaacatttcatcataccagacagaaactctacccattaaacaattaacttcctattatatccctccccacagcccctggtaattctattttactttctgtctctctgaatttgtctattctaagtaccctcatgtaagtggaataatacaatgtttttcttttttaatgtttttaaggttcatccatcttgtagcatgtatagaatttcattctttttttaagactgaggaatattccattgtgtatgtgtatgcatatatgcacacacacacacagacacacacacacacacacatatacatgcataccacattttgtttatccattaatctattgatggacatttgggttgttttcattttttggctattatgaataatgttgctatgaacattggtggtgtgcaagtatctgattgagtccctgttttcagttcttttaggcttatacttagaagtagaattgctagatcatatggtgattctatgtttaactctttgaggaaccaccatactgtttgccatagcggctgcaccattttgtattcccaccaacaatacaccagagttccagtttcttcatatccttgctgacaattgttgttttctggtgtgtgtgtgtgtgtgtgtgtgtgtgtgtgtgtgtttaatgatagccatcccaatgggtgtggagtggtgttgagttgatttacatttctctaatgatttgtgtgattttgagcatctttgcatgtgctcattggccatttgtgtatcttctttggagaaatgtctatgtaaatcctttcgctatttttaatcaggttgttttttgtttgagttgtagtcattctttatgaagtctggatatttatctcttagcagacaggtgctttacaaatattttctcccactctttaggttgattttttactcttgacaatgtccttggtatacaaattgtttaagtccagcttatctagtttttcttttgttgcctctgctcttggtgtcaaattcaagaaattgtcaccaaatccaataacataaacttacccctatattttctttttaggagtctttatagttttagatcttacagttaggtctttggtctgttttgagttgatttttgtttcgtgtatgtgtgtctgtgtattacttcttaaaactgcacatgagttaatttttgtatatggtgtaggtgtaagggtccaacttcattcttttgcatatggctatccagttttcccagcaccatttataaaaagactgttcttttcctttgaatggtctgtcaccataataaaaactcagttgaacatatatataaggtcttattttgaggctctgttctattccattggtctccgtgtctgtccttatgacaggatca

SEQ ID NO: 30285 - DNA, 1076 bp, Homo sapiens
ggtgcgaatgctttttttttttttaattgaaaaacaacacagcaaaaaattaaacatctttaaaacccagtaacaaaaaatattcacattgcccacaccctaacccagctctttttatttttgtgtcttgcccatggatgtcacattttccataactagggtcagtctgtgtatgcacagttttcacttttgccattttcccttagcatttatgtaatcacagtttctggtggttgtattgttgtgccgtaatttactaagccattcagattgctacatttttggtttataaataacaccgtagagaatatatctgtatatgttattattaacttgaattatttccttcatgttaattcctagaagtggaattactgggttaaagagaataaatatattattttccaagagcgtcataccagtttacactgacaccaataatgaatcagtaaatccatttcattgaactcttcccagcatttgatattttaattttttttttgtttttccttgagaaagtgtctggctctgttgcccaggctggagtgcagtggtgcagtctcggcttgctgcaacctctgcctcctgggctcaagccatcctactaactcagcctcccacaaagctggggctacaggcatgtgccaccacacctggctaatttttgtatttttttttgtagagacaggatttcaccatgttgcccaggttggtctcaaacccctgggctcaagcagtctacctgcctcagctcccaaagtgctgggattacaggcttgagccactgtgtctagcctcttttttttctatttcgttaatacaaaagtagcacctcaagattgtttctatttatctctctcttattactagcaaggaatattgactccaaagtaaaaagtttctgacacagctttgctttaccactagactatgctgttgagaaaaatggtttttttcttctgtgtatatttggaatgaaaaagatgtagagccccaatttttaaatcacattggcatttgttgtgaggggcagacaaaatgcataccacatggtttcctgttcaggtaattagtaa

SEQ ID NO: 30286 - DNA, 1077 bp, Homo sapiens
acttcatgataggaaagaggaggatgaggtctggggttctttaaagtctctggtgggctgcctcatgactttaatcagcttgaactgccagtgcaccagcagtttaggtgtgatgagagaattcagatatactttatctttttaaaaaagtgtaaataaaatcaaagaatgtaaagtctatctcttacgctagaggtccaaagctgcctctgttttaaagattatcccaatgtggaagatgcccatgactggtcagctacttcctcctatacattttggtttctttgagggtcactcattgagacacgcaggcctctgagagggtcttgttctagatttcatattgcacttggagggtaacagctgctttttcacgcatggtactcttgatgtttttcactctgtcaaggattttgttggctatcaatgaatgtgtctaaaacttagtgcttccaggtagttatagtactccaaatcaaggaccaacttaaacgttaatttttgtgcaaaaacaaacctgaaaaatatgcttcggaaactgtgcatagttctaattgtaagtcagattgtatattcaaattgtaattaagagatttaaatattagaacggtatgtaaggtagtataattaccactattttaaataattcagttaaacactgctgcaatatttcagtgttgtgcttgaaaatatgtacagtttttttccaatattaataccttatgttgtccttaaatatttctaaaagcgcctttatttcagcattacctttttttcatcactatcttttataaaacattaatataagtcgttacttttagaaactaaaggaaataatagctggaaaaccctctgtagtttaaaatcagtcattaaactcacaatagggtaagtaaatatagccacctgttaacatgtaaataagcataatttgttccaaagatggaatattgaaacttagttcatgtctgctgtaaaatattatttaaatgctgctgggcatttcacttaaagaacttaatgtcaacagctacaacaaagaccaaatctgaactgctaatgtggctgctttgtagg

SEQ ID NO: 30287 - DNA, 1033 bp, Homo sapiens
ccaacaccagagcccaactgtcctctacccagttacagctggggacaagccgccatcactggcatcaccggcacctttatgtctacacacctctgctcctaaatcggcttcggggaggctgccttaggggatctgcaaagggagacttgcttaatgtagcagctaaaatccaggattatggaaagatgataccgtggctggtgccagggtacccgtgtggctgggcacttcctcctctctttcccttcttccaaggctgctgcttcagtgtcaagcagatcttagctccatccctggccctcctctttctgtgactcttggcctcagtgtccctgtctgtaaaatggggatgtggtagaaggtgcaggaggcatgggttttaaagctccttgctgaccatggggaggatgtgctacagtggagggtattgaagccaagcaccatgatggctgggttgggggagtcaagtcagccctaatcaggaccataggaggagtgttggggggatatgggacagctggtgcagggctgggtggcctgtaagtggtgggtatggactaagtgacccctggccacagcccagccccagtccctcagtcctcacccctgagacccaagatctgcagatccgctggatctaaggggacgcaagcctgagtcctctgcaccctggcgctgagccaagaagacaggaactcctcaagggagagagggttggaggggcggggagaagggagtagcagacagggggcatgccaggctgagaagagatacagctgtcagcatttccccttcatccccaggagataaggcctcctcagtcagggcagaggcagaggagggggtcctttttcctcctaagctcaagcttggggcctctggcagtaaccttgaatcctaatgtaagtccagagtggatccagaaatgcaaggagccattgggatactcttccatcccaaaagcttgccaggaacaccttatctagcaggtcctcctgtagtccctgcccccagtccaccctggggccccatc

SEQ ID NO: 30288 - DNA, 1046 bp, Homo sapiens
tcccgccccaagtggaacagcaggagagaggcctgccgcccttctgtgatcctgaccctattccaggctcaggaaacagcagggcttggccagggatcaggttcacctgaggttagattcacctgaattgaggctcggcccaggagagggaaaggaggaaccatcaggccaagattcagctcaggatcagagtaggatactgggtcagaggtcagcctggggctggaattgggatccgggaccctccctctaccctgagccccatggactaggccagcatctattaccccaccagtccccttgctgggatggggcgcggggctgcccacaccattgccagcctcagcaggcctgcggggtccatggcccagagccgtgggcccagcacctcagcatcacctgagcttcacagcacctctgcagaatgggttgctggagctgcgcactcctcccagccccccacaggctctgggatccagttaccgataattgtccattattgttggcagctgcagagcttggctgggctccgggacaactggccagactgcagaggggtgggccgggtggctggagccctctctgcactcagcacccagaggcccacaggtcaacagccaccgcctccctgcccctcgacatacatcctgaccctgacctcaccatgacaagccccagagttggggagacctgggcccagtcccaggaacagatgcaggctctggggctaggaggtgtcctagtggactggcgacatgcagattgggagtgcatagaatcctggggcacaggaatgtcacagctctttttcttaccgtaaagccaggtcataccctatccctccaagggtgtaccaggcctagagtcaagttggtggtatgtggtcggggaggacctggggctcccttcccagaggcacagctcacccaaatataccatgtgccccttgagctggcgcaggccaggacatactgacacaccgaggtctccctgtggcctctgcttgggacaaaacctctcaccccatccagtctcatccacgaggg

SEQ ID NO: 30289 - DNA, 1051 bp, Homo sapiens
ctacagctgaaaggatgcccaccaccccagggccgaggcacgcagttggagaatgtggccctacatgctctgcttctctgcgagggcctctttgacccttaccaaacctggcggcgccagcgcagtgggtgagacccagcccacaggaagggaacccagaggagggtggggagaggatggccgcgctgggcccaaggaggggtgacggccaggagtggtgagagccgggctgatgtacttggcctcactgcccccagggaagtcatcagctccaaggagaagagcaaatacaagttccctcctgctgctttgccccaggaattcagcgccttcttccaaggtcaggccccgcccctgcccccacttggctccacccccaaacctaggccccttcctgtcgttccttgatcctgccatacacaggaaccacttggtggtggctgcatgcaggactgggagaaccaaagaccaagcaagagtttagggacagagacaagagaagacatcttgggctggagcgagggcctcccatcaggtggaggggtggggtcaacctgcctacccagatttctcatcctctttccccgccatctcctggatccttctagccacttgtaccctactgtgatcttaaaactctctggtccaatccctttgtccccatagcctccacgcatctccacccatcccggagacacaggaggtatctccacctcctgttccctggctgctggaggatctggtgcccaggacagctgtggctgcctgttcacaggtggtcctgtgaacctgttctccctggtgaccctccacccctgggtcccctctctcctctcattggagggagactggccaggactttagataggctcagggtgggatatggcctggacagaggtgggcagggctgtgaaaaggtggtgacctattgggatattaaatgtctcagtgatgcccccatggagctgtgggcctggatctagagttggggcagcaactccaggaggggaggcacccctagggagctcctcgactttattttcccatagcc

SEQ ID NO: 30290 - DNA, 1125 bp, Homo sapiens
cacctggatctagggggaaggggcaaggtgggacttaaaggtctcgaaggttcttctggttctaacatcctgtgattgattgtccctaaatctctgacccctgtcaatcactgtgggtgatggggcacttgctggcctgtctgtactcatgtgtctagctttagggagacaggttgggggtagggccctaactccactagagaaagggggactggagggtgcagtcagagtgtccaccattaatctgtcccagtgaggcccttcccagcctttgttagagtgggtcttgctgagctgctcagagagggccctaggtcatgatagggtcacagcagttggggcaaggagtagaaggcctggtgctctgacagagttgctgatccagcacatgccacatgccttggggtgcttggctctgcaccttttttactgcagggggctgccagctgtgacaccctggcccctgcctctcctgatggcccctccccaccccaaggtcctggaccaagacacagacgccattgcagtccatgtagtcagagtgctgacctgcatcatgagtgactccccctcggccaaggtgaggctgctgcactgcagctttagtaggggtgcggggtggagttcaactgaccatatccccagaacaggcctggccggtggccataagcatcctgctccctggagcaaagcaggcgagctgggaggtgactgccctgccctaaagctcactgggcaggtgtggtcgccagtctgtcctgggagctgcatcttctctgtcagggctggatggggaatggacacttgtaggcccacctccatctacagccttctgagatgtactcacgtcccccccatccctctgcagcccactgcccaccagcactgtcacccagaggcagagctacgcaagggaaccccaaaacatgatgcccctccagagtttccagggggtctgagtttgccctccggcccatgtatgtgttcacttcttccccatactaccttacacaggaggtgtttaaggagcgcatcggctaccctcacctgcaggaggttctgcagagccatggtccccccacccatcggctgttgcaagagctgctcaacatggtgagggaaggg

SEQ ID NO: 30291 - DNA, 1016 bp, Homo sapiens
tcccactcgcccctctcttttttatttttcctcgccctctctctcccttgcccgttcatctcgaccctttagcaagcatggaagcccagcgaggcgggggattgctcggaggccgagctcccggcagcctcctccgccttccttcccgctgtgccctcggggctcctacctccacctcggcgcggcgctctgcccccacccgaagtctccaaggcggcagctcccctctcctgtgtggttcttggggccttagaggcaatgtcatgaaaaaaagggtattaatcactttcctacagaaatgataagatgagactaagtagaataacttgaaagagctacgagttgttatttttggaaggagagataggaacgcgtaaatccaatagctaaactttctagacgctgaagagtttttggcgatagatcattttgacattgggggttcatagggttagcgttttttgtgttgttgttgctgttgtttttccactagaattttgaatcggattttaccagcaattggtaacggaaaggaaaggatgtgtcttccaattgagaaacagtggttaaaaactgaaagtgggccgggcgcggtggttcacgcctgtaatcccagcactttaggaggccgaggcgggcggagtaactgaggtcaagagttccagaccacactggccaacatggcgaaaccccatctctactaaaaatacaaaatttagccgggcgtggtggcgcacggctgtaattccaggtacgcgggaggctgaagcaggagaatcgcttgaacccaggaggcggaggttgcagtaagcccagattgtgccactgcactccagcctggcgacagagcaagactccatctcaaaaaaataaataaatgaatgaaaataaaaaataaattagctgggcgtggtggtgcgcctgtaatcccagctactcgggaggctgaggcaggagaatcgcttgaacccaggaggcggaggttgtagtgagcccagatcgcaccattgcactcc

SEQ ID NO: 30292 - DNA, 1027 bp, Homo sapiens
acaatgcacaacctacattgagctccacctcctataattcctattagatgttatttgtatcaagtcagcaccctcctacatagtattattatactctgtagttgtttttcctatacagataatctttctgttacatattgctttgttaacagattttaattacataatatatctatcttaccaactttataagtttgttgtaggcagaagcaatctgtctttcctattttatagtgtttgaggctgtaggtagcaagtgttgaatgaataactactttgttacttctgaaaagcttactttttgattaatacttttcctttttaccaattcctttttctttttttttcaggctcatccatggaataccaattctttttcttagtgttcacattggatttttctgttaaaaatagattgttggagttggctaacaagttgattacttccagtcaggcactctcttctgtaaagtctcttttgtaaactcctacaagcagctatttcactggatttgaaaagactgactaaaaagaaccatgcactgtaactctcaagtatacaggaatattgttattaggtaattttttttttcaatatgtgttaaccttgtcttccctacaattttctttttcttttttttttttttttgagatggaatctcactctgtcgcccaggctggagtgcggtggcacaatctcagctcactgcaacctctactgcctgggttcaagcgattctcctgcctcagcctcctgagtagctgggattacagacgcgcgccaccatacccagctaattttttgtatctttagtagagacggggtttcaccatcttggccaggctggtcttgaactcctgaccttgtgatccacccgcctcagcctcccaaagtgctgggattacaggcatgagccacggcgcccagcctccctacagttttcaaacattcagagaggtgattatggtgtatcttttattctgttttgctttggatcttggcgttcttctagagaactcatctgct

SEQ ID NO: 30293 - DNA, 1099 bp, Homo sapiens
acttattacttatttgatcagtttagtacaatgccatcaatataacagacctatagtattctgaatatagtattctgaaggatagccagattatttatttttcttcagtttatagattgacagaggcaggagaggtaagataactttgggcaacactgaaatgtatactgttgtccattccaagtgaatgtgaactgtttctgattctcatatctggcaggggcaggaaaacaacacactcagcagaataatcgccatatatcatcttcctgaggctgtgataatctgcctaggccagtataccacatctggcacagcagctgcatttgggactactacttgactgagtttgcagtagtccaaatgtctttctccaggatccatctgatgttttttgggggtcgtattggttaattaaatggggatataaggagtacactatccctgatgtctttaagatagttgtatattttggctgggcgtggtggctcatgcctgtaatcccagcactttaggaggccaaggcaggtggacaacttgaggccaggagttggagaccagcctggccaacattgcaaaaccccatctctactaaaaatacaaaaaaattagctgggcatgttggtgcacgcctgtaatcccagctactcaagaggctgaggcaggagaatcgcttgaacctgggaggtggaggtctcagtgagccaagatggcaccattacacaggagcctgggcaacagagtgagactctgtctcaaaaaaaaataaaataaaaattatctttttaaccatctgtgcaagttcccttggctaccatgctgactttgccagtcattatgattatatccacctggcttttaatggttaagctatctgatatctatgggggtgtgcacaattattgttattcacattgctattagagagcccagattaatggcttcttctaacttcaaccctgacctacagagaaaagccactgtttgacttagtgatgcttggtgtcccctcaccaattcattccttacagttttagtaaatggtgtctccttcaagccctcccatggactattagggtatggattcctcttaggaaaa

SEQ ID NO: 30294 - DNA, 1032 bp, Homo sapiens
gttttcttatagaagtggttttgttttgttttgtttgtttgttcatttgagacagagtgtcaccttgtcgcccaggctagagtgtagtggtgcgatctcggctcactgcaacctccgcctcctgggttcaagcaattcttcgcctcagcctcccgagtagctgggattacaggcacccgccaccatgcccggctaattattgtatttttagtagagatggggtttcaccatgttggccaggctggtcttgaacccctgacctcaagtgatccgcccacctcagcctcccaaagtgctgggattacaggcatgagccactgcacccagccgatttagcaccttaatcaaaaatcaactgaccagcactcacattcctgatttcaaaatttattactccagtctgggtaacctagtgagacctcacctctacaaaaataaaaagataaattagccaagtgtgatggcaagtggctgtaatcctagctattcaggaggctgtgacagtaggatcgctgagcccaggagatcaagactgcagggagctatgatcagtcgtgccactgtattccagcctgggtgatagagcaaggccctgtctctaaaaaaacaaaaacaaacaaacaaaactactgataatctacaggtcacatttggcaggcttccaaattaacctgcctagaaaaggtcttaggattcttggcttacattctgtcccttaataaaaaatcttggcatgcctgtaatcccagcactctgagaggctgaggcaggcagatcacttaagcccaggagtttaagaccagcctgggcaacacggtgaaaccccatctctacacaaaattcaaaaattttgtggttgtggtggtgccatctgtagtcccagctacttggtaggctgaagtgggaggattgcttgagccgggggagttcaaggctgcagtgagccactgcactcctccagcctggggcataacagagcgagaccccgtctcaaaaagacaaaacaaaacaggcagggcacggtggctcacg

SEQ ID NO: 30295 - DNA, 1003 bp, Homo sapiens
aagtgtgctaccccaagtgtggtcctggactagcagcatggacatcatctgggagtttattcaaaatatagaatctcaggctccatcagtatctactttttttttttttttttttttttttttagacagtttctcttcgttgcccaggctggagtgcagtggtgcaagcttggctcactgcaacctccacctccctggtttaagcaattctcacacctcagcctcccaagtagctgggattacaggcgtgcacaggcatgcaccaccatggctggctaatttttgtatttttagtagagatggggtttcaccacaatggccaggctggtctcgaactcctggcctcaagtgatctgcccgcctcagcctcccaaagtactgggattataggcacgagctattgttaccggccatctgcattctaaaaagacccctggtgatttgtgtgcacagcacaggatgggacgtgctgctctatgggaccttcagaatccatgtaagagacccctatgcttaagcctctctggatgggcttcagctcctcacagccatcaggtaagtgaagatgtcagcttaatcctaaacgtaaagagtgaattcaactaggggaaatgatgacacaaaatccagaaactaagaaaaagaataccgataaacttgtgctatggtctgaatatcagtgtctccccaaaattcatatgttgaaagctaacccccatggtgatgctatgaagaggtgaggcctttgagaggtgacaggtcttgaaggctttaccctcagggatgggattagtgccctataaaaggggcctgagggagctcgttagtttattgcacttctgctgtgtgaggacacaactagaaggcaccacctctgaagcggagggcaaacccttactagcccatatctgctgatgccttgatgttatacttgccagcttccagaactgtgagcaatacatttctgctgttttttttgttttgttttgttttttttacggag

SEQ ID NO: 30296 - DNA, 1084 bp, Homo sapiens
agactaattctgacttgttcttgaaggaaattctgttctgcacacagtgacaatcagaggttagaaacttgtcagcggagccgtgagtcgagcagagctgctcagctcttggtggttgtaaaacgtgcctctacctcatgtttgagaaagcttgtgttttccgtgtatatggcttagcattttaagtaatcacgatatctgaggggtaatgggaatgcaggagcagcaggtggtggctagttttctgtaggatttaggaaaggactgctgatttaactgaatctctgattattctaagctgctcatagaaatccaccagtcactgctgtctcagacgtcagagggagaagcttaagcatgttctgttgttgacagccattctggttgacttctctaagactgccagctgtattcttgatattcagagtcctgcagatgtggcccctctctgctattctaccctgctttcccacagtgtcctcttgcatcagctggccatctctccatgactgtgttccccctcctctgggcctttgctctagtgttcctttggcttggagtatctgctcacatctgccaagcagagccgtatccatgcttcaagctttcttccatattttcttcctttgctttctttcctttttctttcttcccttgctttccctttccctttctctttctcctcttttcttttttctttcttcagggtcttgctcttgcccaggctggtgcagtggtgcaatcatagttcattgtaacctcgaattcctgggctcaagtgatcttcccacctcagctttctgagtagctggaactacaggtgtgttgccaccacactcagttaatttaaaaaaaaattttttttttttggtagatacagggtcttgctttgttgcccaggctggtctcgaactcctggcctcaggcaatcctcccacctcggcctcacaaagtgctgtgtagccactgtgcccggccccttcaaagttttcttttctcaaagggacccatgccctctttcttgtgctctgtcctatcacagtggggggttgtgtgaagtcccatctctctgaagacagtcttc

SEQ ID NO: 30297 - DNA, 1056 bp, Homo sapiens
tcatcttcacattgagtagtctgggaggaggaagagaagggttggtcttgctgtccctggtggcagaggcggaagaaaatttgtgtacaagtggacctacacagttcaagccggtgtcgttcaaggatcaactgtacattgtcatttctatctgactttttgctttttcgtttctccaaacatttttctatatggtaccaattcttttccaccatttgttttagtttcagtgcccgtatcatagaagagtccatgtcataaaagaaaccatgaataattgaaactcttttgccaagttgtctaatgtcaatttgttttctggcactgcttcttgaatgtcttccttgttgtccagcactggtttgggagctctcatctctatcaagttgtcttctattaattcctcaggtatagtatcaattagctgtttaatttctcaaagatctatatcttgaaactcttcacccctcacctttttgccatattcatgatctcttccatgactggctatgtcataaatcccgtgacgtcatgtacaacagctgaacagctttctccagcaggaacttactgtttcagtcttgatggctttcacagctttttctataacaatgatggcatcttccatggtataatccttccaggcttttatgatgttctctctactagggttctcttccatagcattggcaatcctttccatacagtactgtgtataatgagctttaaaggtcctgtgacaccctgatttagaggctgagttagagacattgtgtttgggggcaggtagaccactttgatgccttcataggtgaattcttggggttccagatggccaggggcattgtccaataccaaagaactttaaaagaccatcccttactggcaaggtacttcctgacttcagtgacaaaacttcaaaggaaccaatccagaaaaagttttcatcatccttatcttcttgtacaaccaaaagactggcagctggtgtcatcctttccgttcaaggctcagggcttagcagctttataggcaagctctcgttctgtcacctag

SEQ ID NO: 30298 - DNA, 1031 bp, Homo sapiens
actgcagtgagctatggttgcagtaccactgtaactccagcctgggcaacagaacaagaccttgtctcgaaaataaaataaaacaataaaaaataaactaaaaacaatttaaatagaaatggaatggtctaatatggaaagaacatgggctctggagcccaaatgcctgggtttcagtcatatccccatcagttattagcaccgtgaccttggtgaataccctaactctttgcctcagtttcctcatttcctcatctgtaaagtggtgatgataatagtgtctacctcttagggttgttctaaggatggagtgattactaggcactcagcacagtgcctgacctgtggtaggttctcagttaagcatctgctgctgatcttataggaggacggagatgagattcagatagaatgtgacctctaggcatgatttgctaggggtgggagcagcatctttctgtcaccattgtgtgaacagcagggtcagatgttcctagtgatatcacgggaagccttgtttctaggatgtaggagtctcctgtccatctgattcctttggcctctatcccacgagacctctgagctacacttttactcattttctctaacctaagggtgggcaaaacctcttactgcaagggagttaaccacagaacattctctcatatagtcaagttttacctcatagcttaggccacattttaaaaaatattttagttaattaattatttttgagatagtgtcacactctcacccaggctggagtgcagtggcacaatcatggttcactgcaaccttgaactcctggtgtcaagcagtcctctcacctcaacctcccaactggccaagagtataggcgcacaccaccacacgtggctaattcttgtgctttttgtagaaatggggttttgccatgttgcccaggcttgtcttgaactcctgggctcaaacgatcggcccaccttggcctcccaaactgctgggattacaggcatgagccactgtgcctggcctatttttattttttaata

SEQ ID NO: 30299 - DNA, 1050 bp, Homo sapiens
gtaatcccagcactttgagaggctgaggcgggtggatcacaaggtcaagtgttcgagaccagcctggccaaaatggggaaaccccgcctctactaaaaatacaaaattagccaggcatggtggcgtgtgcctgtagtctcagctaattgggaggctgaggcaggagaattgcttgaacccaggaggttgcagtgaatactgcattccagcctgggtgacagaatgagactcttttttttttttttttttaaaaaaggaaaaactatgtgggatagattcagtcggccagctgccagccctggcttgtggaatgttttgttgaacgactataggtatagccatggactttttgggatcccttggtgtgtgcagtcggccagctgtgatgcattttcctggcatttgtgagttagctggcctgcgtgtccactgccccatatgacaacaggcctgcttctcccatcctgccccccagaatgctgtccgtgtcccacgagactttgagggctgtagtgtcctccgcaagtacctcggccagcttcattacctgcagagtcgggtccccatgggctcgggccaggaggccgctgtccctgtcacctggtgagagccgcaggcagggctggaggatcccacggggagtctgggtggtgggggtgctcctcccctcccttcccccttctccttgctgcataggatggggaatggcctcatatggtccccccaggcctccccacatccccacaatggggtgtttagtccccttacctaatctcagggccctggctagctcctgccctcgagataactggggtgccatgtctgcaggacagagatcttctcaggcaagtctgtggcccatgaggacatcaagtacgagcaggcctgtattctctacaaccttggtgagctgcctgatcccttcccccggccctactccccagtcctgccagcctagctttcagctcttcagatggccacaaaggcagtgggctgataaagggaggactccaggattcccgcccctccactgacctccccacagccctg

SEQ ID NO: 30300 - DNA, 1034 bp, Homo sapiens
ttccctctttttgtgaagggtcttgtccctctgctggcatctacatgggaagtaggttctggatccccactgacaccccgtgactgcccactccccctgctcctgatccccaggtacaattctgccaagaaggacaacgacttcatttaccatgaggctgtcccagcattggacactcttcagcctgtaaaaggtcggggagctgagaggtgggggcagaggtgacggtggggtggggacaggacacaggaggctgcctcaaggactctgcgtgggcctgatctccacaattcccacccccccaggagcccccttggtgaagcccttgccagtgaaccccacagacccagctgttacaggccctgacatctttgccaaactggtacccatggctgcccacgaggcctcgtcactgtacaggtgggtggagggtggcacagagggaggtggggtgtcttgagatgtgggtcttcagcaaatgctctgtcgcttctgcagtgaggagaaggccaagctgctccgggagatgatggccaagattgaggacaagaatgaggtcctggagtgagtgtgggacttgggcagggaggcggaggcaggcagcacttcccgggcctctgggggccccagggctgcctatgctgggagaggaatgaaatgtccattccaaacaggtttcccaatgctgccttcccgcctggggtggtggggctagtgtgtaaggcaggagtcatgtcttgggaggaggaggtgccttctgttccactgtttccagcagtgccctgggcatgttctgtgagaccaggccagacctggtagtaggggtccgaggtcacaatttgctctctgctgagacctcagattgagtggtgaggcttgccctagcggctcctttgacatggtcagagttggatcagcacccagcacccacctggccctgttgctccccacagccagttcatggattcaatgcagttggatcccgagacggtggacaaccttgatgcctacagccacatcccaccccagctcat

SEQ ID NO: 30301 - DNA, 1090 bp, Homo sapiens
aagagccttctaatgtgagcagagctggcagttaccgaggaagcccaggtggaggtggagttctgaaacagccactgtggtgaaggagtgtgtgcagctgggactgtgggggaggagggttggagtgcaggacttgcttctcccctaacattttgttgtgaaaaatttcaaaaatactgaaacattgaagaaattgtatagtgaacacctttgtatctaccaccttgattctctataggtataggcactcaattttaataaaaaaaaaaatagctgaaagggctttttctttcctgctgaagattataattctactcctgctttttcagctcctttgctttcagaattttttgaaacaagagtcttgttttactgatatctttctcctctttaccaattgtatatgagtcaatttgcattccacaaatgaacatctttgtagaacaggtggtttctcaagcttcaggtgtgtgtggccatctctgctccccttctaccccatttactgtactgaaaccagaggggcaaagagagcaaagagtgcatgcatttctcccagccccaagactagtgactctctgaatgtcaccatttaggtggtttaaaaggaccttaagccttccttacccatatatttccaccttccttacccatgtatttccaccttcccgtggaagactcagtgccttaattttcgttcatgtacctcaagttgttgggacttcttagaaatgtactttctggttactaataagtagcatttagcccccaaatgaatggaagtatttggaatggcaggttgttctcttttagaaagagggagaaggctggtaagtgtgcgtctggttttagctctcaagctggacccacatagtccagtcgtccctctcttacccagctcttggagggaaagaatgatttgagatttggtggctgaggtagccatctggggaacgcatagcaaaggcgtaggtagctaccataagaagcagacacgtggtgcttttgagttgatgtagtaccaaggctttcagctttctcctgttgtcctgtcacatcctcacaacttaagactaagagaagtatatag

SEQ ID NO: 30302 - DNA, 1054 bp, Homo sapiens
attagctgggcatggtggcacgtacctgtagtaccagctgcttgggagactgagacaggagaatcgcttgaacccaggaggcagaggttgcagtgagccgagatcgtgccagtgcattccagcctgggtgacagaacaagactctgtctcaaaaaaataaacataaaaaataagaaaggccaggcgcagtggcccacgcccgtaatcccagcactttgagaggccaaggaaggcgaatcatgaggtcaggagatcgagaccatcctggctaacacagtgaaaccctgtctctactaaaaatacaaaaaattagccgggtgtggtggcgggcacctgtagtcccagctacttggggggctgagccaggataatggtgtgaacctgggaggtggagcttgcagtgagccgagattgcaccactgcactccagcctgggcaacagagcgagactccatctcaaaaaaaaaaaaaaaaagaaaagaaagaaaagaaaggggtttccccttattaatctatcagatctcttgagacttactcactactatgagaacaatatgggagaaaccacccccatgattcaatgacctcccaaccacgtccctcccatgacacatgggaattatgggggctacaattcaagatgagatttgggtggggacacaaccaaaccgagacaaagacccccctgggaacaaactagttggttggcatccctggttgttgtttttttttttttttttgtctttttgagacggagtctcactctgttgccaggctggagtgcagtggcgcaatctcggctcactgcaacctccgcctcccgggttcaagcaattctcctgcctcagcctcccaagtagctgggactacaggcgcgtgccaccatgcccagctaatttttgtatttttagtagagatggggtttcaccatgttgaccaggatggtcttgataccctgacctcatgatccgcctgcctcagcctcccagagtgctgggattacaggcatgagccactgcgcctggctgatttttttttaacataaaaatctaaa

SEQ ID NO: 30303 - DNA, 1067 bp, Homo sapiens
ctaggctggtctcaaactcctgacctcaggtggtccacccgcctcagcctcccaaagttctgggattataggcatgagccactgtgcctggctctcttttgggttttctatatataagatatgtcatttgtaagcagggataattttacttctttctttccagtttggatgcctttttttcttgtctgcctgcactttctagtacttttagtactatgttgaaaaaaagtgctgagagtggccaggggccatttggcaatgtctgtagggattttcgttggacacaggtggaggagtgctactggcagctgtaagatcaaggccaggaatgcttcttcccagcttacagtacacaggacagccccctatagcaaagaattaccctgctcaaaatagcaattatgctgaagctgagaaatccttctctgcctggctgactggctggctggatgtttgaaggcactttaaactcagacttttgttttttgagatggagtctttctctttcgcccaggctagagtgcaatggtgcaatggcgtgatcttggctcactgtaacctctgtctgcctcctggatttaagtgattctcctgcctcagcctccctcatagctgggattacaggtgcctgccaccacgcctggccaatttttgtatttctagtagagatgaggttccaccatgttggccaggctggtctcaaagtctcctgaccttaggtgatccgcctgcctctgcctccgcctcccaaagtgttgggattacagacatgagctactgtgcccggccatcccagcctgtctgaagcaggtcattatcacatttttctccatctctttttctcttccccatctatgtgtatagttttgttttgttttgttttgttttgagatggtgtcttgctctgttgcccaggctagagtgcagtggcgcaatctcggctcactgcaacgttcacgtcctgggtttaagcgattctcctgcctcagcctcccgagtagctgggactacaggtgcgcaccaccacgcccagctaagttttgtatttttagtagagacagggtttc

SEQ ID NO: 30304 - DNA, 1097 bp, Homo sapiens
tcctgcggttttcacgcgtctattcttaatagacagactttagaattggtttgtcaaatgcttaataagaagcctctgcagactttgattggaattgtgttcaatttatggattaatttaagaggtttttgtctcctcacacataaaagttctatcatccaggaacatatatctccatggatttacatccttttgccaagttgtgtgcttagtccatacctttctgacccaccttagttcaccttaggtaggtgatggtttttgttactgttgtgaatagaatttttaaaattaaatttaattatctcaaaaacccaaggagaaagttttatgaaggcaggccatggtcactctccagcttgtcatgagttgggtgggattgaaagctcactgtagagaggttcctggcccgtggcccgtgctgtctgctgtcacatggccctgatgttcacctgacaggccttgttcttgctgtcccgcagactttgtcgcctttaccactcccagtggcagctcctgcaacctgtgctttctttgcagttgctcctgttctcccagctgctcactcatctcacccacgtctttgttccttagaccctggccatctgcatttctcttctgctgcttagattccttgtttgtttgtttgtttgtttttggagatagggtcttgctctgtcacccaggctggagttcagtggtgtgatcatggctcactgcagcctcgatctgtaggcctcaagtgatcctcttgcctcagcctcccaagtctctgggactacaggcacataccaccacccctggctaactgcctcttatattccgaactgcttgagggcaaggaccaggtcttgtctctcctgatgatgcttaggtggccaacatgttgctgcgtacatgctagagacttaggcaatgtttaatttatattttctgtagaaaagcatgaagctataacacatttaaaatcatatttttgtataaatagctttaacatttcaagttatttctctagaatgtattcctaacataggattcttatattctcttttttttttttttttttttgagacggagtttcgccggaggtttgctct

SEQ ID NO: 30305 - DNA, 1392 bp, Homo sapiens
ttggtccaggaagagagaattctttcagttaaacttttggtcctcccagggggagttcctttgagatgacagatgacgacagtgccattagggctctgacccagtttccacttcccaagaaccttctggccaaggtgattcagattgcaacgtcatcctccacagctaaggtgagttgggtctcctagaagtttgtgtgggggccgtttacttggtcatgtctggtgttccctaaaggcaggtttagagagggctgagggggtgtgttcctccagcccaaacctaggccaggtggaggaactcctgcttgggaggaaaagcagcaggtgtgatggaatggaggtcaagcctcagcagcacagggagtgggcttgggggccgcaagagcagaagacccatacctcttctgggcggtggattgtcagtggggaagggttagaggtgtgggtcttggtgaggtatgaatttctctcttgctgccaggcgaaggggctttggtcatgaaatgcctaaccttgtttttactttaactcgttgctttgaattttgtcctgcttgtctctttaatcacctagccttgcttctcatgtaaaataagactctctctagctaagaaagccgtacaaaccccaattgaccccttaatttacaagacactaagggctcctcacccaaccccctttcgtaaggagttggcctgggtaaacagatcctcagcatttcaaaggagcctaattaactgataaggtacgaacaccaacaatatatgaagttcccaggaattttctccaagagataacaacataaaaccttgagttcgtgtctggcgtagaccctatatctaattataatgaaagatttagaatcttgcacctggtactgttgctcttcttgtaaccatttgtcttttaagttgtttatcactctgtaaccattttgattcttttgattcttgcatgtttttacttctgtagaattattacatttaagtccccctccccttcctaaacctaagtataaaagttaatcgagccccttcctcgtggccgaaagaattttgagcattagctgtctctttggccgccggcttaataaaggactcttaattcgtctcaaagtgtggcgtttccttaactcgcctaagtacaacagttaagcagagcttctgtccaggtgcagggtctttttgctcccgcaggatgtgcctggtttttagctcatgctgacagcttcaacccacagctgccacgatgttgccgagatgacagtgggctaggagggcaggtgatggcattgcccaagcactgtcttctgcagtggaagtcgaggtatagcaggagaagcgagcctgggactagggtgcctgagcccatgggcctgctcctggctatg

SEQ ID NO: 30306 - DNA, 1161 bp, Homo sapiens
cgtttgcagcaacagctggctcatgccccagggctcctttacaggtgggatcctgtgcttcctgcctgggtggcaggagatcaaaggagtgcagcagcgcctccaggaggccctgggcatgcacgagagcaagtacctcatcctgccaggtgagagccccggcggagggaccagggacctttggaaaccagcctgacctctgtcctagggactgacccaactgggactccaggggccccggtttctgaccaagctgtggcacttttcactgggcatagtgtttatctgcgcctgtttcatcaaaatggggtcaaaatccttgccctgcccacattccaggggggaattctggtggaagcagtgcccataactggtgtgtgtcttgcccaccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtggcacctacctcctgggcccggccaaccactgggggagggactccgttttgaggtggtccccagcccagatctaccttagacctgctttgtgtgtcttcagaaggccgcgcttgtggggtctcagtgttcctgatgtagggggctggtgagggttactcagggagtggggaagcactgaggaagtggcatttgtgtgctgcttacttgccacctcctccaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggtgcggcggggcggggcaggggctggcctggggaccaggcaggtgggaggcaggctcatggcgggctctggctctgtcataggcggtggagttcctgtccaaggctgtggacagtccaaacatcaaggcagtggacgaggctgtgatcttgctccaggagat

SEQ ID NO: 30307 - DNA, 1035 bp, Homo sapiens
gtaaaaatgtaatagggaagtggtgcagagcatagagaagttgactcaagcataaggcaggaggtgagaggagctcagggtctgggtcagctgagaaggctcaggtggccacagccaaggctcagagggctcttggggatcctcatgatgggcctggtagggctggcttctcaaggttgcttctttctttccccagctctgcctgccaaggattctgcctggccctgggaagagaagcctagatatctggtgagttgggcccgcccttctcttttctgaaatgctggctcatttctcagagaatgggctcatctgtctttcttgggaagggaggaagtgattaacatttaagtggtttatgccttgtgttagccattgttctaggcttattataatggtttttgcacttagtctttctattttttgagcttatacaaaaacatgaccaagtttaattttaattcagagtattctaaaatataatggtaactttttataaaaaccttgggttattaagatcctaaaatgcactattaaagttccctacatcaacatttgcacaaatagttataacactttaatagtatctaatagtctgatcttgtacattggacctctttttcacattttgttttagaaaacaaagatgcaaaagtagaaaaagagttaactcttctgtatccatcatcccacttcagcagttatcaactcatggccaattttatttcatctccattcccactggattaaagaaaatccaaggcatcataccatttaatccataaatatttcagtcctgtgtttaaatcattaacagctgtaggagatgggtggtgacatccccattttcgagatgagatcatctggcttagagggattacgtgatttatgcacagggacacgtggatggccaaatggtagagtcaggaattaaatccagatttctctgatctcaaaccatgaattttctgtgatgccttcttgactgtttttttctcctagaaaactacccaatgataaaagaacacactttcc

SEQ ID NO: 30308 - DNA, 1023 bp, Homo sapiens
ttccattgtagctgagcctgttgttttatgtttcagtggaaaaactagagggggaagaggagtcaagagagaaatggagaggatattggaacatgagagacacaaggcttgaacaagagaaattatgagacctggggtataaaaagaaaaggggaaagatcactgagaatatgagaaccaggatgtgcctgaagcagcaggtcatggaaagcatgtaagggacagcagcccacaccactgcccgctcaggccttggctgcctaatcctgggtcctggcctgctgtctagactttttgtcctccctcgtacactgtgccacgcggcctgactgcctgggctgctggctatagatgtgacatccctcccaaaacttctcacacactcaaggatttcagtatctacacctagtttcctactcttagctcagcatcattattattctctactgcttctgcacttctgtgctgggttttattaaatctcttttatagtccagctctcaggggaggatgctaggaagctctggcttggtagccttgcactgtgtttccttcagcccctactgtcatctttgatttgctagaagcttaattagtttagctttagaacctggaatatacattaccaactcctagagtgccaaggaccacttggaaggtggacaagaagattgatgtatacctgagaataggaggaagaagctgagtcagagaagaggtactcagggtaatcagaggcagctgggaataatgtgcaactgttcccaaagtctgcagagtgaagttaaaattctaaagcaagtccgaggccggcagatcacttgaggtcgggaattggagactagcctggccaacatggtgaaatcccatcgctactaaaaacaaaatacaaaaaaaattagccaggtgtggtggtatgcacctgtggtcccagctacttgggaggctgaggcaggagaattgcttgaacccggtaggcaggggctgcagtgagccaagatcacgccactgcagttcggcctg

SEQ ID NO: 30309 - DNA, 1047 bp, Homo sapiens
gacacacacaggagaaaagccttatgtctgcggagagtgtgggcgaggctttatagttgagtcagtcctccgcaaccacctgagtacacactccggggagaaaccttatgtgtgcagccattgtgggcgaggctttagctgcaagccatacctcatcagacatcagaggacacacacaagggagaaatcgtttatgtgcacagtgtgtgggcgaggctttcgtgaaaagtcagagctcattaagcaccagagaattcacacgggggataagccttatgtgtgcagagattgaggccgaggctttgtaaggagatcatgtctcaacacacaccagaggatacattcagatgagaagccttttgtttgcagagagtgtgggcgaggctttcgtgctaaatcaactctcctcctacaccagtggacacattcagaggtgaaacctcacgtgtgtgaggagtgtgggcatggatttagccagaagtcgtcgctcaaatcacatcggagaacacactcaggggagaagccttatgtgtgtggggaatgtgggcggggatttagccggaggatagtcctcaatggacactggaggacacacacgggagagaagccttacacgtgctttgagtgtgggcgaaactttagcctcaagtccgctcttagtgtacatcagaggatacactctggggagaagccttatgcatgcacggagtgtgggcaaggctttatcacgaaatcacagctcatcagacaccagaggacacacacaggagaaaagccttatgtctgcggagagtgtgggcgaggctttatagctcagtcaaccctccactaccaccggagtacacactccaaggaaaaaccttatgtgtgcagccagtgtgggcgaggcttttgtgataaatcaactctcctcgcacacgagcagacacattcaggggagaagccttatgtgtgtggggaatgtgggcggggatttggccggaagatactcctcaacagacactggaggacacacacaggagagaaaccttacgcatgcatcgagtg

SEQ ID NO: 30310 - DNA, 1048 bp, Homo sapiens
agaaggggggatcctggcaaagagaacagcacatgggatcccctagaccatcctccacctaatacccctagtccccctcctaatacacccaacccttcccctcaggcccagcctaagtccccctccccggaaaaactccaagctcctaattcaccaggtcgcttttgctgggctagtaacatcaaggatccaccgcaacatgtctgcatcgtccctcccatagtacaccccagcggcaggcaaagcccatgctcctgcccccccgctggtccaacatcccagcaccatattgacggcggctctgcaagacccatgggccaggccccagcctatgccccaagcagactacattatgggatatctgccttacttttgccaaggccaagtaatatggggcctcagccgcagctccaagcacctaggcatccctgcggctaagtctcctgagcaagtggtaaataatctttcagctgatatatccgctagcatttattgtggtcaggccagtgttaaaagtaaaaatatccaccagaaaagaactttgattctttaaagtcgcttttttgttgttgttgttgtttgagacggagtctcactctgtcgcccaggctggagtgcagtggcaccatctcggctcactgcaagctctgcctcccaggttcacgccattctcctgcctcagcctccccagtagctgggactacaggcacccaccaccacgcctggctaatttttttgtattttttagtagagacggggtttcaccatgttagtcaggatggtctcgatctcctgatctcgtgatccgcccgcctcggcctcccaaagtgctgggattacacgcatgagccaccacgcccgacctcttaaagtcacttatattaaaatgtgctaccagaaaataattacatgtgtataagtatgaggctattctgttaaaaaggatggtttaacattaactactgataattcgcgtaacctagcaagtttcttaacgagagatccaaatcaaaaagaaagcacacatgtttagatttaactgattacc

SEQ ID NO: 30311 - DNA, 1048 bp, Homo sapiens
cttgcagagacttaccgctttatccaatgaattagctaaaaattctggagtcaatgaccccatttaaggatggctaggaaagtggttcggtaaatggaaaggaatcacggtctcaatttttatttcccttgcagttgtagtaggcatcctcgttctcattgggtgttgtgtcatactatgcatctgtgggctaatacaaagaattgtacaaacaccacttactaaagcctcccttagttctcctctaccttattcaagtacgcttttccttttaaaagatcaaatcgaatggcaaagccaagacatgtttaaaaagtttgaagagaaaggatcgtaagaaaattaaaagggaggaattgtaagatgcaataaatctgagtttctcttcaaagggtttagcctattaacttccttatccttgttctcaaactcaactttcttgttcttccttgcccctagttaccgtaaacagcctatcccccttcccatcagctctaatcaataattcacatctgttcccttggttacctgtatcctttgtttccctgaaactgcacatctcacatgctccacctctgtacctcatgtccccctccccttttatatttgggaaaatatgtacaagtagccaatcgggtcagctcagattgtgcggtccagccacagcccatgggggagtgacacagagatagggactgcgttaaagataaacccccccgccccggtctcctttgttctgtgtgctcttgtgatcttgattgacacaagtggcacccttttgcagaagtaaattgccttgctgaaataatttgcctgagtgctggttttcatggtaccaagcatttattcctagagcattttatatccaacaagacgcagaggggacctctgtccggccagggcagatggctttgggtgccttctagtcaagaatcaccccttcctttgtctcttcgaaaagaggatgaaatcagggctgtaatggcctcatctgtgcagtaacaagctcgaggtgttgtgagatcttcacaataaagggttgcagggg

SEQ ID NO: 30312 - DNA, 1081 bp, Homo sapiens
gcctttgcaggagtgctcgctcagtgcaatcccaggggtcttggttttccgcagctggtcctttccaacatcactctcttctctcccctgccttgttaaccctcctttcccatcttgaggggtcccttcatgtcctggcctcaggaattcctctttttaggccttggagtgaggtgagaatcaagatctccacaactggctcctgtgattcagatgctgggccctatggtaaacctctccaggaaaggaacaggcaagggtggagtgagacttgggcatttataatgagtcttcaagggatcatgggctctcagaactgtaaaactcaggacttgtgaatcctgcatagctcctggggaactgagataatgctgggctcagattaggaatctggggctgctcgccactgggggaaatgaatcccactgttcaccctgattcgggtgattcaagggccctgattccccagggccatgtttgattaagaagggagtaagcccaaaggagaggctgtggaatgatgaatgcgtgggagggagatggttagatgagggtttgaacttggagattccaattccatgggggagaattttgtgtggtgggaggctgacaagtgagaactgtgaaatgttctaatagatactgggaagaggtatctgtcttttgaaatatccaagcttttatggatttctatattacctcttgttctcaagctgaatctatactgaagatttaaaaaatctggtatatctgggccaggtacagtggctcacatctgtaatcccagcactttgagaggctgaggctggcggattacttgaggtcaggaatttgagaccagcctggccaacatggtgaaaccccgtctctactaaaaattagctgggcgtggtacacacgcctgtaatcccagatacttggaggctgaggcatgagaatagcttgaacttaagaggcagaggttgcagtgagccaagattgcaccactgcactccagcctgggtgacaaagcaagactctgtctcaaaaaaaaatttttgtttctttaatcttaataagtgttttatgtaattttaagtaa

SEQ ID NO: 30313 - DNA, 1039 bp, Homo sapiens
ctttcttttctgggttttttttttccccttttttttttttttttttaaagacagggtcttgctatgttactcaggctggccttaaactccaggcagggctcaagcaatcatcttgtctcagcctcctgagcagctgggactccaggcatgtgccactgtaccaagcagaaatttcttttttcacagttctggaactgggaagtccaagatcagggctcctgcccctggacctgaacctggatctttggctttgatgttggaccttgtgtgtggatatgaactttgaacctgcaccttggaactaaacctctgacttggatttgttctgcattttggaactcaccttagacctgaaccttggtcatgaaatggatctgaatcattcttgggtcttggacatgggacttggacctccatgtgtatcttggacttaggaccatgatctggaccttgtaaattgacttggactttggacttggaccttggactagaatttgtccctggctgtggacctcgtctttggatctggatctggacctggtcttggatgttggacctagatgcaggccttgatttgatttggaacatggacttggtccttgcacatggcccaacacccgcgtctttggaactgcatcttggaccttggatctgaaatttaaacagggaggtgaccttcatttcttgtatttgactttataactggaaattcaatctctacctggatcttggacctggatctcagaccttgctttttattgggccatggatcttataccttaaacatggaaattgtacctggatttggacctttgacttggacctggatctggacccagggataagatttggacctcacttgcaaattttggtaatgaaattttcctttgctcctgtagtccttggacctaggcttcagtcatggatttagaccttagacgtgaccatcagaccttagagttgaacctaaattcctggtccccagtcctataactcagaatgattatgcataaccttggacttagaacttagatctgga

SEQ ID NO: 30314 - DNA, 1026 bp, Homo sapiens
tctggcccaagcaaagaaactgccatggtcgctcctattcatgtcctttctacagctttcaacctgattttccactcaaaccataaagccacacccaatctaaccagtacaagatcagctaacccactctccctaatgccacaggtggtaacacgtcattttcagcaactgtctacagagacatccatgacacctcccctccctcactcttcatatccacacgatcaccaacttctggcaattttccctacctaatatatctcaaaacccataccattctcccatcctcaactgctaccaccataactctaagacatcatcattcccctctggacatcttgacagcctcctctttggtctcccagtttctgtcctgccaacctctacaatctccacacagcagccaaagtgaaccacacatgaaaatctaatcatatggttcccctccttaaccctttaaagggcaccctgttcttagaataaaaaccaaaatccttatcacggcctcccaggctctgcatgatcttgtggttccccacgtacctctctagcctcatctggaaccccacactccttaagtttctctagctccaacctcatgggcctttcagttttgaaagaatttctggcttgacagcctttgtgtgagtagttttcgcagtcctgaatgtgctttctctggttgcctcctgcccaccttagtgatcttagctcacttcccgttacactttctcacagctccttgcaagttcccttcagttccgtcttcaccaccagaaggtgtaagcagtacctagcacacagctggctcttaacagtatctgaatgaaccaacgaatgcacctcatccagccattccaaggccaggctgctaggggttctcgtggcaagaacacgcggcctgtagggaggacatggttcctttactaacgcagctaagttgtggctgtcttgactcttggtttacaacaaactgacaagtcgagaatcctgttagacttaaaggtgactccatgagaattaaaa

SEQ ID NO: 30315 - DNA, 1044 bp, Homo sapiens
cactgcactgcagcctgggcgacagagcaagattccatctcagaaaaaaaaaaaaaaaggacttctttttctgtaaaatgggttgatatggcatgaggattaaataagccaatctgtgaagtatacagaagtgtagatctagaccagtgcacagccagccactgcttgtactccatctcatcctcattttacctttacctagaacagacagtatcagtgaagctgctatccatgcttgtgttaaagtgaatgcccaatacaaaagccaggctttactaaggtccacagcaggcccgtggggcttctaccgtaagaactatatttttccctaattgtgactatttttcttttgcagccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaaggatggcgttcttgtgtggttgtatacctgacagaataccttacatgagtttagtggaagaatttgcacttttttttggtgggggagggggtggagtctcactctcacccaggctggagtgcagtggcatgatctctgctcaatgcaacctccacctcccgggttcaaactattctcctgctttggcctcccaagtagctgtggttacaggcacccgccaccatgcctagctaattttttgtatttttagtagagaggggtttcaccatgttggccaggctggtctcaaactcctgacctcaagtgatctgcctgcttcagcctcccaaag

SEQ ID NO: 30316 - DNA, 1537 bp, Homo sapiens
tttttagaaatgggagcatttatagttaacatatcaacttagatatagtgagtgtttttttttttttttaagatagagtttccctcttgttgcccaggttggagtgtaatgatgcaatcttgtctcactgcagtctttgcctccggggttcaatccattctcctgcttcaacctcctgagtagctgggattacaggcatgtgccaccacgcccagctaattttgtgtttttagtagagacggggtttctccatgttggtcaggctggccttgaacccccgaccttaggtgatccacccgcctcggcctcccaaagtgctgggattacaggtgtgagccaccgcgcctcgccaatatttttattatataaaaatgtgactgtaggctgggcacagtggctcttgcctataatcccagcgttttgtaaggccaacgcaggaggatcgcttgaggccaggagtttgaaaccagcctgagcaacatagtaaaaccctgtttatacaaaaaataaaattaggtatgggggtggcatatgcctgtagtcccagttactcaggaggctgaggcaggaggatctgttgagctcaggagttggaagctgcagtgggccatgatcatgtttttatatctcagactgggtgacagagtgatactatgtctcagtactccatagtcttttagactggttacaaattctttttccttttggtagacgtgagtgtcactatgttacccaggctggtttggaactcctggttttgaatgatcctccagcctcagcctcccaaagtgtggggattatgatacaggcgtgagccactgatacagatgtgagccactgtacgtgggccttttttttttaagtagaagattatttacctgaattattattattattattattatttttggagacagaatctctctgttgcctaggctggagtgcagtggcacgatctcactgcagccttgaccttccaggcccaagcagttcttcgatgtagccaggactacagacgcatgaccgctatgcctgtcttattttatttatttgtttattttttgtgtgtgtgacagtgtctcactcttgcccaggttggagtgcagtggcatgatcttggctcactgcaacctcctccctggttcaagtgattctcctgcctcagcctcccaagtagctgggattgcaagtgtgcaccaccctgccaagctaatttattttttattttttatttttttattttttcagattgagtctcgctctgttgcccaggctggagtgcagtggtgcaatctctgctcactgcaacctccgtctcccgagttcaagcagttctcctgcctcagcctcctgagtagctgggattacaggtgcatgccatcatgcctagctaatttttgtattgttagtagagatggggtttcacgtgttagccaggatggtctggatctcctgacctcgtgatctgcctgcctcggcctcccaaagtgctgggattacaggtgtgagccactgcgcccagcctaatttttgtatt

SEQ ID NO: 30317 - DNA, 1197 bp, Homo sapiens
ccagtagaactctttaaacctgaaaaatcagtcaactttgcagactagaggaggatgttgaacacctatgtgtgttttttttttctttaccaactatgcacctatttttcagacacctaaaagtaatgtctgtgaaacagtggttttctttttctacatattacagcaggaagtgttcctatttatgtactgtctgtatcaatactaacggggcatgataagcaaaattttaaactttggtagttaaacctttatgttgcctcccctctgggctgccagctgtggggatgtgcttctcccttaaggactttggcaagaataacaagttcattggaatttgactttctgacatagagcagacagccttgccctgtcatgccaggcctttcatgtgaagttaccatttattagctgcttctgtctctccagggaaggatttcccttttataagcctgggccagggggatgatagtaagattccccatgtgataccagagttggaataggctgtagtgagattagggccaggactgtcccattttgattcttgaatggtttctgttacaacttgtcatggggaaaaagtaacacttattttttttttcctcccttagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtgagcagtgttgtaaactccagtgtaatcccccccagttaaatctaaggatgagctgttgttaattaatgtctcctccagactaattgaatggccttgtagcttgaaaccaaatttaagtgtatgtcaacatcatttggacattttgttacatttactttgttttctaatatatgcatgtctaaggtcctcagattcccaaattagtaagaattagaaagtaggggtggg

SEQ ID NO: 30318 - DNA, 1032 bp, Homo sapiens
tggaacttaaacagaaataactaaggtgtgccttgtatgatttctataaaatttgctttatctactagtttagggatttttttttttttccccagatggttggcaaaggctaataccttgaatttagatactcaggtctttattagcaactggctggaagctgaaagctaagttgtttttttttttgtgtgactaatttctagaagtgattgtagacttcctgtcttgtgctgagcagaaaactctgaagaatgaggacctatggatcctctgggtttgggatttctgcactatggctataacaaagctgctggacccctgcctccagagggcatttccctggtagaaaacaataatcgggtttctcttcctcaccatgcacacctctcccttgttgatcaatagttttcttttgctttagtcatactgtcaggttatatacaatgttggtatttaaaataagaaaaggatatgttcataatgttaggttagaaaaaataatattaggaattatgtagtgtgtaaccatgctctggacagtgtcagttgaccaagttcatgaggatgttcctgtctatacacaagaattctcagattgtcaagcctctgtgctggctttttctgccctgctagagacagctgaggggcccaagcacctgtccgtccgtccgtccgtccttccttccttcctttttttttttgttttttaattgtggtaaaatatatgtaacataaaatttactgttttacattcttccttcttatacatggtcagcctcctggaaagctttcccttcgccgcctcatctcttactgcccttaggagtcctcagagtctagctcatgctttctctgagtgagtttccttgagagaccctagagcacagtggccatgccttctttggtctgtgtccaaagaatacagctcgtttatttttttaggttatgtactgcagtcttctgactgctttatgttttacctgttcacacattttggcatgatctctccaactagattgtcagttcttggag

SEQ ID NO: 30319 - DNA, 1012 bp, Homo sapiens
acattgagaatggcctaaatacaaatggtgcaaagatgtccttgtcttgccagcttagaaaagttattgtcatcgctgtgtacctgataccatacaaaacatgctcatcatcttccagaaaagaagctcttcatcagattcaaggccagctttcattctagtctttttgttgtgctttctgtctacctcaggaaacatggaagtcatgtgtaatcaaggggtgatacggtatttgtgtgtgtttgtttttttttgacatttatattttaatcttgagtttataaatttttttgtcaagatgttactacagtatttaagaaaataatatcattcatgttttcattaacctaaaataagttttcttgcttgcttatcatccttcagctcttgtccatattcatacatagcattattgttcagtatttcattcaaccaatattgggtatttattgagaacctactacgcctcctgttatgttcctgtgccaggcacataacaggaaaaataactgtaaacaaaacagacaaaaatctctgccctggtagacattgcattataataatcagtagatatatgtattttatgcattctgcttttttcatgtatatttcaaacatttccccatttttactttgtcctcataaatactttaaatggctgtgtagcatgccatcttgtttttgaactgtaatttgcttaagctttctgcattgggcatttaagtgagtacctatgtattacagttgttgggggactggttacattgttgtgaatgtctttatggatatgacttttatgtctgttgggccttgtccagagtctgggctagtggtcagatgattgggttccagtcccattttttccatttaatataatatgacctcagataagtctgtcagcatctctatgcttgagtttcctcatctgtaaaataatgataacacctccttcacaacattaaatgtgatgataatgcagataaagtgcctggaacatgaatgttcaaatcga

SEQ ID NO: 30320 - DNA, 1031 bp, Homo sapiens
atttaaagtggattcttcaggctccagcctgatttccttattgttcctctccctaactcatatacttgattttaacctcctccaacctattgtcagcatctccgcccttcttgcaaccctcgagagactgctaagccctccaactttttttaacccgtctcagagaagctgtgtctgacctctcctgtatccctgtgcattcctgagggcttggaagaccttgggcaccttcatacgctcttgtggtggatgtgggtgtggtgacaaggctggaccaccggagacagacagagaatggtcttggcgtatgggacctaatgctagcacaggtattgttccaggttcttgggtttggcagagaaggaatccgtcaaaaaatttctgccctcaatgggctttcattctcttcctgtttatatagttttatataaacagaaaggttataaaaatagggttatatgtttctagcaaaaaggggtagctaaggaaagcagtcgatgaggtagtagctctgtcattgaaacatgctgttggaatctggctttttcattaagatgtgctggcctctgaagtaccctccttttggagaagatggtactaccatcttattggtagtacttggatggtactacctagctggttatttggcattccctgtctttgcctccttacagtagcagtagctgagacatagcattgtttcaaataacttttggacaggatgggctgtggctgcaggaatggacacagcttttagtcctactctgtgcagttcatttgatgtcagctcccatctgcatttcttttggttgggtttgctggacatgatctgcctatgtggcattcccctggaagtctgttaagagttctaggaggggcagtaaccagctctttgtactgagtccttctcaaaaagtttccattaaatgcaccctaaaagatatgctggctgggatttacttcacaataatctgaagggaggaggggagggctggaatggagacatagtgggtctggccaccagctggtta

SEQ ID NO: 30321 - DNA, 1046 bp, Homo sapiens
gggtcctaaatgtcatatgtgcttaccatttccttcagtagcaggaattgatctctctctggtattttaagttctttgtggtcaggggactcaaatgtttgttccaatgactaatttaaacttctgatagaagacttgcttgaatgcggtggaggggaagggacttggtagaaatcagaaaataagtttgtggctgttattaacaaacttcaggtggacttgcaatttgtgatctgaaaaatgatatcacaatctgcttacactgaataaagctgaaacagaagtagggcagcaagtcacagaattgctagtctaaacccacaagcaaattgctattggaattgccttacttaagatcctgaaccctgcagccgtctccttgtagcaagcgggtcagaggacacagagattcaaagttttatcttataaggtagtctccattctaagctgacagtttgatttcagttctctagtctctaacacccttagactgtggaagaaagtgcctccagaacaaaatgctgagattgtagatttgcatgctgctaaccacgtcagtaacagcgactaaagcattcatattcacttcattacatctctgtgagaaaatcttagcattattggcccacagcctgaatttccccctggtcttcatcctccattcctcagtcctgcttgtgaagcaggcatagaactgtgtgacacatttactatgttattcatttaaaaaacagaaaggagaacttgactcccaagcagccatctactctaggtttctaggccagtgtaaccaagtggtaactactgaacatgttttgagggcctgtgtcagatagtattttccaaaggtcatgagcaaacaccttctgtcatccactatagtctgtgcattttagagtttcagtcaaaaacagactatagaggatgacagaaggtgtttgctcatgacctttggaaaatacaaatgaccataaacaaagtcctttttgacatgcatgtagcacatgcttcctgaaataaagatctggaaaccatctgagagtatt

SEQ ID NO: 30322 - DNA, 1026 bp, Homo sapiens
acctcaacctcccaggttcaagtgatccttctacctcagcctcccaggtagatgggacaacaggttcatgtcaccatgcccagctaattttttgtactttttgtagagacagggttttgccatgttgccttggctggtcttgaactcctgggctcaagtgatttgcctgccttagcctctgaaagtgctgggattacaagcgtgagccagtgtaccaggccaactttgtattttttttaccttagtaaattcataaattcatttattagtgttttttttccccctgtggagtttcactcttgtccaggcttcagtgcaatggcaaatttttaaattaaggatttttgtgtctatgtctgtggaatattggggttttttttcttggttatgttttatcatggttatgctaacctcataaaatgagtttggaagaaatgtccctttcttctctagtttgtaaaagtgtttatgtaaaattagtgttgatagaattcatcagtaaaatccctgggcctggaacttggtgggaagggtttcgatcatgacttcaatgtctttactatataaagagctgctcagtttttctttttcattttgtgtcattgttggtaagtattcttcaaagaacatgttaatttcatttaagatgtcaattttattagaattaggttattcataacattttcttattttccctttaatgtctataagaattgtagggggtggtccatcttctacctctgttatggataatttgttttctcttttttcctaattgttctgttttatcaactttgttgatatttttaaagaatccatttttagacttcgttaatttttgctgttacttggattttatttctttctctttttaattgttactattttcttctttttacttcgttttaacttagtcatctttttctagcttcccttttttagctgtaatacacggcagtgactaaatttttctagcgtcttaggttagatctttatgtcattgatttttggaccttttttaatata

SEQ ID NO: 30323 - DNA, 1033 bp, Homo sapiens
gctgaggcaggagaatcacttgaacccgagaagcagaggttgcagtgagccagcgtcgcgccactgtactctagcctgggcgacagaatgacactccatctcaacagaaacgaaaaagaaaaagcattcataaataaataggacttttaatcctctggttacatgttgatctaatagaactgcaagtttcttctgaacaccacattggtcacatgtgttccttctaagtcattagtctttttttttttttggcttacattggttgtttactaccctggatccatttttcttttggaaaagatttggccttttctttataagttgtcttgataatacttaatcctaactaccaacaggttgttagctccttcattacaacagcccagcaagagctcttcttgattctactgaaaggttttctcttcacaattgaacaaattataaagggtaacaaggggacagggggtgaaggactcagttatgaaagtgttgactgtgatagattctaaatggattgttgagctctttcaagcattaaagactaatggtgtgaatactagttcgttccttagaaagctcagctgtttgtactcagacagatttttacctttaatctggcttaatattgtttagaagatttgttttggccctcctgccaggaggccaagatggctcaaggtggccactgcttcctctggaaaactgctggggagttgagatgggggttcagtcagttctctcttgtgacccaaatcagggagaaggtagcctccttgctgagactaccttttagaatatattattctagagtatcattttctcactgtttttctccatctctgtgctgcttttgctcagaggactctggggaatctggctttcctgtagatccttcctggtgtccattactggatgaggtgcagtgacactacattttcccttaattagtggtctcagaatctcatcaggtttgtagtagatttttgagagagagagtctccaatcttctgtgtactatcaacctaatatgtgt

SEQ ID NO: 30324 - DNA, 1051 bp, Homo sapiens
cactcactgattgcatagcctttgacactcattatatgctgggatgtgcccttgtttagtaggtgcgcacttgtctcctttcaggagtgacttgagcgctagaaggagggatcatgtggtgttcactgtgtgtcttccctctgctgcagttcttatctgtggaccaggcacatactaccttacaggtccatggtagctcttgtttaaggactcagtccagtgagcagacaatgttctgtgtgttttcttgtctctctagccgtaaatatgttcctactttctccttgctttagtagtaccctcatggtgtgtattgctctctctgggaagcctgatctaaggcttccaaacacatcccaatcttctgtgatctcacccaagtcttgacacttagggtgttttgtaactagcttaacttcccaattacgattataacatgtagatgcttatttgcttctttaacctaacattaaaatgtgaacttctaaggcgggtgaagtggtatgcacctgtagtgcccgagaggttgaggtgggaggatcacctgagcccaggagttcaaagctgtagtgtgcaatgatcatgcctgtgaacagccttgtattccagcctagacaaccgtagtgcagctcattatttaaaaaaaaaaaaaacaaaaaaacctggccgggcacaatgggtcacacctgtaatcccagcactttgggaggccaaggcaggcggatcacctgagatcaggagttcgaaactagcctggccaacatggtgaaaccctgtctctactaaaaatacaaaaattagctgggcatggtggcgcatgcctgtaatcccagctactcgggaggctgaggcaggagaatcgcttgagcctgggagacagaggttgcagtgagccgaggtcatgccactgcactccagcctgggtgacaaagactgtctcaaaaaaaaaaaaaaaagtctttctatgttaataaacttctcaatcttttaaaataaccatgtagtagtccattgcatagatctgtcatatattatttaactcatttttgtt

SEQ ID NO: 30325 - DNA, 1050 bp, Homo sapiens
gtgtcccactttatgaaattctttccctgggtatttgcctgagggccttttctagccacaaagtactgttggcctccacaaaagaaaatttcaaaatatggaagcctagcccgacgaatattggagtgtcttttttttctgttttaagtttcagtgtcatcagatgtatcatgaccctacagattttgcacgttctggcatttgtgcattcttgtgtgcatatctgactgggagatccgatgagactcccggaagtgggtctcaatcctgccttaggtctgagctaaggagtccttctcagagcacctcaccatgccctttgagagtcatagctctgtgtttgacatcttgggagttggtaaacaagatgtttaaacaaggtatttaacatacatatcatagctcactgcagcctcaaacccctgggatgaagtgatccttctgccttagcctcccaagtaactgaaactacagatgcccagctaatttttttaaatttgttgtaggggccaagtgtggtggctcacacctgtgaccccagctttaggacccctgtgactttaggagactgaggcgggtggatcacctaaggtcaggagttccaagactagcctggccaacatggtgaaatcatgtctctactaaagatacaaaaattagccaggaatagtggcaggagcctgtaatctcagctagtcaggaggctgaggcaggaaaatcacttgaaccagggaggcagaggctgcagtgagccaagatcatgccattgcactccagcctgggtgacaagagcgaaactccatttcagaaaaaaaattgtagagacagggtcttcctatgttgcctaggttggttggtctcaaactcctggtctaaagcaatcctttttttaaaaaacagggtctctctcagttgtccacgttgcagtacagtgatgcgaacacagctcactgcagccttgacctccagagctcaggcaaatcctcctgccttagactctctagtagctgggactacagacacatagcactacacctggctaattttttc

SEQ ID NO: 30326 - DNA, 1043 bp, Homo sapiens
ctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgt

SEQ ID NO: 30327 - DNA, 1984 bp, Homo sapiens
aagctggacaagcgagcagaggccacattgtttcaggccttgatctgactttatccctaagggcagtggggagaacctattgaagggttttaaggtggggaataacttgggaaatgcagtttaagaagctctgcaagtgaattcacctacttctgtggcttccaaagtgacttttatatagctacaattctgtgtgtgtgtgttttttgtttgtttgtttgtttgtttttgagacagtcttcctctgtcacccaggctggagtgcagtggcacggtctcggctccctgcaacctccgcctcccaggttcaagtgattctcctgcctcagcctccggagtagctgggattacaggtgcccaccaccatgcccagctaattgttgtatttttagtagagatggggcctcaccatgttggccaggctggtctcaaactcctgacctcaagtgattcgcctgcctcagccccccaaattgctggaattataggcatgagccaccatacccggcctctctagcctcttcctgagctcttcatttcctgttccatccaccatactcaatgctcttgcccatctcagggcaatcatacatgctgttttctccaccaagaaagctgcaaaccctcccattgctccccacccccccccccccgccccaacatttcccagtccccctcttccgcctcctttcctctggctaactgctgcttatccttgaatcctaactctaaatattgtgtcctcaagttggcctccccttacactcacccagtcttgttagattagaccagggttttctcaatcttgcctcgattgaccttttagaccagataattctttgttggaatgctgtttgtgcattgtaggatgtttagcatcatccctggccttacttgccagtagcacaacccctggagacagccgtacgtgtctccagctattgctagatgtctcctgtggggaaagttgccccctgtggagaaccactggattagactttctcattttacatcttttattttctttttgcattgtcaaaatccttctcattttattttactttttttttttttgagacagagtcttgctctattgctcagggtggagtgcagtggtgcaatctcaggtcactgcaacttccacctcttgggctcaagagatcctctcacctcagcctcccaagtagctgggactacaggcatgcgccattatgcccagctcatttgtataatttttttagaggtggagttttgccctgttgcccaggctggtctcaaactcctgggcttaagcgagcctcctgccttccaaagtgctgggattatcggtgtgagccactgtgccaggccccatctctattttttttttaattaaaaaaaaaaagtgaggtgaggaggaggctctgagtttgagaaatttgtggttgaagtgaacatcaagcgtgactgatgaggctgggcgcggtggctcacgcctgtattcccagcactttgggaggccgaggtgggcggatcatgaggtcaggagatcgagaccatcctggctaacacagtgaaaccccgtctctactaaaaatacaaaaaattagccgggcatggtggcggatgcctgtagtcccagctacttgggaggctgaggcaggaggatggcgtaaacctgggaggcagagcttgtagtgagccaagatcgcgccacagcactccagcttgggcggcagagtgagactttgtctcaaaaaaaaaaaagagtgactgatgagggggccgggcacaatggctcacgcctgtaatcccggcactttgggaggccaaggtgggtggatcaccgcaggtcaggagttcgagaccagcgtggccaacatggtgaaaccctgtctctactaaaaatataaaaactggtcgggcttggtggctcacgcctataatcccagcactttgggaggctgaggcgggcagatcacgaggtcaggagatcgagatcatc

SEQ ID NO: 30328 - DNA, 1002 bp, Homo sapiens
gtagctgggattacaggcacgtgccaccacacctggctaattttttagtagagatggggttttcaccttgttggccaggctagtcctgaacccctgacctcaggtgattcatccgcctgggcttcccaaagtgctaggattacaggcgtgagccaccgtgcctggccgagaccaaggattttcttttttttttttttcttttgagacagagtctggctttggctttccaaagtgcccagattacaggcgtgagccaccgcacccggccgagaccaaggattttctaagattcaagctgcaggattgtgtgtcctgatgcattcataggctacatgccgagaagtttccctgatccccatctcttccctgtgggtcatcagagttaggtacctagctctgacatggctctttgcctctatctaggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacag

SEQ ID NO: 30329 - DNA, 1934 bp, Homo sapiens
ttaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtaatatatgctcctgggcagggtgtggtatgggtcatgcagatgctcccaggcttgcaggctccacctgacagctgcatgttgtctctgcaggtacatgtcccttgctgtgtgtgaacttgaccagcccggccttggcccccttgtggctgcagcct

SEQ ID NO: 30330 - DNA, 1044 bp, Homo sapiens
ctgagggtggccacgctgccaggtgttccactcccccgggactatgggcaagggcccggggcggggagggcggcaggtgctgacactggagctgcgccggaggtcggggaactcggcctcctaagactgaggacactcgcctgctgggccggtcgagctgtgcggtgccctccgggacgcagggggcgctgcagccacgctgggtcaggctccgcagggccctcccaacccggggactaacggcgccggtgacgacttcgccgcgcgttggtcagccatggccaccgctctcgcgctacgtagcttgtaccgagcgcgaccctcgctgcgctgtccgcccgttgagcttccctggtgagcttggaccccgcgccctcgaccatccagccccctagggccggcgactgccagcccagcaccttccggcctctcgggctgcccggcccggccccgcgcccctgaccctttccctccgcagggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgagtcctggcccgcagtgtggaaactgaggcccagagtcacaggccctcaccctgcttggtccctgcaaacttggctttcctctgtctcctcctgcagtggatggagatggggagaggctgcgtggatttgtcgtattaaatgtgcctcctccctgcacaggtgggatcccaccaggacatcaccgaagacagcttttccctcttctggttgctggagccccggataggtactggggaaggggagggagaacagaggtgttctgggccccagaaggcgacccccactgcagcctctcaacagaactgtagactagccacacccacccttccctagagatcgtggtggtggggactggagaccggaccgaga

SEQ ID NO: 30331 - DNA, 1036 bp, Homo sapiens
ctgtcagtgcaggattagggtggggtaactggcttgcctgtcccacctgaaatatctgttctggctgctgaggtgcttgtccatggcatcgagagaacccataccgcgatatttctttagccggatcccatcggaaaagaagtattcaccaggggcctcagtggtggcagccaggagagagcccatcatgactgcggacagatggagtgcttgggttagagcctaagcagcactagggagggggtcccactggccttcacgggtactgggcctcacctgtggaggccccaagggccaaggctttcgcaatatgacccacattttggattcctccatcagcaatgaccggaacaccaaagcgccgtgcatactctgacaccttgtacactgctgttgcttggggccgcccacaggccagcactgttgagatggaggaacacatgggtggatagggttaatggggacgggcagtggaccctgtggccatatttaggacccaggagcttttggctacatctgcatcaggactgcagcttggctgaggaacagacgtgtctgggatggctgctgccacatctgccttaaatagtacaaacagctgtgctgacctctactcacccccacatgtgcacgtgcatgtgtgcagtgcccagggcagcctcaggcacatgcagtcttagcagccgggaaagcccccgtccagctggtatcagatggggcaggagtcaccgtgcagttagtccccagaggcactgaggtcaggcccagcccttcctccctgaatggtgggcagctcaggcaagataagggcagtggttgtgtaggagagcaggctgtggttgtgtggagcaggcagtggttgtgtgggagagcaaggaccacacaaaggagttggtccctgaactatgcctactgcagaagatgtgggcagaaaaggtcctgcctagggaagaaggtcctgccctatcagcaccccagaaggaagagggagctatgttcttgagcaccacccccaaaccatggtctgtgtatcagt

SEQ ID NO: 30332 - DNA, 1048 bp, Homo sapiens
actcggtctcaaaaaaaataaaaaataaaacaaaacaactggccaggcgcggtggctcacgcccgtaatcccagcactttgggaggctgaggcgggtggatcacgaggtcaggagatcaagaccatcctggctaacacggtgaaaccctgtctctactaaaaatacaaaaaattagccaggtggggtggcgggcgcctgtagtcccagctactcattctcctggaggctgaggcaggagaatggcgtgaacccgggaggcggagcttgcagtgagctgagatagcgccactgcagtccggcctgggcgacagagcgagactccgtctcaaaacaaaaaaaaaacacaaaaaaaacacaaaactttatctcctacttgaacctggggtactgcatttcctcttgcgcacagcaggcatcttaacccgtgagagacaatgtgtgttcatccttgtggaggcagttgagagcatatttcatttcttttcttccttttttttttttgagacggagtcttgctctgtcacatcacctaggctggaataaagtggcgtgatcttggctcactgcaacctccgcctcccaggttcaagcaattctcctgcctcagcctcccgagtagctgggatcacaggcacttgccaccacgccaggctaattttttgcatttttagtagagatggggtttcaccatgttggccagcctaatcttgaactcttgatctcaggtgatccgcccgcgtcagcctcccaaagtgttgagattacaggcgtgagccactgcgcctggcctttttttttttttcttctgagacagagtctcactctgttatccaggctggagtgcagtggtgggatcttggctcactgcagcctcgaccagcctccctggctcaagcaatcctcccacctcagcatcctgagtagctaggaccacaggcgcacgccatcactcctggctaatatatgtatatattttttgagaccgagtcttgctctgttgccgaagctggagtgcagtggtatgatctcggctcactgcaacctccg

SEQ ID NO: 30333 - DNA, 1434 bp, Homo sapiens
atttctatagatgttgtttttgtatatgaggtatgagaatctacaaacaagcacctcttatagagttctttctcctaatcggtacacagttttctgtatctataggttccacatctgtggattcctccaactatggattgaaaatatttgggaaaaaaggatggttgcgtccgtatgaaacatgaataaacttttatcatcgtcatcatttcctaaatgttagaacaactattttcataccatttacattgtattatgtgttataagtaatccagggatgtttaaagtatacaggaagatgtttaagggatccagggctgtgcaggacgtgccttgttaacaaaatgtttacaagcagtatacttggtaaaagtcatcgctattctctagtctcaataaactggggacacagtgcattgcggaaaaccacagggacctctgctcttgaaagcggggtattgtccaaggtttctccccatgtgatagtctgaaatatagcctcgtggaatgagaaagacctgaccttcccccagcccgacacctgtaaagggtctatgctgaggtggattagtaaaagaggaaagccgcttgcagttgagatagaggaaggccactgtctcctgcctgcccttgggaactgaatgtctccgtgtaaaacctgattgtacatttgttcaattctgagataggagaaaaactgccctatggggggaggcgagacatgtttgcagcaatgctgccttgttattctttactccactgagatgtttgggtggagagaaacataaatctggcttatgtgtacgtccatccagtcacagtaccttcccttaaacttaattatgacgtagattctattgcttacatgtttttgtccttattatgatgcaaatattacaccattttatataagggacttgagcacttgtggattttgatatcctggaaccaatccctcatggataccgagggaagagtttgtaaatgtattaaaacaaagtagtggaattggaatcaaattcttttgattttgtaggtatctgtgtttagccttttcactgtgctgtgaagatttcccccccaggcatcctaggggttgatgggagatttacttaagattcccaaggctgtctagggcagaagtgaaccagttctgccttggttgtcataaacacctctgttaattagctcagttgttctccagggatagattgattctctagctagcttttgccaagaaaaatgatccagtcaataatggaattccaaataagatttcctttttatttggctattaatcagaacctgggataacatccattttctgggccctgattttactatggaatatttccataaaacatgcatgtgattactgtaaatgtcctgtaaacactcctgcttgggctggtaggtcatctttttttttttttt

SEQ ID NO: 30334 - DNA, 1029 bp, Homo sapiens
atttaatttcatttttgtaaataaataattttgaagccaaattcagatttttcatctttatgtctacttaggttgcttagacctaatgtggtagatcaggttttgtttttgttttctttcttttttttttttttttttttttgagacaaggtctcactctgtcacccaagctagagtgcagtggcatgatcatggctcactgcagtctgaattcctgggcttaagcaatcctcctgcctcagccttctgcaaagctggaactacaggcatgtgccaccatgccagcctatttttttttccttttgtagatacatggtcttgttatgttgcccaggctagtctcaaactcctagcctcaggtgatcctctcatctcaaccttccaaagtggtgggattacaggtgtgaaccaccatgcccagcctgttttcttgttttgaatccaagctttctgagggttgtcctttaggaggagaatgtaaggaattccagagtcagggaggcatgggctgtgctctgggagaggcctggggaggcactgctctggaactgcctgtaggagtggtgtcagactgccagcagaagccagggtggtgaggggagggctgaatgttctgcaagagagatttataccactattttctttttcttttatttatttatttatttatttatttatttatttatttatttattttttgagacggagtcttgctctgtcgcccagactggagtgcagtggtactatctcggctcactgcaagctccgcctcccaggttcacgccattctcctgcctcagcctccctggtagctgggactataggcgcatgccaccacgcccggctaattttttgtatttttagtagagacagggtttcaccgtgttagccaggatggtctcgatctcctgaccttgtgatcctcctgcctcagtatcctgaagtgctgggattacaggcgtgagccaccgcgcccggccctttttcttttttttgagacagagtctcactctggagtgtagtggcatg

SEQ ID NO: 30335 - DNA, 1062 bp, Homo sapiens
agatcacctgagatcaggagttcaagaccagcctggctaacatggtgaaatcccatccctactaaaaatacaaaaattagctggacgtcatagtgggcacctataatcccagctactggagaggttgaggcgagagaagctcttgaacccaggaggcggaggttgcagtgagccgagattgtgctgatgcactccagcctgggtgacagagcaagactccgtctcaaaaaaaaaaaaaaaaaaaattaaaaaatgagccaggcatggtgctgtgaaccagtagtcccagttgtgggaggctgaggcagaaggatcacttgagcccaggagtttgaggttacagtgagctattactgtaccactgtactccaccctgggggatagattgagagactgtctctcaaaaaaaaaataaaaataaccccaaacccacctttttaaattgtgaaaaacacaatataaaacttaaccatcttcaaagtcaagtatactgttcggtaataaataatgtttaacgcagtgtatggacttcagtggaatgtagaaggaattctttcagtgagccccattacgtaccatgttaaaatctactcagattaaaagccatggttcagtggagaatgactgttctgggttttgaaccttgcttttcttccctttccctagaacatgtctgcacctgggtggatttatacctaggttttaaacctttgcttctgtctttgttggaaaaaaccaaaccaccgccagcagaagccactgccctttgtttatctgtgataagtgagaatttgtaagaattttccaagtgagagaagtgttcaaagtagcttttatgtttgatagaatgtgtagtgcttgcctctcaggggtggtattttttctcccacgtatttttacctttaaatctcttgctgtatatgtgaccctggctccctttggttggtcctccagctccctgatggtcctggggctccctccatatcactggtggtatttccacattgcctgcagtttaggtaggaacctgtcccatgtcagggaaaccctatctgtcccctg

SEQ ID NO: 30336 - DNA, 1081 bp, Homo sapiens
aagaagggacctgcctgcgcagagggtatagccccaagatcctggctcttctgctctgccccacacctgacactccttcatgttctgacagctcttgtccagtctcagcctggccagcacttgttgcttaaccaatgctgttctccagttctgccttgagaattgatattctgttattgaccccagcttaactcacacatggactgctttgaccagacgtgtgagaaggggctatgggctccctcaaggtcctcatggccagcatagcttttttgagagacctgtgccatggggcccctgtctcctctcttgtggccttaggaaaccctaaagcagatagtcttgatgtttgctcccttgaatcagactggatgcctgtatacaaagctcagcccagctcttgactgtccttggctctcacagctacttttggagctgagaggaccctttctccttatcagggtctgtggggatgggtcccacagaagccaacctggccttcactcagtggatcctggcctgtcctgggctggcaacagtatgagccacccttgtctcccttgggtttggtgctggatccctgcaggcacctctcctctgacttgagtgtgggactggctgagaaatgtgattatatgccaggagatgttctaacctctcctcgaaggtggtcagggagagacatctttacatttcatgaaatgcccaggctgcccctcagatgtctcattttggtagagcctgcaaggatggcttttcatccctgcttccctttagccttcttgcctgcagacaatgtggaccttccctcagcccaagatgttggcaggctgggagcagcccttcctgggactgtgctctcagctgctggcacgggcccccaattgttcccctgagaacaatgggcactctctttggctaggaaggggagttcatgaaaggagcatttctttggatgcttgagagctttgtggcagccccgcctgtgtgagatgagctgcagtttcttcctgccttgagtgggtgttccgcatttctgaatggaccccttgtgaacaaagcacaccgggaaatgcgggtt

SEQ ID NO: 30337 - DNA, 1033 bp, Homo sapiens
tttcctcttgttagttgtgggggtgtggaaggccagacctactatgtgtgggctatgtgaggggaacctgttgctggagcctgtgggccatgtgcagtaagttggggctaactgtgaaggtaggttggcaacactgtaatagcagttatgactaccattactgaatgactgcctcatcacagacattctgctaggtgttttatttcttattccacctgcttggccattcagcttctgcaggccctgcctgtcctgactttacttactgcctggggactgactttttaaatggtaaaatggtggctaagccctgcatgcctacagcaagggctgactgtcactttaggacatgaggccctctgggtaagctgggacttggtgaacaatctagctgtgggggactcctgctcagtcctttcatttggtgccaggagcatgtcatgctggtattgatcctgcatttgtagcacttgcccgagctccttttctggagggacctctgccatctcctctcactagcacagtggttgaagctgtggagtgaattgggacactggcctgtgggctcctgcctgtggtaggggtgatagaattttggtgtctcactctctgtggttccttctgtacagatcgggcttctagtgggggtctgttgccccctagcattctcttggcccatttgtcttatattttaggttctggtcagctctgctgtggaatgggatactccctgacacatctgtgttgtgccttgggctcccaggctggccacagggctgctgtgatctctccttcctattattcgtctttacgggcacatagggttctaaagagagctttgctctagcagagacctggggcccctacttctttctaacaagagggtcacatggaggcacatgggaagcctccagggagctctagatcaccccaggatcagatcaaatcttgaatggcctggagaggcctggttgcccctaaagtgggtgaggctgctgtcagggccaacggtgaagaagagattttccctgag

SEQ ID NO: 30338 - DNA, 1048 bp, Homo sapiens
ggctggagtgcagtggcgcaatctcggctcgctgcaaactccgccttctgggttcacaccattctcttgcctcagcctccccagtagctgggattacaggcatctgccaccacacccagctaattttttgtattttttattagagatggggtttcactctgttagccaggatggtctcgatctcctgacctcgtgatccacctgccttggcctcccaaagtgctgggattacaggcgtgagccaccacgcccagcctcattattgtacttttcaacaacagaatttctagtttatttttataatttctctttattgataatctgtatctgataagacattgtcatcatagtttcctttaattttttagatgtgattttctttggttctttgaacatatttgtaattgttgctttgaagtctttgctgagttcaacatctagactcagaaacagtttctattgcttacttggttttctgtgtatgaatgggttacactttcctgttgctttgcatgtctcataattttttgttgaaaactggacattttaaggaatatattgtacaacttgttattgattctgtcctctttcagggtttgatattgttgctgttgtttgcttggtcatttgtttagtgatgtgactaaactgactctagctaaactgactctatggagtctgttttccctgaagtgtgtaacttctgatatcagatttttttcttgttttaattttttatcctaggggtcacccctgggtgagagatcaaaggtcaacaattgatgaaatcttgtgcttaagcctctttgaccagtcagatttttgcccttgaacttttggcctcaagcaatcctcctgccttggcctcccaaagtgctgggattacaggtgtgaggcaccatgcctggcctttttgtaaattctagagagggtctcactattttgcccaggttggagtgatccacccacctcggcctcccaaactgctgggattacaggcatgagccaccgtgcccggccgccaccattacacttaatggtgaaaaac

SEQ ID NO: 30339 - DNA, 1128 bp, Homo sapiens
ctgtgcttgagggggtccctgagaatgtgtcccctggacaggtcagcagcaacagcctgtgtcccccctggagtctgggacccttcttgagctaccaccccttgctcactcctgccctttgatcctgtttacaggcattttgggcccctggagatgctggtgtggtgtttgtgggctggtggcatgagcccttccggttgggcatccgcttttgcaccaatcgcaggtgagggagtggggcaaggcaaggggccttgcagcccagctggccttgagactgagtgtctgtctcgtggttccaggtcagccctgtattatgtggacctcatcggggggaagtgtggtaagtggctgatgcccacctgtgctttgctgacacatgttggccctgccagcctgcgtgatgctcatgtttccatctggcccagagctcctctcggatgactccctggctgtctcttctccccggctgagcccagaccaatgtcgcattgtctacctgcagtacccatctctgatcccccatcaccaatgcagccagctgtgcctggtgagctggaggtggcagggatgggagggtggtcagcaagaagatgggatggtggatgagagctgaagggccagtatcatctccccataggccctcagtaggtgcccttctgtcctcaatgcagcagcggtgtgagttctgcctgtcctctcaaggagggcctagaggttgagagtgctgccatggagagctttgcactgttggggcattccaccttgagagaatgctcgtctgcaagaatgctcctccccttggctctcaactgcatgtagccaggctctgcaaggggctgggatatagtggggagttacacaatcccagaccctccccaggaagagctctgggcccctggtaaaagtcagagggacatgcctatctgaggccccttgggcatctggtccaggtcaccagaaaagagatacatcaggcttattccagttcccccatctcctggggctacctgaggcaaaaggggataggcacagggcactgtgccctaagggaactgcctgtcccctactggacctgaccattgtgttctcttgcagtatgactggtataccaaggttacctcagtg

SEQ ID NO: 30340 - DNA, 1021 bp, Homo sapiens
gtgtgatgttagatggaggcttttcatatatggtctttattatgttgaactgccttcattctctgcatcttcagcactaactcacctgtgtctttctaatcccattattaatggagagattcactcctgtaaaccagcactttgggaggctgaagcgggaggatcacttgaagccaagagttcatgaccagcctgggcaacccatctctacaaaaaaaacaaaatttaattagcggggcatggtgacacatacctgtagtcccagctactctgaggtcaggagttcaagaccagcctggccaacatggcgaaaccccatctctcctaaaaatacaaaaattagcagggcgtggtatcacatacctgtaggaggatcacatgagcccaggagttccaggttacagtgagctgtgattgtgccactgcattccagccttgacgctatatgtgcccaaaagttatgctctctccttctttctctgtcttagctgctacatcttccccttcatctccctccagcacaggctcttccccatctctgaaatagtctcaccagggtctctgtctgcccccatctcaatccggccggcacatttccatctcctttgcattgataccttagctctgatggggccattgccagcccctcaccagacacagtcttcgctggccttctgtagcagcaggatcatcgctgcctaggtttgcgcctaggccctcccctaacctcttgcttacatcttctcctcagttccttgggctttagggcacatcagagagctggtgtgaagcccaggtgctgtgaccgcactccaagacacacgggtgctgtgggtctgggctggggcctgaggcctcattcttgcctgggctcctttgtgagaccctgacatagactttgtggaaaccacattgtggggagcagggccctcagcaggttttgtctgtttcctgtgacctctgttccaccagtcacactgccccctgctttcccaccaccttctcctttgcactccagatc

SEQ ID NO: 30341 - DNA, 1043 bp, Homo sapiens
gagcccaggtcagggctcctgccagggcctgtcatcccttcacagtgagcctgtgccttagcccttgcacagccaccaatgaatgctttgcccgatgtccccagatgccaccctgggtccaggctggccttgggagccagctctagagcctgctacccaagtccacccaccctgctgacatgcctgcctctggagcccccactcccagccgacacgtctcacttcccacccttgcaggctatgaagagaccctgacccgcctggctgccattctcgccaaacactttgccgacgcacgcattgtgggcactggtgaggggcccctacagagggtacagggggagggggatgggatggcacctctggtcggctttcttctatgaaaaatgtggccaggtgggcatgaagtatgggtccagggctcatgccaagcccctgctgaggcacggtgtgtccccgcagacatccgagactcactgatgcaggccctggccagctacgtgtgctacccacactccctgcgggctgtggagcgaatccccgaggagcagtgagtggggcctggggggcacacaccctggccacaagcaccatgcccagcctcaccccgtctctcccctccttgccctcacaggcgtatcgccatggtgaggaacctcctggcgccctatgagcagcggccctgggcccagaccaactggatcctggtgcggctctggagggtaagcctgactcgaggggaagtggctgaggctggctggagggagagggtgcgctgtcccattgacctgggcactgacccccacctccacagggctgtggcttcgggtaccgctatacacggctgccacatctgctgaaaaccaaacttgaggacgccaatttgcccagcctccagagtgagtatctgggttgggcgagtcctgggcaaggcaggcgggggcgcttacctcctacccatgggttctttcagactctccacttcttccagcccctctctggttcccccattgggtcccagactccctacgtgtcccctgggg

SEQ ID NO: 30342 - DNA, 1082 bp, Homo sapiens
atcttggcttaagcaacctctgcctcctgggatcaagcctcgggatcctcctacctcaacctctgcagtatttgggactacagacacctgctaccacacccagttaattttcgtatttttttgtagagatagggtctctattgatgtgcatttaggctttataatatttatatatatattttttgaaacaaagttttgctcttgttgcccaggctggagtgcagtggcatgatcttggctcactgcaaccttcgcctcccaggttcaagtgattctcctgccttagactcccgagtagctgggattacagtttttaaaaaatgtatcctaggctgggcgcagtggctcacgcctgtaatcccagccctttgggaggctgaggcgggtggatcacctgaggtttggagtttgagaccagcctggccaacatggtgaaacctcgtctgtactaaaaatacaaaaattagctgggtgtactggcgggcacctgtaatctcagcttcttgggaggctgagacaggagaatctcttgaacttgagaggcggtggttgcagtgagccattgcactccagcctgggtgtcaagcaaaactctgtctctctctctctctgtgtctctctctctctctctgtgtgtgtgtgtgtgtgtgtgtgtatatgtatatatattctgccaatattttgtgattagagagtttaaagtatttacatttaaagtaattactgataaggacttttgccattttgctactacttttatgtttagctgatttttttttttttggtagtgaaaaaaaattttttttttttgagagcatgagactgttgcctaggctttggtgagcaaaatagtgcagtgccacaatctcagctcactgcaactttgggctcaagtgatcctcctgtcccagtctcctgagtagctggtagtataggtgtgccaccaccatgcctggctaatttttgtattttttgtagagatagggttttgccatgttgcccaggctggtctcaaactgggttcaaacaatctacctgccttagccttccaaagtgttgggattacaggcattagccacttt

SEQ ID NO: 30343 - DNA, 1080 bp, Homo sapiens
cccttagcctcctgagtagctgggactacaggtgtatgccaccatgcctggctaattattgtatttttttttttagtagagatggcgtttcaccatgttggccaggctgatctcaaactcctgacctcaagtgatccacctacctcagcctcccaaagtgctgggactataagtgtgagccaccgcacctgccatttggattggcaatctgcaagattttattacttaaatgcaacagatgttctcattcattgttctgaagcttggagttccaatgaaaaatttaggtggagaactgagtttagaaaatccatataatgtttagtaaaactagtatttcataaatgctgaatgacagagattggtctttaaattaaaacaacagtgtgatgttgggtattttttttctttcaaaatactaaggattagatcagtggtcagcaaactacagctgatagcctgtttttgtaaataaagttttactggaaaacagccactcttactcatttgcagattgtgtatggctgctttcatgctatgatggcagagttgaatagttgtaacagagattgtataacccacaaaatccgatatgtttacgaactggctcttcatggaaaaagtttcctgacctctcatctagatcaatggggttgtacgttaccatttaaaaatatttaggttgtaatctatcctcttattacttgtatttatgggtaactattttgtaagtaaggctgtttcgtatagaattaacgtggtttaggtaagcattcagaaatgttaggttaatttagctttattgtctaacttttttcaaatttagaacatttgtctttgactcgtttaaacttatttaaaattatattttcccaccttaattttagtttaaatgtaagtcattatatgctgttttttaacatctttgactaggagggagacagtttttgggaactaatttgaaccaaaacagatataggaaaatgattttgttacatttcctttgaacttttcttttaaaatttgtttttatttggttgaaaataattttcataactactgatattttatattagtaga

SEQ ID NO: 30344 - DNA, 1341 bp, Homo sapiens
aatatgctggtgtgtagatttcaaactctctggacaatatgaataacactgtctttgtttctacagtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggacct

SEQ ID NO: 30345 - DNA, 1034 bp, Homo sapiens
gcactgtcaccagtgctggagtgcagtggcgcgatatcggctcactgcaacctccgcctcctgggttcaagcgattctcctgcctcagccatcggagtagctgggattataggcgcctgccaccatgcccagctaattttttgtattttttagtagagacggggtttcaccatgttggccagcctggtctcaaactgacctcatgattcgtccacctctgcctcccaaagtgctgggattacaggcatgagccactgcgtccggcctatattttatctttaaatgatcagcagaaaccttgtaagctgaagactgcaatcaacagcttatgtcaagtaaactatagagcagtggttctcagagtggatcctggaccatcatcatctctttaccccttgggaacttgttggaatccaaattcttaagccccatcctaaacctactgaatcagaaactctggggtggggcccagtagcctgtgcttttaagaagtcctccagatatttttaatgtaccctgaggaccactggcagtagataaagtgtttgtttagattctttattctagaacttttgtatagtttaaaagtgacttaataataagcaagtggaccttttgtaagtagacaaagctaatgcttatgtgctttaggagccagtgctgatcacatgccttgcctacctaatatcagttctcctgctctgcatagcaggagaaggagctggagtagtgttggtactatcttatgactttagttatatgtaactaaggacatataacttagttgttttttctgtttatatatagtatacttcctccagagatcttggaatggttgtagatcttctcattcacacagtgtttctgtgacatatgaatgcaggcagaattgcttttgatttttaggtttgtttgcatactacgtagtatataagcttgctgtgatatttttccaaaagggatttatatcatttaagcaaaaatgatacagcttctggattatgtttcctaataaggctcaaacatagaaagta

SEQ ID NO: 30346 - DNA, 1658 bp, Homo sapiens
tcttgatctcctgacctcaagtgatccgcccacctcgacctcccaaagtcctgggattacggacataagatactgtgcctggctgagtttgtaaatttctttctttcttttttcttttttttttgagacagagtcttactctgtcacctgggctagaatgcaataatgcgatctctgctcactgcaacctctgcctcctgggttcaaacaattcccctgcctcagcctcctgagtagctgggattacagccgcctgccactatgcccagctaatttttgtattttttgtagagatggggttttgccgtgtaggccaggctggtctagaactcctgacttcaggtgatccacccaccttggcctcccaagcgtggggattacaggtatgagccaccacgcccggtcatcaaagataatgtttttaatgatcaggagcactttgagatgtttagaacaatctgaaacctgatttccaagccatctcaaaatatactttggtaatcaagacagggaaatgatggtgttatatcatttgtgggactcaactgattttgttgagtattgattttgctgtgggattccttgttctcttggttgtgttgggcctactgctttttaaaaaagtattttgagacagggtcttactctgttgctcaggctggagtgtagtggcgcagtctcttgtctctgcaacctcaatctcctgggctcaagggatcctcccacctcagcctcccaagtagctgggaccacaggtacccaccatcacacctggctaatttttgtattttttgtagacatgggggtcactgtcttgcccaggcaggtcttgaactcctaagctcaaacaaccgtcctgccttgccctcccaaattgctggaattacaggtgtgagccagtgcgcctggccttcttttttttttttaaccactattttttagaactagatttggcctggaaagagaaaaaagatattcctcgacttgatctatatattttatggttcattcatttgctttagaggtagaaggagcaggaaaaagtacaacaaaacaaaatcttacctttggtgtttaatttgaatgcccacagatgcttttgcatttattagtagtgagttttcataattatcaaatatgtagtagaaaaatctggctgtgcatggtggctaatgcctgtaaatccctatatgctgggaggctgaggcaggtggattttctgagctcaggagttcaagaccagcctgggcaacatggcaaaaccccatctctgccaaaaataagctgggtgtggtggcacacgcctgtggtaccaggtactccggaggctgagctgagaagattgtggaggtttcagtgagccaagattgcaccactgcactccaacctgggtgacagagtgagactccatctcaaaaaaaagaaaaaaaaatctccttgtccaggagctgtgttgagtgggctgtggactagcaggaattcatagctctggtgaaagatgactagataatgtcattttttttttaaaagtccctgaatgattgtgacagggtaggaaaatcatcacatagcaaaatcttcattagattttccctaatgacttatcaactgggtttgtgcaccaaacgaaacaacttcctgcctttgtttgtctgaaa

SEQ ID NO: 30347 - DNA, 1029 bp, Homo sapiens
gttctggttgatccttctgtcatgcctgcaccatcttttctgccagactgaagtgttcttgcttggggaaaagcagatttgcaaaggttctctttttcctgattgttgctttgcagattgagtatatttgtttgtttgtttttaagtgaacaaaagttgaatgagattgattactggctctttaaagaataattactcccccttttgacttatgtagcatcttgaggtgatctatgaccgtttgtacttgtcatgacttccattagattaaactctggggcaaagacgttgctcttcattgtgctcatatgacaccattactgccagtggaattgaaataaattgagtaagggcgagtgtttcctaacaaatgttatcctgggcctgaggaaccatcatcaagatggagtggccctgcgattaattttggacttaaagcaaaaaacaaacaaatttttttctttaaataaccagttggcacagatacagaataaaataagatagatccacgtgtagtttttgaaaatttaggtcaggtggctcactcctataatcccagcactttgggaggccaaggcgtgtggataactcgaggttaggagtttaagaccagtctggccatcatgatgaaaccccatctctactaaaagtacaaaaattagctgggcatggtggcgcatgcctgtaaacctagctactcaggaggctaaggcaggagaattgcttgaacctggtaggcggtagttgcaatgagccgagattgcgccactgcactccagcctgggtgacagagtgagactctgtctcaaaagaaaaaaaaatttaagaaataatcatcagtgtatatcttccttttttcatttttctttaaaaaaaaaaacaacccttgtatgcatagctgaaggagaaataattgaaagtgtttataagatttcaaggtgatgggctggacacagttgctcatgcctaataatctgcacgcctgtaatcccagctattcgggagcctgaggcaggagaatcacttgaa

SEQ ID NO: 30348 - DNA, 1030 bp, Homo sapiens
cttactttcataggctagtttgctaattgctgaaaatccttatggcacaaccatgagtcttgaacacacagaataccttttttttttttaacgttttaggcagtatagttaaaccttaaatttctgttcttgtttgatagctaaagtttcagtcagaataaatttagtgttgggcttgtgaatataatattaaatctgaagtatgttgtcaacatatagtattgcagggttgatgtctagaaatgctatattagatgctcataatgttttctgtatctttttcttcccaatgtctacttgtcctttagcaaagtatgaacgttgtcatgaatcttttctctctgtccacagattctgtgtgctcctctgggccacagtagttacttctttaagcacagaaaggaaacttagggctttgccagttttagtattagttctctatgtttttcatccgggcagctatggagagggttgctttccacacacctgggtactccattgatatgttctgtagaggtaatcaacacactagagagtacacctgtttgttccatggctaaccctttctgattgtagacatgcatttgagtgtttgcagtggatatttggtgctaacaggtgtcttagttccttctgttattctgtaatgtttcccaagaatattcagagctgtttataaaatgcagagtgatttatgtattaggtgttcaatgagtttgatcaagaagattcacttgaaaggaattaactaacaaagcagtttccattgttaataggatatgcatgctgtttctctaaagtatttttatttcttcaaagagttattaagcagaggagactgattttgtggtaagtttggaggggttagttttaatccacgttggtcaaaactaaaagtagattagaaaatctatttctcatcctacagtagtgctgaggtttctagtagattgtttttcttcttcctagtcattttctgaaactcaaaacaagaatcaacctataccattgtaatgtttcacagttaact

SEQ ID NO: 30349 - DNA, 1045 bp, Homo sapiens
ggttaaaatgtttcgggtccccacgtgaactctctgtgggattacccaattctggggtaccttcaccagatcaccagtgctaaagagggcaaaggatcttcttggttaatagaaaaggctgttttggaatgaatctcaaagtccagaaacatcgagacttttcttcaatacttttttctatttggggtagcaactttacctagtgtaggggagggaggggttagttgggagggcttgtgtttaaggggttcagaaacaggggatttaagtgtgtcttttgtgtttgcaaggcactaacaccactcccgtctgtatttaaatgctgtccccaggttacgactatggctatgtctgcgtggagttttcactcttggaagatgccatcggatgcatggaggccaaccaggttgctttatacttcggtcaaatgatgctggaaggatatatttttttatatatggggagggagggtttcaaatgattttactttggaaaggtacaagaagtctatctgtggagcatactgtattccaaccatcggttgtgaggaaaatctttaaaaaggctggaaagctttctctacaaaacttaatgggcacagagtgcattttaaaagctagagcccagttgcttttggactagattccaaagacaatagttggaaaaaaaaaaaaaagacacatctggagtgtttccttttggagtgtgactgagatggtaatcctgatgcaaagaatgatccttgattgtctgtgaccccaaggatctgcctagcacagaaattctaggtcaatagttacacccagacctagggtgaagacctctgatggtgacttctgtggcatcagatcctgcctgcaggggctacttccaaaagagagctatcagggaagagagaggagtggattgttggtgtctattgcattcatcattgttttttgccaattggagttgcatactcaagtccttggctgcgtatagtcagagctggtgaatcagaatctgtactcaccttacgtttgaactatctggagttactcagctt

SEQ ID NO: 30350 - DNA, 1025 bp, Homo sapiens
tcttgtttcccaggctggagtgcaatggcgcaatctcggctcaccacaacctccccgtcccgggttcaagcaattctcctgcctcagcctcccaagtaattgggattacagccatgcgccaccacgcctggctaattttatattttttagtggagaccaggttcctccatgttggtcaggctggtattgaactcccgacctcaggtgatctgaccacctgggcctcctaaagtgctgggattacaggcgtgagccaccgtgccaggcccacccagattcttcttagcacatttgaatgcagatttttgaatagttatgatctattctcattgaaaaagggacatcatttgacttgacctcccaccagactcttcctttgaggttggatggaggtgcttaatggatgctgtggatggtgtgtgaatttccattgggttgagtggatgatgtatgtggaaggcgattgggatttactttgtcggtgtctccaagaggtcccccactgggctttgtcaggtgctggggttggaggtcaagaagtagggcaacatctaaagcttctactcctgggcactgtgaggtttttataggtcttttaaaaaaaacagtgaataggccgaacgcggtggctcacacctgtaatcccagcactttcagaggccgagggaggcggatcacgaggtcaagagatcaagaccatcctggcctcgtggtgaaaccccatctctactaaaaatacaaaaattagctgggcatggtggcacatgtctgtagtcccagctactcgggaggctggagcaggataatcgcttgaaccctggaggtggaggttgcagtgagcccagatttcaccactgcactccagcctggcgacagcgaggctctgtctcaaaaatatgttcttccatgagacagcgggcatttggatgcctgatacaaaaagaggagggactatgtgctagtcagctttagactgagaagcagcagcaaccatggcaaaggggaagcaaactttcctgagtggc

SEQ ID NO: 30351 - DNA, 1050 bp, Homo sapiens
atattactgttactgacttctagtttaattctattgtgatctgagagcatatattattttttctgtcattttaaactggaaaaggtatgttttatggcccataatgtgctgcgtgagcttgaagagaatatgtagttcgctgttgctggatgaaatagtctacaaatgttgattagattgctgctgttattttgatgcgtatccttccagatttttctatgcatgtatcatctatctgtgtatctatctgtaggataggagagtcttgtacaaatggttttataactctttaacttcaaatattgtggacttacttccttgtcattaaatacatttaaggctgggtgcagtggctcatacctgtaatcctagcactttgggaggccgaaacaggcagatcacctgaggtcaggagtttgagaccagcctagccaacatgttgaaaccccgtctctactaaaaatacaaaaattagctgggtgtggtggcacacgcctgtaatcccagctgctcaagaggctgaggcacgaaaatcggttgaacccaaggaggcggaggttgcggtgaaccaagattgcgccagtgcactccagcctgggtgacagagcaaaactttgtctctaaataaataaataaacaaataaaatacatacctatgtacatacatacattttaagaatcattttgatatattcatctccatactgaggaatttaagtgcttttttttttttttttttttttttttttttgagacagagtctcactttgttgcccaggctggagtgtggcggcacgatcttggctcactgcaacctctctacctcctgggttcaggaaattctcctgcctagccgggtgagatttcctctttagcttgtgtgttatttagaagcatgtttttgtacctatcgtagcttctctagagaagggaggtaggagaatcgcttgagcccgggaggtcaaggctgcagtgactgacccatgaccatgccactgcactgtagcctgggtgacagagtgagcccctgtctcaaaaaggaaaaaaaag

SEQ ID NO: 30352 - DNA, 1034 bp, Homo sapiens
gacttcaggtgatccacccatctcagcctcccaaagtgctgggattacaggtgtgagccactgctcccagccgggtgtgatatttttaataaaacaagtattcaaattcacttacaggaccaatgaaagaatcgtttgtcgtaattttatgccaaagggtacttgtggcttaagataaacttcccataatgacattatccacagattcaaaaagtagtttatcttaaacaacttctgtgacattttaaaatgatgtggcttagaaaattgctaggttatctaaaatggctctattgatgatgtaaatgtagcacatgaagagcttgaataaaatagacttttgaagtgtgcaaatggaaagaacagtccttctaaataattatttcccctcccttttattgacgtatacatacagaaaagatatcatgtcgtaagtgtattgcttagtgaattactccaaagttggatatacctggttaaccaccacctgaatgaaaaaaacagaacactgcttcatatggagaagcccctcctgcccctcctggtcattgtccttttcatccctcccacaggtagtcactgagttctaataccacagagtcttttgactttcttttgagccttatgtaattagaatcacaaaagatgtattcttttgcctgacttttatacttagtattgtttttgaaattcatcttgtgtgtaactgcgatttgttcattttcattgcttagtgaattattccaaagttggatatacctggttaaccaccacccgaatgaaaaaaacagtttttggccgggcacgatggctcacgcctgttatcccagcactttgggaggctgaagcgtgcagattacgaggtcaggagatcaagaccatcctggctaacacggtgaaaccccgtctctactaaaaatacaaaaaattagctgggcgtggtgacgggcccctgtagtcccagctactcaggaggctgaggcaggacacctgtaatcccagctacttgagatgctgaaacaggagagtggcgt

SEQ ID NO: 30353 - DNA, 1050 bp, Homo sapiens
cccagagacatgtttgcatttgtttctgtcaggtttcctggctcaactggcaccctttaaggccagagaacgttagtttaggcacttttcctagtaaaatacttcttgtggctcttcctgtgtacttggaataaaggaggcattccattgttagacatgcttgggtagttcagggtaatcttagagtcatgagagatatgatataaaggaataactagctaaaccagaaaaaatgcctgggtaatgactagcaaataggtggtcaacagatgtcctcattagattgaaaggtccatgaaagcagggactatttcttttctttactgcttaaaaaggttagaactggacctggcaacatatgatgagctaaataaatacatatttgtgaattgggttaacacatattgcataaagtggttttggctctgttttattcttcataagccctagtgatctttttaatttctgtaaaatgtggtcttgacccccccaacccaagtgacctccttatttgctaggctctgatatttctgttaggtttctactgtattttctgagatagcaattagtagatactatttctcctttgatggagctagccatatattcttgtttgttcattttagctttcaaatttctgtctgattcttgttcttttactctggaatgtagtgaatggaatgacttggaaggtacaaggtaggtcagtttaggttgtctagggccttgcatttaaaagtttaatttgatgacatggtggattacaagaatgtaacagtatcaaaatgatactatcttcttgtggtggtatgtagacttaaaaagagaaactgcagagaaaagggtcccttaggatgtagagcagcagttgatatgtgagaagttgatgccttgcattagggattaggagtagatgtggaaggaagagatcaggtttgaaagagtttaaacaaagaatctctaggatttgataacactggatatcagaggggaaggtacaagagagagggcagaatcaaaggccactcagaggttaaaggaatcataccg

SEQ ID NO: 30354 - DNA, 1077 bp, Homo sapiens
tgagtaagaccatcagagaaatgcaaatcaaaaccacaatgatataggtggctcacgcctatatgtatctcacaccagttagaatagtgatcagtaaaaagccaggaaacaacaggtgctggagaggatgtggagaaacaggaacacttttacactgttggtgggactgtaaactagttcagccattgtggaagacagtgtggcgattcctcaaggatctagaactagaaataccatttgacccagccatcccattactgggtatatacccaaaggattataaatcatgctgctataaagacacatgcacatgtatgtttattgcggcactattcacaatagcaaagacttggaaccaatccaaatgtccatcaatgatagactggattaagaaaatgtggcacatatacaccatggaatactatgcagcaataaaaaaggatgagttcatgtcctttgtagggacatggatgaagctgtaaaccatcattctgagcaaactatctaagggcagaaaaccggacaccacatgttctcacttatacgtgggaattgaacaatgagaacacttggacacagagcggggaacatcacacactggggcctgtcgtggggtgggggaggggggagtgatagcattaggagatatacttaatgtaaatgacgagttaatgggtgcagcacaccaacatggcacatgtatacatgtgtaacaaacctgcacattgtgcaccatgtaccctagaacttaaagtataaaaaaaaagacctactatttgataccacaatagggtgagtatagtcaataatgacttaattgtacattttaaaataacataaaaagaaaaaaataaaataatgcagagtataatttgattggttgtaactcaaaagataaatgcatgaggggatggatactctattccccatgatatgcttatttcacattgcatgcctgtatcaaaacatctcctgtactccataaataaatacacctactatgtatccacaaaaatttcttaaaaaaggatacttttgagcgtttcaagcattacttctagttatgttcagttgatc

SEQ ID NO: 30355 - DNA, 1542 bp, Homo sapiens
catttgagcccaggagttcaagaccagccggggcatcataggaagaccccatgtctgcataaaataaaataaattagccagacttggtgacatgcacgtattgtcccagcttgtcaggaagctgaggtgggatgattgcttgagctcaggagatcaaggctacaatgagctatgatcatacaacaccagtgcactctagcctgagtgacagagcaagaccctgtctcaaaaaaagcaggggggcatagtcacctccctaaaatattagttgaacagtatgtattcagaagtccagaggctctgtattttattaatattttcaaggcactatttctgcagaaatcaagtcagcaagactctttgaggacgttacaggcagaggggctaaagatacctttgaggaagctcaagtacttgggtgggaggtgatagataaagggtcagtagaaataatgtctctttttattttttttcccattaaaaaattttgttttaatagcaatggagatggggtctcactgtgttccctgagctggtctggtctcgagctcctgggttcaagcagttctcccaccttgaccttctaaagtgtagggattatagacatgagccaccatgcgtggcaaatttcttttctttcctttttttttttttttttttgagacagagttttgctcttgttgcccaggctggagtgtggtggcacgatcttggttcactgcaccctccacctcccaggttcaggtgattctcttgcctcagcctcctgagtagctgggattacaggcgcccgccaccatgcccgggtaatttttgtatttttagtagagatgggatttcaccatgttggccaggctggtcttgaactcctgacctcaggtgatccacccgcctcagcctcccaaagtgctgggattacaggtgtgagccaccgctgccggttccaatgtctcttttggatggtggatcctgaagaatagctgctggttctttggggatgcctggggaatactgtgcaggctttgtgatgggctcagcagtgaggcctgtacagtatcttaggtcttgtgggcctcagtctgctctcttggctgttctctaccacctcctgccattaagtttttaagaaaaaggaatagttttattatattctttggtaaacaaagcaaattaagaagctttatattttccacatttatttaccaaactccctatttgtttttctctatagtgattcagtttagagacctattcaatgaagcatgccttgatgttgaatttagagtctactttttccagaagaaaagagccagggagctccaatagtagtcatctcagaatataaaagtgttatagaaatgatgtaaatcaggccgggtacaggggctcacgcctgtaatcccagcactttgggaggccgaggcgggcggatcatgaggtccggagatcgagaacatcctggctaacagggtgaaaccccgtctctactaaaaatacaaaaaaaatcagccaggtgtggtggccggcacctgtagtcccaac

SEQ ID NO: 30356 - DNA, 1125 bp, Homo sapiens
ttgactcccacctgctgatgctggtcttttttggttcctagggcttataatgatcaacatttcttgagccctcactatattctatgctaagctctttacatgtatgaatttacttaatcttcacaaccaccctaagaaataggtactgttgtccttactttacagatgaggaaatggaagcacaaagaagttaaggaccttgctgaaggtcatggagtagaggcaggattcaaatttagggaactcagcctacagtccatgctcttaaagatgttatatcctgtctctgggcttagaaggggttcatcttaggccggacacagtggctcacgtctgtaatcccagcactttgggaggccaaagcgggcagatcacgaggtcaggagttcgagaccagcctgaccaacatagtgaaaccccatctctactaaaaatacaaaaattagccaggcatggtggtgtgcgcctgtagtcccagctactcgggaggctgaggcaggagaattgcttgaacctgggaggcggaggttgtggtgagccgagatcgtgccactgtacttgagagtgagtgacagagcaagactctgtctcaaaaaaaaaaaaaagacggccaggcgcagtggcttacgcctgtaatcccagcactttgggaggccgaggtgggcggattacctaaggttgggaattcgagaccagcctgaccaacgtggagaaaccccgtctctactaaaaatacaaaattagccaagcgtggtggcatatatctataatcccagctactcgggaggctgaggcaggagactcgcttgaacctgggaggcggaggttgcagtgagccgagatcacgccatagcactccagcctgggcaacaagagcgaaactctgtctcagggaaaaaaaaaaaaaaaaaaggagggggcgcttcatcttgactaacttcctgcattggtggagcttgatagagtggtccttcccagatccttccctgcatacagagcctgtctcttttctgattggtccctaaggccagattacctgtccctaatactgagcagaagctggtgaatgaaacaggagatccctcagtcaaaacaaaaggaaaaagaaaaatgaaacaggagatc

SEQ ID NO: 30357 - DNA, 1086 bp, Homo sapiens
gtgctcatccagagagaggcatctgtagatgcacctatttgtgttggtcaccctaattcttgggttcttgatgagtctccagtaagggcttcattggacagagactaacattggctctgatcttgttacctttagcatcatctgactgctacatatatgattctgctactggctactattatgaccccttggcaggaacttattatgaccccaatacccaggtgagtttggggcttttttttttttttttttttttttacctctgtcaatgattcttttgagaaaagcacccataatttgctacttgaggattttattccctggattctctggatgctcattgcatgaaaagtggaaaagtttagatctatggaaacagaactgttgcctatatggaaaatcagtgccttgtggcaatacaggtaagaacagtgttgctcttgaaaaagtggacagtgggtggtctgaatgtgtcctggtccctggagtgggtttttagattgatgtggactcttcttagacttgtaagtaaaaaagttgtttcttcccctaaaagggaactgtgcgccttagacctggaattgctgggaaactgaaacattctgtagacttacttgtttccaactgtatcgcagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgagggtaagaggaattgttaatttgctgtcttttgccacatagttattaaaatgttggaggtacgaacagaggatatctatgtttgcaagtgtaaagtaactttaaaaatactctgtcagccgggcgtggtggctaacgcctgtaatcccagcactttgggaggccaaggcgggcggatcatgaggtcaggagatcgagaccatcctggccaacatggtgaaacccctgtctctactaaaaatacaaaaattagctgcgtgtggtggtacacgcctgtagtcccagctactcaggaggctgaggcagg

SEQ ID NO: 30358 - DNA, 1058 bp, Homo sapiens
tttttggtccattttccagtaggcatgatacccttgagagtagatgagccagggatgtacttaatttcaccctttaaaattgggtgaaattcgagtaactgctttcttcctgtttttggtcactaagatctgaatcagggatgaagggataatatgtagactctaggcttgacaaaatgcaaaaataaacttggacaacatgactctttcttagaaatattcaacccaaatgtttatttcagatttagcatacattcctgagaattatcattacatttagggatgtaggtattttcccagtggttatcttagtaaactggaatttggtaatactttttaacactttaaactatttggattatcttataaactgatctgtgggccgtgtgtatttttaactatgtcttttaaaggtacaaaatgtgactgactttagaatgaaaattattttccctggcagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagaggtgagtgaccagcggctgtataaccccccaaaacactctgagccttatagtaatagaaataacagccaggcagccaggtccagtggccccttcccataatcctatcactttgggaggccaaggcggccagatcacttgaggtcaggagtttaagaccagtctggccaacatagtaaaacccgtctctactaaaaatacaaaaattagctgagtggggtggtgggcgcctgtaatcccagctacttgggagactgaggtaagagaatcacttgaaacctgggaggcggaggttgcagtgagctgagattgtatcagtgctctccagcatgggtgacaaagcaagactccatctcaaaaaaaaaaaaaaaagaaaagaaataatggccagggtttacatagggatcaccatgtacttttgagcacttgacttca

SEQ ID NO: 30359 - DNA, 1130 bp, Homo sapiens
gtgcttgagcccaggagttcaagtccaacctggacaacatggtaagacgcatctctccaaaaaaaaaaaaaaatagccagtcttaatggcgcttgtctgtggtcccagttacttgggagactgaggcaggaagatcacttgagcctaggaggtcaagggtacagtgagttgtgttcacgccactgcactccagcctgagcgacagagcaagaccctgtctcaaaaagagggtcatgtcggaaaaggtcctattgaaagaggtctgcctaagagctcttgaaggttatttaaaggaaattgttactagtggagggtaaggaatcttctatttttatttttgtgagacagggccttactctgtcgcataggctggagtgcaatcgcgtgattgtggctcacagcagcctccaacttttggggctcaggcaatccaccagcctcagcctcccaagtagctgggattacaggcatgtgtcaccactccgagctaatttttttttttatcgtttgtttttttttttgtagagacaaggtctctctttattgcctagactggtcttgaactcttgtcttcaatcaatcctcccgcctgggtctcccaaagtgctaggattataggcgtggaaaactaagggaatggtgtggtagatgggcccttcaggcggaggggtatcacatgagcagggaatagaaaggtactgaatctagataaggcctagcaatcggcttgatttggctggagtcagaggcttttggcaggagagggatgagtggcaaagtgctattgtggctaggggctagagttctcaaaagtctagctaagcctaaaagaatattactgagggttggccaggtgcggtggctcacgcctgtaatcccagcactttaggattctgaggcaggcggatcacaaggtcaggagatcgagaccatcctggctagcacggtgaaaccctgtctctactaaaactacaaaaaaattagccagccgtggtggcgggcgcctgtagtcccagttactcaggaggctgaggcaggagaatggcatgaatctgagaggcggagcttgcagtgagccgagatcgtgccattgcactccagcctgggcgacagagcaagactgtctcaaa

SEQ ID NO: 30360 - DNA, 1081 bp, Homo sapiens
cgatctcggctcactgcaacctccgcctcccggggtcaagcgattctcttgcctcagcctcccaagtagctaggactacaggcacgtgccaccacgtctggctgattttttgtatttttagtagagacgggatttcactgtgttagccaggatggtctccatctcttgacctcgtgatccacctgccttggccccccaaagtgctggaattacaggcgtgagccactatgcgaggcctaatttttaaaatttttgtatacagatggggtcttactgtgttccccaggctggtctcacactcctgtgctcaagcgctcatcttgcctcatcttcccaaagcgctaggattataggcttgagccactgtactatcctgcagaacaaaggacagggagattagactaaaggatggaggcttgagacatcataccacaagcaaggatgtgtatcataacagaaattaattgcggccaggcattgtggctcactcctgtaatcctagcactttgggaggccaaggtggccggatcgcttgagcccaggagttccagaccagcctgggcaacgtggcaaaactctgtctctacaaaaaatacaaaaattaaccaggtgtggtggtgtgcatttgtagtcccagctacttaggaggctgaggtgggaggatcacttgagtccaggaaggcagaggttgcagtgagctgagatcacaccagtgcacttcagcctgggtgtcagagctaggccctgtctcaaaaaaaaaaaaggaaaaattaattacacctgagggaaattcccatgcaacatttaatgaatgccttcagtgctgttataatgcattaatttctatgagaaatgttctctcttttttgtgccttttaggaaaattgcattttggtgatagaagataaaaacttggctaattaggccaggcatggtgggtcatgcatgtaatgatatgggaggctggcatatcacttgaggccaggagttcgagactagcctgtccaacacagtgaaaccccgtctctactaaaaatacaaaaattagctggatgtggtggtggatgcctgtaatcccagc

SEQ ID NO: 30361 - DNA, 1018 bp, Homo sapiens
tataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagttagagtggcattaacattctaatctccttgagaatgccttttatagtctgttcaaagcaagtcattgatggttcttcgaggtagtgttaactgaagtgttcttcagtttgtcaagataatgttcagtgcttggcact

SEQ ID NO: 30362 - DNA, 1034 bp, Homo sapiens
ccagcactttgggaggccgaggcgggtggatcacgaggttaggagatcaagaccatcctggctaacacggtgaaaccccgtctctactaaaaatacaaaaattagccgggcgtggtggcacatgcctgtaatcccagctactcgggaggctgaggcaggagaattgcttgaaccccggagacggaggttgcagtgagccaagattgcgccactgcagtccagtttgggcaacagagcaagactcctcttgaaaaagaaagcaaaaaagttgtcaacatgtgttttgctgagggattgccttagattattgctacagtgtgtctgtcaggggagcccttcctcctggatgattgcagtgatttagctctcttaaaaggctttacagttgaaattatattgaagctgctgttctttccagactgaggaagcacagcctagcactagcacaagtacacaggccccagccgcttcccctactggtgtagttcctggtaccaaatatggtaagccaaacctcatggggctgttgacagttggaaggtcttagttgttgtctttgtttaatgagagttcttctccctttgcgggtgtcagagggacacttggggatgtgagacagagaagaaacattaggcctgctgcatctcactggcttagaatttgaaataaagccaatttcttacctggaatgactgtatgctggattttgtttttgcagcagtacctgacacgtccacttaccagtatgatgaatcttcaggatattactatgatccgacaacagggctctattatgaccccaactcgcaagtaaatgtgctgctttcctcctcaatttcactagaagtagtttcgcttagtgcatttatgaggcataaaatgaaatatttcctgcaaaagaatatatgactcagattagttttaacttcttcaaagccaccaaaatgtaatttttatatggagattgtaagttttaattgtagggttaaaaaatgttttgaggtataatatacacacaaaaaaatacacaaaac

SEQ ID NO: 30363 - DNA, 1058 bp, Homo sapiens
ccacttctctcatttgtgaagcctggccatttatttccctgtcagttctttttttttttttttttttttcccgtcagttctctttggtggccttagaagttgtgtctgtaggctgggcgcagtggctcacgcctgtaatcccagcactttgggaggccaagatgggaggatcactaggtcaggagattgagaccatcctggctaacacagtgaaaccccgtctctactaaaaaaaaaaaaaaaatacaaaaaaattagccaagcgtggtgtcgaatgcctgtagtcccagctactcgggaggctgaggcaggagaatggcgtgaacccgggaggtggagctggcagtaagcgaatgtcgcgccactgcactccagcctgggtgacggagcgagactctgtctaaaaaaaaaaaaaaaaaaaaaaaaaaaaaagttgtgtctgttagccacgccaccttacccagaagagacagacactgtctcctgggtccctgttgagcagatagagtgagcgactggaaaatagaggagaggatatgtgacacctctcctctgttgcaattcctgctgagcttgggtcccttcaccaacacctccttccagctctgtgctagtgtttacaccctgtgtgtggttgcctggtatccaatggattctatgtggatgggcccaatgatgagctgttgtcatggcagatgtctgaactccatgacacgcccacctgttctggctgcctggtttatgtaaatagtctgtggaacagagtgagacaaattgctctttgggtgccctctaggtaggcccagggattaaattaatgggaactagactttttaaatttttattatcattttttttgagatggagtcttactctgttgcccagactggagtgcagtggcatgatcttggctcactgccacctcctccatctcccaggttcaagcagttctcttgcctcagcctcctgagtagctgggattacaggtgtgccatcatgcccagctaatttttgtatttttagtagagatgagttatcaccatgttggccaggctggt

SEQ ID NO: 30364 - DNA, 1051 bp, Homo sapiens
atcatgccactgcactccagcctgggtgacagagcaagactccatctgaaaaaaaaaaaaaaaaaaaaaaaacccaaaataaataaaaaggagggatgttcagaacaaattggaaagtccaaccatgtcatgaacagtcagtgtaagtcacaaaaaacccaaaaactttttttttttttttgagacggagtctcgctctatcacccaggctggagtgcagtggcgcaatctcggctcactgcaagcttgcctcccgggttcacgccattctcctgcctcagccttctgagtagctgggactacaggggcccgccatcatgcctggctaatttttttgtgtttttagtagagacagggtttcaccatgttagccaggatggtcttgatctcctgacctcgtgatccacctgcctcggcctccagaagtgctgagattacaggtgtgagccaccgtgcccggccaaaaacccaaaaacttttatataatcaagttgtcgtatacttttttcttcagggtagagtcttgctttgttgcccaggctgaagtgcagtggtgcaatcttggctcactgcaacctctgcctcctgggttcaagtgattctcctgcctcagcctccccagtagctgggtttacaggcatgtgccaccacacctggctaatttttgtatttttggtagacatggggtttcagcatattggcttggctggtctcaaactcctcgcctcaggtgatccgcctgccttggcctcccaaaatgctaggattacaggcgtgagccaccatgtcaggccacgttgtcgtattatatattattattattattattttttgagatggattctcgctctgtcacccaggctggagtgcagtggcgcgatctcagctcactgcaagctccacctcccaggttcatgccattctcctgcctcagcctcctgagtagctggggctacaggcgcccaccaccgcgcccggctaattttttgtatttttggtagagacagggtttcaccgtggtctcgatctcctgacctcgtgatctgcccac

SEQ ID NO: 30365 - DNA, 1036 bp, Homo sapiens
cactggggggagcccagcaggcaagaagggtctggggacacttgaacagttcggaggtgagatgtgatttgggtgccaaacacctgcggcgtcccgctttgggactccccatcccaaggcgcagaccagactctcagggcctggccagctcaggtccttcagtgagggagggacgaggctctaaggcggggagtgtggggcaggagggtgggaaaggcgaagaggccgggtgaggtgggagtggaggtggggtggggcagggtgctcagaggcggcgagaggcgtggacgaggacttgaggctgcggccggggcggcaggcccaggaggagcagcagttgcagggagaccaggacgcccagcgacggcgggaaggaggccccgcggccacagtctgaggtatcttcctgcggggagagacaaggagctggtcggcctgggcgggcgcaaggccgcgggatttcgggtccaccgccccctctcctcactgtcgcgttgtagtcgaagcagatgtgcgggcctctccggtatcgcggtctctgcactagctcacactgctccgggccgtccgctgggcatgggtggggagtcaaggaggcggacggcggcggcggcacggagggggcgcgcggggcagagggggagcgggcggcggggagggcgggggcaggatacagtgcgtctccttctgcagcagccggccagcctcgcactggctgcacagcggcttctcggccaccacaaagagaagattggtgttggtcagtctctgcgcgtggaacagcctgcgggcagcccggaaaggcggggcgttgagtttgccccgccctgacccacccccatcctgcggccccgcccccggccgctcggaggccccgccccttccatcctcccgagcgtctcgccccgctcacaggttccgcccttggcctctggtcccgccccactgccagcacctggagcagtttccgcagtcgatgatggcgttgtaggaggcgtttaccgagccgaagtagtactgggtctgtttcatgacg

SEQ ID NO: 30366 - DNA, 1068 bp, Homo sapiens
gccagggcaggtacagtgcagtcaggcacctccctctgcacccatgcctgttgacctatgcctgtgtatgccacagccctcaggtccttagtcaggaccatgtccccccatggcccatctcctccaaaagagggaattccctgtccctttggcctaggagcctccctgggggcctctcaagcccagctctgtgaggaggctggggacacaccagctcctgattcttggccaccatgaaaccacaggccaggctcaggtggggccttgaccccaggcctcagtttcctcatgggacacttgtgaggatttaacagattaatacaggaaaaactctgggagcagggtcaggccagagggagtggacaggaactatcaggtatggttcttagcttttttcttttgagatggagtgttgctctgtctcccaggctggagtgcagtggcgcgatcctgatccactgcaacctctacctcccgggctcaagcaattctccctctcacctcagccttctgagtagctgggactagagacatccgccaccatgcccatgcctggcaaattttcacacctttagcagagacggggtttcaccatgttggccaggctggtctcaaactccaaactcaagtgatctgtccaccttagcctcacaaagtgttgggattacaggcatgagccaccgtgcccagccagttcttagcatttctgtaagcacagaatgggaggatgtctgtaaagggcttagctggggttgattgaacacttaacatgaaacaggtgtggattagtgcatttaatccccaccacatccccacgaggtgggctatcctcaactgggctcagatgtacagatggggaagctgaggcctggaggggcagggtgacttggccatgccccagctgacatgaaggtcagtctggctttggctacctccccttcctacgttcacaagggtaactgcttaggcctctgtaccaagacccccaggagccacgttggcaccgactctgatccagatccctctgcttcacaggaactggttgagtgggtgctggaagaggtggcc

SEQ ID NO: 30367 - DNA, 1034 bp, Homo sapiens
tttccccacaggtagaagggcgctgctgatccttgttgggttatggtgaccactgtgtgaggtggcctctgcacagtactggcccagcaccagggacagactgttgtcctgtagggagcgctaatcccacctgactccatcattccctcagcacctacctggggcctggacgtttggggtcagtggtatcatgtgagccgccctccttggaaccgagcctctgaggaggagaggtaaatggacagggtgagacagaggacaggatgtggttggaacttaatgaagcgaggtctcatctggcaggaggccaactcatccatagctgcaaaattggttccattacctcctttaatgagctacgaaagctcggagaatgagtttgtgagagaataatggcacatgtctgcagctctgatttgaaactgtggctaaaaagttagatattacactaccttccagctctccaaatagcaccagtgcccttgtcgggagggagagggaggacatggggggcaggagcggggttctggcattataaggaagatgctgaagctttaagaaggaaaagtctgcttctgaactctgaattcagggtcaatcccatcctgacgtcttccctgcagagcagaggctgaggctgtgacccattctctgagtgggcaaagcagctcacaagggtcacactggctggcagggccgtgtgtgttaatagcccacacaggtgccagcagcactggcaggggtttcaacaactggctgtaaaataaattctgctattccagtggtgtctcttatatcatttgagatgtgatcctcatgggaaataatcccaaataatcatacaactgggagctgggagagatcttagagatggctgagtcgaagacttgtcaaggagggagtatggtaggttcaaagtgttttgtcttattcacggcctgcctctgtaagaataggggttcccaacaatgaaacctaaatttccctacaacattctctacagttttgctgcctgagatttcgtgttgagcacg

SEQ ID NO: 30368 - DNA, 1022 bp, Homo sapiens
gagggctagcttgaaaatataaccattatcattttcctgtgagaaaatgtttgagtttcagctttgatttttatgactaacttggagcacagatttgtgtctttgtttgtcaacctataatcacatagcaaggagggaaaccccttacacttacttcctaccaatttggagaaatttgtggaggagggcctcgagggcctccttttgccctgatgttagtgagggaaggagtcccctgttgcagcagtacaaagggttttttccactgcagctgttcatttgtatttgacattgataaggctttgagatcctgtagtaatacttattaaattttttataatataggaattctgtacaggttataacatgactgaattgtttggtttattcatttaggatgaggtgatgactgagcccccctttccattgtaatattctgtgagtgattttaggcagtggggaggacattatcctttctgagggtcagtgataggcctgtcagtgtgcctgggactctcacttaggtaaccccatgtcgattcccagagtagtcttaatgttatcattattacacagataaagaaactggatcccaaaggttgttaatttttttttttttgtccttcaacgattgtatatttttcttaattttcttcttggcagtgggcagtattttgtgaaatacttgactgtcttgctttctttttgtggtactgtaaggtactgttctttactgtacccgttcgcccgtgttttgacttcttatgtccctttccctcttagagaatctctgctttcctttctgttgccatgaatgcttggaaagtcctgcatccttccattctttattctacctttccaagaagcttcctgctctaaagtgtattaggtgagaaaaatccagctatttttgtgaaacacctgtctttccctatactgactgtacccagagtaccaaatatagaatacaaaaaccaagaaaatgcttttctcaccctctaacaggagcaacagcaggagca

SEQ ID NO: 30369 - DNA, 1034 bp, Homo sapiens
acaaacaaacaaacaaacaaatcctgagtccttaaaagaaacttgtaaagatcctgtggtgcaggaaaagaatctgaaggtggggaggaaatagatccttgaaaccagatctggaagaattagtgttcacaaaatttgagtaaatctgttggtaaatggactagaactcaccaaaatagtctgaagacagtgtgctctttagttatttattcagtgagggaagcccaacctttgcaacctctggaagggccccaatacccctttagaggtaaagacatcatccactaggggtaggaaagatttcatagacctatgactttattttgttctgaaaagtgaggatgtgcttgatgtcttgtttagtgtttatggggaacttccttattcatgattctacttgagctttacactatatcaccacctctcccctcttttttaaacagatgagaaagaagctttagctgagagaaattaagtaactgatctaagatactttagatagtaagtgctgagttgagatttgaacctaggactttgagattctaagccacagattgtattattacaccgtgtcctctgaaaggaattgtcagtagtatatgactgtggcttgaaagataagacatactctgcagttttcaatttaaactggatagttatatttaaggaattttatttctgtattggactatttttttctttttctttctttttttttttttttagacagagtcttgccgtgatgcccaggttggagtgcaatggggtgatctcggctcactgcaaccttcgcttcctgggttcaagcgattcttctgtctcagccttctgagtagctgggattacaggtgtgcgccgccacacctggctaattcttttctatttttagtagagacggggtttcaccatattggccaggccggtctcgagctcctgacctcaagtgatctgcccgtcttgacctctcaaagtgctgggattacaggcatgagccaccgtgccctgcttttttttttttttttttttttttaaga

SEQ ID NO: 30370 - DNA, 1034 bp, Homo sapiens
ggtggatcacctgaagtcaggagttcgaggccagcctggccaaaatggtgaaaccccgtctttactaaaaatacaaaaaattagctgggtgtggtggcgggtgcctgtaatcccagctacttgggaggctgaggcaggagaatcacctaagcccaggaggcggaggttgcagtgagccgagatcgtgccactgcactccagcctgggcaataagagcaaaactccgtctcaaaaacaaaccaaccaaccaacaaaccaaccccaaaaatgagccgggcacaaccttagcctctagaagattgcttttgtgtcttgttttgccatttcttcttttattattgttatggactcatgggtttttgtttattcagtgtgactcagctcatcattatgattataattctcaaattattctaatgcttttaaatttcttctgtgatggtttcctgtgactggagagacacctgtttttgtctgctgctttgttgtgataattgattatatttggtcttaggtcctaaagtctgtgctattttaatttttttgaggtaaaaatcagttatataaaatttattctcatagtaagttttcttccatgatgtttatcatcttttgcttactatttttctttttttatcttttaaaaatagcaggggtgtcgaggtataattcacataccatatagttaagtctttaaagtgtactatcccattatttttagtatatttgtagagttgtgcctccatcaccagtatctaattccagaacagtttcattacccccaaaagaaatcctatacccattagcagtcactactcattctctctcccccacccgggcaccccctaattggctttttgtctctaaggatttgcctattctaggcatttcatataaatggaatcatgtattatgtgaccttttgtgtttggctgctttcactgagtatgtttttaaggcttatccatgttttagcatatatcaatacgtcattcctttttatggctgaataatattctattatatggatatac

SEQ ID NO: 30371 - DNA, 1045 bp, Homo sapiens
tgcctgtgcttttgaggtcttagtcataaaatctttgtgtagaccaatgttttcttttagtagttttgtagttttgggtcttatgtttacctccttaatccattttgagttgatttttgcgtatggtgagagacaggtgtctagtttcattcttctacatattgatacccagttttctcagcaccatttatggaagaaagtgtcctatccccagtgtatatttttggcacctttgttgaaaatcagttggctgtaaataggtggatttatttctggttttctctgttctgttccagtggtttatgtgtctgtttttaatgccagtaccatgttgctttggttactgtagctttgtagtatattttgaagtccgatattgtgatgcctctagctttgttctttttgtacaagattactttggctattcacagtcttttgtggttccatacaaattttagattgtttattctatttctgtgaagaatataattggtactttaatgaggattgcattgaatctgtagatttctttgggtagtatggtcattttaacactgttagttctttggatccatgagcatgggatttctttccgtttctttgtgtcctcttcaaatctcccttcagtgttttgtcatttttgtcgtagaggtctttcatctctttgattaaatttattcctaggtgttttatttttctgtatgtgttttagctggttcattagtggcatatagaaatgctactgattttttctttttttttagatagagtcttgctctgtcacccaggctggagtgcagtggcgcaatctcggcacactgcaacctccgcctgctgagttcaagcgattctcctgcctcagcctcccgagtagcttggattataggtgtacatcaccacacccagctaatttttttttggtatttttagtagagatggggtttcaccatgttggtcaggctggtctcgatctcctgacctcaagctatctgcctgtcttgtcctcccaaatggctgggattacagatgtgagccactgtgccca

SEQ ID NO: 30372 - DNA, 1010 bp, Homo sapiens
caggttttttatttttatttttatttatttattttttaatttcagatgagctcttacaatattgcccaggatggagtgcagaggcagtttacaggagcagtcatcacacactgcagcctcaaactcctggggttatgtgattcctcctgccccagcctcctaagtggaactacaagcatacaccaccatgctgggcagaatcttcctgctttcaattttgctattctttctcccttttctgcactgtaacttcccaagtgattttaataaaaacaaaccatgtcttggcactccctttcttaaaacctttttattgcatcatttaggataaagtccacatttcttaaaatgacttaaaagcaacttggacttctggttcctgcttacttcaccagctttgtcccaatcaccaagctactaatctgccatattgaactttttgagtttaaaatgtggcatattctctgtaacctgctgttcttgcagatctggtcctgatttatgtctctgactacttcttttatttatttatttatttttggataggatcttgttctgttacccgaggctggagtgctgtggtgtgatcatggctcactgcagcctcgacctcctgggctcaagggactgtagatgcatgccagcacatctggctaatttttaaatttttttgtagagatggagtctcactatgttgcccaggctggtctccagcagtccttctgcctcagcctcctaatgtgctgagattacaggggtgagccactgcacccagcttctaactacctctctaagtctccctctttccagctgtattatccaaccaatcaagtatcttttagttcctaagagttattctttctcttgccttttggctctttgcacatgctcttctaacacttttactccttttcacccatttttgccttactcctattcattctttagttttcaggttgtttgttcaaggaggccttccttgacccctagaccaggtttaatttttctgc

SEQ ID NO: 30373 - DNA, 1073 bp, Homo sapiens
tatatcttttgttctctggtatatccctggttcttagaagagtgtttgtcatataataaatatttgttgaatggatctctacccatttatatgcatctcctttttcagaagtataaagagaatgggcttggttactgcacagtcctggatttgaattctgtttttttcttcttactagttgtgtgacctggggcaggctaattgaacaatctgttatctgtttccttctctatcgattggcaactatacctgttggatataaaagtgagccatatcaattcaccttgacattaaaaaaatttataattgatataatctatacctatttaaagtgtacattgataaattttgacatacgtattcatctgtgaattcatcactgtaatcactcccagaagtttcttaagcctctttttaatcctactctttcatctctatttctcctcttgccttttcccccatctccaaacaactacttacctgctctctgtcactgtatattactttgcatcttctaagatcttatataaattggtcatactgtatgtactctttttgactacatttctcattattcatttagtctcattattttgtgatttatctctgttacctgtatcaatagttcttttctttatttttacagaatagtattccattgtgtgaacataccaaaatttgtttatccattcattgttgatagatatatggattattaccaatttttttgctaatcaaataaagctgctgtgaacacccatgaatcaatcttggtatcgtcatatttttttcatttctcttgagaaaataccgaggaatggaacggttaaattatgtggtaggtatatacttaacttttttagaaactgccaaactttcttccaaaacgatagtatcatttttacattccactagtgatgtgtaagaattccagttcttccacatctttactaacatttggtatggccagtctttttaattttagcagtctataggtgtgtagtggtatctcactgtagctttaatttgtatattgagaatccttttatgtgacagctgttttaccgtcttgg

SEQ ID NO: 30374 - DNA, 1058 bp, Homo sapiens
tgttgtagtatggaatcattaatttatttgtcatgcattttgttgaccataaaatttcatgccttgtacctgggttttactttttaccacaatagctttttaaagaattgtgttaaaatatatataacataaagtgaccattttaacaatttttaaatgtataattcggtggtattaagtatattcacagtgtgtagccatcaccactatctagttcccgaacttttttattacaccaaacaaaaagtcaacacccatgagacaataactctttgttctcccctcccccaagtctaggtaccttatataggtggaattatacaatacatgttcttttgtgtttggcttgtttcacttagcatagtgttttcacggttctatatcatgtgctagagcttcattatttttttggatgactatatatatatattatatatatgtatatatcccccattttgtttatccactaatatacacttacattgtttccaccttttggctactgtgaataatctatgaacattgatgtacaagtatctgtttcagtctctgtttttttattttattttattattattctttaagttttagggtacatgtgcacaatgtgcagattagttacatatgtatacatgtgccatgctggtgtgctgcacccactaactcgtcatttagcattaggtatatctcctaaagctatccctcccccctccccccaccccacaacagtccgcagagtgtgatgttcccctccctgtgtccatgtgttctcattgttcagttcccacctatgagtgagaatatgcagtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcgtgtgtctttatagcagcatgatttatagt

SEQ ID NO: 30375 - DNA, 1046 bp, Homo sapiens
tacagttctgcagcatcaagtacatacatactgttgttaaataaccatctccaccatctatatctagaactttttcatcttcctcagcttgaactctgtacccattaaagactgactcttcattccacactttcccagcccccggcaaccaaaattctacttttttctttatgaatttgagcactccgggaacaatgtattacagatactccttctcttttgatgagggtacatccaaaagcttattgtaagattgaaaaatcatgaattgaaccatcataagttgaggatcatctatagtggaatcatataaaattttccttttgtgactagcttattttacttagtgtagtactttcaaggtttatccatgttgtagcatgtcaagattttgttactttgtaaggctgaataatattccattgtaggcacgtaccatattttatctgttcatctatcagtggacacttggattactttcaccttttcactattgtatataatcgtgctagaacacgggtatacaaatatctgtccttgtcccctgcctttggatatatacgcagaagtggaatggctggatcatataattctgtttaatatcaaattaaaattaaatttgttaaatgaaattagatatttaattaactaaattaagtatttaatttaaattctttttaaattaaaataattatatttgattattctgtttaatttttttaggaattgctatactgttttccacagcggctgcaccattttacatccccaccagcaatgcaaaaaggttctaatttctccacacctttaatatttgttcttttttattttttcgtaatagccatccaaatgggtatgaagtggcatctcattgtgctttgatttgcatttccctaatgattagggatgttgaacatctttttatgtgcctgttgagcatctgtgtatcttctttgcaaaaatgcctactcaagtcttttgcctattttaagaatcaatttgggttgggtgttttggcccacacctgtaatcccagcactttggga

SEQ ID NO: 30376 - DNA, 1025 bp, Homo sapiens
aaacaaccctgggtcacttctcacaggtcacacttagctttctgcactggtgcttcaggctcctttgtttcccgcttcttacgcttaggtggctctgcactcttcctgcaacctcttgtagttctgggagtaggggaagtggtagctgcagcaacagaggcagctctcctcattcttctttctgtaacgctgactttctctgttatcttctcctttttcttctgcttatcattctctccatagtcattgctgttatctgtggccccttcctctctctcttcctcctcattgtttaagaacaggagtctctttggattgagaagaggtacccttttcccctttaggtacatttaatgtttgattattaaggtttacctccactatgatctgctcccttttgtaaaagacttcttcctcttcttcctcctcctcttctgtgtcatcagaattctcctggtcttccttaatagcatgcacatcagactctgctcctgtctccctgaaatgtggctgttcttctgtttcatggagatgtagtttgctcatcttggtgtccacaaacacagaataaggacttcctggttccctttgttacactttggtggacaggtcaagttccttgtggcaccatgatgaaagctggatggcacttgcccatgacggctatcatcttgtgccattcctgctacaggcacagcacagttttcaaccagctcctgacgagaagtggctgtgtgcctcattggtaaatgactcaatttattaagcagttcagactgtaaagaaaatagctttaaaacaaggtaattattaagactaaaatatttttccatccctaagaatcactcaaatgaaaaaaagatattcctggaaactgaattcttccagtgttgcagcaccaaagcataagtcaaaaaggtttggtattatggcaagagcagaccactagtgatttttcttctgaagagaactacaagggacttggtgcatcttatctgggccagccacctccaccgcctagatca

SEQ ID NO: 30377 - DNA, 1030 bp, Homo sapiens
gttgggtagcatgatgcctccagctttgttctttttgcttaggattgccttggctattcgggatatttttttattccttggccattcgggatttttttttgttccatgtgaattttaaaatagatttttctagttctgtgaagaatgtcattgtagtttgataggaatagcattgaatctgtaaattgctttgggcagtatgaccattttaatgatatggattcttctctgttagcatgaaatatttttccatttgtttgtgtcatctctgattttttttttttttgagcaatgttttgtagttctttttgtagacgtctttcacttctctggttagctatatttctaggtatttcattctttttatggcagtgaatgagattctgttccgatttggctctcaagttggctgttgttggtgtataggaactctagtgatttttgcacgtagattttgtattctgagactttgctgaagttgtttttcagcttaaggagctttggggctgacactgtggggttttgtaggtataggacatgtcatctacaaatgggtagtttgacttcctctcttcctatttggatgctgtttatttctttttcttgcctaattgttctggaaaggacttccaatactatgttgactaggagtggtgagagagagcacctctgtcttgtgccggttttcaaggggaatgcttccagctttatagattggttatgacgttggctgtgggtttgtcatagatatctgttactatttcaccaagcttattgagagtttttaacataaatggtgttgaattttaccaaaagccttttctgcatctgttgagatgatcatgtggtttttgtttctagctctgtttatgtgatgaatcacgtttattgatttgcatacgttagagcaatcttgcattccagggataaattggtcatagtggataagctttttgatgtgctgctggatttggtttgcgaatatttcattgaggatttttgcactgatgttcattgaggatattggcct

SEQ ID NO: 30378 - DNA, 1082 bp, Homo sapiens
aagatcatgtcatctgcaaacagggacagtttggctttctgctttccagttttgatgcctcttatttatttttcttgcctgattgctctggctaggacatctagtgctatgttgaataagagtggagatccttgtcttgttccagttcttagaggaaaagctttcagttttttccccattccagaagatgctagctgtgggtttgttatatatggcctttgtatattgagatgctttttttctacacataatttattaagtgttttcatcatgaagggatgttgaatttcattaagagctttctctgagtctactgaggtgttacggtttttgtccttcattttattgatatgatgtatgatgtttgtttatttgcatgtgttgaattattcttatattcctgggatttatcccacttggttatggttatctttttgatatgttgttggctttggtttgctagtattttgtcgaggacttttgtgtctgtgttcatcagggatattggcatgtagttttcttttctgattgtgtctttatgtggttttgctatcaaggtaatgctggacttgtagaatgaattagtgagaattccctgcttcaacattttgaagtagtttgagaagacttggtattaattcttctttaaaagaatgatagaattctttggtgaagccattatttttggacttttctttgttgaaagaccttttattactgagttgtctcattacttgttattattgttattggttcagattttctttcttcttagtttacttttggtatgttgtaggtgtccaggaatttatctgttctaggtttttaaatttattgacatatttcatagtaatcaccaatgagcctttgtatttccatggctcctgttgtgctgtctcatttttcacttctgattttatttggatcttctcttttttcttagtctagctaatggtttaccaattttatttattttcaaaaaaaacaacttttagttttgttgatcttttgtttttagtctcaattttgtttatttctgttctggtcattattatttctttacttctgctaactttttgttt

SEQ ID NO: 30379 - DNA, 1028 bp, Homo sapiens
tggtatgattttgatcttgttataaataaagtttcagtgtcgtaaaagaaatagtgcttgaatataaaattttctgttttttttcttctcagcaaggcaatttacttctatagaagggtgcaccctcacagatggagcaatggtgagcacacacctggacaagggaggggaaggggttctgattcctgacacatgtggcccctgctgcttgttattcctcctattagctagggttaggccgcacaggctaaactaattctgattggctaatttaaagagagtgacctggtgagtggtttggcaggaaaaatggttatggcagagcaggtaattggaatgagttagggtgcagcaggtaattggaatgagtcagggtggagcagataattggaatgagtcagggtggagcaggtaattggaaggagtcagggtggagcaggtgattgaaaaaggttgctttatgaggaagttaagtttaaaagtagaaggcaaagaattgaacatactgacatattgatactttgaagagaaatttagaactcatatctaacaatcttaaagttttttttgagacttgttttgtgtcctaacatatagttaatcctggagaatgttcaatgggctgatgaggagaatgtgtattctatagctgttgggtgaaatgttctacaaatatctgttacatccatttggtctgtggtgcagtttaaatctgatgtcccattgttggttttctgtcaagatgatctgtccattgctgagagtggagtgttgaagtccacagctattattgtatttggatctatttcttcatttgggtctaatagtatttgttttatatgtctgggtgttctgatgttgggtgcatatatatttataattgttatattctcttgctaacttgattgctttattactgtgttgccttgtctctttttacagcttttaactacaggtctttttcgtccaatataagtatagctattcatgctcacttttggttttcttttgcatggaatatctttttt

SEQ ID NO: 30380 - DNA, 1087 bp, Homo sapiens
tgatttttttctgaatcatattatagatagtttcacacatatttgatagcagatttctcttttaaagtgtattgaacacactattccttagattagccaaagttttaagaataacagaatctaggtggggcatggtggctaacaccttaatccgaaagaagccagtcaaagctcaccagaaccagatggcgacaaaagcgacctctagttgtcctcatttctcattatacactaattataatgcattagcatgttaaacgacactcccaccagtgccatgacagtttataaaggccatggtgagccaggcacagtggctcatgcctgtaatcccaacaatttgggaagccagggcaggtggataacttgaggtcaggagtttgagaccagcctggccaacatggcgaaaccccgtctctactaaaaatacaaaacttagccaggcgtggtggtgcacacctgtaatcccagctactcaggaggctgaggcaggagaatcgcttgagcctgggaggtggagattgcagtgacccgagatcgcatcactgcactctaacttgggcgagagagcaagactccgtctcaaaataaaaaacaacaacaacaaaaaatgccatggcaacatctagaagttacagtatatgtctgaaagggggagaaagcctcagttcaggaactccccacccctttcccaaaaaactcatgaataatccaccccttgtttagcatataatgaagaaataaccataagtttactcaggcagcccatgccgctgctctgtctgtagagtaactgttcttttattcctttattttcttaataaacttgctttcactttactctgttggctcactcttaaattccttcctgcatgaagccaagaacccacatggcctcccagctaaaccccaattttggggtttgccctgtgacaagtaggagcgatcatgtatcattttttatcagtggggtctttgtgacccttacgttgcaaaatcagtcctgccaaattgctgtctcacacttataagtgagaacatgtgtatttagttttctgttcctgtgttaatttgtttaggataatag

SEQ ID NO: 30381 - DNA, 1092 bp, Homo sapiens
ttcaaaggcttgacatctggatacgcttatattggggattaggtttcaacatatgaatttgcaggaggaagacaaaacattctgtctgtagcatatataaatattagaatggtgcaaaagtaattgtggttttgccattggaagtaatggcaaaaaccccaattacttttgcatcaacctatagcttgtggtttgggagtttatttttgtttaaactgacaatctggattatttagtccatttgcactttgatatagttaggtgtaggtgtatcatcttggtccttgttttctttttgttccttagtttctcaacttatcctttcttattttccttgaattaacccagcattttaatgatttcatttaggctcctctattagcttgttggttttacagtgttttgcttttcccttagtgattatcctagagtttgaaacatgcactctttttttttttttgagatggagtcttgctctgtcccctaggctggagtgcagtggtgcgatctcggctcactgcagcttctgcctccatggcctcagcttcctgaatagctgggactacagttgtgcgccaccatgcctggctaatttttgtatttttagcagagacaaggtttcatcatattggccaggctggcctcgaactccggacctcaattgatccacccacctcggcctcccaaagtgctgggattacaggtgtgagccaccacacgtgccagaaaacatgcactcttattagagtctaccttaaatttgttcttttaccactccccagatcgcatgaactttacaatgatttaactacatttgtccctcttgtcttttatgcaactatggtctatattttacttctgtctacattcattcgtttgcccacattttttacccttttcttttcttttttctttttttgagacaaagtctcactatgtcacccaggctggagtacagtggcatgatcttggctcactgcaaactctgcctcctgggttcaagaaattctcatgcctcagcctcctgagtagctgggattacaggtacccaccaccacgcccagctaattttcatatttttagtagagatgg

SEQ ID NO: 30382 - DNA, 1034 bp, Homo sapiens
tttctgtagcttaatatttgatgcagtatgtttttgtttgtatagaaaaataccaaaattatcacttttttcattcaaaaagaaaattgtttagagttctaataatcagttttgccagtagaatcattcagttttattagttttaaggtaatgattataaggaaacagtatctttacattttaatgcctcctagctgtggtttctcattcttggcactgttggcattttgggccagataattctttattgtgggagacagtcttgtgcaatgtgagatgtttagcagagtatatggcttctacctactagatgccagcaaccctctgtcccttagtgtgacaacaaaagaggacttcagacattgctgaatttgtcttggggacaaaatgacccctggttgagaaccactgcttataggtaatttttcttatatttctgattttgaaatacattcatgaatgcttacgtgggaatagtttctacttgtggtttattttttaaattttgatttaaaattgttgaaaagttagaactggaataaatgaggaatcttataaatgaatagttgtaatttgtgatattgcgtgctatttatttattttagtaatatttgtggtcttggccacctcccactatcttatttccaatactagtgtttgaggatcagcgcgtggactgtgctcattaaaattattgtatgtttgtggttaaagtatgaaattgatgcaaagtttgtggcttgaaaacattattgagacaggaatgatggtacccttaaaatattaaacatcactgttttgattatatcttcctacacaatgaagtactccaaatttgtggattaaactaataaacattttatctcttatgcttttgtgacttgactgggtcagctgggtagccagttattctgggatgtgtgaggttacctgtggcaacagtcagctgtggggtcagtgtccaagacattctggtaggaatgtccaagagagtttacttgtatgtctggcatcttggcagggttggctggaag

SEQ ID NO: 30383 - DNA, 1032 bp, Homo sapiens
gcagctggaaaccataattctgagcaaactgtcacgaggacagaaaaccaaacaccacatgttctcactcataggtgggaactgaacaatgagaacacttggacacaggacggggaacatcacactctggggcctgttgtgggatgggggtcagggggaaggatagcattaggagaaatacctaatgtaaatgacgagttgatgggtgcagcataccaacacgacacatatataaatatgtatcaaacctgcacgttgtgcacatgtaccctgtaacttaaaatataataataataataataataataataataaaaataaaatgtttagtataggctcccagtctcttctggcttgtagggtttcagctgagacgtctgctgttgccctgatggggatccctttgtaggtgacctgcactttctctttatctgcctttaacattctttcttttattcaaaccttggaaaatctgacagttatgtgtcttggggatgatcttcttatgtagaatcttgcaagagttctctgtatttcctgaatttgactgttggtttctctagcaaggttggggaagttttcatggatgatatcctgaaatatattttccaggtcgtttgctttctccccctccctttcagggatgccaatgattcatagatttggcctcttttttacataattttatacttctcagaggttttgttcatttctttttattctatttttctttatttttctctgtcttattttagagagccagtattcaagttctgagattctttccttagcttggttattctcatgttaatacttgtgattacactgtgaaattcttgtattgtgttattcagctctgtcagacccgttaggttcttttttatattggctattttgtcctttagctcctgtatcactttattgtggttcttattttccttgggtttcatattgtcatcctcctgactctcgattatttttgtttctacttgtattctgaattctgaattctatttctgtcattccggctag

SEQ ID NO: 30384 - DNA, 1028 bp, Homo sapiens
gtgtatatgtgccacattttcttaatccagtctatcattgatggacatttgcgttggttccaagtctttgctattgtgaatagtgccacattaaacatacgtgtgcatgtgtctttatagtagcatgatttataatcctttgggtatatacccagtaatgggatggctgggtcagatggtatttctagttctagatccttgaggaatcgctacgctgtcttccataatggttgaactagtttacagtcccaccaacagtgtaagagtgttcctatttctccacatcctctccagcacctgttgtttcctgagtttttaatgatcgccattctaactggtgtgagatagtatctcattgtggttttgatttgcatttctctgatgaccagtgacaacgaatattttttcatgtgtctgttggctgcataaatatcttcttttgagaagtgtctgttcatatcctttgcccactttgtgatggggtggttttattcttgtaaatttgtagattctttttaagtttaagttctttgtagattctggatattagcccattgtcagatgagtagattgcaaaaattttttcccattctgtaggttgcctgttcactctgatggtagtttcttttgctgtgcagaagctctttagtttaattagatcccatttgtctatttttgcttttgttgccattgcttttggaagtccttgcacatgcctatgtcctaaatggtattgcccaggttttcttctagggtttttatggttttaggtctaacatttaagtctttaatccatcttgaattaatttttgtataaggtgtaagaaagggatccagtttcagctttctacatatggctagccagttttcccagaaccgtttgttaaatagggaatcctttccccattgcttgtttttctcagctttgtcaaagatcagatggttgtagatgtgtggtattatttctgagggctctgttctgttccattggtctatatctctgtttttgtaccagtaccatgctgttt

SEQ ID NO: 30385 - DNA, 1050 bp, Homo sapiens
ccctggggatcttttgggttccattcatgcttcttcctactctgttgtatagcaccaaaagtacttctgttgaagacttgtaaaaatcatgccaaccaatgccaaaactgctgctgtttttgtttgtttgtttgtttgtttgttcagtggcaggggtaacctgaacctgaaatggcctcatgggaatctcagcttcaatataattgaatcatattgttatctgtgtatgcatgtttcccttgaattctaaattagcagagccagagtcctcaaagatagaaagcaaaaaatttgcaagtgagtcattaggtgtgagaatgagaagttgtcttttacatttctacttcatgtttctggacccatgtattgtggttatgggagaaacataactttatattagttactggttcagaataattgtcgcaatttgtggattgccccatcattaaaaaagctagcataacaaagtcttctatagtcttgtctattgttctatacagtctgttgctctggatgatgaagtaattagtaagatcagttaatctgtgagtgtcagctccttatcttccttctttgtgtttaaaatgagttccttgctcatattccagttttatatgcaacagtgttatggcaaatagggtattgaatagtctactgaaggttatgtttccagaaatgaagcagccagggaaagtaagtccaaatctcatcctctttgtcatgaatggggtcaaaagtatgaacttgcctgtaggcagttggctaatccacttggaatatgtgtaccacatccaagtctcagggttgcccactgctaccggtcagttctgattcagcagttgtggtgtcagatcagccttggtgagggaaagttcatggagttgagctcctctatagctgctatttctttcacagcattcttttcaggatggctgggaaagtaaacagattgaatttacaggacactggggacaattatgcgggtggtgtatggtctaaggaaaatgggcttctctttgcaagataattcactcaggtgatgtagtctca

SEQ ID NO: 30386 - DNA, 1073 bp, Homo sapiens
cagttcattcttttcgctgttaagctttcacgtgcactcttctacatatatttgaattctcacacaacaaaacaactgtatatctacctattttttaatttttaaaagtcattttttctggtaaaatatgacataaaatttaccatttcaactatcattaagtgtatagttcagtggtattaagtacgttcacattgttatgcaatccccaccattgttatgcaacccccaccaccatccatctctagaattttttttcatttgccaaattcaaagtctattcctattaaacattaaccccacgtttctccctcccatatatcctggaaaccaccactgtactttccgcttctatgaatttgactgctctaagtaccttatatgagtagaaccatatggtcctgttgcgactggcttatttcacttagcataatgtcttcagggttcatccatatgggttcaggatgtgtcaggatttccttcctttttaaggctgaataatactctatcttatgtacagtgtcagtggaatctgagtttcatatagataacaatacagaaagaaccaggatttgggagttaaatatgtatgcttgggtttaaatcctatctaggtcactcacatgctctatgacctgatggagatttgtaatttatctgaatctcagcttcctcatctatgaaataatgaaaataaagcctttctgatgggactgttgtgtgaattatattatttatataaagtacccaatatagtgactggcccgaggagaacaattaagggtaaaagttcgtatgcttgttagctgcatgtatattttctttggaaaaatgcctgttcatgtcctttattcactttttaatgaggtggttttttttcttgtaaatttaagttccttgtagatgatggatattagaattttgtcagatgcatagtttgcagatattttctcccaatctataggttgtctgtttactttgttgatagtttctttttctgtgcagaagctgttaagtttaattagatcctatttgtcaatttttacttttgttgctattgcttttggcatctt

SEQ ID NO: 30387 - DNA, 1023 bp, Homo sapiens
gtgggagtgtaaattagttcaaccattgtggagagcagtgtggcaattcctcgaagagctaaaaacagaactactatttagcccagcagtctcattgctggttatgtactcagaggaatacaagtttttctgccataaagacacatgcacacaaatgttcattgcagtgccattcacaatagtcaagacatggaatcaacctaaatgctcatcaatgacagactggatcaagaaaatgtggtacatatacaccatgaatactatacagccataaaaaagaatgaggtcttgtcttttgctggaacatggatggagctgtaagttattatccttatcaaactgatgcggggacagaaaaccaaatactggatgttctcacttataagtggaagctaaatgataacacatggacacaaagaagggcacaacagacactagggcctacttgagggtgaagagtgggaggaaggagaggagcgtagaaagaataactattgggcactaggcttagaacccgggtgatgaaataatctgtacaacaaactcctgtgacatgagtttacctatataacaaacctgcacgtgtacccctgaatggaaaacaaaagctaaaaaaagggataacagttgattgcttaccactaactctcctgaagatgcttatgtatgcctggccctctttatgtcctttgaggatgatggtacttttgttgaaattatcatttcaaatcagtatttggaattttccctttacccacagcagagcccaccttgactgtgatgctgaatttttactgaggtcaactgcttcttattttctgtgtgccacatttttttttttttttaaaatgctggtcagccaccagccactgtttgatttgcatttagttcagaatttgagaagtcagctgttttcttagcattctgccatatatcaagtctatctgaacttcatatttcattttatagaagatattttagagaaagttgtggaaaaaggaaaaagtctgtggttggagagca

SEQ ID NO: 30388 - DNA, 1050 bp, Homo sapiens
taagtcatggacaaattgtaatattgtaccagccctttcctattatatttgtatatttatttgagatgtttaatattgtaagaaaattttgattcataatattgcaaataaatagctgttgtctaaatacagaaacaatagttttctgccaacaaagaggaaaacatttagagccaggtactgatattgaagttcatttggtttcaaattgatatttaagataaaataactttcttttaaaaatggaaatttaatgagcattagatttcatttctaattactaccttagcttctgtaatctagcactacctagttgctattccagatcttgaaatttttaggactaccttactctgaaagttattctgctaatctatcaaaaccaaatgccaggagacttccactggatgttactaccgctagacacagtgccagcttctttttgtctcatcattctgtgcacttacataacaaaactttgttaaagtagaaccaaacgtttcatggaggaattgttatttaggcgaataagatttctgtttactaaatctatgacactcaggtaaatattgtaaggaatgcttacactgttgaacaccagccagaacacattagacaagtttttaatccagaaaccttctggtacatgacagattgtttgtattattctctagcaagtgttagaataattctagttctcttcatttgttcagacttcactaggttaattgagaaggaaagattgttaaattatttaaattaactaaagccaaaatttccactccacaatttccctagtttattctatttttttctgtttgaaaacttattttttaatttagtgttttttgtttttcttggcttcttaagttggtttctttctgtagattgctcttctttttctctcctatcctgcagacaacaagtattttgtcacccatagcaattcttcctttgatatgtcttctaatttctcctgtctttgtccagtcccactgctattgtctggatattcacctcctcggataagatttagtttgtttcttcctc

SEQ ID NO: 30389 - DNA, 1058 bp, Homo sapiens
gaccagcctggccaagatggcgaaaccctgtctctactaaatataaaaattagccgggtgtggtggcacacacctgtaatcccagctacatgggaggctgaggcatgaaaattgcttgaacccaggaggtggaagttgcagtgagccaagattgcaccattgtactccagcctgggtgacagtgagactgtctcaaaaacaaaaacaaaaaaataaattgtttgctgaatcttcttgcaaaacattataatgtatatccagaccatcttacctgtaagtcttgtttcttttgtcagtgcctgaaaagttttgcataaaatttgtacttctgtttctgtcctgtcattctgattacttctagtaaatatgacagggtggtagtgttctttatttctcttcttgtggtagccattatatttatattgtttcatgaacttagatgtgaaacaaaatattcaaattgaatccagatatgtaaacagaataacacatcatgaccaaatattgtttatctgagaatataaacttgatttaatatttaaaaatcaatatagacttctgcttctgcccacgataaagtcaatgggactgtatatacccagacagtatatataccttcccacctgaacaacagcaacatcacagataaaatatactaaataatggttttaaagaaactggacatcaagcacaaaggatagtgatcctttagacacaggaaataaataaggtgagctgtaagattgcttcagcttactgcatggagcatctcctctgcattgcattgcagggagatggaattcaagggaaatccagtgggttcactgaactgaggagacagaactgagattctagggagaacaaggcagttagagttggccggacacagtactgaagaggagagagcttcaagagacctagagatctgtagaaggtatcctctgtgtattcagcagtgtgctcatcaggcatcatgtgaggaaactactcagggctagggaaacactcattagaatggatttaatagtacagtgcctgcatttacactgtgctgcaga

SEQ ID NO: 30390 - DNA, 1421 bp, Homo sapiens
tttgttctggttgcatagcttttaatcactttcagtgggattcaatagtacatatttatttgttgaacaggcagatattaggctacgcatttaaaatgacaactctgcttctggtcagttcaaaaaatatatatactgagctcctaccatgatgtgccaggcattgtgctgagcaccataacatatgattaagacaggttattgaactcaagagacctctatcatgtcttaggtcagtgttttattttgacaggtatgaatgtattttcagaactatggagatagtattttaaatttaaatttatttattaaattaaattaattaaattaaataaatttatttaataaacccgggatgtattgtctctgtacgacagccatgtgaccctcttctaagatttttttagctaatctattttaaaagttttaaaaattttatgccaatatagtgtatttttctgctaggcattctaccttgtgcttattttttattaaatatctatttatatattgtcactccccagtctgcaagtatttgtactttgaacctttgagtcactatttccagtacaacgttgatttgattcagtttctattatgtttaattaacatttactgagaacctaccatgtgcccagatcctcccttaggacccaagaatacaagataaatgacctatgatttttatcctagagtgtataaagagtggtggaagaggtagatgaataaaccaaaaaaaattatgcaagtatatagttacaatctaaagtaaaacccaaatatatgcccattattttctccttatcataaacccctttaatgctatctaacaagtttgcctgatagcctgtgacatacttctccaagaatgacaaatgtcagtgaaattgtgaagattagtttggctactataaatgctgtgtgtagaattcacatgtgacaaattcacccacatatcccatactctattcctacccagttacacaatgacattatcctggtacaggattttttaggcccattcccatccttactagaatagctttggaaatttcaaagtaagcccaattatagtttgcattgcttttccaaatgtttcaaataatcatattcttttggattttctctgttaacattataccgaatcttttatttctgcctcacacctggcatgttttatattttaaaatgtatattctatattgtataaatatttatgagacagattaaattacctagtataaaaacaatatacttttacacagaactctgtattccctcagtctaagcacaggcttgctttttacaagaaaagatgttaaagatcctgaagttgttcatacttttcccacaaattaaagctctatgcatcatttatgaaagcagcgtgctgctatgatcttaaggtgctggagcctgga

SEQ ID NO: 30391 - DNA, 1180 bp, Homo sapiens
tatctgtccccttggctaaaagagctgttaaaactgtggttttgcctggattagcaattgcacttggggaaaaagcagttttggttacttggcttctttttctgggtttttgccttttttcaaaatttggcttaataattccttgccatcctattaactatttgatacttttcagaagctgaagttttataatattttatccagtaattttaggtaatttcagcaaggagatataaatagctcagcctggaatgactggaaatagaaatcttcttaattaacatctctttcagattgtctcaaggcaactcaaccctggactttcaaaacaagacttctatcctcctctgcacccccagcatggtctttttccagtgttcatcagtttattgcacacatgagaaatccatatgaactcaccatctggttctctatagttttactaaatagttctttaatcactttacttctattgctttcattctgatctgtcattactcaccagtacaacagtagtagaatctacacctccatctttaggctcccttagtctgttctagagattgtagccaaaatgacctttttaaaattcagatttgatcatgccattgccctgcttaaagtcctttaatgacttcctatgatattcagaacaaagacccaaattactactattgttggtcaggccctgcattgtctgccctgtgctgcctcccaaccacagggccttggaggtaaaactgtctaatacaggtctagaaaaggctattggtcctaacttagaaagttgcttttttttaatggcagtgaggagtctgcagggaaccacaaaaaaagacttaaagcaatagaaagatacatctgcttccgtagcattgatattggactgagtggcaggactgagagacctgtgaagatgacaagtagtgaagacctggtccaggaggatggcagaggtttcatacagaaatgctttttgagatagaattagtgagagtcagcaacttactgcatgtagttggtaagggaaaaagataagtcaaaattataaaatatttcacatgtaaatttatcaagcagttacaatgtattagacaccattttaaacatttttctatattctcttttacttctcacagtcatcctgtgagataagtattgttagtatcttcagcttttc

SEQ ID NO: 30392 - DNA, 1031 bp, Homo sapiens
ctctagtgaagtgtctcgttttaaaattagtttatttgttgagattggagagtttttcctatattctgggtattagtcctttgccagatatttgatttgcagatattttctctttgcctatagtttgtcttttcatttcttagttgtatcttcacacagcaaaagtttcaaattttgaagtccaagtttattgatcttttatagattatgcttttgatatcatgactgaattcttagcttatccacagcttataaagattttctcctgtatttattctataagttgtatagtcttataactgtgatccagtttaagttaatttttatgtaaggttcaaggtttatttgggggagcagtggcatttggagatccagttgtttcaaaaccacatttgtttaaacagccttgaactttgacaaattcaatttgttaaaaggactgttctttgcactcagacttatcacccctcctacttgtttattcccttgtcattttggataaaatgcttgtagctcctctctgacccacttaatgatcttagacaaattacatttccacttgttatgacatttttttcttaagctatatttgaccctttcaacctcaaagtatttgaaaagaaataactggtctgttaactctggataaatgtatgtgattaattttaaatgattattattcattctggaaagcattatttaagtctatgtggtatgccctgactagtcaaatacaataaagagattactccttagatatggggcatagagtctagaaacataaagaaggaaatgtgaatacatattcctaacataagatgtttcagatagccagaatctctttgtagctctcttcttttcagtgctttgcattttcctattgattcattaaaaagtagttaaggggaaaagaagatgagaagaaaacctcaaatagatctcagtgattcttcacatttttttaaagagctgctagtcagtcttttagcagaaagtgtgtccagcctaagcagtacattactctgtagtct

SEQ ID NO: 30393 - DNA, 1059 bp, Homo sapiens
gtggttctcaggtcgctggggtaatgtttcacaggggagtataactgcctctgctgcacagaggagtttacaaaaggagtggggagtagtgggcagcagtgagccttacctagttcccacatcgttttcaaggtcggtgtcactcctgcggtgctctggtgacagcacctggtttagatctaggcagtctgcacacagaattcagacctgccccagcctataagcttccccacagagatagcaaccacagctttcaggccgcacccctccccgtctttctgcaaagtcacgtgcccagcttctgcactcctgtctgcagctcacttcctgctcattccccaggttctgttcatggggtgtttgtcctctcttgagattatatcacaaaattcagttgggagctgcatttaccctgtgaattctccctcgttgaccgacttccccaagggctcctgtgagatatagtcaggaatcacttcccttggttcacactggagactgggaatgcctgcaagccccttcccactgttgcttctacttttatattttatgccactttctaaatttgatccagctcttggtagagtttaaggtcttcttccatggcctgaattttcagattccccagtgaggatgtactcagaggcagactctccccttctcacactctgagaacttagtttttcacctgtctcatggagtaggctgcagcctgccatttgtttcaaagggtctgtagattcttttgatttttctattaagttcctgtgttggttcttgctttaaaaaaaaaaattcacagtgtgaatctctacacactattctgaccttccaagtgggagaggcaagctaacactgcctccaatctgccattttgaaaaaaataaaaaatgaaaaaatgagggtttgtattatgaagtgacgttggattttattgaatggtttttctgagtctattgagatggtcatatgtttttttttgtttttagttccattgatgtggtgaatcacatttattgacttgtatatgtttaccatccttgcatctcaggaataaag

SEQ ID NO: 30394 - DNA, 1033 bp, Homo sapiens
ttcacattcatgtctttaaaccatctgggactcactgtccagatggaaatttgtaatctctacttttctcaatatgataagccagttttctctataccacctactaatcaatctgtttgtacttcattgacttctaatgctgtctctaccaaataccagattccatgtgtggtttatttctaggctcttcttttattgtctgaaatgtgccagtttttttttttttaatcaaaatggctttgtgatctgtcttaatatatgacaaggcatatcttactaccggcatacacctcagaggtactgtaaatgtggttccagattactacatcaaagtgaatattgcaataaagcaagtcacatgaatattttggtttcctaatgaatataaaaattatgctgaaactatacataccttaattttaaaatactttattgctaaaaaaatgctaattatcatctgatccttcagccagtcatgatcttttctctagtggagggtcttgtctaagtattgatggctgctgactgatcagtgtggtgattactgaaggttggtgtggctgtggcaatttcttaagacaacaaatttgttgcatcaattgactgttcctttcatgaaagatttctctgtagcttgcaatgctgtttgatagtattttacccataaacttctttctgaattggagtcaggcttctccaaccctgccactactttatcaataaagtttatgtaatattctaaatcttttgttataatttcaataatgttcacagcatcttcaccaggagtagattctgtctcaggaaaccacttcctttgctcatccataaaatgcaactcctcatttgttcaaattttatcatgagattgtagcagttgagttctgtcttcagggtccacttctaattatagttttcttgctaattctaccatatctgcaatcactttcaccatggaagccttgaaccacttgaagtcattcatgagggttggcatcaacatctaaatttctgttactgctgatattctgac

SEQ ID NO: 30395 - DNA, 1051 bp, Homo sapiens
tgacaaacccacatactgaatgggcaccatcatactgaatgggcaaaagctggaagcattccccttgaaaatgggcacaagacaaggatgccctctctcaccactcctgttcgacataatattggaagttctggccagggcagtccagcaggagcaaaaaatgaagcccattcagatagagagaaaggaagtcaaactattcctgtttgcagatgacatgattctgtatttagaaaatctcatcatctcagcccaaaagttccttaaacagataaacaatgtcagcaaagtcccaggatacacaatcaatgtgcaataattgctagcattcctatagatcaacagtagtagagccaagagccaaatcatgaacaaactctccttcacagttgccataaaaagaataaaacacctaggagtacagctaatcagggaggttgaaagatctctacaaagagaactacaaaccactgctcaaagaaatcagagatgacgcaaacaaattttaaaaaattccacactcatggataggaagaaccaatataattaaaacggccatactgcccaaagcaactatagattcaatgctagtccattaaactaccattgacattctttacagaactagaaaaaactattttaaaattcatgtgtaaccaaaaaagagcctgaatagctaaggcaatcctaagcaaaaagagctggaagcatcacactacctgactccaaactactgcaggtctacagtaaccaaagcagcatggtactggtacaagaacagacacacagaccaatggaacagaacagagaacacagaaataagaccgcacacctacaactatctgatcttcaacaaaacagacaaaaacaagcaatggggaaaggattccctattcaataaatggtgctgggataactgtctagccataggcagaagattgaaactgcactccttccttataccatattcaaaaattaactcaagatggataaaagacttaaatgtaaaatcccaaactacaaaaaccctaggagacaacctaggcaatac

SEQ ID NO: 30396 - DNA, 1094 bp, Homo sapiens
gtacccatgttcatcagtgatcttagctagatcttctgaataacttgctacagcttctccatcagcacttgctgtttcaccttgcatttttatgttgtggagataccatctttctttaaacctcatgaaccaacctcttttagcttagacttttcttcagcagcttccccacctctcttcgcattcatagaattaaggagaattagtgccttgtgctagatttggctttggcataagggaatattgtggtcattttggttgactacccagaccactcaaaaattttttttatattagtaatgagactggtttgctgtcttatcatttttgtgttcactggagtagcacttttaatttcccccaacaaacttttcctttgcattcacaacttggttgtttggtgcaaggggccttgcttttgggctgtctcagctttcaacatgcctttgccactaagcttaatcatttctagcttttgatttaaagtgacagatgcatgactcttgttttccccttcaacacttagaggcccattgtagagttattacttgacctaattttagtattattttgtctcagagaatagggaggactgaggagagggaaagagataggggaatgcctgattggtggagcagtgacaatacagacatttgcgattaatttctccatcttatatgggtgtggtttttaatgccccagaacaattacaatagtaacatcagagatcactgatcacacacagttcaccataacagacataataataatgaaaacatttgaaatattgcaagaattaccagaattccagagacacaaagtgagtacatgcccttggaacaatggagctgatagactcacttggcacagggttgcctagttttgcaatttgtaaaaaccgtaatatctgtgaagctcaataaagtgaaatgcaataaaacgaggtatgcctgtatttagtagggcaggtctatttttatttctcatcttttgcaaagttgatgtagctattcatggtcttaattcataggatatcatacttttgtttgtagaatttctttatttaaaaaatgtcttggtatttataatggaat

SEQ ID NO: 30397 - DNA, 1065 bp, Homo sapiens
gtaatcccagcactttaaaagaccaaggtgggtggatcgcttgaacctgggagttcaagacaagcctgggccacatagcaagaccttgtctctctaaaatacaaaaaattagctgggcatggtgcacctatagtcccagctacttaggatgctgaggtggcagcatcactggagcctgggaagttaaggctgcagtgagccgtgattgtgccactgtactccaacctaggcagcagagcaagaccctgtctaaaaaatgaatgaatgaatggactagagtagactagaggtaggagttaacgcaacataatgcctttaatagagagttcctggatgcccttggaatttcagctcttttcgtgtgaaaggactgagcctgctgcatgccagtgtgcactttctgcttttttcctttatttgccttagcaaggagactcagatcttgaaggggcttggttggcagggtagcaactatcatttctgctttgtatgtactgtcactaatgtgaaagctgtgaagggacagatgctatatgtaatcaagagacagagctttccatagggtattcttttactgtggaatgtgtttcatttctcatccactctaggaatgagaagtataaatggtctagcttttgtgttgattctgagagggatcattgcactagtgcaggtttggctggttctatttatttaaagtaataaatagcagtgagggctaaattgagactgcttaactttgtgacccatagcaacccagttggggtggaggatggaggaaggccctttatagtaaggattattcagtttcatcttttaaaaaagtcaaagatatatatatatatatatatatatatatatatatatatatatatggattttaagttatatattacagactacttggcattgaacaaaaaaatagctttaaattcctgtccctatctctccccattcctgattctcactccccattttttaaaccctcttagttgtttcttctggtgttttacatttctaaataatgttattttaatgtatatcttgacttttctatttaagtta

SEQ ID NO: 30398 - DNA, 1027 bp, Homo sapiens
actttcctaacctctgaatgttggaaatcagtgtcagacttagcatgtccaaaattaaacttagtttccttcttccaggcatgctttccaggccacaaaacaagagtgatactttactctgttcataacccacatctagtccgtcagcaaattctggcacctctacctacaaaacatgtcaaaacttcaagcccttcttaacatcagcattcttaccttcatccaagcagctgttatgctgtgaactgttgcactaaatagcctcctgactggaatccctgccttcctctttgcctttttatggtttatcttcaatagagcactcagagtgatgctttcgagacttaagtcatatcacatcactcttctgctccaaatctccagtaacttcccatcttgcttagaataaaagccaaagccttaaggtggtttacaaaatctgtgtttaacctggtgcctgctgcctgtctgcatcatcaatcttccctttctcaagacacactgaccctgtttttcctgaacatgccatgtttacttccacctcaaggcctttgcacttgtttcttatgcctgaataatgtccccagttttcttaaatgttgccaccttacttcattcaggtgtattctcaaagttcagctcccaaaaagtctttccctgaccactccacctaaagcagtaccttccccagtgccccagccagcctacccttggccactctgatttttctttttataatttatcaccatcattaatgatttgcctattgcctgctctctagatcaaaagtgccatgagagcagggacttttgatcacaacaaagtgttagtactcaagaggtgctgcacaagcatttgttaattggatgaatgaatgaatgcttgtggatgtatacatgcaatggactatcatataggctttgatgggaaaataataattcaaactttctgttttatacttaaacaggtgattttgttttatcaatatgaaacgtatgtgttggaaacaaatatcacattgccttta

SEQ ID NO: 30399 - DNA, 1089 bp, Homo sapiens
acccgggagtagagtgcagtgagccgagatcatgctactgcactccagtctgggtgacagagtgagactctgtctcaaaaaaaaaaaaaaaaaaaaaaaggaaaaagaaaatggtttcctggagaactaagatatttgtcacctggtggagatttttagttcacttgtaagttggaattactgtccctatatttcttcactgtttactcctcccagctgcttgcttgcccacctcaacccaagtctgttgatgcagcatcccctacaagcagagaaaacatcttcagtttctcaaataatctccttcagtagtgtgaaaagagtttgtaatttagtttccactttttaatgatcaatataaaaaataactaaaataaaaatcactgggtttttttcttcctcattaggtagatacaatgcgcccacgtcatggggaaacatgtcggatgccagtgccacatcacttcttcctcagcctgaagagtttcacttacaatactattggggaagataccgatgtcttcttttccttatatgacatgagggaaggcaagcagatcaggtgagagtcactggaaattctggtgaggttctatgttaggatggtatgggtcataggcatctctggccatcagagaagacagatgcacagaagaggcaaaacaagataaagtaacctcatctcattagctaggagttttggccccaattccctgtgtgcccttaagtcacgtaaaccataccatgggtggctgccttttttatgactttttccacatagaagctcaaaatcgagtcttggctatcaccacctcacagagagaaaaggatgcatctatttaataccacaaaaaaggcataggagaaacatagaaccaaacaaatgcagcagagacacacagctccagagtgcaggaagccctgggccttggcttgctgcatgtggaagagagggtttgaagaaaaagggggctgatggtgtcttgtctgggcagcccatgaaaggagagcatcttctgagtttcttttatattgcttgggaacttcttgtgttaggagtgctttatggcttttacttgctttagtact

SEQ ID NO: 30400 - DNA, 1091 bp, Homo sapiens
aaggaaatctcagcaaagaatttcatatccagccaaactaagcttcataagcaaaggggaaagaagatccttgtcaggcaagcaaatgctgaggaaattagttaccaccagacctgccttacaagagcttctaaacgaagcactaaatatggaaaggaaagaccattgccaaccaccacatacacacacttaggtacacagaccagtgacactataaagcagccacacaagttagcaaatagcttaaacaaataaacacgaacacaggataaaatttacacattcactactaaccttggatgtaaatgggcaaaatgccccaattaaaaggcacagagtaacaaggtggataaagaagcaagacccagtggtatgctgtcttcaagagacccatctcacattcattgatacccataggctaaaaataaagggatggagaaaaatctaccaagcaaatggaaaacagaaaaaagcagggattgcaatcctgatttcagacaaaacagatttcacaccaacaaagatcaaaaagacaaaagagcattatataatggtaaagggttcaattcaacaagaagacctaactatcctaaatatatatgcgctcaacacaggagcactcaaattcataaagcaaattcttagagaccttcaaagaaacttagactcccacacaacaatagtgggagacttcaacaccccacttacagtgttagatcatcaaggcagaaaattagtgaagatatgcaggacctgaactcaacactggaccaaatggatgtgatagacatctacaaaactccaccccaaaacaacagaatatacattcttatctgcacatggcacataccctaaaattaactacaccgttagacataaaacaatcatcagcaaatacaaagcaagcaaagtcacatcaaccactttctcaaaccacagagcaataaaaatagaattcaagaataggaaaatctctcaaaatcacacaattacagggaaattggacaacttgctcctgaatgacttttaggtaaataatgaaattaaggtggaaatcaagttctttgaaactaatgagaacaaagatacaa

SEQ ID NO: 30401 - DNA, 1034 bp, Homo sapiens
tacatagatcttctgaaacctgtctcaagcccagattaaaaactgtcctttaaagcataaaagacccactctgataacagtccccatgctgtcatatgcctcatacctcagcatccacttcattttatccacctactctggctccacactttgctcctgaccagggtgtggtcagccataaccagtccgtagcttcattccactgcccgggaggataattcagcctacccatggtccatctccacccaacactagccctgcccatggttttccagcttcagcccataagtcagaactcacaaggattcctgagtttgacctctgagatctgtccttgtccttgtcctaaactctgaactcacactgccactggccttacctgccctaccctatattctttgagggttgcagagatgtaagacatacagtctctgctgctttgcagacaaggatgctggacttaaaagacatgttggggttctccaagaccacccttagtgattattcactacaaggactcatagggcttagcatatacttgtagtcatggctaagacttatgacagtgatgtagtaaggatacatagctggatcataacagaaagacacagactttggaggaatctacacacaagcttctttgtgctctctgtctcacacatgaggggtcacacagagcactcttccagcaatgaaaatgtagcattatgtgtgtgatatttcagccctgggaagcccattagggactcagcacccaaggtttattgggggctgtcacatgggcaccctctgtgtagcacatgctaaattccgagctcccaggagggaagcaggtatttaacataagccgtattgttcacacagacagtctaggcatagtgagccacgcttagttgttgggaacactctgaaaaccaaataccagatgccagctaagggccagccttgcaagcagacccttctaaatagcagtctcaggcctgctatgttaactcttttctgtgccccaagctcctggttcatagaattttggc

SEQ ID NO: 30402 - DNA, 1842 bp, Homo sapiens
ttaattcaactaaagatttgtcagccgggcgcggtggctcacgcctgtaatcccagcgctttgggaggcgaaggcgggcggatcatgagatcaggagatcaggaccatcctggccaacatggtgaaaccccatctctactaaaaatacaaaaattagctgggtatggtagcacacacctgtaatcccagctactcgggaggctgaggcaggagaatggcttgaacccaggaggcagagattgcagtgagccaagattgtgccactgcactccagcctggccacagagcaagactccatctcaaaaaaaaaaaaaaaaaaaagatttgtcaatttaatttagctttccaagaaaccaactgttaacgatgtttatcttttctgttgtctttctcgtctctatttcatttatttttgccctaactttcattattttcttccttttgttaactttgagcttagtttgctattttttagttccttgagatataacattacattatttgagatcttttttctgcaggtaggcatttattactgtaaatgtttctctgagaactgctttttctgcatgccttaagtcttgataggttttgttttcattttcatttatctcaaggtatattatgaatttccttctttgacccattagttgttcaagagagtgttgtttaatttccacatatttgtgaaattttcagttttcctcgttactgatgtctggtttcataccattgtggtcagaaaaaatagttgagatttcattcttcttaaatttgttaagatttgttttgtgggccaggtgcggtggctcacacctgtaatctcagcactttgggaggccaaggcgggcagatcacgaggtcatgagatcacgaccatcctggctaacacggtgaaatcccgtctctactaaaaatacagaaaaattagcggagtgtggtggtgggcacctgtagtcccagctactcagggggctgaggcaggagatggcatgaacccgggaggcagagcttgcagtgagccgagatcttgccactgcactccagcctgggcgacagagcgagactccatctcaaaaaaaaaaaaaaaaagacttgttttgtggcctaataaatgctgtattgctgtatcccggaaaatgttgcatgtgtgcttgagaggaatgtgtactctgttgctctgtatatgtctgttagatccacttggtttacactgttactcaagtctgctatttcattattgattttctgtttggatgatctcttagcttttcaaagtgaagtattgaagttccctactgttattgtattgtactatatctcttcctgtagaactattaatatttgctttatatatttagatgctctaattttgggtgcaaatatatttacaactgttatatacttggatgaattcactctttatcattacagagagtccatatttgtcttgtgacagattttgaatatctattttgtctaatttaagtattgccactcctactctcttttggttatatttgaatggaatatcgtttcttttttttttttttgagacatagtcttgctctctcacccaagctggagtgcagtggcacaatctcgactcactgcaacctccgcctcccgggttccagcaattatcctgcctcagcctcccgagttgctgggactacaggcatgggccaccatgcctggctaattttttgtatttttagtgagagatggggtttcaccatgttagccaggatggtctccatctcctgacctcgtcatctgcccgccttggcctcccaaagtgctgggattacaggcatgagctaccacgcccagctggaatat

SEQ ID NO: 30403 - DNA, 1028 bp, Homo sapiens
ggaaatcatcattctcagtaaactatcgcaagaacaaaaaaccaaacaccgcatgttctcactcataggtgggaattgaacaatgggaacacatggacacaggacggggaacatcacactctggggactgttgtggggtgggggtaggggggagggatagcattgggagatatacctaatgctggatgacgagttagtgggtgcagcgcaccagcatgtcacatgtatacatatgtaacttacctgcacattgtgcacatgtacgctaaaacttaaagtataataataaaaataaataaataaataaatacagtgaaaaaaaaagaaaaagaaggtccacatctatcaccacagtatgaggtttaaggatttagaaagcacttttacctaaatatgcctttaataactacatcaggtataacacgaggatgctgctaaaagaatggaagagtaagatagagaggcatgaaatgatgaagactttgatggggttaggactaaagagaataattttaaaaactgaacaattggcccaggtgtggtggctcatgactgtgatcttagcactttgagggctaaggcgggaggatcgcttgagttcaggagttcgagaccagcctgggcaacatggtgaaaccttatctctacaaaaaaaaaaaaaagacaaaaattagctcggcatggtggtgtgtgcctgtggtcccaggtgctctggagactgaggtagggggatcacctgagcctggggaggtgaaggctgcagtgaccagtgattgtaccgctacactccagcctgggcgacagtgagaccctgtatagatcagttaatagatagatagaaagaaagaattcattgttaacagcatatagtatttgaaagcaagtgctgtattaagagaataaaaggaagcattggtaattgaaggtaaattgatgcctttgtaacaataacttggcagttctgcaaagctaaatgttttttatagccagtcatgagtagactgcaaaatttcgagagttcagtcttg

SEQ ID NO: 30404 - DNA, 1021 bp, Homo sapiens
tttagaggaccctctgactcttccccttgtgctcagaaacacactctgtccttttctttgactcctgacaaaaatgtgcatgtttcatcactgaccttcaagtgatgtttctttcttttcgtgtttgtcttaattgttcttgtttttctctgtgctgtcccttcattttcgcccctttctttctgacgcagagatgaagatagttgggtgtaagttctgtcttttgtgtgctctgtctgcttattgcctgctttgttctcatcttcatttgtttcatggaatgttgcaatactggggtggggtatcatgtacatattaataatcctcatcagcctcaccttcttgggtaactgacaagacataaaaagaaaagctaccagcccatcctataacactgtgtattacttttgagtattcactaagatctgaagaaactggagacatattggaatgtctagaaaatcttaacaagcttaaggtgtatagatacaggaaactatttttgtatgagactgatcagttgcattcattgaaaagaaaaggaatcgtgcttactccaagccaaaagaatcagaaaggtggaaagcttctctttttggctttgtgggacatacttcacatgaaaaggcaaaccaacagagatatggtttttggaagaaagctttcctcaaggggagcaatgacattatttaccacaagtgggttcatagcgctggtcaatctgagtgtcaaatgaggctatggcagtgtatctaagggatggtttaagaataatcacatctagtctcaaaagaggttggaagatcatcacatccctgactcaagaaaggacaaactatctatagtgatgtcacactatgcccatacctctcatcctgttagagcaaagagcatcactgactttgttgcaatggaaaccagaagtgtgacaccaaagacatggtaagaagaagaaagaatccttctttcctgggtactctaaagaagtcctctcaagagcctttttttttcttttggtctc

SEQ ID NO: 30405 - DNA, 1400 bp, Homo sapiens
aagaaaggcatattacttatagaaaattcagaaactatagaaaagcataaggaaagaaatgtagaacaaaaatggatttttaaattataccattttattaggttgctagagaatagaatttcacatgcatttaaaatgaagggcagttgccaggtgataagaatatacaaggataggctatccacatggagtgggagaggcaccttaaaaaaagagtatattttgttcgagcaggggacagggactcaataggatactctgatgttcaaacttaaagtgccatctggtgacaggggtctagcttggcagagagtgactatgatggtgataatggccctattatttgatcttggctccaggtaagacttggcagctcttcttcccaccaggcctcagagaagccacaccaagcacataagatctactcatagcccaaggttgtattgagggggtggacagcttattgctaaaggaaggagagaaattgaagcaaaaaaagaggaggaatggaacacaagtgggaaccagtaaaaacttggaggtgacggtttggttgtgtttgtggggctagagtcagtgtaattagttgcttataactacccaaagatacatcactggtaagtgttatgatcagttcgacagataggaaagatgactttggtcccaagagctgctcaaattcttcatgtggaatggggcagagtatagttaaaatggatggatgggtagagggacaatgaaactgaagctcaatgagagcagagatattatctctcgttcacctctatatattcaggttctcaaacagtgactggcacatggtaaatgtttagtgaatgataaatcgatggatgggtgaaagatagacaccaggaccagtagtagtataaacatcttagacgaggggcaacaggaatctctttgtgagataattaaaatcatgctacagaatttgagatgaatgtgagaagtctataataggataatagactcttcctaaattaggaagtggcccttagtgaggagacatgctccattgtttttgtgaggtggccagagaaagatgcactgaggctggagtccttcaaatggaccctgtaacacgagcaagagagctgaggagctagaagtggacccaggcatatctaggcagcagtcccggctggcaaaaattgagggcacccaaggggaagaccctgaggagaaaacagcgtgcttagaaagatgagctacttctgtgcattagtgctatgcactagtgaaggtgcagctgccacaccctgtagtgtgaatttgtcaccatttctcaaactttatcattccaaaagtgtcagcagagttttgccttctcctgactattctagggaaatcaaagaaaacatttaactcaagatctttgc

SEQ ID NO: 30406 - DNA, 1031 bp, Homo sapiens
gactactgctgatgtggctgacctagtaagtgctgccagctgtacttcagcctggcttgctgctaatggtgtgctctcttgctgctcgctccaggaggcagatgtcatggaggaagtagagatgatggtggagagcctcctggacgtgctcttgcagactctgctcaccatcatgagcaaatcgcacgctcaggaggcggtaagagggcagcggtgcccgcagtgcacagccgagatcactgttagtaactaacatccaggttttcttgccttcttttctaacccggggcttctccacaacactccccctccatcttaccatcccaccaccttcatctcagccttccctcctgcatggttgtcagcatgctgccctcttcccttcttgagtctgactctcctctctactctgaaagctctaggttcacattcccaggactcttctttagggcagatctggggaatgtttcttgtcctgttttcctgcatactttgagccaagtcattttctatattgtagaatgaagctgggatgtatgtaagatgtagtaagaggttgaaggtgaaaaacagactatttcttctaggaaccccctcatacaggttctcctaaatgatgtacaggacagaataattttctcagaattggcttctatctacaaattagttgcttttgtccattatgtttgtatctaaatttttagcatttggaaaaatatgatgaggtaaatttcactggcattagtgaataacgatttttctgtgatctaattagaagagaaacaaactgggaaggcttctcaggaggggcagagagacaataccttgggcccctcatgcaccccaactccagagtagacttacttctcagccctgaggtggggatgtgataaacagttttcgtggaatctttccattggcagatgggagattacagtgatctctctgaagaaaaccctctggagcaagccaagctacagcgtgctagggagagcagggagcactcagggagcaggtatgtgttctggagc

SEQ ID NO: 30407 - DNA, 1050 bp, Homo sapiens
ttcttctgctagctcagatctgctgctgagcccctttagtgaatttttcatttcagttattgtattcttcaatcctagaatttatattcggtgtactttaagtaatttctaccctttttgttggcatcctctatttggtgagtcattgttcttacactttcctttaattctttaagtgtgatttccttcatttctttgtttaaagtattttccaagcaagtccaatgtttgagctacctcaggaaaagtttttatttacttctttttgcccgtgtatgggccatactttcctatttttttatatcttataatattttgttgaaaactggacattttaattaatttggcaactctggaaatcagatcccttccccacatccccagggcttgttattgttgctttttattgctttatgttgttgatgatgcttgtttctttttttagtgacattattggactcattgctttttggggtttttttagacagggtcttgctgtattgctcaggctgtagtacagtgatgtgatcagagctcactacaaccttgcctggactcaagaaatcctcccacttcaacctgctgagtagcttggattacaggcatgcaccaccacatgcagctaattttttaattttttgtaaagatggggatcttgctatgtttcccaagctggttccaaactcctggcctcaagtgatcctgttgcctcagcctcccaaagcactaggattacagatgtgagccaccatgcctggacccattctttaatatctgtattttttaactatatgcagtcactaaagtctccatgcagttagttaatgatcagctaataactgaacagatattttcttaaatgccttaaatcaataactctccgcattttgtaaagtgttttttttatgtgtatgtgttggggctcactgtcattgctccagcacttttcagttcagccatagccttcacttcctgcttgcccagagcctcaaggtcagcacaggtgagagattaggccttctcaggccttccctaggaatgtgcacagcc

SEQ ID NO: 30408 - DNA, 1086 bp, Homo sapiens
tccataaactctaaaaagttgagggagagtacctcagaaaaccataggggagagcttgttttgctctcagaagcttccagtatggattgtagcatgtgttgtggccccatttgggaatcttccatggaaggagcaaagcaggcataaactaatttgggttttgtttttcaggtgaacataagatccactttattccgggaatgattggtccttttctgggtgtgacactggtcccacagccagaagtacggaatatcatgattcccatctttcatgacatgatggactgggagcagagaaaaaatggcaacttcaaacaggtaagacacctggcagtgttcggggtattctctggaatggatcccttctgcttaggcaggtggcctagatgaccaagccatgattctagtggggatgggctgtagtttggctaatttgaatcctgttcaagggttttcccttacttgctggccaaaattgatttgtggattttctccatgaagttagaggccagaaaataatgaggccaggaaagaatgaacatcactataactttctgatcaaggaatgattgagactgtagcctcccagtttcaatcatgatagggccctgggagtgtgatgtcattcctttactgaggattttcactgtataatccaggcatttctagggctgcagcccagaccagatgacttctcatggctcagggtagcccagcattttatagactactgcacagaggggttggtccaggagatacaggccccttggcttccaactgaatggcttcaggctgtcctcctgtgtagttcttttgccaccactaagtgtaggagatggcccctgcctttatatctgtagctccaggggatagtaccaggaccaataggggctaatgatgaggaagccaattttagctaatcaaataaataacttgctaacagcaaaaactgtccactgtaagcaggcctgctttgggagatagagattttctctcttggcagatgatcttcaagcagaagctcccaggaaacctctaggggaattttctgtattggcttgggaattgtaccagttccccacta

SEQ ID NO: 30409 - DNA, 1044 bp, Homo sapiens
tgcttacccacgtaacaaacctggcacaggtaccaatcaatcaacaatcaaacaaacaatcaagcacgggtatcccctgaacttaaaattaaattaaatttaaaaaaaaagtgactgagtactgctgaatgcccttgcaaatccgtggggtaggaacaaatatagtcttgctccttatgatttaggtatccaataacaaatgcaggggcccggtgatggcccagtgataggaacagcagcctcaagggctctaggttctgtgagtacaaacagtagagcctgttatcctgaaggaaattggctggaggaaacactcaaatctcatttagctccatttaatgccagtcattagagtgaggacaagctccccagaaagcatcctttttgactggctgactacagggtaaagttctaaccaaatgtattttacgcatacaaattcttttgaattaatgtttttaaagggggaaaaaaacatctgaaaaaggcctcttttgaatccaaagtacttttctctgtagggaatccttgccttttgcccttagattggaaagagtacctgagacttttaagtcctatctctttttcaaaccattagggtgggaggcctttttgatttggggagcagaatggtttcttggtgctataggtaaaatactaccttccctgggatttctttggagcaaggacaggatcaggaagtagtttcccaccatcctcacccaccacaggaactggatttcccattctttttctgaggtcatctcaggtttatgaagtctctgcttccttctaggtggaggccgagttgattgacaagctggacagcatggtgtcagaagggaaaggtgacgagagctacagggagctcttcagcctactgtaagctgctccagccccaggcacaccacactgggggatgggatgaagtgggccaatgaaaagtagaggttgcaactgcactggcaggctttagaggttggtcatcaagagggacctgggttgttcctgatggtagcaatgctcaacttctgtcaacaagaa

SEQ ID NO: 30410 - DNA, 1033 bp, Homo sapiens
ttagcccatttttcctgggcctttcgagttcaaagctggccttggggccccttttacagcaggagacttctttgttcacaccaggtccgtagcttctcctgcagctgcaattagacagggaagagaggtgggtaaagtgctgcacctccccctttccaaaacattttctaaagtttggctttattcaccgtggcctaacaaaggagcagaaaataatttcttaggctccaaggccttattctagccgcctgtttgatttctttagctgccttctacaagcagctcaaactcatgcccaaaagcaacttcattctctatttcttgtctcaatggtggtatctacaaaaaggccaaagtctttaatatggcatcactggcctttactcacttctccagaccaatcttctgctagtccccagtactcatgccctacacaccagcctcccagtgttgcttcttgctaacatgaaaggaaacagcataatgttgatgatggcccctgtttattgaaaatctaccacgagtgctctacatacattttctctaatcccataagcatcctcattctttttatccatgaggagacaactaaagtatacatatgtaacaaacctgcaggttgtgcacatgtaccctagaacttaaaatataatttaaaaaaaaaaaagaaaaagccaaaaaaaaagaagaagaagtaccactgctaggatttgaacccagatctagctgactcaagaaccatgccctatctctgtgtccatgttgtcaccacttaatcacttgtattttcccttcaggtttctctgtatgctgtgttctctcccaagagtggtcttccaactcacccctattaaggaagctttcccaagccaggagcttacctttccgtgcacacattgaatgatgatcatttgtcattctgtcttaccttacaaaagaggaccagctccttgaggataggaaccttgtccttatctccctgttcccctgtatgggggccagctcctggcaggtgcatagtaaataatgagtg

SEQ ID NO: 30411 - DNA, 1066 bp, Homo sapiens
tgcctggctccaacagagaaaggacatatttctttttgctggtatttgttctctaggaggagctggccaaaagaattcacatgtccactgctgcttctgcagagtggcaccctcagaccccaaggtccagccatcattcctctctcctcctgaaaagtctgtcatcccaactgtggctgaggggacagtattctggcagtggactccttctttaacacagaagggcactctgtgcttccctttttcctgggcccactgcacccctgcatccatggcatgtgggtgctaggaactggggttctgtagacgccaaagggtactcatcggctccacagccctccctcctcctgttaggaagcagtgggtccagctggatctgggctgcagtttcttccaacaggtacctgtccttgctccctgcttttcccactgagcctgggcagtaggagagctgactctagactttggcaaggagctctatgtcctgtgctctctctatattctctcattctcatctctactcttctgtcctgttttctcttctcctcctggcagatcccagaggctgcaggcgttcactccttgctgcacattcagctatctcatcctgaatactctttagacataaactcactctgttgccctcctcttaagcagcttcaatccctggccactctcccctgtggaccacagtgccttgcttggccagcgtttttagttccaggtgctggcatgccccacatgtgtgctggatacgtggtgcacactggagaagccacaagctgtacttctcccagagggtggctcaagaagtaacctcccttcatgccatctgtttccacccttcagctgtgccagcagcccccagcagctggagtctggatagcggagcccaagaggcccagcccttcctgtctgcccatatggggcgcatcctggcccccccagtgcctccccgaagcctgctgcatggtaagaagacctccagcgggtcccccgatagtccctggtctcagactctgctcaagggccacagcaacagccatctaagctgagaagatgggcc

SEQ ID NO: 30412 - DNA, 1055 bp, Homo sapiens
ggcccgcatggcctgggagcacggccgaggggagcagtgaggggcaacgaggcggctgggatgccgccctcagtaagcagcttgccaatcactccaggtctgaaaagcaagtcccccagccccaccccagggagccagagaggcttgcactcaggagagaaccacccccaagtctccgttctactgccgtgaactcatgtgttgccatgtacagaggccacagcagcatgaagggttgtggcttccctttttatttttttacatttccatttctatgggttttcctttctttcctttatgcagtagatgctttcttcctcctgcagttctggaccatgtggagctacatggagaaattgcacagacagaatcactttgccacactgcagggcccaggagtgggagcccaggccctccctccagggtagagatgcaccgaatggaaattgcactaaggacctcttcctttgctgtatggacagaagagttcatggttgcattcagggattgcaaggaccatatagacatgtcacaggtggaaaaagggccacaagccgttttgcacaaatgcctgcccacctgcccctcttccatccaggagtgtgctactgaggggctggctggaccaacctgctggctcaggcatgtgactggcctaactgcatgcccagggcactgccagggttcaatgggccagccgtctcctactccaccttggatttttctctccatcacatcatttctgaccatttgctcccttccattcttgaaacacctcatgccccacaggagccccagtggtgactggatctgcaagggttatctcccgccctctggggtttgagtggaggtatggagccagagaggctatcctagctaccttcctcctagggggagctggtccccttcctatgtggtagagagactggtgtaagagtgtggggtgtggcaggcgccggaaatcctcaaagctttcagaagcatccagaatgcctaccatcagctcctgaatcagggattttcagcactacctctgagccatggggttggctgcc

SEQ ID NO: 30413 - DNA, 1101 bp, Homo sapiens
aaaatcggtgatggaaaagctcacctctaatgattcatctccgtgtctcctattaaaattgctggcggagttcttttctggtggattggaacagcttggtgattgctgagcatctcccgtccctctcttttccagtttgtatttcttatctgggaagattttaccaggacctcaaagacagagatgtcacattctcaccagccactattgaaaacgaacttataaagttctgccgggaagcaagaggcaaagagaatcggttggtaagtagctggtgatcctccccaactggccctggctcatgttaaccctcggcttcaccagccgtttgataaaaggccttgcccacctctctgttcaggaagccagctactctctccataaactaatgtgagaagactgaagtgcttctatgtccttcccaaagcagcatgtgttctgcaactgtgatttttttttatcctgttagtctttattaagcacctactatgtgctaggcactgggaatatcaggggaaagaagtgacagtcggacacacaaataatgcaatgtctgggtgtcatgaagaaaatggaccagcaggtgctgatttagagtggccaagaagtctctgaggaagggttatcattgaagtggggtaagaccatcccatacagggaacagcagtgtgagtgcccagaggcctgaaagagtgtggcatgtatgtggacaggagaaggtgacagggtgcctacaggataggcaagggccgaatccaagacaaaagccctagtgaagcaatgggttttctaacttgaatttctctgacagtctctggcttttctctctgttaaaggtttgaaccctggtgacacttaaattcatttggtggctgtcagcttggactgagcatgtgttaagagtccagggtttacactggctgaatctgactaccagtacaggcagggcaccgaaaaatgccgctgtgggccaggtgcggtggctcatgcctgtcttcctagcactttgggaggccaaggtgggaggattgcttgaacttaggagtttgagatcagcctgggcaaagtggtgaaatcctgtctgcacaaaaaaatttttag

SEQ ID NO: 30414 - DNA, 1076 bp, Homo sapiens
agtgctggttgtcagtagtagttaatgtgtattattatataggacctctaatctcagtagtattaatagtaggaatgtggctgggtactgtggtgctgtgcaggattcaagtttccttgtctggtgaggaaggcagctgtctgcacctgttggcactctggacaggtgaggaaattttgaggttgtcttttttttttttttgagacggagtcttgctctgttgcccagtctggagtgcagtggtgcgatctcggctcactgcaagctccacctcccaggttcacgccattctcccgcctcagcctccctgggattacaggcctcccgagtagctgggactacaggcgcctgccaccacacccggctaattttttgtatttttagtagagatggggtttcatcgtgttagccaggatggtctcgatctactgacctcgtgatccgcccgtcttggcctcccaaagtgctggggttacaggtgtgagccaccgcgcctggccaaggttgtctttattcagtgccggtaggcaggagtccacactataaagtccaaggtcattcctggcagtagaaggttttttcctgacagtttgtatggggaagccaggaggtaactgtttggcatgttcttgtttggaaacagcgggctctcccattgatagaacactaaagtataccaggcagcattgtgttctatatggcccctgatcaggacatttctctggcattcttctgctggcaccagagacctggctttggtgtttttgccaggaattctccagatgcaggagagatttgtcattttctttaattggggctactttggtaaaatctagcactctgttcaggcatgtttttgatgaacagacttagttatagaactttcagttttattttttcccaataagacaggaaaaaaaaaaagtcccactaatattcaagagaaaaataagtagaggccagaagtgacttgaaataactggtctctaatttcttgcagtcttgctgtagtcaaatgccccctccattctgctggtctttaattccagataagagtaagtaatggccaggcgcgg

SEQ ID NO: 30415 - DNA, 1083 bp, Homo sapiens
ttgaagagcaatactttactagcataatttattttaccttccaaatcattttcttttttttctttttttttttttttgagatggagtctcgctctgtcacctaggctggagtgcagtggtgcagtctctgctcactacaagctccgcctcctgggatcacgccattctccttcctcagcctcctgtagtagctaggactacaggtgcccaccaccacgcctggctaattttttatattttttagtagagacagggtttcactgtgttagccaggctgcgatctcctgacctcatgatccacctgcctctgcctcccaaagtgctgggattacaggtgtgagccaccgtgcctggccccccaaatagttttcaaatctggcctttcctctggctttttaactggccttctattttcaatccccttttattccgccttccacatttcttccagcaaattttttttctaggccatgttttgaatacaatgtgctaaatactgagccaggtatctttattgtagaatttatattccttcaccacttgatcctcttaagaaaatttgaaggtagggaatatcttcattttacaagtgaggaaacaaactgtggtccaaagaatttaagtagcttgctgaagctcatgtagcaaaatgagctggtacttgttttcagtttgaaactgttcttttaagcattaacattctatgccacagagtgacctttataaaagacggatctgcttataccattctgctcttgcttggaggctaaaatcctatctccttagcaggtctccaggttgccctatgttcttggccctgttacttctccaggctcattttctactcttctcccatacttcctactttatgctttagtaatacagactgcttggatttccttgaaaacattctgctttcttgtctctgaatcattgttcatgaaattccctatctttttttaggtgagacagagttgctctgttacccaggctggagtgcagaaatgtgatctcggttcattgcaacctccacctcctgggttcaagtgattctcctgcctcagcctcccaagtagctgggat

SEQ ID NO: 30416 - DNA, 1026 bp, Homo sapiens
ctcagaaaatcagcggtggttgttattattattaacgagactctgtcgcctaggctggagtacagtggtgcagtctggacccactgcaacctccatctcctgggttcaagcgattctcctgcctcagtctaccaggttgctgggactacaggcacgcaccaccacaaccggctaatttttgtatttttagtagaaacggggtttcactgtgttggccaagctggtctcgaactcctggcctcaagtgatccacccacctcggcctcccaaagtgcagggattacaggcgtgaggcactgtgcctatttgcattataaaaggattcatatagaattcctgcacggtcttatttaaaagctttgatttgttgaaatgctacttccacagagcttttcaggatcatgtctggtgagtagtttgactagatagaatctttgtcacacagttcatactgaatgttcatgcggctatgaagggcaaaacatctcctctgtgcgcagcttgtatcggtctgggctcgaaagcacccagactgagctctgtggctctgtgatagagctctcaggagagggaggatcctcagagggcttgtactttgagaagagactggcaagggagaatggaggcagtggtgattggggaattggaaggatgagacactgagcatggcttggcttttttccaagcctcttcagtctcattgtctagcagataaacctgatctgcttttaagctgttctgaactcagggctgacttaggcttagggaagtctgaggaaagtggaccctccatgtccctgccatgtgggttcttgtttctgtagtctcccttctcttttcttttttttttttttgagtcagggttactctgtcacccaggctgaagtgcagtggtatgatcatgacccactggaaccttgaacacctgagctcaagtgatcctctggcctcagactataggtgggcactagcatgctggctaatttttaaatttttttgtagagatgaggtctcactatgttgccc

SEQ ID NO: 30417 - DNA, 1022 bp, Homo sapiens
tcggtaatgcccactgaggacctctgggagccatgtcagacgaatctgcctcagggagcgatccagacctggacccggacgtggagctggaggatgcggaagaggaggaggaggaggaggaggtggcagtggaggagtgtgacagggatgatgaagaagacctgctggatggtaagtgggctctattgagtgacagaagttgccttatattttcctccagtggaatttttgctgggagaccttggcgtttccagttagatttcttaggccatccatagtgggaagatacagactaggaactgagatgcaatgaattcagatgctcattcctaggaaatagattattgttcctccacataagctttgttttactgctggaagaacctttagcctttagcttgtctctgacagatgtttggactcaggtccagagattcgagtgttgcatacttgcccaggtcatggaggagtcaatggcagagttcctatggtaagactttgcagtctggaggccatgggctcttcaggtagatgtgagggtaactgtgagtggtctgtaagttttctgaaattatacatacaattgtgcttgtgtgtacatgagggaattgtccaggcagagattcttagacagattcacaacttcagaaagctcactgcatctcctgcagtgctgcgctacctcttggccattccagtgactataaattgcccctactgggagggcactacatctccatagctggtagatccccttttgatgccttctatttggtttgctcagctcactccttcctttgccctcagcttcttgaaatggcattgaacttttaatgttcagtctaatgttaggttatttggccagccacaaggcttctcaattaattccagccttttatggcataggatttagttgtttgtaagcttcctactgactgaggaatagggtttttgtctgttcataacagaccccctagtgggactgaacgttgcattagatcatctaattacttgaatctgaa

SEQ ID NO: 30418 - DNA, 1032 bp, Homo sapiens
tataggtaaattgcatgtctcaggagttcagttcatcttttttatacaataggagagagaagagatggaacccctggggaaagagtcctggaagtgtttgtaccttgtaccttcattgaatgtaacgtaggaatttttctttcaaagctactcatttgcctagtcaaatttatagtggtggtgttcataattcattcccaagaaacttatgtaagtgttctttggtgtttatataactcttgtggttactgctcacagctggctcacgtgaaggagaaagttcaggggtatttgcaactaggcctgattctgtaatcctgaactgtggtagtaatagtcattgacttttaaactatgcagatactaatttaatttacatttgttgtctgtcaaagcacatgtctctttacctccttattgaactttttttcttttctctcagtaactgttggtgggttatagtctagaatctggggaagggctattttttggaagttacattattttgcttaggttgtgaattcacttgattcagtgttcagaaggtaaaaaaaaaacaacacagtgaaaagttacattttgactgaaggaaatttaattatagaatttttgaaataacagattttttattaagaatagtttattaaaggtatagcatctattataatgttatgtaaaaaccataatcatcatgaaacagcaaaaatgaagcacttgaaagacatgtatttacatgacaatgaactttaaatattagcacatctgtaaactaaattcctttaataagctaaaagtagttgttgaacccagaagctgaggattcattcaaagaatgctgggtggtaaggaactggtttagacatgtatcatctgtataaggcatgagaattaaatatactgtgcctgatgattttaaaattgttactgcacttggccacattcagcctcatgtcagacaggagttcacagtgggccacaagccttataacttgggatgaatgtttgataataaatctgttggtgatattgaaa

SEQ ID NO: 30419 - DNA, 1049 bp, Homo sapiens
aagtgcttctctcaaaagttatctttaaaggtactggagacacctgtcttacttgctgagagaagcaagaaaaaggtaccattctgctgacttaccttaggctagtctaaagcagacccctcatttttccttgttgagatggcatatggagcgaaagctcagagaggcagcccaaattaaagtaagaacctcaagttcccctgtctctgtcatgcagtcagacttgacctgggacaggtcactctgcctcttagtgttagttttcatccttaaggtgagtttcttcttggttgttgaaccactctgcattattgcaaggctgcagtgcatgttgagatcctcaagagggaggtgtggcaggagtgcaaaaggctctgtttttatcttgtgctgacccctcctggccacactaccttgccgtttctgttctgtttgcctccataggagaggccacactgtgctgaagattcatctccctgccaaggaagaaaatgtgatccttgtgcggctctccaagatccagcgagatttgtatacacagttcatggatcgcttccgggactgtggtagcagcggttggctggggctgaacccccttaaggcattctgtgtgtgttgcaaggtgcattggggcctcagggaagattgagatggggactaaggatacacatggtcccaagggagttactcctactgagagtcttcaataaagggagaataaagtgagagggggccacctcagttcactgcactggaggtttgggggctccaaggagagaggtgatggttttgtaccacataactcctgggggtgccattcacacagtgtaatataactgatgccccctgcagtgtgcaactcagctgcacaacttgttattccaaggggattaatggaaaaatactgtggggcagcgtttttgactgctagcataatcagaattcaagagatatatagcttagacaagttattaggggtaccttccattggattccatacttaatcagattgagacctctctcattcttttcttgagggacctgtttca

SEQ ID NO: 30420 - DNA, 1075 bp, Homo sapiens
tcatgggaaattggagtgctaccaggtccatggtttttgctttttttttttttttttttttttttttttttttttaaagaaaataacctgaaaacacttctgacttttccactgtctctttatatgtgctgataggcaaatgtgcatgcacaccaaacataagcatgtttgtgagggaagcaggaagtatctcagagcctaagaaccatgttttatagtttctttgatcataaacacttggtggtgtcttccacccattatccaggcctgaggggggcagggtggctggtgataagagggagggcagaaaatcaggcctaggcgttttcccttaccattgtcttccatggaatgttttcaagggcctctcaagccccattcatctggtttagccaagttctcagcctggggaacacagtactacttaatgattgaggtttaccatttatagtgatgcttgatttccttttcttaatatatttgtagataaaaattgaacagggacaaagtagctatttaagaaaggaagtgaaccatgttgggtcatatcattttctttagattggatatctatgaagtccacacccctttgagttatgctttttaggcatctatctcatcatctcctgatttaaggataattctgtctggtccttggagctctcttccctaggaattagtgtgtggagtctctatatgcttgtgatccttggagctctcttccctaggaattagtgtgtggagtctctatatgcttgtgattcacaactaaatatgaaatttctcaattcaggagcaggaagcaaagtgctggggtacagttttgcagattggttgaaacacttagccaaacttaagtggcctgggtaggaccatcactcccaaagttgtcagcagagaagggccctctgtgtgagtctattcaaacctggcattgctctgaaattgagtcctcatcccatggggaaggtcttctgggggctttacattccttgttactagtgttctggatattaccttctgcttcccacttccttttttttttttttgagacagagtcttgctctgtcaccca

SEQ ID NO: 30421 - DNA, 1027 bp, Homo sapiens
ccatcaggacatcccaaccttctgggcacttgacagccttagtaggccttttccctggaggcgggtctgggctttactgggaggccaggaaagctttcctctgccactggatcagccttgccactccctaggttattttagggcctgtcccatttcctccttgctggtgccttgttcagctgcttcccagcttcaactttgcatggggccacttagtgggtggtaggcttgctgagagaccttctaggctcctccttaggccagggcaggggaggaggtaggaagtgttcttacttgtggaattagggagttgcttagccaggaaaggagctgctgtgccccacacacctcctggatcctgggagccctgtcttcttagctcccttcttccactttgacaggagctctgccttttctccaggtggagggagaggaagtttgttatggtgcagggcttgcttgtgtgtgcatgcatgtactgtcactgagcatgcctcaagaactttctgtgtgcgcaggatcctggacctttttgcctagaggcctggagtgatggagagagatggggaggccatcagttacagtgcagcacaacacctgctccctggtgggtacttgggatcagagaggaggggctgcttggtggagagcaacagaaggctttgaaggggaaagttgagctgagtcttgcaggatgggcaggagtttcccagtcagaagggactctggaatagggtgaagaaggacatttcaggcagaggaagtagcttacgcaaaggcaggaagcatgggaggatgtggcatgtttggggagctgcaaatagtttcatgtgggtgtgtgtgggggtgtggcgggtgaggaggctggcaaggcgggctgggccagagcctggatctgtccctccctctgccatgcagacactcagttggtgcctgcccacctgggctctggcccctgctggggcctgaggctgcagaaagggagtgcaaggtgagtgtgtgggcaaattcatgcagtattatgtgg

SEQ ID NO: 30422 - DNA, 1044 bp, Homo sapiens
cctgccagccgtggcaccgctgccccgggtgctgggaccccatcccccactgtcccagtcacccgccgccttgaggtcagcgtttatcctccagatcttttgcctagacggccgcctcagtttccccctttcggccccttccggctattcccggttgaacccgccgctttagaattcccttctcatacccctcccgtcattctcgagacctcgaccgcgggtcacctctgacccccactgccggaggactgccttctttctccagactcaactccctcgactttataagcccctgcgcgtccccagtgaggcccaaggcgctggccctcatacccctaccctcatttgtgcccctcctttctcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctagatgtaagccaagatgtcttatctgcactgtgcatctccctaagaaacctctggcctcccaaacctgttcttgacctttccctcatccttccgcccccttgattatgtactgtcagtattcatttggtgaagttgctttgcaggtgcctttgtgtagcgctggagaatgaagaagttggtgacccgggtaaagtgtggtcaccattccttagctcacatcagtgctgtccttaggcatttttgagggagaagtgttagtattccagggtaccctttatataaactgcggttgacacctgaatccagtgagcttgcagtgatatttgcctgattattaacaactgttgatgtcactcttcatcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatga

SEQ ID NO: 30423 - DNA, 1031 bp, Homo sapiens
actcaggaggctaaggtaggaagattgcttaagcccaagacttcaaggttcagtgagctatgatcacgctattgcactccagcctgaatgacagacagagactcagtttctaggaaaaacaaaaaaatgtatggtgagttgaggcttgaaagccatatcccttgcttgcgtgagcaggtgcttttggttgtggtgactacaggtgctgttggtagcctgccttctgtcctttaatacttaccgtctacacatggcactgagccaaacacgacatacagtcttatttacttacaagatgaggacatcaaataacctgcccaggatctccctcagttgccaagctgagacttgttgtatttcaccaaaatgcagctgtgtttcacaaccaccattctgtactgtcttttgttcaatttttagctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatgtaagtagcccttggctttcaaatattactgttgttatttggcaagccaatgatgatgtataggggttggatcttttatggagggaacattcagtagctgaaagtgtgccatagcaaaatactattcttagcttctgaaaaatatctacagattacttttaaaggaactctaatatgcaggtagctgctggagccccttaacttgtgagggttcaagcttataggctcaatgaccacacacgtcagtccactttctatcactctgcaagtgagtgtgcctttaacaccaggcagtctttcacagagacatccttggttgtggctgtgagtggagaaatacgaatctagcagcgctagagaaaaagctactccaaaagacatgttaaaa

SEQ ID NO: 30424 - DNA, 1021 bp, Homo sapiens
ggccacaggccctgggctggctgaggggaaggacagcaagggggcccacatcaaaagaggaaagggcttattcaagaccaccagcctgtcgaggtcaagtcaggcctttgacctgggtctctgaccacttggtcaacgccttctgcatcctcccctgcagcacaggcacaccagtcttgggctgtggtcaggggccctcgctgacgcccactggatgaccccagggaggggcgggcccccaccctcctctattacctccagcccacccaagtgaagcccaggggacaccagtgcccatccccctgaagagatttcagccaattagcacgtacagtatttacttaattagggtaatgacataattagtgtaactcgggctccatcacatggcttcaacatgcaattaggagctgtcagcgggaggcgacattgtgagagcgctcattcaattttggttccagcatggaggcctagcagctgcctctgcttggagggagggagatgggtggatggtggcggctgctgtgtgtgtgaggtgactgcaggcagcccatagcctaggagagaagagtaagtggggacagaaaggcagtttcctgggctaatggagtccctgactgagcctactcacatcctcaacagacattgccacccttgaccccagccccagggcaaggcagaggcggtggcttggctggagtgtctgcgattagggggctgagcactgcaggctcctctgcccccaagttctctgcctgaaatgccaccattagcaggctgtcttgtctctctttagggctttgctgttcataagagccaccatctgatacccactggccagtaggctattcttcgtggccccaggaggccacagactggcaggactgggatgatccctgttatcctcattggattcatggggaaagtggggcttaggtcaaggaaggtggtagagccagtcatggcagtgccaaccccaagagggagcctgttatggctggagactccccaagcctgggca

SEQ ID NO: 30425 - DNA, 1050 bp, Homo sapiens
gagtacctgtgtgaatgccaacaagaaaaataaaaccacagtttggattcaggaaaggttgcaccaccatcaggtcttgaagggtgagtaggagtccgccagatgcaggagtggatggagacaggttctagacagaggaagcagaagcctgtgcaagggctgaaccactgtctccaggcatagattacaccctgcctctaggttcctcatggcctggcctctccatctttcccactcaatacactttatggtggggatagggtccagttcagttccagacacttagtgcccagcaacaggcctggcaccaagccagcacgactaaaatgccaagtaaaattcaacatcagggcctatgacctcccctagtactaaccgtctcagcaagtctgtttccccatctgtgaaatggggccagttttgagaaggctgtgggcaggggttctcaggtacagatggggtgatgtttttcttttggttcttttggtttgtaaaccacttctttcccttacagaaaaaattggaagactagtacatggacatctgtgaccttcagattccctaattgttatattgcagcacttttgctttatctcctctttgtctttttatctagctatgcttacctatatgtataatttttgctgaaccatttgaaaggaaattgtagcggacattctgacgtgtttcttcaaacacttcaggccacgtcaactaaggacagtctgatacaaccacagtagcattatcacatctaagaaaattaacaataattcaatattcagaatagggcaggaagatcaaaacctgaacccatgccaggtgctgagagcagatgaggggcatcagagggtgggcgcccgagccgaggggtgtcgggcgcatccgctgcccagcggaagcggcggcctgagtggagtcaccgtgcaatgggtgggtgtggctttgtgagccaagccccaggagaaccagaacccaccttttcctcagtgccctgaccagctgtcccgcagctgtggcttaaatgccaacttccagttcgtaaatttc

SEQ ID NO: 30426 - DNA, 1050 bp, Homo sapiens
ccctcgagggaagggaccaggccgcattcccctgtttcccctagtgcctcccagggcctggcacagtcctgacactgctgactgtgacccccatcccatgaggaagaaatggatgagtgcgtgagtttgcgctgatgggagaagacaagagatacatcctgaatggggaatttggaggcagaagggggaaatggctcattttgaagatgtctcacccttggactcatgtttcagagagtattttaggactctcacactcaagacccattgaatctcagagaatcctggggtcatggacccagaagtccttccaggaaggaggctggtttgtctcccaggcaccgagtgtttcctgtcactgcaggctttgctggcgtgggtgtgttcctccctttggaagagcagctcccccggctcctttggaggcttgggcgtcctgtggggatgtgggacttctctggagggcaggcatccctgtatcctctttgttccctggagtatcacagatgacagcaccatctagaaatctccctgtagacactggctttggtgtccagtgctctgcccaacatgctggtggggtgaaatgtcccagtcattgggacaaaccccagcttggaccctgacagtccatatcacacccctccctgcccctcccctccccaggaggttctggaggagtggctgaactgtcagcggtcctggctctacctggagcccatctttagctctgaggacatcaaccagcagctgcctgtggagagcaagcgctaccagaccatggagcggatctggaagaagatcatgaagaatgcctacgagaaccgggaggcaagctcaatgagggtgggaggggcagctgggatccccaagggccctggtcacattgctggtagcctcctagtctcttccctccctacacagaaaaggctggtggacaagcctgaggatttgatcttgaaccatgtcctccagagtgggctccccagcctcagagttgctccttagaggcacagtcactgacggtttttctcttggagatccacagcc

SEQ ID NO: 30427 - DNA, 1030 bp, Homo sapiens
agtgcactcctgggtgccggcgctcccacacacccttctttccaaaatgctccccacccccaatcagagcaactatcccacatggttttggaaatgcactcaactcttcccaaatagaaatgacccaaagtcaagcccagcctcttcatgcagctccaagtccgagatttctggaacatatgctagtctatgggttgggtctagatggagtcctcttggttgggcaccatggggcagaatgattaatttaactatttccaactcacttactgtgtaatgaagagaaacaggctgggggaaaaagcatggtggtgtggccagaaagacgggtctggagagatgttatgggagaatgttagaaggaagctcaagggccatcaaggccaagctgattgttgcacagatgggaaactccttcattcacttttccagcacaactagagggccctcctgcccctggccatgtgctgggacagtgaccaaaggatgcagaatgggtatcggataaaggagggggctatcgggacagtaaagtgcagggtgcccggggagcccaaagaaggtgcacctgcccaggctgggcatgtaggtggtcccagcaggtctgcaagggaagtgctatgagctggtgatgagacttggccaactgccaggtgggaggcagagtgttccaggcagaagccttggagagggacagtgctcacccatgcctccttctgtatggcgacaggatcactatgacttcgggatgagagccgtgaaaactgtgatctcggctgctgggaacctcaagcgagaaaaccccagcatgaatgaggtgagctccacccagcagggctccaggagtggaactctgggagggctcctgggcagctggagggcagctggcccactgccctgaaggctcagccggcacctgctgcaggagctgatctgcctccgggccatccgtgatgtgaacgtgcccaagttcctgcaggaggacctcaagctcttctctggcatcgtgtccgacctgtttcccaccatc

SEQ ID NO: 30428 - DNA, 1062 bp, Homo sapiens
ggaggaagcgtcctggggtgcccgtccactgtgtcggggaccgtgtttggggtccagccccctacagtaacatcgggtgttcttttctttcacaagaaactgatcccaaagattgagttcctggacctgagtcacaatggattgctggttgtggacaatctgcaggtagtgcctttggagaccagtgctgcccgcacacactcccaaggccccgccctgagatttcaggagactgacgcagccttgggaattggccaggggttgtaagggcaggggttgctgtcttcgctttaggatcccagcaatgcactgagtgattgttgctctagttccaaagaattaggaagcatgagtaaatacaaaccaggcatgatgatgcacctccgtcctgaaggtggacagccatgttttcaacgcccaccccaactgtctgcaggggtgccactgtgctgtggcatgtgcggcagagaagagggacttcccttcctaaaataactgtcagagtgacttgcagaactgggtagtttgggttggaaggcccatcctgccattagtgtcaggcccctatctttggagacttgacctgagccactttacgctgttctccacgccgctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacaggtgagcccaaggacctcacagttttgggatttctgtgccttggtgtgtatcatgttaaagaagaatgttaagattcctttcatttaaaagagaccatgaaacgtgttggcgtgttgctgaagtgttaagagaagggaccaaaggggatggaactcataccttgcagatggaggaggtccggagcataggcagcctcccgtgtctggagcacgtgtctctgctgaacaaccctctgagcatcatccccgactaccgga

SEQ ID NO: 30429 - DNA, 1090 bp, Homo sapiens
ggttttttagcgcgtgggagcagctttgctgacccatgcctgttgcttccagcctgattcccgagaagggagcctgcttgcgaaggaactggcactcgggcctgcctgaagggggcgctgtccagacaacacccagcctcccgtcgtggcaggcgctgtcggagccatggatgattgtgaccaataggggtggtcgccagagttgattgtccagccaggcccaggggctgagaggaggctgtgtggagaggtggttaggagccagggctcggtcagctgagttcgcatgccagcttcctagctgtgggacctcaagcaacttgtagcccctctgaagctgttttctcaactgtgaagtggacgcaccctacttcattgattctaagaggcacgcatttccaccttgtgacttctctgaaactgaggtgcgtctttcagtcagtggcgtctcatagtcgctgtcagccagctggtattcgagatggagtcgtggaaaacccgtggacaccttccgctaggaccaagatggcgccacctgccgcatcttagatttgatgaaatgtggtaaataacgagaggcatgcatgagcgaatgctggggaggcgcttggcactacccagagctccacagaggtggtcgatgagggctgccctttcccacatccttagtagggggttcaagatgacccagactgtgcccctggggagcttggagccatgcgggaggatgagccatgtgctggaggagaacagggtaggatggtgtggggcttttgtagactgtctagagcagagaaggtctgcagtggaggtggtgtctgaggtgaatctcgaaggtgaataggagttgaacgttagcaggcagagggtggattgcaggagagcagcggcctgggcaggtgcccagcgtggcccatcagggtgcttcatgcatggctgtgtgcttgccatccttcctgcctgcctaccccctgctgcttcgcttcgtgggggcgtttgagcttgggcccacctgcctgcctcgcttgtgggcagaggacccaggctgtgtgagttgtcctgtcccggggagcagctgagctggtcgggg

SEQ ID NO: 30430 - DNA, 1024 bp, Homo sapiens
aggtggcgagtcaaaggtctggcaaagcagcagctggaacaaggaaactgatctcctctccccacctgaaggtttctggatatgggagagggagcatcagagagccaagaggcaagaagtgcctttgaggagccaggttttagttaagaaggatgacttcagagcacagaatagaaattatgggggagaaggaagtgagggacatcttaaaacactaagagatgtgctaagacatgattctatctttcaagacactgacttttaccctatttaagtctagaactccattatcatagtcctcatctaactcaagttttgttttaagtttattttggcattgagttaaatattaatgccaagattcagaagtaggtgacagacctagactattggttaaattattcagattgttttaattttaaatatgtttcttaaacatctgagcaactttttgtttgatacagatgatgtctaccgtagaaaagcctcagaaagacagtatcagagaaggctggaagatgaatgagactgaacttcagcagtcaataaagtcaatatgaatttttactattggtttcagtgccttttaaaatatacttttcagatctcttgttctgacacagcttgtcctttatcagctgcacaatattccaataactgtttttgcaaagaatttttatagttctgtctctgcttgagtacttcccaagtcactgctggacagcacttgtgggaaaattatttcctcctaaaacactcactcgatgaatctagtccatgaaatatttcttaaacaattcaaggatcaatcaggatgcttttcagtgaagcccgaattgttttcggcaatctttgtttttaggcaactaattataaccttatttacttttttgcagaattcaaattaaattatggacacattctctattgccagatcatttaaaccaggataattatgcaggttgtatttctgccagctactagactataaactttttgctagggtggtggaaattcttgattg

SEQ ID NO: 30431 - DNA, 1042 bp, Homo sapiens
gcctcccaagtagctgggattacagacaccagacaccacgcccagctaatttttgtatttttagtagagatgggatttcaccatgttggccaggatggtcttgatctcctgacctcaagtgatctgcccgcttcagcctcccaaagtgctgggattacaggcgtgagccaccgctcctggccctcatctggctaatttttaatttttttgtagagacggggttttgccatgttgtccaggctggtctcaaactcctgaactcaatcgatctgtccacttcagcctcccaaagtgggagccaccgtgcctggccaataatttttaatttacccaatgcatctatactaatgtccaaatgcctgaaaaacaaaacaaaacaaaacaaaacaacaaacaaaaaacaatgtacttaaaaagatggcagtgatgtttatgagaaaactaggctttgaaatttggcaaaaaaaaccacaacaacacttttaggcagggcgctgtgactcatgcctataatcccagctctttgggaggctgaggtgaatagatcacctgaggtcaggagttcgagaccagcctggccaaaacggcgaaaccccatctctactaaagataaaaaaattagctgggcgtggtgctgagcacctgtaattccagctgctcaggaggctaagacacaagaatcgcttgaacctgggggtcggaggttgcagtaagtcgagattgtaccactgcactccagcctgggcgacagagtgagactgtctcaaaaaaaaaaaaacaacccaaaaaccattttcaggccaggcacagtggctcacgcctgtaatcccagcactttgagaggccgaggcaggtggatcacttgaggtcaagagtttgagaccagcctggctgatatggtgaaaccccatctctactaaaaatataaacattagccaggtgtggtggcatgtgcctgtaatcccagctactggggaggctgaggcagaagaatcagttgaacctggaaggcggagactgcagtgagccaagatcgcgccac

SEQ ID NO: 30432 - DNA, 1027 bp, Homo sapiens
ccgcctgcagccccggccgcggtcaccgaccgccgcgccccgccccgtggccgccacggctgctgctattgctcctccggccgcggccgctgccgtcgcttcggcacccgccgccctcacctcccttacccctcccggtgccgccgcaaaaccagtcccgcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgatgtgtttgtgcttccttctacagccaatatgaaaaggcctagtaagtggggtcgggaggcgggcgtggagggacccacgtctggaagttgctgcagccaccacgacgctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaa

SEQ ID NO: 30433 - DNA, 4858 bp, Homo sapiens
acttacatatgcattactttgtaagattccaattaaagctccattttcctaggacattttataggcataactaaattgcagccagattggtttctcacttgaattctgcttaagtataaagatatttttgtaagcagacaaaatctctttattttaataggttcgagaacatcatcgaaaattaagaaaggaggctaaaaagcggggtcacaagaagcctaggaaagacccaggagttccaaacagtgctccctttaaggaggctcttcttagggaagctgagctaaggaaacagagggtaagttatgttagccagaattttcattgagtggtgtagtgtgttatgtgtgatatttttcagagtaaggtaacaacactagtcactggttcacctatttcccttatggctctgacagcttgaagaactaaaacagcagcagaaacttgacaggcagaaggaactagaaaagaaaagaaaacttgaaactaatcctgatattaagccatcaaatgtggaacctatggaaaaggtatgattaggtctctttatgaatgagagatcaggggttttgattttggtttttttgcttgggcctgagtgcagtggcacaatcacaactcactgcaacctggaccacccaggctcaagcagtcttaccacctcagtctccaagtagctgggactacagaagcacaccatcacgcctggctaattttttttagcagacacgggctttcactatattgccaaggctggtctcaagtgatccacccaactcagcctcccgaagtttctggtattacaggtgtgggctgttgtgcctggctgagagatgagttctgatgcagaaataaaagcacatccacaggctgctgagcttcttgggaggaagacaactgagttcagactccatcttacctatttaacaactgcaagggctgctactcagctgtggaaaatggagttagaggttacagttgctctacttctaattttgtgttatttccccctttatcctctaggagtttgggctttgcaaaactgagaacaaagccaagtcgggcaaacagaattcaaagaagctgtactgccaagaacttaaaaaggtatcttagcctaggtcagtgtctgacagtagtaatgaggtttaaaagactcaagtcattttttttttaaccttttaagatgaagggtgcatgtgcaggtttgttatatgggtaaacttgcgtcataggggtttgctgtacagattatttcatcacccaggtattaagcctagtacgacattagttatctttcctgatcctctccctcctcccaccttttcaccaacaaatcatttcgtgactcgactctagcttatgctgtttaatgcctttcctgctatgtttacctgacggaaatagtttctttggttctaaatatttgcacaaaactggttctgcctgtaagcatgatttacaacattaaaaaaaaacgttgacatagtgttgagattgagaaaggtacattggagtaagcagtgtcaggctaaaggtctctaaagtactctgttgaaacctaagtgaaggaggacaacttggtgtagttgctctccagcactcccatccccaacatccattttcccaagctcactcccccatggatagaacctgactgcccctcagcagcttttggcaaggccagaaggacctatcaaactatataattcactatgggaggattcagacagggatatttgcatttttgaaatccatcttgatcagagactgctgagcaagcctatgttttactttcctgtgtgagaaatgatgagggtcaacattcttcataccaaagtgaagacatgagatccaactctgagctcaccctgttgctaaatggataatgccagtactctcttgtggaaggtattaccagaacaagggatgtagttctgatcattttctccttgataatgtagttctggtcattttttccttgataggtgattgaagcctccgatgttgtcctagaggtgttggatgccagagatcctcttggttgcagatgtcctcaggtagaagaggccattgtccagagtggacagaaaaagctggtacttatattaaataaatcaggtgagtaaagagggtaccctttgtcttctgtgtacatgggtgaggtacgaggaaacagtctgatagtcactgaagactgattagatccaactctgatctcagcaaagccagagtacgtgcactttgccagagacagtgctaggcagtggggagccaggtgacttttacaactgactcaactggtttctactattcttttgccattcagtatttaccatcttttaaataaagagtgtaagctgctatacccagcttattgtgtagtatatttcatctaggaagtgatgacagtgtgacaaattccccacacctacacaatgtcgggtattagttcaagagtgaaataaattggaacgtatgtgacaaaatatttaaatgaaatgcataattatgcatctgagtttgagcagcaggaaaaagaaaacccagaacagagaattacaaagcagaaaatgggaatgagatctaaaattgttgttggggttaagaaacaattggctgcttgggaggctgaagtgggcacatcacttgaggccaggagttcgagaaaagcctggccaacacggcgaaaccccatctctactaaaatacaaatattagccgggcatgatgatgggcacttgtagtcccagctactcggaaggctgaggcaggagaattgcttgaacccgggaggcggaggttgcagtgagccgatactgtgccactgcactccagcctgggcaacaacacttcgtctcaaaaatgaagaaacaattggctgctagctaaaggtaaattctggaaacatagctctagggttagtagggttgtaatccagacgttgagtctgtcctgaagttttcaagtgagcaatacaaggggaattgaaatagagaagtgcagatgctgagctctgttaagatacgggcagtatggtaggggagcttaccctgccctgattttctagttaaatccttttgaaaggactgggaaaatgtaaaccagagtaaaatctatagttgccagattttgcaaatgcatctcaacaaaatagccacattggagcaaatgtctttttctttttttctttttgagatggaggcttgctgtgtcacccaggctggagtgcagtggcgccatctcagctcactgcaagctccacctcccgggttcacgccgttctcctgcctcagcctcccgagtagctgggactacaggtgcccaccaccacgcccagctaatttttttgtatttttagtagagacggggttttatcgtgttagccaggatggtcttgatctcctgaactcgtgatccgcctgtctcggcctcccaaagtgctgggattacaggcgtgagccaccgtgcctggccgcaaatgtcttatttctaattgctatcagatctggtaccaaaggagaatttggagagctggctaaattatttgaagaaagaattgccaacagtggtgttcagagcctcaacaaaaccaaaggataaagggaagataaccaaggtatcctttattagtggtaagaaatgtgattctttcagattttggttgaaatatgatgagtgtacaaaatcttgatttaagtgaatgaaaaattacaagatccaactctgatttcagccagagatcatctgaaaggcaatgtagttatcttaagagctgggctctggagcctgattgcttggggtttgttgaaatttatcaggtaagttgccagaataattcaactatttggaattttagcgtgtgaaggcaaagaagaatgctgctccattcagaagtgaagtctgctttgggaaagagggcctttggaaacttcttggaggttttcaggaaacttgcagcaaagccattcgggttggagtaattggtgagtttcagttcattactttttactttttaagtgttgaaatagttaagaagtttagccagctctccaagtgcccaagcagcagtgtatggagttgttgtcaagtaaaaggctcactcaaatactagcttcttgcttataccttactgaaagcacataaccacacacaatttaaagaaaaaaacttacacaactgctgccagattcaggttttttgttgggactgattactgtaggaagctggtttctaaaagttcttggtttgtttgaatttatagtattttcctgcctttgcattacttgtgcaagaaatgaagaaactaaaattggtcttagtattgaagtgaagacactgagatccaactctgatcttgccctaaacatcagggaaatggaaaattaggcagtgaaaatttcataagtgccaacatataatgctttttatatctggatttcccatttatttgtaggtttcccaaatgtggggaaaagcagcattatcaatagcttaaaacaagaacagatgtgtaatgttggtgtatccatggggcttacaaggtaaatggaggtgtccataattgtaatattatagtgacacactattttattttggttatctcaaggaaggtgattttttttttttttttttttgagacagtttcactcttgttcccaggctggagggcaatggcgcaatctcggctcactgcaacctccacctctcaggttcaagtgattctcctgcctcagcctccagagtagctgggattacaggcatgtgcccccacgcccggctaattttgtatttttaatagagacgggtttctccatgttggttaggctggtctcaaactcctgacttcagctgatct

SEQ ID NO: 30434 - DNA, 1001 bp, Homo sapiens
ccgcctaggcctcacaaagtgttgggattacacttgtgttgggtggcatgagccactgtgcctggccaacttttagattttttttttttgggagatggagtctgtctcccaggctggagtacagtggtgctatcttggctcactgcaacctcagcctcctgagtagctgggatcaaaggcacccggctaatttttgtatttttagtagagacagggctttcatcatgttggccaggctggtctcaaactcctgacctcaggtgatccacccacctcggcctcccaaagtgctgggattacaggcgtgagccaccgcgcccagccagaaggtggcatatttatagcaaaggaaatagcatgtgttttggttgatgtaaatatataagctataacatgtagtgttctctttagaacagtcgggtatgctgttacagttttagataaatgtgaagcaaatgatgataaactggatctgactgactgtgctgagtctgttcaatccaaccctgagcttcatgttctgtctcttaacctccaaatagaccaatgcccccatcaattccatcgctcttctttcaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtaaaaggaccccttctcatgagctccttggagccatcttctttcatcataagcattttgagtagaaaaatcttggaagtgttttaaagtactggcatgtcagatgaaggacagctcctttgtttggttttttttttaaggtagtactgaaatatactgtcccaggctacaggaattctctggaattttttactgtgcttgctcagagaagaggtatgcaccaaaaaggtggaatcccaaatgttga

SEQ ID NO: 30435 - DNA, 1058 bp, Homo sapiens
ctgaccaacatggtgaaaccctgtctctactaaaaaatacaaaagttagctgggcatggtggtggatgcctgtaatctcagctactcaggaggctgaggcaggagaattgcttgaacccgggaggcggaggttgcagtgagctgagatcatgccactgcactccagcctgtgtgacagaatgagactgtgtctcaaaaaaaaaaaaaaaaaaaaaaaaaaaggtgggagcgagctgcatgctgccatatgcttgtccacgcctagaattgctctaaggagagcctcatgattgagctcagtggaaggtagactttgtactgtttgccatttctagttcccatatgcattaagtatatactcaaatgactaattactaaatatagacatggtctctgcctgtgggaagtagacaaacctgaacctgggggtcacttctgctgctgactgctaggggaccctgggcgagtgacatcacctgtttgagccccatttgggcttcaggaagtagggcagtgtatgcccagcgtttagcacacagtaggggacttgcaagaagcacctgtttttaggatctctttctccttctgcttccttttctgtttctcattcccttgtacccttggggacagtcctggactaatacggctgaaaattaggacatggggggcagggttggaaggagaagaaatgtcccctgctgactcttacctgtcccctgtccttagggacctcaaactggacaatgtgctgctggaccgggatggccacatcaagattgccgactttgggatgtgcaaagagaacatattcggggagagccgggccagcaccttctgcggcacccctgactatatcgcccctgaggtgagccgatacccttccagccccccgctcagtcaggcaccttgcctccccacggtgggccagggaaggattcccaagggcagtgatgtccaagccaaagcccataggctgaggcggcctggctaggcttcgtgcccaggggcccctctcagcctcagcacctcagctcctgctgacctgctgctctccccac

SEQ ID NO: 30436 - DNA, 1179 bp, Homo sapiens
tgttggctttcatagcagagcagtctaggaaattttgtactctggttccagggctcagagtagcaagagtgctgggacctgtctgagaagcagtgctgggctgtggatgcttgcctgtggcaccagatgccttacagtggccaggaatgctgcgggacagtctactttgattgctttctttcctccatggctgagatctgagtgtagtgttaactgggcttaaaaatcaagtccgttgtatctgcatggtcacgtagttcggcatctcatggcttttgcacctagaggtgtgaaccataatacctgaaacacaatttcataacctggctccttgggcttagcctatatggtggaggttaggtctgtatatcatcaagactgtgtctttgcatggttgtcattctgttggaattgaactttcttatttctgtaggcctaggttctgtctattcttctcagacagctcatatgctgcttcttcccttcagccttctctgatacttgtccactccccgcctgcctacatctgagtacttgctttccctctggacacccctgtgcccagtccaactctcctgtacagacaccagcccctttcccctggtttataactgttgtgggaagtggcgtggagtgtgatggtctgctcatgggctgtggggtctgacagcctgactctttggctgattagctgagtgactttggatggaactagaatatgagttcctagaggctgagactgcagtctgatttgggtgtatagccttgtgaacttaatcctgtgcctggcacacaggaagcacatcaggaaatgcacgtcaaatgagtgaataaataaatgaatgaccatacaaggactccatggtatattcttgtagatcattagttaattatcaacaattggctaatgattaatgtttgcctgagaggctgactttttgtccattagtaatgacatcccaggaaacacctggcagagttcgtctttaatttcaggagtatatctttctttcttggcaaatttaactattaaagagagaagaaagacaagtacttgatactttttgaatctgtaagttataaacctgtcttctgtattcaatgttgtatattagccacattgcagatgattctatttggatggatgtgtgactgtcacctttcacataaaaattgatt

SEQ ID NO: 30437 - DNA, 1045 bp, Homo sapiens
cctttctgatattgaattcactagctttgctttgcttttgtcatgtttgcagcttgacaattgtgtaattatttccagctgtttatggctttgttatcatttcttgctgctgcctggcattttgtaatctgatgcgagggaaaggtgaggtgttgcttggcattgcgttccagggtgggtgtccaccctagtccttggtttggaatcgtctgctctgggggtcctgaaatactcacggctttgggttacttggcagagactttcataagtggtgggggagcatgttagacaacttggggagcatttttcagctatgttttggctgttttggtccactatccccgcaaatgcttttgtatttttaaaattagcaaagaacattggtttagagagttcagagtatgaatgggagtagatctgagtgctcagagtgtaggagacataacatcatttggaaaaacaagtggataattgcttctcttttgctaattttcaagtttctgtccatttgcatgaggaattactcctctaagtcagagctctgtgcaccctgccatcatatcactgtgtccttaacaattaagatgctttcaaaatgagttagaaaatttggctggaaaatgcattaacactgtattaaggggactcaaagatgacaatactatgttgtataatagagtgtaattgctctttttaaggcatggatttttaaacttgattttcagttaagtaaggtgtgctgtataccaccatataattttatgtattttatgtagtttcactaattgacacttcatgttgtgaatcaatatagtgtgttcatttttagaatggaagtttagtcatttttgcactaaaacatacactttacaaagtagttattatgaatataagttaaataataattggccatgcatctattttaaggtgtttagtgactgggaaaactgccattttggtaacatgtttttattaggtgatataatttgaggtagcagtattgttactgacttcatcaatgtaaacacaaacatttagcaatgta

SEQ ID NO: 30438 - DNA, 1035 bp, Homo sapiens
taatgtgtgtctctgccagtaacgctggaacagaattgacatttaccttggacgcctcatggagcacttaccaaacacgcacatcttggaatgcacaatctgttttttacattatcaactatttattgagagggcagccttaatatataaagttgatatctctttccacaggacagagtcagcaaagtaaaaggttggtgctttaagccatttttataattatgacttttcatcaatgtgaaaatcggtggacttttaaataactgaataggtgtattcacttatcaggaattaggtagcagtgccttgctgctcgtgggaagcccagcactcttcagattgctcttgtgggggaggcgctgttttgctaacattttgtgttgaataaacacagttatttgccatcctgaatgataaatgcgttcaacctatgctgcggatgctttaattcatagcattactttaaatactggacttttccttagcaggttatttttaaaagcttgaaatctctgaagtgacagtttttaatcattcagggcagtttattggtctcattaacacaatcacccagacagtagcagagcagggcaaaccaatgagcattcagtttgtgcctcttatgcatatagctcattgcacttgtagagttactcatgaccacttgctaactttcggtctgagccttttttgctcattttttttttcttttcctttaacttgttttttttctccttaaaatttcttttctgccagatacatttctactttgccttttctcccattaggaactgctgcggcctgtgttgctcaggagaccaacagatgctactcaaaattaagggaaaatgaaaatataggcatggttttctggttggaggcaaacttcaaatttttaattcccatgtggttataattttgattgattagcatggtgatcgcatgctgattttaattaattaattctaacactactgcaatttttaggcaaacacatgaataccaaaccacctgataattctgaaatccattggg

SEQ ID NO: 30439 - DNA, 1043 bp, Homo sapiens
aacttcttaaaccgtggcttacagtaaagaatacatgttacattgcaacccgttacaacctcacatgtgaaacatgtttcatgaaacatcacttagtcttattctttgcagtgcaggctggtattttgtactttattctattatagtctattcaacgcaagttgactagacgggactctgttgtactctattctacactattctactctactctgttttctattctgttcattttagaaggctgactctgacctataaattgatttcacaatataataaatgtgttttaaaaacccgtgctctaaatgttaccggggtaaattataagttagttcagttttattctgggaggtgcagcattgatctttgagacctaggctgtgttttccccagtaataacgatcagtggtgatagctaatgcttatgagccagtcacagtgctgtgctgtctgtataaatttcatttcaccactgcgacgatcccatgggacaggtgctctgatggcatcattttccagaggaagacatgagttcatggaggtgatgtgacttgcccagggcaacacagctaataagtggtggcctcgatttgtgaatccagcgctgtctgaacatgaagcctggactctcaactgcatttgcatttgcctcttcctttgccagcagccactttagttggttccaagtgttagcactgggctatgcaatgtggaaggccagagagaggaaatttggagatggcatgctggggagcagtggggaggacatgtgagagagagcggggagattggaagagggcagtctgtgaagcttggggtgagcggtggtcctcggagcatctggtattttgcctagcacctagagaacctgcagtgtttttgcatctctggttatagtgcctgcctcctccttaaagcacccactgcatccggtgtttgttattgtacttgctggacaaatacttgttttcacatctccttctctgaccaggggtcattgttttgaggccagaaatgatggcttgtacttcttgggatgccag

SEQ ID NO: 30440 - DNA, 1038 bp, Homo sapiens
gagtgtcattaatttcaagatacaggagtttgttgccccctttttgtttttattttacccttggatgttcatttaattaaattatttaaatttggtaatgtggggaagataatatgggggaagattttattttcttccccagtacctttaatcacaatcatcttagttaaaaaggtgttagtgatgctattgcctgtgtggtgcttcatttataggagatgaattttgaaaagtttgttgcacttatcagataactttatgaaccttttggaacattttaaatgagtttttatgagacttccatgacaatattctgtgtatctctttgatgtggagagaggaagattgcagacttcatggtctgaaaaattatgatgtatttttatttacattggactgatgatagatttcaggtcatttttcctatcaaagatatcctgatgaaagttaatattttgcgggaagattttatgagttataatattacctggattacagttttcttgaattacgtaaaaacgtcttgtgagattgttttagggaaaaggattccacttgtcttcaggtcttgggggaagcatcttactccctttgcggaacaagaatttctatgtacagagtgtcctgctgtttcctctgcttgcacttaattccctccaccttgcattcttattgagttattgagttattctgttgagttattgagacagctgtgttccccactaggtcataagctcacctggggtgtttagatattcccaaaccaggtatatagttgatccacagtaaattgttctcagtcaagccatgttcaatggaaatatgtatgattttgctagctctgcaaaggcactgattggacctgataccctccaactctgattaatgcctccccagccttctgcttttctctcaccaagacatagcatcttccagcgggttccttatacccatctgccatttgtcattgccatacaccgcagagcctggggatttgtaatgactaagctcaggtttgggagataatgtgtccaactt

SEQ ID NO: 30441 - DNA, 1031 bp, Homo sapiens
gagtagctgggactacaggcgcccgccaccacgcctggctaatttttagtattttttggtagagatggggtttcaccgtgttagccaggatggtttcgatctcctgaccttgtgatccacccgccttggcctcccaaagtgctgggattacaggcgtgagccactgtgcctggcctgaagttggactattttgaagaaaaatgtcaggtttttctggaaggaggagatggacatttggtagtggcagtgttggtggaggcatcgatttttgaggtattgttacccttggtttctgcctcatttgctgctataggccttttggttgagcttcagctgtgtctggggcagggggttttgaagtgaggcacggccagctccatctgcacagttggatttgtacctatcccctgacttcccaagacattgaaactcttctttgagagttcagacaattcagtgacttaagtttttcttgccatttcaagtgccaccatagcacagactgtgtcacacacattgtagctggtttttcattgcttttaaaatgcttttgaagtgaaagggggccccattgtgtaagtgttcatagttagcattagcaaatggacttgtaggggccatgggggatgtttcctctggccctctcaagatttgctgagaaattaactctcaagaggcagattaaggccgggcgcggtggtttacgcctgtaatccccgcgctttgggagaccgaggcgggcgggtcatgagatcaggagatggagaccatcctggctagcatggtgaaaccccgtctctactaaaaaaaaaaattagctgggcatggtggcgggcgcctgtagtcccagctactcggaaggctgaggcaggagaatggtgtgaacccgggaggcagaacttgcagtgagctgaggttgcgacactgcactccagcctggggtgacaaagcgagactctgtctcaaaaaaaaaaaaaaaaaaaaagcagattaattggagaaagtgcatatacatttatttaatcattgtt

SEQ ID NO: 30442 - DNA, 1029 bp, Homo sapiens
gatgaatgggattttcctcctttggatccagggcttttggttctgggctacagaggggcagagtctgggacacaaacagatgaggctgcctagtgaggagttggtttccagatctgtgaaaagcctctgtttggaaggcactataggtgacagccttgaagcttcatttgcatagcaaacttttttttttaaatttagcatctatattgatgtgagttggtggctgacagtacccagcactgcctctgcccacaccgtcaacctttttgggaggagaggggttagtagtggcttgaagccctaccttgagaggctgtacatagctcatcctgagaaggtcctgtgaccctcatcagaggcccagcacctttttgattttgaaagaggaaaaagggaaagagaaatagccatgaaagaatcttctttgctgaagattaaactgtttgactcaaagtaggaatgtgaccgcttgcatcgtctgtcagtacctcagaagttgcctgtggattactgacatgcagaaggatctggaaggctgggcctttgggcagtcttgctctcttctggctctcccagaagaagctccttctgcaggaattctgttgctactcttggggaacctttctcccatgatccagctagattcttgggtctgtcggtgattggctgagatgttatgttctaaggcagctgtctacgccctcatgcctcctgcccagtggtggaggaaacgcgtaattgggggaattttgctgggattccctgcgatggactgaatgcttatgttccctcaaaattcatatgttgaagcttaattcatatttatatgttaaaaccgaatttgtattcatatgttgaagcctaatcctcaatgtggtggtagttggagatgaggcctttgggagctaattaggtcagaaaggtggagccttcatggtaggattagtgcccttataagaagagagatctgtgaggacacaatgagaaggtggctatctacaaacccggaagcgagccctcaccaggaac

SEQ ID NO: 30443 - DNA, 1024 bp, Homo sapiens
gtgttttctatgctaggacttatgaaaaatgacagtgttttgggtaagccacttagcagtacagccttgtccaacactccctgagaactcatcagcattcagtaatcctgtcagaatggaaaaatctttttgctttaaatgagattttgcttgattggtatttttattttggaaatccaattttagctttttgtctcacttgataatgagttttttgataaatattgtcaccctttattgtaagcataaagaagaggtaacaaatggctttctgtaatgtgatactgtaataaataaaatcagatgccaggagtccgctcgtcactggcataaataaatgcattccttcctattgggcagatgggaacaggatgttgattctgagttggtaaaactttgattcccattcctttgaaaaatccaacgaatggctttattttcacatctaatgtttcttctgtagtctgaaacaaatgttactacgttatttgatttagagtgactatgttagataactctaccagttaatttggttgggttttactttgctgtggctgagtgctctgcacttgctgtggttggtggttgggaaagtgggccctgggcgatcacttcctctctgtgggtttccactgggatggcagaaactgcttatcatgccacaggctggaaaataaatcctggaagcaccatatagctcaagagacaatttgaaaataacaatcagagtcatgaatagaagccgatgcacaaattcagttaacaagcagaggaactaatctatcagacattgggtggaaagcctatttctgagtttatttcacagcacattatgacatttctttaaatcacaacttgtccccatgtaaaagatataatctacatattcctgtgggaaataatcagagacaaagctttactgtatttgtcgtttctgaagttgacctcattccccccccaaaatatttttcatgttgtgaaatgtaatttgcttgaccccaacaaaattggaataaaaaccatc

SEQ ID NO: 30444 - DNA, 1058 bp, Homo sapiens
gaaggaatgagctagctcttcagggcctcttttataagggcactgattttattcctatgggtggagccctcatgatctaatcatcctccaaaggccctgcttcctaataccatcactttgggagtaaggaatttgacatgaatttcgggggcacacacacatttaggccatgctacagtattccttactggaagcagggttattagaaagtgtcaatggcaggtgaggtgaggtacccagaaagggtgaatgtttcttaaatctgctttcctctgtagaagggagagagaatggaagaacacaagtttaggacctactgatggtggctaaaaggttgtgctctaggtgagtggtgtctcaccctgccaccagcacacacaccactttccaccttccccaaattgagagttttaaaaccttacatcattgtacgtttgatttttagccccagctgaaatctctaagcatgtcactatcagagtttctgtctatagagacctttggacatgaatcttaaatactcctgctgttgtgccttcccatctctttcactttgatgccattggcagtgagccattttgcttccagagaaagtaaatctctttttttcaatctctccttataagattataagtaaaatactccagatacattttacaaacattagttgcaactgcagaagtgtcgagatccactagacagaacacagggtgttggggtctgtagagctgaattctaattctgactctgctccctagtggccatgtgatcttggataaaagacttaacctcgttgggcctctgttttctcatctgtaaaatggggctatctgtctggaaacaaaaaaaggacccccgccccagaactgtcataaagatgaagtgggataataccagaacctgccatcatatatggtgttgaattgctacttgatcaatgtaggtggaagcaaaaaaaaaaaaaaaaaagtgcctttcttgagttggatttgttttaatcagtcacgataaacccactcaaagaaagttttgaagaactcgtatgaggccaaaacaca

SEQ ID NO: 30445 - DNA, 1006 bp, Homo sapiens
atttcaaagaagtaaggagaatatttgtgaagtggaataatttaccatcaaataaaatacaccgagtgcctcctaacatagaatgctgagctgatttttctctgtggtatcagttccatctccagctttagtggtggatatccagctgggaggaaagcatcaaggtaaaataaaatgcaaacgatctctagcatatatttgtgattttctcatttcagcatccattcctgctgtaattgccagagtaggaacaaagctgcagggagaactgttctagggtattgcatttcatagcatttgattacttaggattgaatagctttgagattatattgaccctgtagacttgtctcctgtttccctattttctaaacattttagacaagtgctttggaaaataggaacttttttgttgttgttgagattttaagatgaaaatatttctttatggttcaaaattgttattgttatattttgtgggagaagcaacttgctgaaatgatcctgtggtttacttagaactgcattgtccaatgtgatagccactgagccacacataatgctactgagcacctgagagtgtgtggccggtctgaaatgagacgctctgtaaatgtgaaataagcgctgggttttggtgacatagtacagcaaaacgaatgtgaaatctttcataatttcggaatactgattatatgttgaaatcacgttttgtatatattggattaaaccacatatatcattggaattattttcacctgtttccttttaccttttaaagcagctaccagaaaatttgaaattacacattatagttagcattatatatacttcgaaaagtgctgaatattgagatgagataattaaagaaattttaaacaattagagccatgatgggaaagcttggcttatttgaataagaatattgctctaatgttggaagttacggtaacaaaagaagtatagcattaactcaagaattattgattgatggaaagaacatttc

SEQ ID NO: 30446 - DNA, 1048 bp, Homo sapiens
tgctgggattacaggtgtgagccactgcacccggcctgtccacgtctcttttggtcacctccctgctccctttcatgaagcttgacagaagctgttcttctgagccacccatgctcatctgaagcagaactgacttgcattggaaagcaaatggagctcctttcttggttgagtactttgttctttgttctaccatgttctttgcatggtctcggtccagcagagctctgtggatcctcttctatttcaatttaaagtttatgtgtttaagggattttgtgtgaccctttccaagaccaaatttctgccttgtagcttagacactagggacagtagaatagtggactttcagagcttccagagacttggtctattctcctgattttatagatgagaaaactgagggctgttcaaaggttcagtttggcttccttcacaggatggtatagcagaaaccgggaatcagatcctgactgtgccacttaactggttgcaatcttagagagacatctaacctccgagtgagttttgattgtatggcctgtacaagaataatgagaaggatgagaatgatacctgcctgtcactgagaattacacagaatgcatatgaatcacctaggctggtcaccactaactggtgctaaaaagattaaacaagtatttattgacttgccagactgtggtgggaacatgggccctgtctttgaggaggtggccatggtctagcagtcatctctttagcaacttcatggggattctagtcttttatttcacacatgaaattcagaccttgaagtcagaaccctgagaacaaggacttgtgacccattttatctgcaactttattctttctcccattattgctctcagcaggcctctcctgatctccaccaaggtgtacactgtggaaactggataatagcctcagtctgaattgggagatgacagaatcactgtttcacagaggaatattactgcctatattgtcaagcatggagtctgggttttcaatttgggcttcagacatgccagagcgacacagtgcc

SEQ ID NO: 30447 - DNA, 1073 bp, Homo sapiens
tcttctttacctctactgccacgtactctgggaatctctcaaatcatctcaaatgtcttccagtaaagtcttttctaaacacattacttccagaattaatcattttacccccctgtatagaaatggatacatgaggttaagcgaggttaagtaacttatccaaggtcacagatccagtaagtgtcagagttggggtgggcaatgagacacataatgaaaaaaaaaatgcaaaagcatagttggaaataggaagtcattgttaaatttagggacaaaaaataggctttgtgagaaatgaaccactgggctatagcctgagaaaaggttgtatacacaggatcttggaaagggaaggtccttgaacctgaaattggtgacactttttctgggggacctgaaatcttgtcactaggaaggtgtgtggtgtggtcaaaagtgctatgtgaagtcttgttgtacctggaagaggaagtcctcaggattgaatgcctcccctttctctgactgctgattaatatgcctagcattccattattggaatgctaagcatatgggaattatttctatcctactgctcaaggtcatcgccaagatctgattttcaaaatccaaaaaattgcaaccttcaggcataaatgggctagggggccatgtgatgaggaatatgggcagcttttgtgatcttctcatgccgtataggggctgtcctggatatggcagaccctgattataaatcaataggcatttgagtgaggtaaaaagaaagcagttttattagggttatgtactattgtaggtctccccaagtttatgctgcttcccagagggtccacatttttctgtatgcactagaatatgatgaatgacacacacctgagaagttcacattaatggcattgtgctctctgttactgacaccatcaacatcgaaataaagcatgttcttctcttgtcaagaccactgtaaggagtgagactccgtctcaaaaaaaaaaaaaaaaaaaccactgtaagagcagcctctacaaaatgagctgtcttctttccagtgcactttcttatccagaaggtct

SEQ ID NO: 30448 - DNA, 1029 bp, Homo sapiens
aagtttggttctgaaacttagtggcatgagaatcttctggaagtatgtggcttcagaagggaaagcagtggatggagaagcccatggaatgggttttggtttctctccttgttatttttgggccaggaggacctgatgtggagagaagagttcctgtggcttggtttggttctttgcttttgggatccattgagcccctgctctgctcagcaaggaaaacagcagtgattggagcagccaaaccacagtttggggcctggatgtgagtgatcggtacaggtacaggtgaaagaggccccacctggatttgaattccactggtagcgccttttctatttcagggctgccatcccatcttggaattctgtggatgtccgaggggaggaaatattgctggatctagtgtgtgggcccctcttttatgatttagcatttctctatctcttgcagccttttcctaatttcttttgttctggtgtgagtttcctctttctcccatccctttgttgcattcctgtcttcctgtgttttaatgaagaataagataaagaaaagagcacttactgtgtactgcatactaggagctggggatgcaaagctaaacattgtggaccccacctttgggactgcacattctgaaggtgagggagatgtgcccacacatgattggtgtgctgtgatggcaagagtaccaaccaccatcactgtgtaaagcatgtaaagaaaatcctgcaaggagtggaggatcctgggcacctaggctggggatgcagacagtggccagggaagatgtggggaaggaggtgctgtctggaccaggtgtccagagatgaatgggagttatcttggcaaaaaggaggtggatgagtttttaaaagcagcttcatggaacagtgttagggatagaaatcacttgttttttgttgtttgtttgtttcatgaatttgattgatcaaagacacttaaaaatacagaaaatacttagaggaaagtgtctgacacttgagaaaagaccttaatacatggtct

SEQ ID NO: 30449 - DNA, 1023 bp, Homo sapiens
tctagacatctagtctgatctaggaaaagaagtgactgtattcagtgatgttactgtccttgtgattcttaagtcaccaggctatgtgctgggctctgggtatgcaatgagcttcatgaatttacagtgtagtgagaagacattaaagcagatacatatataagtgtattacaagttgtgataagtattatgagaaagagcacaggtttcaatgtgagagaataaaagacatcactttctgtaggaattagccctctaagaagaacatacacttttagttttcgctttgtttttttttttgtcatcaaatacagtcattattagttgaatcacaaaccctatcatagtagttagcattgtttgtgcttgtagataataaaagtctgttatcaaataggaagaaatacatgagaaataggtctttattcttgagggtacatttcccttttgatgaagcagtttcgtactttacatgatcctaaaaggatttttactttaaaaacaaagaaggagagattgatttgagttttgagccagcaggactttgaaatgtgattataattataggatacaaattgcagaattttagtgagaagtaatgttgtccaaagagaattgatagggaaggtggtgtcagtgaagcagaaaagatgccagtcctgttttcccaagttctactttctgatcctggcagggacagcagtggtggactgccctggggtaaaatccctgccctctgtagggtcagaattctttttctaaatgggaagagatagactttaagggtcctccctccatggatatctcctgatgctgtgaaatgtttttggtcgcagaatataatgtgaagttgcatatctgcactcttttagcagagtattaaacatgagaacaagatatttaatgggcaaatgttttgagcttagatacctaacagagcagataaaattcttcaggaagtattaataacaagaggaagaaattgctttagaggcttactctgtgtttctggctttcattgta

SEQ ID NO: 30450 - DNA, 1071 bp, Homo sapiens
tagacggctaaggcattctcagtcacaggatgagataggaggtcagcacaaaatacaggtcataaagaccttactgataaaaacaggttacagtaaaggagccagccaaaacccaccaaaaccaaaatggccacgggagtgacctctggtcgtcctcactgctgctctcccaccatgagcgccatgacagtttacaattgccatggcaacgacaggaagttaccctatagggtctaaaaaggagaggcatgaataatccaccccttgtttagtgtattgtcaagaaataaccataaaaatgcacaaccgacagcccttggggcttctctgtctgtggagtagccattcttttattcctttacttacgtagtaataaacttgctttcactttgccctgcagactgaccctgaattcttttttgagcgagatccaagaaccctctgctggggtctggatcgggacccctttcctgtaacacaacctccagctatttctgttttttccttcataatttttgccttatctgagtagtacctgtagaaatgtttaacagaatgtttttctttacattttcttctttttttcaatttattttttaaagcaggcttttaaacactactgctgaagggaaaccagctggtcatagaagaagatacctaagagggagagtgaatccaaatggccttgctcagttctagctcttttccatgacctgcaaggctttcatcagagacctgtggtgagagggcagaggagctgggatcggagttcccgagaggctgagacattgtttttccttgtctcaattaagaggcatcaaggagaacaggaaaaggaagactttttttctctgtgaggctcagtgtcacttaatggagtgtctagcgactaccttctgtcactccccaaagcacctctaagcctaacgtcatctccactggcctctacctttgctgtggaagagtctaagtctttgcaatcttagataggacatgattagttccaagtctctcttgatgctcttttttttttttaaaaaaattgcatgtgtagaatctgaatcaaagttt

SEQ ID NO: 30451 - DNA, 1034 bp, Homo sapiens
ctttctctctctgggcttgaagtctgagtgtcagtgcaagtggaggggtaccactgactactttaggattagcgttcagaggctttactgacaaaagtgtaggccattttaggttcttctaagctaactgcaaaatagttcacactttcacattttgtgcatgctttattggagcatatttggaaacatctagaagtttcaagatgatgggctcaactgttctgttatcaacaccagccacattgtatcctcttgctcacaacccaggcaaatgctccacaagagtgagctttcgagatactcgaagcatcaaccttgtaaaatactgtgaattttgtgggacatgtgttttcaatgtgttctctacctgtctgcttacctggatggtattataacttatcacttcttttgtggccctgtctcacggcttttaacatccatgtgtgtgtgacacagtcacttggtaagggcatacagaagctgtttgcttctaggtcagatgtttccatactgcttggattttgagatcttgagtctgtttttttttttttgtttgttttttttttttttttttttgagacagagtctcactgtgtcgcccaggctggaggcgcgatctcggctcactgcaacctccacctcctgggctcaagcaattctcctgcctcagcttctcaagtagctgggattacaggtacctaccaccatgcccggctaatttttgtacttttactagagagggggttaccgcatgttggccaggctggtctcgaactcctgacctcgagtgatctgcctgcgttagccttccaaagtgctgggattacaggcatgagctaccgcgcccggccttgagtctgatttttaaacatttttctgtctcttttttccttgtcagccattggtggcttcctgctgctgcttgccgccatttttaattttactgcatctaagtgtgttgtgacttgggaagtcatataaacaagattgttggaatggtgttcaaactaataaagtgtttgtgttctctgctc

SEQ ID NO: 30452 - DNA, 1108 bp, Homo sapiens
gttgttccaagttctccctatatgagagccaaccgtgggaggcagtgattctgggaagtttccttgtttcaatcaagctgttttatgctggaaaatcttgtctcttcctctaccctgtcttaataatattttacacttgtgtggaatcctttgggaaatttttgtatgtatattctcaccagattcacacactgaggtacagactaaaggttttattatttgtgttcatcagattagaaaaccaggactcagagaagttaagacttgcccagagtcagtgagtaggaagacctggattcaaactcttgtctttgatttctgagacctgttctgactctactgtaacaaaatgtaccccaaacttcttgaggcctaagactcagttatctatttattggggttcagtttttggtgatgttcttgttacctaataggttctcaacaagtacttgctaaactaaacagaagtgacagaaaagtgatacaaccaggaatggaaactctctgcaggacagacttccttaccagtaccaacaccttgttatgttgactgtgacttatctggggcagatgtccctgtcttccttggctagttgggcaataccttcaatactctgccatggtgagttctagtcaacaccttctgagtaagccctggaaacgtataattaagggctggaacagaattttattcaccacaatcagaggccttggtgataggaaatttcctttcattttggagaacaaatggtcatccttcaggtcagcggtccccaacctttttggcatcagggatcggtttcatgaaagacagtttttgcatgggggagtgagggatagctttgggatgaggctgttccacctcagataatcaggcattagttagattctcttaaggagcgtgcagcctggatcccttgcatgcgcagttcacaatagagttcatgctcctatgagaatctaatgctgatgatctcacaggaggctgagctcaggcagtgatgctcgcaggccctccactcacctcctgctgtgcagcccagttcctaacaggccaccgaccagtactggtccatgctgggggttggggactcatgcctcagatgat

SEQ ID NO: 30453 - DNA, 1085 bp, Homo sapiens
tgtcaggtcacatataagggaaatcatcgttagaatgtcagtgaatttcttaagagaaacgttgcaagccaggagagaaagggatgaaaattttaaagtactgaaaggaaaaagaatgtcagccaagaatactatacccattaaaggtgtccttcaggaataaaggagaaacaaaagtctttcctaggcaagcaaacgttgagagaatttatcaccactaaacccgtcttagaagaaatacttaagagagttcttcaagtagaaacaaaaggatgtgaattactaatgtaacaacatatgaaagtataaaattcaatggtaaaggtcaagtccagaatacttcattgttgatatgatactctgtaaatcgtatatatctctagtataaaggtcaaaagtcaaaacagtcaaaaataatgatagctaccattaattaagaaatgcttaatataaaaagacgtaaattctgacatcaaaaatataaattgttgggagagggcaaaagtcaagagtgtttgtatgagaatgaaattaagttgttatcagtgtaaaatatcctattataactgtatgatgttttgcataaaccatatggcactacaaagcaaaacctatagcatatataccaatgataaagagaaaagaataaaaacttagcactacagaaacttactagattacaaagataaaaaacaagagagggagaagggaacaaaggatctgtgaaacaaccagaatacagttaataaaatggcagtaataattctttacctatcaataattacgatgaatgtaaatggattaaattctccaaccaaaagacatagagtggctaaattgattaaaaaaacaaggtccaactatatgctacccacaagaaacccactttagccttaaggacacacataggctgaaagtaaaggaatggaagaagatattgcatgcaaatggcaaccaaaaaaaagagcagggctggctatacttatatctaataaaatagattttaagtatgaaactgtcacaaaagacaaatagggtcactatttaatgataaagggctcaattcatcaagaggacataatgtc

SEQ ID NO: 30454 - DNA, 1087 bp, Homo sapiens
catcaataatattttagcaactcaaattcaagaacaaatcaagaagattatacatcatgatcgagagagatgtatccctggccatgtaagactagcatatacaaattaatcaatgtgatactttcattaacagacaaaaaccacacgatcatataaactgatgcagaaaaagcattcaacaaagttcaacatcctttcttgatgaaaactcttaacagtttaggtatagatggaaggtttctcagcataataaagttcatttatgaaaaaccgacagctggcatcataatcaatgaggagaaactgaaagcttttcttttaagatctgctgtaaggtaagaatgcccacacttgccactactattcaacatagtactggaagtattagcaagagcagttagacaaaaaagaaataaaaagctttcagatgggaacaaaagaagtaaaattatcacgaattacagatgacatgatcctttatgtagaaaaccccaaagactccaccaaaaagctgttagatctcaataaagttgcaggatgtaaaataaagatacaaaaatttcttgtatttctatatacaaataacaacctagatgaaaaattcaagaaaataatctcatttctaatagcatcaaaaataaaacaagatgaaatacttaagaataaattttaccaagaaagtaaaagacatacactgaaaactataaaacattgatgaaacaaattgaagagtacactgaaaactataaaacattgatgaaagaaattgaagaggacacaaatagaaagatatttcatgctcatgaattggaagaattaatattgttaaaatgtctatactatactatactaaaatgtctatactatactatactatactgtactgtactatactatactaaaaagcaatatgtatagatccaatgcaatccctatcaaaatcccaatggcattcttcacataaatgtaaaaaccctaaaatttatgtggaaccacattaaaccctgaatagccaaaatactactcagtaaaaaaaaaaaaaaaaaaaaaagttggaggcttcacatttcctgttaaaattatatta

SEQ ID NO: 30455 - DNA, 1042 bp, Homo sapiens
cactttctgagttccaccatagtatgaattaatcatatttaatgctaattatgtccttgctgcgcaactactttctatgtaaattgtgggaaaatgtgaaaacatttacaagccccaagcaagttttacaatgagcttatatatgcggatttgttatttatttgctaggtgtctctttcaatccaaattattctgtgcagatttatcaaaatgttgtgttgctattttttactttcaaaaacattactgatatgttccctccccttcaatcaaagtgttaaaaatattgaggttgggtcagtaatacagctttcattgagttgttgagcttgttcagaattctctatgcggatattatgaagattgcccatggattatttggcttttgtgatttataactctttgtctccagaactgacagttggaatttataccatcaagtaaccagttttatatctttgattaaagttttcaactcaacacatgcagaaattggcttaatcctggacgtgatttggttgcttgatgggttttgggtattctggatcctttggatatgtctagggtctcccctgcactaagctccaaaccacttgtatccatgagtctcttccagacctgcaatgactttgacttttagactacagttaatgccttaaatatatgaagattctgtcattggagggttcctctacattttttgattattaaggaaatttgcttgacaactaattctttagtgcaataactgataacagttgacccttaaacaacacaggggcttaggggcgctgactcctgcacagtaaataatttgagtataatttttgactccccaaaaacttaactactactagtctccttttgaccagaagccttaccaataaacataaacagtcgattaacacatattttgtgtgttatatgtagtatataccatattcttagaatagattagctagagaaaagaaaatgtactaagaaaaatcataaggggcctggtgcggtggctcacggctgtaatcccagcactttgggaggc

SEQ ID NO: 30456 - DNA, 1050 bp, Homo sapiens
gggcacagtaatgaggcaaaattcactttaggcagcgtcttagattgtggtacatttgttgcaaaacttatgattggcaggttgcagtttctgtatatttggatccccatgtaaaattgctccttgtccatagctgttaattcttttgggcttcttcactaggaagaattagagagttggcagggggacagggcctcctggattgggtatgctttcttcctctcacctgacatgtccaccaagtgttttcctggtggagcagacagatccttggccgacgaccctggcatttgctctgcttcccatctgcagacatgccggtggggatttggcattccttcctcactgggtcggctacattgtgttcagccttcacattcgtctcttgccatgtcttgtcttgaatgcagatagaaaaacttgggaaggaaaacaagtttcacggtttcttcctttgatttgagtcatcggtcatagatcaaagtgaccgcaaagtcatctttgctttgtagagttctattgcaaaacatgctgctgttttgttttgttgggaagggcatggggaggatttggcttttatttactctgattctctttgcttctggacttcctcattgtgttgctcaacatttgcagcgaacttgaaagcaccaggggatggccactatatcccagcaaggcaaggaaggagtggagacccgggccacattttgtttatcaaaggcaatgggtatgacaccgcatttcccccttatctatttccttcttcttttcagcacttcccagtgaatttccttggttgaaaatattaaccaaggtgcccagctgtctcctagccagaggggacctgtgatccaaacctggcctgttagagtctcccaggaatttaatttgaggaaaatgtcccagacacctttttttctagcatcttccttaccacattaatgagcaattcctgcttacttggaaattcagggtggccctagtcccttatttctcaagtcttggttctccagccttgttgattctgtgaggtcccctgtgtgtttt

SEQ ID NO: 30457 - DNA, 1044 bp, Homo sapiens
gaatcatgcttgtaatgattcctagacagaatcttcagagatagtcagattttttgagccgttggatgtagctaatgatattcaaagtcatcctcagcagccctcctgggatctgcccatcacctctgcccagtccattgtcacccagccaggctgtggggcatggaccagggtcagccaggtgttctgtcttgtctcagccaggcagtgaatcactgcccaagggcagaggagaggcagggacttcaggcaaattcctgtctccactctacctaattcaaaacagcccctaacagccttttttttttgttttccttttcaagctgcaggaatatattttatgtttagaaggccctccagctcagatctagttattgatgacgtactcaaaacaaatgctcagagattggtcactggctgtgctgtttttgggttggaaatcttacccccagcgaagaaaaccaatacaaggtcattctctcctagctgcttggacttctgtgggcatataccaaagtggtttgatacttgcctaggagcttctgtgatctatgttctggggtataatttttagttctagatgaaactagctggtaaactctacctgctttctacaatctgctttctgcctccgtgggcgggcctggcaactgggctgctcagccgggtttgtgctttcctctctggctgaggtgcctttctcttgagcactgaaagagactgcagcttcaaagttggtgatgtgggcaagctgtgcccatgggaactcaaagaggcatattcattgagtgtttagaaatgcatctcagggccctcaggttgcctgatgcagcagcttttttcatgaaactccttcagcagatgtttgctgagtggctgctctggcatccccagcttgtgagtcttactatttcggagactttgaagatgaatggctgatacctttagagccgtaaatgactccatatcctctatgagtaaagcaagaggcaggatgcttttgcaagaactgctgatgatctggcagagaattcagataaagct

SEQ ID NO: 30458 - DNA, 1080 bp, Homo sapiens
taaaaatctagtctgaaaaatctctgcctcttggattatttaattaattcacatttattattaagtctgatgttagcatagcatatattcatatagcacatgtgtggtatagtatatagtatactaaagaaagatgtagtacgtcatatgtatatacatataatggcatatatgttttagttcataaggtatatatttatagcttcattatattaaccttatttaaaatgtatttctggatatttttatttattcctgtggatttcagttaccgtctggatttcttagccgcatatatctctgcactcaaccacttccttcatgccgtttttggcaaatatattacctctctatatgttatagacccaaccatacattgcataatattgccgtatacaattgttatttagtcaattaagaaaggtgaagacatgggcattcattttgtctttcatagttacatattcacctttttggtgatcttgatttttgtcttgtgactttgaattaccatcttgggttatttgctctaagcatgcagaacttcttttagcatttcctgtaagccaggtctgctagcactaaattctctcagtttttctttatctgttaatatctttattctatattcatttttaaaaaatagctatgctggatataggatttttggttgacagttttgttctttgacactttgaatatattatttcattgttttgatggcctttattgtttctactaagaagtcagcttttaatgttatgcagtttcacttgtaatattcttgtaatgagtcatttttttcttgtctgctttcaatattttttccttgtctttggccttcagcttttttttttctatgatgtgtctttttgcatatctgtttgcgtttatatgaattggagttcattgagcttcctggatgtgcaggttattatttttcaataattttagaaagtttatattcattcaatatccttcaatatctttttctgtttcttctctttgttctctccttcttatattcccatcacccatatgttggtgaatgtaatggtgtctcacatctgagctctgttc

SEQ ID NO: 30459 - DNA, 1076 bp, Homo sapiens
cagcttctttccctggccttgtgggctgtaatgctcctctgacaacacaagggggatttgaggatccaggcaagcagagagagagaggatgccaagcttctgggcattcacaggggctacctcaagggaaggccggctttctcctaacagacttagcccgtgttctgagggattcactgtcctcccatgctgccttgtcttcattgcctttggccctggtgcaaagatgcggagaattatgggggtgctccataatttctgtacaaggtgcatccatgtgcatgagtgacccctggcccatttctcttaagggggcgggaccagaagagtccatactatatgtatgaatttgtcttagttttgaactttggaaatgtggccccagtaatttacttattctctctttacgttggtttctgtcaataaaatgtggtcaagaggacttttctcgtggctctgctgctaactgtgtgaccttggacatgttacttggtggcttacgttcacttttgccgtctgtaaaatgagaattacattagtactcaccctagagttgttttgattcaatgtgttgtcatccatagctgtcttaggatagctccttgacacatcctgaatgctcagttgtgtcggccgtgttcatgttccactagctcctagtagggtcacctagggcaaattacttaagccttctatggcttcagtttcctcatttgtaagtgtgcataataggacctttatcatagaggcttaagtgagccacagcatgaaagtgtttagctgagcaaatggagagtgctgtatacatgaccagtgttatttttttagggagatgtgttattgaaagtgcccctatttctccttctcctgtgttacttcttattcaaatgcagcctagtgaacagttaatggtgccttgcccaggaccatcagtatcctgttgcattttgaaggggtgtgtgtgtgttgtatgtgctaaatgttttcttttgctttgtgacatttgtgtggtgtgtaccctatttccatgtgaaggtgtgcgtctctttgccttccgctacttttgctttcctgac

SEQ ID NO: 30460 - DNA, 1043 bp, Homo sapiens
tgagatgtgtcagaaagtattctctgcgccagccagtttgtggccgggtattttaggaccagttttgcaaagctgctgacgagcaggccctgcttctgggttggaagagaggaaccgccatccattttccctaaaagaagaaaaataggtgagcctggaaagtctgtgggtaggagtgaaataatcaccaactcaatttgcagccgtcttggaagagataagctgttgtttcttcccaagtgaatttctgcaaagaacagatcctaccaagtgagcctcatctcctctaatcaagtggtggccgggctattgaacatgatgattgtcctcagcatccctttcacttggcctgtgaggcagagctggagtcttggcagtttatggaaataatgatttcctgcaagaacttccaattcagcggcatcctcaaacccagatgcctccctggataacagcgtttctcccctggctaacagactgatgactggtaaatgttgacctcaagtaagaaacaatagtgaactgcgaagctgctgctaagctttttaaaaataattgaagtaccaaatataaagctaaatataatttgccgttatcttccccaagataccatgggcattttgaatttgatattatttttcagaaataaaataatcattttcatctgctaatgttgtctcatgttaaggtaacgtgggaaatcgtcagacaggactcacaacccagtcattgttccatagtatgcattggtcgggtatatataaaatggtcgggtaaataggtagtggttggattctggtgaggactcttttcctagtttgcagttggctgttttcttcctgtgtcctcagatggcagtaaacaagcaagagaggaagcgagctctcttatgtctcttttttttaaaggcactaatttcatcatgagtgttccctctcatgatttaattaccacccaaagaccccatctcctagtaccatcacactggggattggggattattgtaggtatccccacaatctatgaattctgtggggacataa

SEQ ID NO: 30461 - DNA, 1069 bp, Homo sapiens
ttttaaaacaatttcagctaaaatttctaagtagttctgtccttgaagatacttggagcttaacttccatttctgaaggcctgtccttgtcatatatcatttttgtagcagctggcttgttccactcttggtgtacttcctgttaaatatgtatggcttgcttggttttattttagtagcagtaacattttcccctttttcattgttatttgcagcatgtaatctgctggacttgcaacattatttcccacgaagcacttctttcttttttttctttacatcccaagagatctgtgtcttgcattaaactttccttgctggtgactgatacagttccttttatctgccatgcagttttagaatgccaacaaatttcttgtacaacaatatggtatggaagtgcttcacttggggaatgatcctgaccaatttaaatcccttaactgaattagtgacttggttaaatcctaggttccttgggttgtatgacctctgagatgactctgtgggtgtttgtgacaatactggaaacttggaagagatgtttatgtttggtgaccttatcttcttcttccctgtggtctttattctggcaccttgaatttcgttcaggaacccatctttcaggactgctgggcttgcattcagatccaaggcttaataggtttaagcaggttggcatgctccatcaccctcctgtgctgactagttgagggatgggcatacaatggtcaccgtccatgcagtcagaagacatctgaagatcccctattctgcctcggtagggttaggaaaagatgtgatgactgtaagtgctatggcaattttgtggccctataaggggaaaggctggaactaccggacaacaggggtcgggggaagggcctggatgtgtgaaaggaagaacctgagcatggaggcagccctgcaggatgcagaaaagaaataaagacagaaaccaggtcactggtgaagccacgggcaatgtctggatcattttctccacaaaaccatttttacccctcatttttgtagttccttgggctaatattttgaaaggtattttgag

SEQ ID NO: 30462 - DNA, 1069 bp, Homo sapiens
ctgtctccctcatagtgattgtttcacaataaatctgtcttatcaaatgcactgccctttcattgaggcccttggagcccccatgtgtagaatatttattaagagcacaaagaaaatcatggcactaaaataattacattgaattcaaaggcttgctagttctgaaacaattgcattcacttattgtccttgtgctctaataaacacaatgctatggtgtgcttgatgcttacgttgacactcttgaaagaatatggctcttgctaagatttcaaagaaaattgaacccacttgttatttcccttgtccttctcacgattgattaaatggtcactggggtaactgttggggtaacttgtctgctattaaaggtaagcttttcaaggataggaatgctgtctgctcactactgtatcctcaatgtgccaagcattgcctgttccattaatattgtggaacaaaaggacgatacgttaaaggagaatcttacacaatgggatagaggtttcccctccagttttggagtatcctaggaaaatttctaaagtagacttctgtaaaataaatcctgtttccctttagccacctttaaatttgtcagtacagctaccgcaaccaccactataccacccctgcagggccagttgacagtttcacttgaaggtatagctgtggctgcagccatgtcacagcttctgggactcacagctgccattgcccatgttgattttctgtacctgacacacagagctgctcttcccctggagagcagacctgcatgaggtagctgggggcaatggccaaggcaggcttttgtgaggcacattctatatgctggagagaatcccctggctcgtattgtgttggtgctatcttagatgcaggtagtagaagcacttaatttaggtatgtttgaggaagtgagcaacagaggattgggagaaattcattccagttggaacacaaagtataaagtgaaaaatacactagagttaatatctgggcttcagtttgaggggaaagaagcagcatgataagcttcatatttaggagggaggaaccaagtaca

SEQ ID NO: 30463 - DNA, 1055 bp, Homo sapiens
ttaaacatatggatactgtatgactttacctatgacccagcaatcccattcctggatatttaccaaaaggaatgaaaaattatgtttatacaaagacttgcacatgaatgctcctagcagttttcattgtaaccacccaaactggaaacaacccaagtttccttcagcacgggaatgaataaacagactatggtacattcatacagaagaactgctaagttaaaaaaagccagtctcaaaaagttacatactgtatgattccatttatatgacattctcaaaataaaattatagtgatagaaaatgatcagtggtttccagggactaggagtggaggggagtatagggcgataaagggttattgcaagggagtttctttatggtgatagaacagttctgaatcctgattgtggtggttgtgacacaagtctattcttgtgataaaatttcataaaattgtacacacaacaaaaaaatgaatgtgaaaactggtgaaatccaaatgaagtctgtagttaggttaacagtgttataccactgtcagtttcctgggtttgaatattatactacaataaagatgttatcattgggggaagctgggtgaagggcacaggaactttctgatactagctttgcaacttttatgtcagtctataattattttttaaaaggctttaaacattcccctaatagcagctaataattcctgaatatttgctagtttccagccctttgctcatctcatttgaccttcccaacagccttgtctggtgcattctgttttgcccattttatggaggaagagatgttacgaaaatcacacacacaataaagagtagtatggctaggttttgcatgcacgtggcctggctccagaatttgtgtgtttaaccaccgtaaggtttttcctcccttgccaagctttgagataacaaagactggtgtagaccatgctgtgtgtagaccactttgctggaaatctcagtggtagtgctcaaagatgtggcttcatccttgctgcttgctatgatgaacatgactcttgcagatttaaa

SEQ ID NO: 30464 - DNA, 1050 bp, Homo sapiens
taaaccacgtttttctaagacaaaagatcagtcttattttgtgacatgtgattcagggtgactgggggattacctggtagtacgaggggaacttggacctgtattgtcaacctcgcatggttggaagtactttgtgctatcaaattcctctgtctggctcgtcacctggggcagcagaatcctttcaagactctgcccaggtggatggctgctgaattctagtggaacatttgagggcagttctctggctctagcggtcgattttcctcctgtcagaagagccattcatgaactctgttgaccaaaaagttaattccttcatgtttttagcagaagcagctcattccagcttaaattcccaaagatcaggtcttctcatgttaattactcatctatattctggctggcacagtataactggtacatgaacactgttttaaaactctgctgattggatcatttatgagacattcatgtaaaaaggaccctaccttgaactattttttttcaaatataatgttggaaccctaggacctcaggattagaagaaaacaaagagtgaactgtatgaattggttttcaagactaacttatgacacctgcgggccagttttgttttgtgcatgttggatccataatctgtaaccaccctccaaggcagaggctggaaggaggtggcaagaagaaggtcagatgccatttgtagtggatgcatctgcttgccatggttagataaagaggttttcattttattcctgttccatcagagacaatatccctaccatcactcaagccagggtattgaaccttgaaaactgatgcattgcctgtcatcacacagaccactttctgctgagttaaagaaaagacacagtctagtttgttggaaaatggtgatgaatatttggaccagatattaaaagagtcaaaataaggtcaggtgccgtggctcacgcctgtaatcctagcattttgggaaactgagctaagggaattgcttgagcccaggacttcaagatcaacctgtgtaacatagggagacccagtccc

SEQ ID NO: 30465 - DNA, 1043 bp, Homo sapiens
aataattttttttaaaaagccaggcatggtggtgcatgcctgttctcccagctacttgagaggctaaagcaggaggatcacctgagcctgggaggtcaaggctgcagtgagccgtaattacgtgactgcactccagcctgggcgacagaatgagacccccatctcaaaaaaaaaaaaaagtcaaaatagatatttttatattagaattttatatcaacatgaaatggcaagcagaattgagaaaaagaattttcttattccgaaattcagaaggctatttattataaccttgctgtgtttaagaaaaactattttaagagcaaatatcatcagtaggccttgggatacaagactaaaataaaaaagcaaatcctctgagcatgggagagaatgccttaaatattagtaagaagttagacctaattttaaaaattgggttaatcagacatacagtgccttgagttttttctcttttctccaccctgagtcattagtgtgtctgagagggaaaagacctgagccttcattctccatttgtacaataacatttaatcaagtgcaaacagccctgcagagttcaggagtgctgctggagctaggatgatgggtctaatactctagggaccaagaacaatgaagctgacatgtgggttcacctccgccattgttcaaggaagcatccgtggccttttgctgtgtttaattacagtggcaaaatctcagtcactgtttacacaggcttattgctcaggtgtggaaatgcactctaggctcacttttggcatttgctttgtatcggggagttcttagtctcttgaattaaaaatacattcatccattccttctggtgttacaaatgtaaatatcttcaccaaccctgcagggattgccgtagtggtagatgggtttgttacttcagccacttcacacaggagacagggaacctgtgggaaccagtcaattctgtggtttctgcaagtgttccttcaagatggcagtggtcatgcagcctggaaggccgtacagtgtccaggcatctagtc

SEQ ID NO: 30466 - DNA, 1025 bp, Homo sapiens
ctttgctgttgggaaggcagaggagaaagtaagtgagggagtacatgatttatcaaaagtgacaaggagaacagagctcctctatcagccctcagctaccctcctatttatataacacctttccttccagtgtttcccccagcagatggccaggtgaggttcgtggtctctgcacggaaatacagctgctccagggcaggaatgggggatcttttgggctctctcccagcagaattatgcaatagtccatggagggaggggacaaagtcattccctagctgaagcagccctggaaatgtagacttaaagccaagtgctgcttgcaaattgggaggttgccaagacctagcaccctaagactcaggggttaaagtaaaatcctggaggagttaagtaattgaccacaagtgggtctgcccccatctgcccctgcataatgagaaagtcagtgagacttgatggggtcacaaaagcacagcaatgtgttgactgagatgactgtgctctgccaagggaaagagtctgcccttcaaagggattctccaggtgtactctgaaagtttccccattgtcctgttttatcaagatccaagaaccaaaggaggtccttgtcctgcttgagatttttgctctggggttgagcatgtgagtatcaggagacctcatttggtacaggatgttgaacacacacagctgcttttttaaggtttccatttgcaactggttgagccgtaacaggtaattagcacctttgctgttggaccaagcggtgcttttattggttggagtttcttaattaggctggctgctttgcagttttggggaagagaatttagagggaaagcaggaatgctgtgtgtctcagaggatgaggccaagctgagaaaacagccagagggtctgagttcagtgccccagcccttcagtgccatattctaatcctaccctgcaagttctaacctcccgttggcctttttctgagatcatgggtagacctcagaaatggttcttgtatccacacttct

SEQ ID NO: 30467 - DNA, 1030 bp, Homo sapiens
tagtgaccacaggagtaaagtttgattgattaagctgtgggaggaggagagagagtaattttagtcttaaaaatagatactcatcagagacaaagaaagggcaatagaccacagtatttaggagggaaagttgagttacctttagagtcctgagggacacatgtgtgatgagagagagaaatgaagcaagaggtgaaaaattcacagaacaaaaatgtcgattattttaaaaaggcacaaggaaaagacggagggagtggtagatgggtcttgtttttggagacttcttttgaatagaatgatctgaatctaaggggtctggaaaaagttccaggagcttagatccctgggaagggagggaatatctaggcagtaggtttgccctctattttagacagacctttctgtaataatttagcttgatgtttccaagagagaagtagtggtgtggttatggagaagttaaagtgccttctgcattaagagttggtgattgtatgatttgaggtctgctgtttacatagaagaagctgacaagaagagggactgcaaattgaagacaagagagagtttaataggaaagattgggcgtagaggaaatcctgaaattctaaccacacctgagggaaaagagcacaataaaaaagtagatgactggccgggcgcggtggctcacgcctgtaatcccagcattttgggaggccaaggagggcggatcatgaggtcaggagtttgaggccagcctggccaatatggtgacaccccatctctactaaaaatacaaaaattagccgggcatggtggtgcgcgcctgtagtcccagccacttgggaggctgaggcagaagaatcgcttgaagccgggaggtggaggttgtaatgagccgagatcgtgcaattgcatcccagcctgggtgacagagtgagactcggtctcaaaaaaaaaaaaaaaaaaaaaaaaaaaaagttgatgatcaagttaattaattgcataaacatttctttgtttggtaaaatttgcttttttctca

SEQ ID NO: 30468 - DNA, 1041 bp, Homo sapiens
ggctggtttcaaacttttggcctcaagtgatccgcctgcctccacctctcaaagtgctgggattacaggcgttgagtcaccatgcccagcccctgatgcaagcttttaattggtgaacaacttaggttcagagaaaataagtgacctgcccaaaaacaaatatgggggggatttggaatttgaatcatgtgtgcgtgattgcaaagtgtgatgtttatactgcattctggctgcctccttttgtgtctcatttatgcaaaacagaacagcacacacacacacacacacacacacacacacaccacaaaaccctagtaatgtcatgataacaaaagtatttaaatataaatatgagaaggaaacagaggcataattatatgcagacttaaagttcttctttatgttgtatatcattagaacgttgagaatgaaatcaataaggaatagaattagcccgggcgtggtggctcacgcctgtaatcccagcactttgggaggtcaaggcgagtggatcatttgagccaggagtttgagaccagcctggccaacatgacgaaaccctgtctctactaaaaatataaaaattagccaggtatggtggtgcaggcctataatctcagctacttgggaggctgaggcacaagaatcgcttgagctgcagtgagctgagatggtgccactgcactccagcctgggtgacagagtaaaactctgactcaaaaaagaaaaaagaaattaataaggaatagaattaaagaattacaagttcaaaaagtgagtatagtgaatgccttcagaatggcctttaaatatactctattttataaatacatctggaaagctacatctggaaaggaagattaaaatctaatcttcccacaaggtcatcagtgtgattcccaagcagtaggcttgggctgagcactgcttggagagatcaagtggagacttggtgtgttcttaccatcccaccacccactgccttctctgaagtcgagtcagtcttgatgacgtctctgaagctgagctattaattttaac

SEQ ID NO: 30469 - DNA, 1761 bp, Homo sapiens
gtacaaagaggagctagtaccattccttctgaaactattccaatcaatagaaaaagagggaatcctccctaactcattttatgaggccagcatcatcctgataccaaaacctagcagagacacaacaaaaaatgaaaatttgaggtcaatattgctcattaacattgatgcaaaaatcttcaataaaaaactggcaaaccaaatctagcagcatatcaaaaagcttatccaccacaatcaagtcagcctcatacctgggatgcaaggttggttcaacatatgcaaatcaagaaatgggatccatcacaaaataaaaccaatcacaaaaaccacatgattatctcaatagatgcagaaaaggcctttgacaaaattcaacaccccttcatgcccaaagctcttaataaactgggtatcaatagaatgtatctcaaaataacgagagctatttatgacagacccacgtccaatatcatactgaatgggcaaaaactggaagcattcccttggacaaccagcacaagacaagggtgccttctctcaccactcctattcaacatagtattgggaattctggctagggcaatcaggcaagggaaagaaataaagggtattcatataggaagagaggaagtcaaatggtctctgtttgcagatgacatgattgtgtatttagaaaaccacatcgtctcagtggagtctccttaggctgataagcaacttcagcaaagtctcaggatacaaaatcaatgtgcagaaatcacaagcattcctatacaccaataatagacaaacagagagccaaatcatgagtgaactcccattcacaattgctactaagagaataaaatactcaggaatacaacttacaagggatgtgaaggacctcttcaagcagaactaaaaaccagcgctcaaggaaatcagagaggacacaaacaaatggaaaaatattccatgctcatggttaggaagaatcaatatggtgaaaatggccatgctgcccaaagtaatttatacattcagtgctatccccatcaagctaccactgactttattcacagaattggaaaaaactactttaaacttcatatgcaaccaaaaaagagcctacatagccaagacaatcctgggcaagaagagcaaggctggaggcatcacactacctgacttcaaactatactacaagactacagtaaccaaaacagcatggtgtactggtaccaaaacagagatatagaccaatggagcagaacagaggcctcggaaataacaccacacatctacaacaatctgatctttgagaaacctgacacaaacaagtaatggggaaaagattacctatttaataaatgttgttggtaaaactggctagccatatgcagaaaactgaaactggacccctcccttacaccttatacaaaaatcaactcaaggtggatcaaagacttaaacgtaaaacctagaaccataaaaatcctgtaaggaaacgtgggtaataccattcaggacatagacatgggcaaaggcttcatgtctaaaacaccaaaagcaatggcaacaaaagccaaaattgacaaatgggagctaattaaactaaagagcttctgcaaagcaaaagaaactatcgtcagagtgaacaggcaacctacagaatgggagaagatttttgcaatctatccagctgacaaagggctaatatccagaatctacaaagaactgaaatgtataagagaaaaacaaccccatcaaaaagtgggc

SEQ ID NO: 30470 - DNA, 1055 bp, Homo sapiens
tttataaaccttaatttatttgcctttcagcatttatattaagcctatgatagataggcctgtttgagtcacagccaaacgttgagagatgagacagacctatgacttaatggcctcaatctcacagagtgaggagaaatcaatccaaaaggaaattgatcctgggaagaccgagaagtaccagagtcctgcacaaaacttgttggtagaatccgaaaccaatccacgcctaagatcatgtaccacatcagcagggtattaattatgataccatactgttaagctatggagccctttagttaaatgtctttgtggaccctttcatataaagcatatagaagcagaggtcctctggtaggtattgggaaatggagacacgaagcccagttgcttggccacatcccagggagactctgaagcattgttttcatctttccttgcactgcagagcctaggtagtattctaagtaatcaggtgtcaacctctgagaatagtcgtataggattctctgctgtggattctctgttgtaccctttagtttacaacagagtgctgggttgagtccagttaggaaagatggctatggggattggcaggttgtgtctgtattcaaaaatcaaattgagaaagttagtatagtaatatgactattttatcatatttcggccttatttttcttcatcacttctgatgatcaaacactggctcattgtacttctgtcacctcttagaaagcattggctgtaggcaagagaacccactcaagctgtgagaaatttactggatggctcaggggcagccccaggagggataaggaccatcaaggagcaagaagccaccaagagcaaatgaccactctttttgttctttcttccttcttcctttgttcttttttcttgtccctcctacttgccatccccagtcatcggtgaaacacagtttcctggtctcctcccagtcctggctttacataatgccccagttgagatccaaaaaggatgaaatcagtgtgtgttgtgtatctgagtttacatttctgagcaaattatataca

SEQ ID NO: 30471 - DNA, 1049 bp, Homo sapiens
tagataagaatggcatcttctccaacatttcactcagcatgtagcatccttgctcaaggccatcttcattaggcatgtgatgagtggatgcatcttcaccatgagactgggcttctctctcaggtacccagcaccaccaatccaacaaagattttgccacattcatcaaaaagatctgaattcatgtgtccacggtttgaggagctaagataatggcattctgacatatcagctgtgtcattgttaagataaaattgatattacttttgcccaccgttatgatgttacttttgcccactgttacaacagaagggcttttttttttgagacagagtctccttctgttgcccaggctggagtgcagtggcacaacctcagctcactgcaacctccacctcccaggctcaagtgattctcctgcctcagcctcccaagtagttgggactacaaggtgtgtgccactacgcccagctaatttgtgtatttttagtagagacgaggtttcaccatgttgaacaggctggtcttgaactcctcaccttaggtgatccacccaccttggcctcccgaagtgctgagattacaggtgtgagctaccactcctggcccagaatggaatttttaaacaagattttggcaagattggaatcaaatctggctgtcaagtaatgggcattcaggaaatccttgaaaataatcccttacagttgtacttgtaatgtgcttttttctgtatttcccccaagttcttaccatggtcaatagtgcctcaccatcgctggccattctccctcactctcagaacatcagctgtgctggtcaccttttagttgcctgaacaacccaaactttctccctcccctgggcttttgaacattcttctccttctgaactggaaagactcccctgctgctctgcttctctactggggaagaggctctttcccatgttctttgtctcagctaaaatgtgtccattgcctttccatctcaggtcccctataggttttcttcatagagattatgatcatttagaattatcttaattag

SEQ ID NO: 30472 - DNA, 1029 bp, Homo sapiens
ccactctgttcccagtacctaacacagtaccatacaaatggtaatatggatgaatgaatggtaaaatagtgtccacttgggagaacctgattttactcttgttatagttgaatctatttacctaatgcttctgcagtcctttaagtctctttttaagtactgcctcttctggagtcccctccctgcactggctccatgggccagttattatacaatacagtatggttatctttatttactcctgtgtctcttcactttgtaagcatcccaggactgaatcatgcccaagtctctcatgtccacagtcttccttggcctaggctttatagatatttggtaggtaaataaatagcaaataactatattattagtcctgataagtttaaatcttaaaaaactgtgaatgtaatgcacttatcacttagctataacctagttgataaacagtatgtaatttcacacccatctgatttatccatggttaaaaaaacacacaactgattttacatatggaatgttgaaactgggagcacatacggtgacacctcagagagcctgcatcttacatatctttgcatgtggctcacatgcccaatactcctataaatgtttgttgtgtgagtgaatgagtccatgaatgtatgacttcaacttgctatcacttttggtattagattttcaaatttcccaacatggagatatggaagccattgttatttgaaataactctgtgtttgttactcattttagttagcaacaaaaagatgaaaacgatcaaattttaccattcccacatgtttcagagcttttcccttcttgtggttgtttcctgaacacacatatttgagggaatattcagtactcataacgcgtttaaagacaattgccttgagttttggagcaattgaattctgaaatagctcatttgtattagttataggtaagaagctatccagataacaatacagtctgattctgttggtgtaaaccaccttatcagttgaaattcattgcttcataaaatcattt

SEQ ID NO: 30473 - DNA, 1057 bp, Homo sapiens
tgtattctgtgacttcatattttcttttatcttttaactgagtaatctcatctgtcagtcatgatattactgtgggtcataagggtttgaaaaccttttaccttttttgtaccagtgttggacatggtaatcttaaggaaggctgttcctcaatatagcctgttgaggtgaacatgtttggctgattttcttaactggttttgtctaatattccttgcctgattgttcaagatgtctcaccaccagtccgtgactaagtgtgggggaagatctgtcagggcacccagacaccttagagccccaagtctctagatgtcttctttgtggtaattaccttcctcttagtatccattcaaggagccagtcggaggtgtccaaaaaatcacttttgaaactctccaaatgaggagtggaaagcctggggatactgaggaactgacctttgtccctttcaacttggtgctatcagtgaccacaccccagaatttctgaggctccttgacaactcaatggacattgacgaaagaagtttgaagactgaggctccagcctgtgctctgccatgtgcccttatataaatcacttcctttttctgggtccaagtttctctacttcattgggtcaggtgctataaaatttatattgtataacaaagttaaagtgctgatactgtgaatatttaaaatattcatgtgaagataatcattgcagtaatgactcagtgggttgaatttgcctactctaagtattcttaggtattcatttctaaaatatttctccagaaattcttagtacctggtatgtaggagacatttaataagttttgttgagtgaaaagaaaaccttacctttccctgggttcatgcattgttgattgagcggccaaaaataatgataaaaattacagctgcatttattgaatgctcacagttggccaggcacagttcaaagagattaacacataactatatgtcaagaatatttctaaataaatgtaacattaatattttatttaaatataagcatatcattaagtataaatatataacagtcttat

SEQ ID NO: 30474 - DNA, 1029 bp, Homo sapiens
acctctggagcctgatcatgcttgagcctgagcccctagtgactcactgagctggtgctgtcactgtgtgccctcctacagtccaccatccagaaggggcttttctttcttggccatgctcagggctgtcactattgctaggcagtgtcagtcaaggtgaaaaggattgtggagtttcaggttgagtttgccctgaaaagcaccatctccacagtcagaaattctcacttctgtggtgtctcctgctgtgcactattaaccagcccattggcctatcggtacttcatttccctgtctgattttggcaccttctttgtatttttttttttaactttctgttatgggtagtctatggatgttcctccaagaagagtttctttctctgagctctgctcactcagcagaatgcctccacatgacagatgcctgggaaacatgtcctaatcaattgattccatcttaggtccatcaccaggaatttgctaacatccgtgtgcatatgacattatatgaggactgatacagatgtgggttacacccatttattattatttctcaatgttcagtaggaatataaagggttcccagagggtgtaagaaccaccttagaccctgagaaacaagggcagatgtattcagagcagatgcaaagacagaaatatggagggaaaataacaaggaagagaaatgcaagctaagttcatatgtgattagacattttccatttttagcctcatggcttacatttgcataattcttttaaaaagaaaaattaattatttatgactctagcttttaaccaaaccgtgcatttaaagtaatcactctgggtaatttaaataaaatcttttctgtaaatagtttatgctcattagaatgagaaaactgttggtttattcaattaaaaggacattattgccagtttggattctctctctttttttccacttcaaaacagagggcagtcacattgagacagatgggacttaattaagttgtctcaaaagtaaccagattttgctttaaaaa

SEQ ID NO: 30475 - DNA, 1049 bp, Homo sapiens
gtggacggtgtggtgctctttgtagacctgtagcagagctagccacttggccattcaggaattttgaagtttaatattctctatgcctttaactcattcagaccctgggaaaggcttatccagataatctgtattttaaaattactggaatatcttttttttttttttttcttagacagagtcttactctgtcacccaggctggagtgcagtggtatgatctcagctcactgtaacctctgcttcccaggctcaacagattctaacgcctcagcctcctgagtagctgggactataggcacccagcaccacgcctggctaatttttgtattttttattagagatggggtttcaccatgttggccaggctggtgtcaaactcctgacctcaagtgatctgcccattttggcctcccaaagtgctgggattacaggggtgagccatcatgcccggcctggaatatctttaaaaatgaaggtgttggcttggcgggggtggtacaatgaacatcagaaagagagaaccttgctcagagtgtaacttgggacaacttttcttgagagtatttggactgaaatgtgcaataccctttaaccagtaattcaccttcttgaaaagttgagagggtgcctaacaatttgactacaaggatgtccattaccgtgtcattcatgttagtgacagcctagatctctaataataagaaatttaataagtaacttattacatattcaaataatttaaatatcataaagtgatttaacatgaagttaattgagatcagcggtggatattagcatcatagggagctttaaatgtctttttttggcctatcttttatatctaattttctacaaaaaaccggcattacttgtgtgatttttaaaaagaaacacttaggaaagtatatgtgttgccaagaagggtctttctgttcatcttttccttgcttttaaacataccattggaagaaaaaaaaaattgaagtcccatccataccccaaactagagattgagaaatcactattaaattatgtatgtcctggtaa

SEQ ID NO: 30476 - DNA, 1034 bp, Homo sapiens
ttggggtagagataataacacctgccagaagaggtgccatcagagctgagatctgacgcatgggtagggaatcagtgaggcagggaagtggggtagtcagagaattgacgtgaagttgtcggggcagagcattaaccaaccagaggaaagagccccacaaaggctttaaggcaagtgaaatttgaagcacaggctgccaagtaccaggcttatactttcagatcattctgggtgccatgtaaaggaaggattggattggagggctggagtgaacctggagagaccagatgagcagcagtggtggcatggtgtggggtggcagaagtggaaggatgtgagacaacctgcactgccaaatcttagctcatcagagaccccttggcataggttttagagtttgagccatttaacagaactttctttgctctatagtagagtgcggatctttatccacattgcttaatgaagaagaatggaagattatacatgcaagcatccacagggaaaaaaatgaacacacagaacctcagcagcaagcagggattgatcattcattcatgaggcccgaggcaaagggccagttttacaaatggaataaagatatgtaggccaggctttttttgttttacacagttggcaggaaaatactttgtttcttatttggtctttacatatttcacagtgaaatgtgttgttttgatcaatagatctttaattggagttttatgtttgaaaaagggtccactcaagtttggaacttcgttgagctagagcactagatgtcccttcaatcacccccatgggtctgtgtgaaactctgaggtagaaatgaagtgaattaggagaattaaaacaaaaacatgtccctctgctcggtgggtatttttctttttgaaatacctttatcagggcctcagatctcttcctcacatctcctttgtgcctcacctattgttcctcacaggttgcctgcgctggtcccatctcatcacatgggctctccctggtgggatgtccccgattgagtcctgggc

SEQ ID NO: 30477 - DNA, 1028 bp, Homo sapiens
ctttgttctcgtaagttatttcttgaggaaaatatatgttttgtggggaggatgagggcagtcttaaactgaggacatcaccacaaaggcctggtctgtcattttccttcccaggatttcttcccatatgcttaaatggatgagtcaaaaagaggtgtttcctgctcaacaaagataaaatagagagagagagaaaggacagctctcctgtcagagaggcctgcaaagtccagcagtttgtgcagggcttcactttggtatttattttgcagtccatcaaacatttgtcatactcatggccccttgctttcacaggacatagctgcgattcgacacaaacactttcctaagaaaatatacatttttcattccacaatgttcatgtatccaaggtttgtttcctgttgtgtgaaaagatgtttaatatttgagaagcttttttaaaagtgattcctcattttaaactcagtttctcatctcgtggtctatttttttctgaactcttgaaaagcactggaggagcttatgagcttcctttctgaatagttccagccataagtaggaggaacaaatcaggaaaacatcctcatatttccgtcttcttaaattgggagacccgtataagataaaagtgttggaaattgagtgttggagaagttggagtctgcttttcatagacattctcaataccattttggagacatctctgagatccaaaacatcttgtttgttcggttctactctttgtgggctccatccacaggggcaggggtttagggcaagtttaagagagccctggtcttcttttatcagaagagaaagcattcttcccagagtaaaaagaatgggaaagtctgatgattcaagtggagaccttaagatgtctcatttagttgctttgcattttctagcacttctgatgtcataagctctagagagacagagagaaagtctactgtcacaattcccaagtgtttggggtctttatttatgtgtgaattgagttgaattagtatgttctaaagtca

SEQ ID NO: 30478 - DNA, 1029 bp, Homo sapiens
tacttggtttgccactgaagggggagactgaggccagcacatggatctggggagcagcagcacagaggtggtcactgcagcttattgagggagaggagagctaaggcagacagtaggtactggggacagaatcttagggaaaatgagtacttgaggaatgggcaaaggacaaagatcctgtgaaaaggagaaagcccaggagtatgggacctggaaactgagggaatagtgtcgaggaagaggaagcaatgggctaagaaaagtaggaagatttgagggagaaaatcctgtaaggtttggcaatgaagaggcccctggcaaccgtagagaaagggatttccatggcatatttggtggtggagggagggcaaaggcagaatgcagtgggttgaggcataaaggggcaataaggaaacagagatggcacttggttaatgaatacaggacattgggatgggaagatgagctcagcgtctgcattctgggggaggaagcagagagtttagctaagctgtgtagaatctgcactaaatgcagtttcttctattgtttccctacttccacctttttctctttcttctttcccttctcatctctctattccaaccaccccgccatatattgttaaccgcacgataggacctttgccctcatgaaacttacattctggtaggggaggcaggcatgaaataatcaaaagtcctgattacttatactcaaccccacagataattgattattataattttgataagtactataagagtacaggcattaagaggagtcctgccttcttttgaggattgcttctcacaagcaaaagaagaagaaccaaagtaatgtacattagaaggtgctgaatacatgagctgactataaaatattatttgttttgtttaattttgagtttgaattcccaaatacaatttttgcctttaatggaaaaagccaaactctcaagatttttttttgacccctccagtccatctgaaactaaaacataataatggtaattaatgcagcgttgac

SEQ ID NO: 30479 - DNA, 1098 bp, Homo sapiens
cagaccagcatgcatccagaaacatttttaaaaagacatatcactgtaattgagaatcacacacacacaaaatcaaaactgagtattttgctggatcacctatccggtcgagaagacggaccaatgatggacaagaaccagctcagtttggtagtcggaacatggctggggcttagagcatatgtgtacaaagtggtcacatacatatttatactgtaaagcacagtatcctcagagggttgcagaagaagggccaccccatttgagaaaggagagagactcagctggaaggatctgggaaatttctttcatggaaaaggtggccacaaagatggagcccttcatgtcttttcttccttcataagtatcttcaacaatttttagcaggaaaagcaaaacaaaataaagctattaaaccaagcatctccctaaataaaattacacacacacacacacacacacacacgcacacacacgcacacgtgatgaaggctcagcattctgacgttggttgttggttgatgctattacaggcataaatcaggtaatggcagttggcttggaagaaagaatttctttccctcttgcctgcatccctttattaacttcacttgcaaattcattgccagcttcctgccctgcttgtcgtttagcataaaaacctgaagttgaaggctctctctgttcctcagccatctcagagatggtgagactagagtccactgcccagggactaagttaaggagaggcattggaaatggggtgacaggatatgagtcaatgggcccgaactacttaccacaggaggaaaaccaacaagagagaactccctcttccgtggtggttagccgtggcatctttcgaaagttaacattttgtagtgttgatggatactactttgagattttacttgagtgaataaaggaagtcaatgtttttgcagtttcaaaactagaatcaattagttgtccctaattgtacctcatattcaaaacggtctgacggctccacatacccaaaagtcttttgatatggtcaactgctcaaaggaataatgtcaaagaaagttctgtaaattttttaaaaagttacctgcca

SEQ ID NO: 30480 - DNA, 1021 bp, Homo sapiens
ttcctacattataaacaccccacaaccagcatgaaaggcctcaagacacaagaatgtccagacacaagaacgtccggtcgataaaatggtaggcttgcagggtgactaacaccagtgatttaggggagaaaactaaaaccacttccccagttattcatgcactcatcagcttttccggagaaatgccctaacagccattacatctggctatgattcccaataccctcatctactccaggtaaaggagccatgcttagttcagtactgctgtggccagtgtgacagcgaatagatggttctgtgtgtctgcaaaatgccaccagtatgctgagcccagccccagctctggagatcagtgcttttgcttcctagctaaggagtacgggtaggtttgagacaaaaggtagaggagagagaattataaagtatagggggatatgactagattctttggtaaatgtaagtaagaagccctttctcgtatcacggactgagttttagcagctttgggatacacacacacacacacacacacacacacacacacacacacacacacacaccattcaatgggaagacaaatccaactgctaactagtctgctatgatttacagaatttacattgtttacatgtataccatataggtggagacacacacacacacacacacacacacacacacacacacacaccccccattcaaggaggggacagattttcctttgcatctggtgttttggaaaccaagaagtctacaaggtaaattcatatcaagcaaagagttaacttttctactcccaacttggagccaatgtttagaggcatctgaccttggctttcctgtcattaaaagtccctaggactgtcaccctgctgggcttctcaccctcatcggtccactcccaagccctgtccatgaaacaggacttgggaaggtaaagattgccctggctgatgacttcacggacttttgtttttcttttctttttcttcttccccttgctagtacgaagaaggaa

SEQ ID NO: 30481 - DNA, 1055 bp, Homo sapiens
tctctctactttgcagtcttgggggagcttgggatctgggccaggttaggttgtgagtaggatggagaagtgagagctcagtttcatagggtgttagatataaccctgtggttttatttctgaagtggagggtggagggctgtggggaaggccgtggtagttgatatcaaagactaggatgagaactgctttagcagcttattattatttctttaccattattactttaagtagactattaaagattaaaaagaaaaggaagaaccattccttttcccttatattttcatgtgttacatgattcatttctctccacttttctgttcttccttagttcattccctcattgtatcttcccttctatcctgtttctctccatttttctattcaatagttcattccctcattgtatcttcccttccatcctgacattcattctgttctcattttcattcattcactcatcaagtcttgactgtgtgtctgttatgtgccagactctgagcgaggtgttggggaaatggagagaaaccacacagatagagcccttaacatcatggcacctgtggtatatagtgtgctgtattattaagaatcataactgctttgaaggaaaagtaaagacacataaagtgtaacagatctaaagtggaggaggaagatgggaactagttcaaggtttgggcagcattccaggaacagcatgtacaaaggccttgagatgagaaagcatttgacacattggaggaatttaaagaaggtggacacagctgacatatagaggatagcctggaagatgtcagaggatgaggctgcagaggggccgcatggctcaggaccttgggagtcaggttaaggattttggattttatactcagagcagtggaagatcactgaaggattttaagaaggggaagaaaatgatcagattttcattttacaaaaagatctctctattgctgtgtggagaacagagggtgatggggtaagaacaatagtaaaggttcgtacagttttcccagggattcatgacttggacccgggcagtgggcaca

SEQ ID NO: 30482 - DNA, 1035 bp, Homo sapiens
ttcgtcagttctcccaagagtctacagagtgaccttttacattgtaatcagatcctattgttcccttgactaaaactcttcaagagctttccatctcacttaaagtccaagcatcttggccttctctgcacacttctgcatgatctgacccccaagtactggtgttgtcttgtctgtgtctactcactcccttcctctgcactggccactgtcttgtccctctttttgtcctgcagccaagccaagttttccccctcatcaagccctttgcgttcactattccttcccccagttatctcatggctcattcctcctcagtctttgggttctgctcagccatgtcacctccttggagacatcttcccatccatcctatcaaaaatgagacccacattctatcactctccccttcccctgcctcattgtttcttagcactaactgctattctaaacatgtatctttatttatcatcttatttaacatctgtttctactaccagaatggaatctctgtgatggttaggcactgccatcttctcagtgcctggcatacaaaaggcactcaaatatagaaatgaatgaatcatgctgagagctaggaagagtgaagcactgtgaagtggaggaaagaatgtcgggtcaagacccaaaagccatgccttctgttctcacctgggcttctgctctgtgatcttgggcaagtcactgaacctctctgggactctgttgcccattgacaacaggggttggcaaacttttctgtaaagggccagatagacaatacagcccctgtcacaactactctgcttttatagtgcaaagcaaccactcactcattatataatgaatgggcatggctgtgttccaataaaactttatttacagaaacgggagatgggctgtggccctggggctgtagtttgctaaccctgggtggtttccagagtccctcatctttaatagtctgagatctcttgctttgctgttgtcatcatgttaaagaaattgtgagtaactttagagagaggccctgtt

SEQ ID NO: 30483 - DNA, 1024 bp, Homo sapiens
gttgtccctcggtatatgagggggattggttccagcaatctgtgcttgcaccagtcctgcaactggccctgtggaacccacatgtaggaaaagtcaaccttccaagtatccaggtttcacattccataaattatgtattttccaatctgtgtattagtggacctgtgcagttcaaactcgtgttgtgcaagggtcaactgtatatgaaaaagtacagccattaaaagtgcaaggaaaaagaggtacatggttccataagagaatgcagtctggcaattcagcctgagaggtgagggcaggcatcccaatggatgttatagccaggctgaaatctgaagtactagccagaatttaccacagagaggggaagagacgagggccattccaggtaaaggcatggcatgtgttacgctgagaggccagtgagatggcacagcatcttagggactagcagaaggcgggcatgatcacagcacagagggtgaggaaggagcttgggcaagcaggtgctggagaaggggtgagaggctggttgctgtccccgacctcatctcccggtcactttattattaatattgaaaaccattggttttcaccatctgaccataaccagagaaaagccccttgctgtccctcagtatgcttctcagaggaggtaaagaggatgttgatttcacaagcattatgaaatccccgtacacgtttctcagatcctgagctttgatgtggagttggcagttgtgggcaaatcctttctgcatgtgtctgaggggcagcagaatggcagagttgcattctcaccacatcagtgcctgggtccagtgcagtcaaggaagaaccagccctgctggggctccagtactgcctggatgggacgtaacatttcctcctgtgagtttgtgtatatgttagtgcagatgcaaacactgcagcagaccagaagtggcaaatgagtgtttacgtcctgcaactacctgctttgtggcctcatggcaaccttgctcagcagcccctggggccatcc

SEQ ID NO: 30484 - DNA, 1034 bp, Homo sapiens
gggtaaaagtagataagaaggaagttagacagttgggaaaagaggaagtctggaaggaagatactttgttgaagtttcgatatctgtagttaagccctcttagagtattgagaggagttgtgagaacagtcacacagatagttcaaaagagaggtcagtgcttcagattcctgaatatttcacatgaaaggattctgggctctttgagatggcaattcttataacaataattttgctgtcttggtttccaaagaccatcccagtatcttggggtcgctgtcctaggaggctcaccccatattggcacatggggaaggatcctatgggataatattttctggatcggttgtgttcctgggtggtgagtaagatatcaccagatgcagttgtgtaaagggactttgtctctatccatgtgatgaagattcccagcagggagggagccctgggacatctgtaatcaaattgaagtaaggagcactgtgacctccggggaaatatgttgatgattttctggactgtctaaaacattacaaaccccaggaatggtgatttttttttttctgtaactctccttgggacttgagtttcacaaaagcatttgctgtctttgttttccttattaaattagcaagactgacttaaatcaatatactgttactgcttgaaatgttgctgaaagaacaaaatagacgggcttgacaaatgtctcaggttccatttaggttatgtgggggctgaagggagagagtgggactcactgaagtagtcgtgttttctctgataaaggtcaagaaaagaaaaatgtggaccaaaactaaggaaaatagtgaaaggaagctacacttctgtttgtggcttgtggcaggtgatatttgtttttctgaatagagttggccataggattcccttaagcatttttgtttatttgcttgtttgttgggggagagggttattcttatttttttttttgttgccttgttttttgcactttaaatcattttcacgctcaagaaataatgagctcaatcccg

SEQ ID NO: 30485 - DNA, 1031 bp, Homo sapiens
tgttgtttgtatttctgctgtgcttggtgcaacacgcttgagcttttacctgtccaaggccattcatattttccctatgggatctggcaaatgtccttgtcgctgcaccccacaagtgttcattaacatggctggcttgtgtggaattccctgtggcagcttctgctatttaaatcacctttctaaaaggtgacacatccaggtagaatccaagatctgtatcatttctactcctgtctctgtgtggtgggacttgggagctttccctgtctttggtaatcacattacacttcagcgagtgccctggccttggagtgtagagagtgttaaaggagaattctgttatgtttggatggctgctcgcctttaatgccgactgccccgctgatgtctaatactcaacaactcatgtaatgagtgtaatggcttcgtggcttcctgctgacctgaccatgtcctcagaattatgctttgtcagaggtggcattgaagggaacaaggagacagattggtttggacaagtatatttctgggccaaactttctggaaggcagagacatggagcttccaatgaaccactctttaaaatccaaaagctgctgcttgagcatccccagttacagcaataacagtaactgccctcatcttcatcatcatgcagtctgtctcacttattaaatactaactataggcaaggcattattccaggcagttaacatgcattaccttaattaattcccatcacaattccatgaagtaactactattattatttccatttgacaaacaagggactagaagtggaggctcccagcaacttgtcaagctctctcacaggcatgagtgagaagacagaatttgaactcatgtctctcagattccagagcatgttctcctgataaccattcatgtcttctccatagttggagcagactagcatatcttctgcagagtttttctttttacattcatatttgctctgccttaagagatagagaaagaaagtctttctttttatttatttatttatt

SEQ ID NO: 30486 - DNA, 1094 bp, Homo sapiens
gtaaggaagtctaaaaatactaatttgggaccctcacgttacagacccaggaccacaactttttcttctacctttctccaagatggcttttaagttcaaggttacctcatgattcaatgtagctgctgagccccagccatcatatctgcaattcaggcttgcaaaagaagagttcagggagttccaaaagctccaaaaggccaagtttcaaattactttttaataaatgctttaaataagatttttaatgtattaagcagcctcccatacaatacttgtgcttaatcacttggccttacctcactacaaaggaacctgggaaatgtgcatattaaaaagtcagagttctgctcaccagaagaggagaatagttattgtgaaactactgatagtttctaccacatccagcatgccccagtttgcttcaaactatatgagtcctctggcttcctctgataacccctttggaactccttgagtgatggggctgtattcataactcttctcctagtcttccctccccacagcatgcccaatgcggtcctgaacacagattgtcatagccaccttctaaccacctgtccgtgtgcctgcctgaccccagacaatggaagtaggaacattcaataacacctgttgggttttatgaataataatcataacagcagcaataccaacactcagaggtactaacatttattaagcctcaatgacatgccccacactgccaagtgcagtacaggcatcattgtggtgcagttgctatgaaatatggacctggcttcacgaatgtggcagagcccaaggacgcttccccagaatcagctctcctgcttcaaatgggttttgcattaactcattcccaaagcagaattcagctttttccttctaaggagacaaaagaaatttaatattttctatattgaattaattgtgattccattttccccttcagtttcataagtgaagctaatttccatgggaggggctgcgtgaatgggcaaaccagctggcagctaggtgcatttactgggcacccatgaatttgatcacttgccccaggagcaaagcaaatgcggttggtagagcaacat

SEQ ID NO: 30487 - DNA, 1141 bp, Homo sapiens
ttatgtcccatgataggtctctatgtctaatgcctcccttgtcctgtttttagggctgtatttgcagacattaagctgtttcaagattgtttttaggccagttgtttagccaaagtgagctaatttgatgaatcattacaggaaaattacctggcctcacggtacatagtaggtgtttaataaatgttgagccccacagttgctaaccacccctaaattagccagcctaaattagctgagcttatgctgttaaaatgcagcctgctaattcttagagcaaatatttttcttggtcaggatttttgtctagttggaaaagaaagaacagtatcagcaaaatggctttaaacatgtcttaatgtcatgagtttgtcatccaaggctctacccagcatgggtgcagggctaccaggctttgtttgtattgctttgagttgtttcttcagaggccgtatctgccttctgtcaaagtttaaagtttcaaagttccaccatccatgtgggcacacagcgatgctaatgataaggttggttggagtagcctggtggtgatgtcatggggattaaggcatgttatctgtaataagaatacacccccactgctgagtgcagctgcacacagcaccagtcttgggctgggcatgattctcagagctgattttagagtcaaatgaaagcaggcaattatcatgttctttaactgtaatcagccgaacaggatacaggtagccgcaaaatggagttatttaaaacagtaacaaagtcacttcaaaaagggtaataatctggaagtctcctgctgcaatatctagttaaagctgtccaagtgtggagaagacagggaaggcttattttgtaacctcgtcaatggcaatagtatcaggaaagcctccttttgaaatagaggagtggggaacaaggggagggagagtgttaggacaaatatctaattcacatggggcttaaaacctagatgatgggttgataggtacaggaaaccaccatggcacatgtattcctatggaacaaacctgcttgttctgcgcatgtatactataacttaaagtaatatttaaaaataaataaataaataaaaggaaccttggcctgggggctgccccagagcaatttagtttagccc

SEQ ID NO: 30488 - DNA, 1035 bp, Homo sapiens
tgattgggtttttctattcctttttttttttccatactctatgtaaagtacacactattcctttagtagttgccctttgcctttttacgatgtttcaattggtgaggatctcctctctcctccagaacaaacaaaaacttacattttgttaagttggattacctcacatctctttcatataatattttctaaccttctagttctactgtgtttttaacccatgaaataactattactattgctgctgcctatagtaaataacatgtttacctgcattttttatatgtttatagttactctttaatttaaaaaaagcattgctttttgttttacagtacttcagaagtttttccaagaatgatctgagagtgataaattctcattctttgtctaaaatcccaaatttagtatgtactcaacagtgatggtttatctccataacctcaaaattaaaatattttgaagatattccattgtcttctcacttttagccttgtacctttgtaggtagtctgacctctcccccgtttcggatggcttttacagtgttcagtctctctcgaatgttctgaggtttcactgaagtgattccagatataaattcatttctatttttatgtgctttattctggataatttctttaaactcatattccagttcactaatttccttttgatcctgtctggtctgctgcttaaacaatctattgagcttttcatttctagacatttcatttgcttctcttaaaaatatatgttttcttttatacagtcttattcttcggttctctgtaccaaattataaaaaccttttaagattgttctaatagtttaaattttaggagtatcaatcctcttttttcttctatctgtgtttttccatgttagattattggctcatgtattttgtcatttttaactgtgaattgatctctactattaaatattatttctctgggaacagaatagaatttgagtttctcttcacaatatatttgcattttggcttctatcatgtatcctattagtaacgac

SEQ ID NO: 30489 - DNA, 1029 bp, Homo sapiens
ttgctagaactaagtaaatcatgtcaggtggttctacccatatagcagaagtcttttcagtcttcagaagtctttgaagaacaaagttgagctgcgtcctactccatttctgtgtcctgtttccagaatcattagatggtttcgtatggaaaatacatcaagaggtgactcagttgctctaaatagaaaccttcaaattggcaactccaaaagtggacatttgtatgtctatagcatagacagatctgttataacatacagggacagtatgtagtgtttttaaagggattttcaaaaatatagggtttattaagaatgcaggagcctaaaagaaaataagaatttacataagaatgtcattagggttggtggtttggctgctctaaccaataatttttgtcatccaataccccactgattattaaattaatctgttattcaaacagcaatcgaaaacaactcagcccatattttctgggcatttgtgactgtcaacaagttggacaaaattggaatctaaaaaggatgtaatgttttactattttccagtatgtttctttccttcttgattacccagccccctttgccaagaaagagattcacaaagacttgcttagaatcaattgcaaaataaatagttagaaccagttaagaaaaataattaatcaaaaataaaactttaaacacatgtaacattttcatttcaacatttcagtgttggcaaaatattaatttctaaggtaaattaggtttttgtttttgttttttagtgtgtgcttttttagttagtatcactcatcacttctcataaaaattatattgccgtcggtttcactttgagatctgtacacaagctttgctcatcttcctggaagccccaaaagctgtggctacagttttcttctctcatcgcttctccccacgcacctttcatttatctgctaagctgaaagaaagtaattggtctcgaagctgtgttgacatgtttcgtgggctacagttcagaaaaccatagttcagggattccat

SEQ ID NO: 30490 - DNA, 1085 bp, Homo sapiens
gcttgtaatagagtgatatttaaatgatattttagaaaaagctgtttcctcaaacttctgcagatttccttctagccaaataaaatcagattacaacactgcttactactgtcagtattcagactcataacatttaatgttccagtatattgcgtgttcattatatccatatagcaaatatcctcattgcctgatgaataatacaagtaaaatttatgtaattatgttctttgcatgtaaagaatgtatcatttgagaaaagtttatagtaagaccaccgtaaaatgctaaagtcacttttagtattcgtttttaaactcagtgtactttggtaccttctccttcgcatttttttttctgtttatagttttaccttggaaagataaaaaacaaaaataaaatagaagtaaatccttgaactggattagaaaaaaatactcagtcaagatctaaagtttatgctttcgaggataatgttgctagcttaaaatcttataacaatattaattacagttttcttgcattaccaccttagtatgcttttggtggatagtttagtaatttcttttttcttttgtagaacataaatcaaaaatttctgtgaaggtaagccgtataactttgacctgacctgttttcaaatgtaaaatgcagttttatttatagtggttagaaaataattcctgggaaatgtcaagtgttctaaggggtttggaattatagtgaggagttattattttcttgctttcagattggtcctttcacagaaattgaatcattttaggtttagcccaatagaacctctttctctagataagtgctattcagtaaagcatctgtgttaatggaagtgttcattaataaaatcagtattattgaatatggaagccactagtcatgtatagttattgaacccttaaaatgtaactagtatgactgagcaactgaatttctaatttcctttaatttttaatggaatttaatggataatggattgtactggacaatgcactccagagatctttaaaaatagatattcagactttaaacagaaatgttttttcttttcatactcaaattccatt

SEQ ID NO: 30491 - DNA, 1046 bp, Homo sapiens
ctaggactacaggcacgtgccaccacacctacctaatttttgtaatttttgtagagacgaggttttgtcatgttgcccaggctgatctcgaactcctgagcttaagcaatctgcccacgtcagccttccaaagttctgggactacaggtgtgagccaccactccctgcttcctttttttctttttgacaggaagggaaacttaatggctacctcaaggattgttttgagagttaatttaagtaacgtgtaagacatgtaagaactgtatagcactatgccaagtattataacagatgtaatttagtgttaattttaaaacatgtattttacctcctaggtcaatatagtctatatttaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatgtatgtaactcctatctgttgttattgtgtggtcatcttcagaatatggttttgcttttcctttacttgcatgtgaaatagttactctgaatacttagagctatttaaaagcttattacttaatatttatggagtcagttgtgtagaaatgtatgatacagtttctgttatcttttgtgttttaccttagagagaatgaatggaaaccagctgatatattcagtactctgggggaaagggaatgtgatagaagttcgttggaagcaaaaaaagcccagtggaggaaagagctaggtaggtaacttttatacctttattatagttttattggcttaaagaatatgtattgaagccgggcacggtggctcacacctgtaataccagcactttgggaagccgaggtgggtggatcaggagggcaagagatcaagaccatcctggccaacatggtgaaatcccatctctactaaaaatataaaaattagctgggcgtggtggtgcacgcctgtaatcccagctactcgggaggctgaggcaggaga

SEQ ID NO: 30492 - DNA, 1719 bp, Homo sapiens
tggaaggccaagatgggaggattgcttgaggccaggggttcaacatcagcctgctggagcaacagagtgagaccctatctctacaaaaaaacagagagaagcagcagaaataaggagtgaattgatgctggaagtcaagtgtgttagtctgttttgtgttgctataaaggaatacctgagactgaataattgataaaagaggtttatttggcccacagttttgcagactgtacaagcatggtaccagcatctcctcggcttctggtgaggcctcaggaagcttttactcacggtggaaggcaaagggggagcaggcattttacatggcaagagagatgccaggctcttttacacaaccagctctcatgtgaactgacagagggagaactcaagcatcatcccaaggggatggcaccaagccattcatgagggattcatctcctgtgacccaaacacctccccttaggccccacctccaacactggggaatcacatttcaacatgagatttgaaggggacaaatatccaaactgtatcatcaaggtaaaagaagaatgaagagattaaacttatgttagcagtatcagaaggtttggcggtcttgatgtgtgtttatatcacaatttcatctttaaatattttctttcagcacattccacatcaaaatgcaataccaaatgtctgaaataatatggaactacttggaaatgaccagaatattttgtgctttaatcatttttgttgttgttgttgttttgagacggagtttcattcttgttgcccaagctggagtgcaatggcaccatctcagctcactgcaacctctgcttgctgggttcaagtgattctcctgcctcagcctcctgagtagctgggattacaggcacctgccaccatgcccaacttactttttgtatctttagtagagacagggtttcaccatgttggccaggctggtctcaaactcctaacctcaggtgatccgcctgccttggcctcccgaagtgctgtgattacagttgtgagccaccacacctggccttatgctttaattattttaaaaatcagtttactgtttttttaacttgtctcagtaaagtgcctctatttaagtcatgcttccagtaacattcttggaatttaaatttatacaacattgaattttgtatttaaagaactactgttgattggggggttagttttgactatatctctcagacacaggcttttatgttttttacttgtcagcaattaagaaataatagctaacattcattgaatatttactttgtgccaagccctatattgagataggcactattattatccccattttatagaagaaaccaaggcttagaaagcttaccagcagttggccaactgcggtgggctcatgcctgtaatcctaccacgttgggaggccgaggcaggtggatcacaaggtcaggaaatagagaccatcctagccaacatggtgaaaccacatctccactaaaatacaaaaattagccgggcgtggtggtgctgcctgtagccccagctactcaggaggctgaggcaggggaatcgcttgaacctgggaggcggagattgcagtgagctgagatagcgccattgcactccaggctgctgacagaatgagactctatattaaaaaaaaaaaaagcttaccagcagtttgctaacagtcacgtagctgggaagttgttgaacttgaat

SEQ ID NO: 30493 - DNA, 1049 bp, Homo sapiens
tttcagtgtacaagtcttactcctccttggttaagtttttctttttaattttttaaattttttttgtttttttatatatttttctttttattgttttggttaagtttattcctaagtattttttctttttgatgccattgtacatgggatttttaaaaaaaattttatgccattgtacatggaatttttttttttattattatactttaagttctggggtaaatgtgcacaacatgcaggtttgttacatatgtatacatgtgtcatgttggtgtgctgcacccattaactcgtcatttacattagatatacctcctaatgctatccctcctccctccccccaccccacgacaagccccgatgtgtgatgttccccaccctgtgtccaagtgttctcattgtttagttcccacctataagtgagaacatgcaatgtttggttttctctccttgcaatagtttgcttagaatgatggtttccagcttcatccatgtccctacaaaggacatgaactcatcttttttatggctgcagagtattgcatggtgtatatgtgcatagtattccatggtgtatgtgtattaatccagtctatcattgatggacatttgggttggttccaagtctttgctattgtgaatagtgccgcagtaaacatacgtatgcatgtgtcttcatagcagcatgatttataatcctttgggtatatacccagtaatgggatggctgggtcaaatagtatttctagttctagatccttgaggaattgccacactgtcttctacaatggctgaactagcatgtagtcccactaacagtgtaaaagtgttcctatttctccacatcctctctagcacctgttgttccctgattttttaatgatcactattctaactgctgtgagatggtatctcattgtggttttgatttgcatttctctgatggccagtgatgatgagcatttttttcatgtgtctgttggctgcataaatgtcttcttttgagaagtgtctgttcatatcctttgcccactttttgatggagttgt

SEQ ID NO: 30494 - DNA, 1043 bp, Homo sapiens
cctttatcattttttattgcatctatttgattcttctctcttttcttctttattagtcttgctagtggtctatcaattttgttgatcttttcaaaaaaccagctcctggattcattgattttttttgaagggttttttgtgtctctatctccttcagttctgctttgatcttagttatttcttgccttctgctagcttttgaatgtgtttgctcttgcttctctagttcttttaattgtgatattagggtgtcaattttagatctttcctgctttctcttgtggacattaagtgctataaatttccctctacacactgctttgaatgtgtcccagagattctggtatgttgtgtctttgttctcatggtttcaaagaacatgttaatttctgccttcatttcgttatgtacccagtagtcattcaggagcaggttgatcagtttccatgtagttgagtggttttgagtgaatttcttaatcctgagttctagtttgattgcactgtagtctgagagatagtttgttaaaatttctgttcttttacatttgctgaggagtgctttacttccagcttcgtggtcaattttggaataagtgtgatgtggtactgagaagaatgtttattctgttgatttggggtggagagttctgtagatgtctgttaggtctgcttggtgcagagctgagttcaattcctcgatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccagtatgtaatggccttctttgtctcttttgatctttgttggtttaaagtctgttttatcagagactaggattgcaacccctgcttttttttgttttccatttgcttggtagatcttcctccatccctttattttgagcctgtgtg

SEQ ID NO: 30495 - DNA, 1026 bp, Homo sapiens
acactgcaagaagaaaaacggtcttgggcaacagatgaaataaactaacactgtgatagctgataaacttaaaaaaaattgcaaaacactttcataatgttttaaggaagtttacaaatttgtgttgggccacattcaaagctgtcttgggccacaggttggacaatgctcgtttttcttttcccattttgacctctaaaacatttcttgaggtataaaaattgttaaatcttttacctaaagataatgttccttttgaagtgattgttttagacttaaataagttggatggtttttaatctggttagaatgtaggaggacctgagatagaaggatctttactttttgtataaatatttcttctgatcaaaacagtgagttgtaaactatgagctttgtgatcttttctggtaaaaacaagggaagaaagtaacattgtgaggtatatcgtcattgtaggattctgtcaaacagtttttcttaattatgtcttgtagttatttcatgtaatgaaatgttttgttgtttgcctgttgcatttcagaagaatttgagtagaatatatttttttccttttttaaaagagtatcctaaactcatcaattaaagtggcagcaaacttttatgctactgttttcattttttactttttccttaagattcaaagactcgttctggacacagtatatttttgttattgaaacatcataggctgtgatagagctgtagtagcagaaacctagaagacagaggttctcctagagagagacatgattcaatagggaaagtctcttgctctcacacatctttctatattctccttgttcttggtccaaagacaatattccaaatgttgtattccaaagccaaatgtaaaacaatattcatctgttttaaattaataactctttcagcctctaaaagagacttagaattttgaaaaacaatatttttgagacagggtctcactctgttgcccatgctggagtgcagtggcatgatttcagctcactacaacctccacct

SEQ ID NO: 30496 - DNA, 1034 bp, Homo sapiens
taccacattttgtttatctatttgttcatcaatggacactcagattgtaaatagtgctacagttagcacaagagtgcaggtttccttttgatatacagatttcatgttctttcgataaatatccagtactgggaatgctggatcatatggtagttccatttttagttttttgagacgtctccatactgttttccatagtgactgtatttatttacattcccactaacaatgtataaggattcccttttctccgcttccttggcagtatctgttagtttttgtcttttggtatgtttgtttgtttgcttgtttttgagacagggtcttgctctgctgcgcagtctggtatgcagtggcataatcatggctcactgtagcctcatacccctgggctcaagcaatcctgctgcccgagcctccccagtagctgatattacaagcatgcgccaccatgtcaggctaatgttaatttttttcttttatagagacacagtctcactatgttgaccagactggtttcgagctccttgcctcaaacagtcctccaacctcagcctcccagagtgctgggattacaggcatgagccaccgggcccagcatttttgtctttttagtaatagccattctaactgaggcgatatgatatctcattatgggtttgatttgcatttctgtgattagtaatgttgagcattttttcatgtacctgtttgccatttatatgtcttctttagaaaaatgtttattaatgttctttgcccactttttaatggaattatttggatttttggtgtgtgtgtgtgtttagtttgagtttcttaggcattctggatagtagccctttgttggatgaatagtttgcagatattcaaactactgaatatgcaagctattgaatattcaaactactgaatattcaaactgggggacagactgtctctttcactctggttattgtttcctttcccgtgcagaagatttttagttcaatgtagccctattcgtatgtttttggtccctgtgtttttgaggt

SEQ ID NO: 30497 - DNA, 1050 bp, Homo sapiens
aatttcagacctggttattggtatcttcagggattcgtcttcttcttggtttagacttgggagggtgtatgtgtccaggaatttatccatttcttctagattttctagtttatttgtgtagaggtgtttatagtattctttgatggtagtttgtatttctgtgggaacagcggtgatatcccctttatcattttttttttttttttttgagacagagtgttgctctgtcacccaggctggagtgcagtggcatgatctcggctcactgcaagctctgcctcccaggttcacgccattctcctgcctcagcctcctgagtagctgggactacaggcgcccaccatcacacccagctaattttttgtattttttagtagagacggggtttcaccgtgttagccaggatggtctcaatctcccaacctcgtgatccacccacctcggcctcccaaagtactgggattacaggtgtgaggcacggcacccggccccctttatcattttttattgcgtctgtttgattcttctctcttttcttcttattagtctggctagtggtctgtctattttgttgatcttttcaaaaagccagctcctggattcattgattttttttgaagggtttcgtgtctgtatctcctacagttctgctctaatcttagttatttcttgtcttctggtagcttttgaatttgtttgctcttgtttctctagttcttttagttgtgatgttagggtgtcaattttagatctttcctgctttctcctgtgggcatttagtgctataaatttccctgtaaacactgctttaaatgtgtcccatagattttggtacgttgtctctttgttctcattggtttcaaataacatctttatttctgtcttaatttcgttatttacccagtagtcattcaggagcaggttggtcattttccacgtagttgagcggttttgagtgagtttcttaatcctgagttctaatttgattgcactgtggtctgagagactgtgtttttatatctagttttttttgcatttgctgaggagtgt

SEQ ID NO: 30498 - DNA, 1049 bp, Homo sapiens
ggtaccaattacctgaatgtctggtagaatgctgctgttaatccatctggtcctggactttttttgttggtaatttttaaattaccatttcaatctcactgcttgctattggtctgttcagggtatctaattctgatttaagctaggagggttgtatttttccgggtctttatccatttcttctaggttttctagtttatgtgtgtaaaggtgttcatagtagccttgaatgatcttttgtatttcagtggtgtcagttgtaatatctcctgttttgtttcttagtgaggtgtttggattttctctgttcttttcttggttaatcttgctaatctatccattttatttatcttttcaaagaaccagctttttgtttcatttgtcgtttgtttcaatttcatttagttctgctctgatgttggttgtttcctttcttctgctaggtttggtttgttcttgtttctccatttccttgaggtgtgaccttagattgtctgtctgtgctctttcagacttttttgatgtaggtgttttagggctatgaactttcctcttagcactgtcttaactgtatcccaaaggttttgataggttgtgtcattactgtcgttcagttcaaagaatttttaaattttcatcttgatttcatttttggcccagtgctcattcaggagcaatttatttaatttccatgtatttgtgtggttttgaaggttccttttggagttgatttccacttttattccactgtggtctgagagagtgcttgatataatttcagttttcttaaatttattgaggcttgttttatggcctgtcatatagtctattttggagaaagttccacgtgcttttgaatagaatgtgtattctgtggttgttagactaaatgttctgtatatatctgttaggtccatttgttccagggtatagtttaaatccattgtttctttgttgactttctgtcttgatgacctgtctagtcagtggagtattgaagtcctccactattatggtgttgctatctcatttcttaggtctattagtaa

SEQ ID NO: 30499 - DNA, 1075 bp, Homo sapiens
atgattggcctatcattatccacttaggaacatacatttgcagaataattggctgggattgatgatacaatttgtgactgttagagatctctgtgttaaatggcctttttaaaaagtagatacctagttggctaggagaaccctaagtggtgcagacaagataggtatgtatggtggtggtaccatatttgagctaacctaacaaaaatactcacttgctaaagttttaaagtgtagagcactttaaacattttcttgccttttgctgcagttttcccacttggcaaccttcactccaaaattggctggtaaagggacacatggtctgggttccagtttcattgagttgataggctgagccagttacccctaggtaacatgaggaaatcagtaaagtatcatttgaaccgcaagaaatggtcataaatcttgtgtttaccttttaaaatctatttttaaatgtaataaaagtttttaaaactttgaaaacttttagtataaatttgaaatgggtaaaaagagttatatttgtgattgaatacagctgtagaaaaagatgttaaaatgtaagctccaaaagggcaggaactttgccttgttgactgttgtacccttagtgtctaaacaagtgcctgatacataggagaagcttagaaaatgtttactgagaggaaatagtcaagtctttgtatgtttaatagatgaatttagtaacacatcaatattgacaggaaatcatgactctcaagacaaatgagctattccagacaatgcagcgagcacaggaactggcacagagactaaaacaagaacaaagaatccgagaattggcgcaaaagggacatgacacttctagactgattaaaaatcttggtggtaagggcctaaccagaactttatttataatatttttagaagatgattttaaataattcctttttatctttgtttggagacaaggactcattctgttgcacaggctagagtgcagtggtgccatcacagctcactgcaacctcatattttttgtagacatggaatctcgctttgttgcccaggctggtcttgctgcctt

SEQ ID NO: 30500 - DNA, 1072 bp, Homo sapiens
ttctggagcatttcgagtttgtgaatcacaattgtggtatgacaaaatttcaaccagatgtttcttctgatagacattcagaagcgtcaacagacttagagctttagcattcaatctgtgaaattaagcagttcagtttctggatctgtacttctaaaatttagtatggaaatttctgctttagattaaaattcaatttctccactgaggcaactaatgacaactgcactgctttagctctctgcctgatgtagggggtgtgcttctttggaaagaaagaaagaagggataagtccaggggtttcttggtcgcgaggcctcagggccagctatacagcttaggctaaaatctcagctgattattctacttactaaataataaattatgattacctttattaattttgaactttaatgaaggacttaaagggacaaaaacagtataaatccttccttcaaaaaacacaatatatggaccaggcctggtggctcacacctgtaatcccaaaactttgggaggccaaagcagttggatcacctgagatcaggagttcgagaccagcctggccaacatggtgaaaccccatctctactcaaaattcacaattagccggatgaggtggctcatgcctgtaatccgaactacttgggaggctgaggcagaagaatcacttgaacccaggaggcagaggttgcagtgagctgagactgctctattacactccagtctgggcaacaagaacgaaactctgtcttaaaaaataaaattaaatacactattatggctctaagctatttcttttttttttttgagacagagtctcactctgtcgccgattctcctgcctcagcttcccgagtagctgggactacaggtgtatgccaccacacccagctaatttttgtatttttagtacagatggggtttcaccatgttggacaggatactctcaatctcctgaccttgtgatccacccgcctcagcctcccaatgtgctgggattacaggcgtaagccaccgtgcccggccagctctaagctgtttctatattgcaagggacaaggcaacaag

SEQ ID NO: 30501 - DNA, 1938 bp, Homo sapiens
agagtctcactgtcacgtaggttggattgcagtggcacagccatagctctgaaacctcaaactcctgggcacacgccaccaagctcagctaattttattttattttatttttattttttggagatggagtttcgctcttgtcgcctaggctagagtgcagtggcatgatcttggctcactgcaacctccacctcccgggttcaagtgattctgcttcctcagcctcccaagtagcccaactaatctaaaaattttttgtagaagactgggcgtggtggctcatgcctgtaatctcagcactttgggaggacgaggcaggtgaatcacgaggtcaggagtttgagaccgacctggccaacatagtgaaaccccgtctctcctaaaaatacaaaaaattagccgggcgtggtggtggacgtctgtaatcccagctactcgggaagctgaggcaggagaatcacttgaacccgggaggcgggggttgcagtgagccgaaattgtaccgttgcactccagcccgggcaaccgtgcgagactccgtctcaaaaaaaaaaaaaaaaaaaaagaaaattttttttttgtaaagacaggttttcactatgttggccaggctagtcttgaactcctggccttagtgctgggattacagatgtgagccactgtaccaggccctaaaagttttttgtttgattagtttttaattttttttagatcatttagatctaatcaaaagtggcctgccagttgctacctaaaaaagagccttggcctggcacagtggctcatgcttgtaaacacttgagggtgggggttcaagaccaccctgggccaaatagcaagacctcatctctacaaaaaataaaattagctgggcgtggtggcatgcacctgtagtcccagctattcaggaggctagggcaggaggatcgattgagtccaggagtctgtggctgcagtgagctatgatcacaccactgcactccagcctgggtaacagaacgaggctttggctcttaaaaaaaaaaaaaaaaagagcctgggagtgatggaagactatcctgaattacagttacccttcttttagttttgatttatagtaactacgtattaaattagggagaatttgcaagtccaaaatccagctgatcaaacaagcatcttttaagaatactgcctggaacctaggtggggaaaaagcatgtttggaattaccttgcccaaaccagacagttctgcaaaagatcatccattgagccagaaaatcttaagcttatagtagatgccttgtccatatttatatgttgttttgaaaatcaaaatcaaaataaaccttgttaattactaagaacagataatgatctttagaaaattaattgattttatatgtagatatgtatcttagtgattcatctatgatagaacagtgaagacaaaccccagtcccaaatgggatcttctgtttttgcataatatgaattaatcatgagatgtgcctttcctcccaacattttgatgtctctgattgggattcctcttagagttgatggtatattaacaattgctatcagccaggtagcagtagtaatgtatttcacattgcctgcaaatgtacatacttggttgtttctcctagtagcatactggccaagtgtagtctctcagtgttcaactaacagatcaattttgccaccatttgagaaaggaatatcagtcctggttgttgtccgaaaaccttcttttgacacctggtgagatgtcaaatgacatcatcaaaatttgctgaatgagtatcagtttcttggaagaaaatattagggacaaaaatggagtacttctaagaaatacttacctcctcatggcacagagaatgataatgtataggaaaacatgcatattgatgactctcgagttgaaaagtggttcatgggcccggtgcgg

SEQ ID NO: 30502 - DNA, 1023 bp, Homo sapiens
ttatatagatcctttgcccgtttttaaattggttgtctttttattagttgtaaaagttctctttctagatacaagttacttatcagatacataattggcaaatattttctcccattctgagttgttttttttttttttcactttcttgatggtgcgctttcatgcatagaagttttaaattttgatgatgtccattatatattttctcttgttccttgtgcttttagtgtcatatgcaagaaagtgttaccaaatccaaggtcattctgtgttttctaagagtttagtaaatggaattttttgactatatagtattttgtactatatcacataatttttagtgttttcctatataaaatatatcagaaccatttttactagattatgtttaatttacataacactggttaaatgtctgtgtatagttatttggcctttttggtctttctttttctagcttagctcttgtcatgcagtgctttcaactcaacttgctgatgccatgatgttccccattacccagtttaaagaaagagatctgaaaggtattgaagtcaagcttatgtttactttcattggctgtgagatcaacacttgtaaaatgcatattactctgtacttacaccatttctggatgacagcctatgccactcttactttgctcagttaccaaacatttataggagctcctgctagatgtcaaactagatattgagaaataccgatatggataagatatcccctcttttgagaaattctagagaaggaagtgggcacatgcataattacaacacttatgtctcttataattagggaatgagcaaggtgctggcggggctgttaggagggggtcagcaaggctttacccaaggatgtgacatgagcattgaacagtgaagaggaatttgccaggagaacagtcattgttctgttagagggactagagtgcacaagatatggcttttagaaatacacagcctatttgacagtagcaagaaactcagtgtggctgcaatgctgtat

SEQ ID NO: 30503 - DNA, 1057 bp, Homo sapiens
atggagaggaaggagtacttttgggagatatttttttaagtagaattgacaagacttgtggtaataggaggaataaaaaatgagtcctagatttcttggatgtctggatggatcctgtagtaattaagaaaggtaagaaacaaagcagaagaacaggttttgtgtacaaaactatcttcagttttgtacatttttagcacataaacacacataaagaacccagctggagatgtgtttactctgtcacttgggaaggtgagagggaggagataaaatttgtgagtcattgagtcattggtgtattggaatattagaatattcttcgtacttgaggattctaaggaaagcaggaaggcagaagaacctaatgcctattacataataggtattcaataaatatttgttgtctgaataaaagaactctagggagcacacgtatttcaagtatgggtgaaggaagacaagcaagtgcaagagaggaagactgatagggagagaaccaggaggggagaatggtatgctgtgaactgatcaaagtcaaagactaatgactaagctaataacaaacaattgtctgccattcctccttgtcgtaagctttctctgccatgcttagtttagttattgtaccattcttagttacgtacagaattctgttttcaatatgcagttttttttttttttgagacagtctctctctgtcacccaggctggagtacagtggtgtgatcttggctcactgcaacctccccctcccagggtgaagctattctcatgcctcggcctccccagtagctggaattataggtgtgtaccactgcacctggctaatttttttttccatttttaatagagtcggtttcaccatgttggccaggctgttcttaaactcctgacctcaagtgatcgtcccgcctcggcctcccaaagtgctgggattacaggcatgagccaccacgcctgggctcaatgtgcattttgtaaattatgtggttggaagttaaacaggaaaatttgcttaaccagtatgttgaaggatttctaaaagatcagaaaa

SEQ ID NO: 30504 - DNA, 1047 bp, Homo sapiens
ttcagttcttattgcaatccttgttgtagatatggttccagagccatgtcaagttagaatccaaagactggcatcaatcatggatctggcctgtgagatctgaagttcttaaatctgcatgtggccaggcggggtggctcatgcctgtaatcccagcactctgggaggccgaggcaggtggatcatttgaagccaggagttcgagaccagcctggccaacatggtgaaaccccgtctctattaaaaatacaaaaattagctgggcgtggtgactgcatgcctgtaatctcagctactcgtgagactgaggcaggagaatcgcttgaacccaggaggcagaggttgcagtgagctgtgattgcaccactgcactccagcctggttgacacagactctgtctcaaaaaaaaaaaaaaaaaatctgtgtgttttagccccctcagggacagggtagaaactgaagattaccacccaaagggaaataacatgaaataaattattaatttgtcttacgtgctactttgaaagaatttgctttgaagaaggtcattttgataccctctacagacatggctcttagctttttctcatccttgtttttattgccatatgatattagcttttcattccggtgtccatggtgttgtttccatgatttaggtggattgggatgaaagtattacctatctatataataagtagttacctaacagattttgtctccttggaaaaggtaataaatacaaattaagtgtagttagtaacatttttaaagataggaatagtatttttctggtttaagtcaagcttttaaccagaagagaagggtgttctaattctaaaacaaccaaataagaatacaattagtacttttgtaaaaagtcattctatgagaaggatacttacttaagataaaatgtatttctgaccagatcccctgtttttggagcacagctttcaactttgaacagatccgaacttgatcaacataatcaagcatcactcgaacaacctttccagagagatgttgcagccatgacaaagttat

SEQ ID NO: 30505 - DNA, 1105 bp, Homo sapiens
agtctgtctctgtcgcccagactggagtgcagtggtgcgatctcagctcactgcagagtagctgggactacaggtgcccaccatcacggccggctaattttttgtatttttagtagagatggggttttactgtgttagccaggatgatctcgatctcctgacctcgtgatctgctcgcctcggcctcccaaagtgcggggattacaggcatgagccaccacacccggccaccttccactctaattatttaacgaacccaggttgaggagaataaattccctcggacactctgtcctgtttacaatttggtcaattacattatcttaaacatttaaacctgcattcatagatttagtattgtgttagttttctatagctgctgtaagaagtaaccacacacttagtggcttaaaacaacaataataaaacaaatttattatcttacagtttagtagttcagaaatccaaaacagtcctcaccggactgaaatcaagatgtcagcagggctctgttccttctggaggctcttggggagactctatctctgccttttctagcttctagaagccacccacatttcttggctggtggactctctgcctccatcttcaaagccagcattgttgggcttagtccttttaacactgccatctcccaagttgtctctcctggctccccctctttcacacttaaagatcctgtgttacactgggaccacctgggtaatccagagtacaccccctatctaaaagtcagctgattagcagccataattccatctgtagccttacttctcctttgccatgtaaggttccagaaattaggacatctttggatgggaccattactccacatgtcacaagtatgttctagttttctaattccttcaagtacctgactaaatcagcaagcctgcctaagtatcatacacttcctgcaaatctaatcaagtaaatgcataaccacagtcaatttcagtttctctgaaacatttcaatactctccttagcccaactctcttatacctttcaacctaaaattgtaagttcaaagtcagttactcaattatgcaatttaaggttttaatcataaggttaatataac

SEQ ID NO: 30506 - DNA, 1029 bp, Homo sapiens
agctgttgaatacaacacttaatactatattgccgatgagaaaaccattacctctcatccttaggtgcatgttgtgctgttcctggcttataaatatcctgcaaactctgttgaatgatgagctgggtgtcaaagtcttcatctatgtcttcatcgctggtgtaattatccatgtgaaacgtggacaggtttactttaaagtcagagtgaattaaaagtatttttccagttgtgaagagatcaactgcttaaaattacaaatgaaattcagaaatctagaaaattggtaggattaacaatgaaaaatatacaaaatttaggaaacaaaatattcactaaaaaatttctataaacttaaaaaagttttgtggactgccacagattcaacaaaaattagaagtttccatgagtagccattgacttaaagcttattcaggaaaaaccacctttcaaataagacttcggttagtgccactctaacactgacaacactctgatctgttcaacttggctgtgagtctttcacagtgattgtagcactcatccaaaataatatctttcctacacacagtgtgatgctgaaaataatattttacttaatatacattaaaaataaacatgttataggaacaaatgtattctcataattacaacatggatacagcagtagtaaaaacaaatgtatcttactaggcaatatctaaatggttttaaaagaaaaatgtcagttttagcatagaatacatttggtcacatttcaaagactttttaccttttgttttatcctctaggacagcagtgaagttttcactgttaaggactaacacatgtaagcctcagaattttcatttatatttaggctctcctctcccctgtagtgaccattccattaatagctttactataaatacttcatcataagacagtttggcacattctccttgttttttacatgtggtttagctctttttggaaacatgatctcttttcttcagtgctacattcatcaaatttaaaggattaaatatt

SEQ ID NO: 30507 - DNA, 1026 bp, Homo sapiens
gtggagtctttgagccgagagtctaggaaaaccaaaccttaggacagaattccagagaggagagagcagcacagaaagagagagagctgcagaagtttccttagaatattcagcagagtaattattagcacatgaatctgagcaaactacccaaaaccaaggggaaaatcaacagataaggttagaggaaacattgtccagggttggttgggaacaatgcctggttctatcaatcagccagattgaaaaaaactcataacctgtgggacagtgggtagagtactcaaaaaggtcttgcctcactgatgaagaataattaattctaaattgagtactactctggacctacctaaaaaattataaaaaacctgaaaagatcaaattatttcccagtcatttaactacatcctagaacaaaccgcacaaggatttaaagtaaaacgaaaatacacaatatcaaacaaggtaaaattctggcatctaatacaaaattattgggcatgcaaagaggaaggaatacatgaccatcatgagagtaattgatcaattgaaaccaacacagaactgacagagatgttattttaaataagtaaagacatgtaagatatttttaaaagacttgagcatctagaaataaaaacaatgtctgagatgaaaagtacactagatggaattaacagtagattaaactacacagaagaaaagattaataaacttaaactcatagaaataggaactattcaaaatgaaacagaaaagagtcaaaaaggaaaaatgaagagcattagtgagctgtgaaatagcctcaagtagcctaatacatgggtaactgaagtccctaaaagaagggaagagggacagaaaaaaatatgttaagaaataatgaccaatgacccacattttcccaaatttggttaaaccacacgtatagatgctttactaagtccaagcacaagaaacatggagaaaattatatcaaagtgtattgctatcaaataagttgaaaccagtgataaagaggaaatc

SEQ ID NO: 30508 - DNA, 1030 bp, Homo sapiens
cccgacttggccactgcccgcgccccgccggcctccacgcctcgcgcggagaacctcagccaccgccgtctcggatcgtgccaggccggggaccgcgtcccccttcccggggcggcctccgctcagcaggggcgatgcagactgtcccgccggccgtctagagcccctccgtctccgtcacctctcgccccttcactccgggcgaggactggcggtggctgcccagaggtgcccagccacaccttccttcggcccaaaaggactttcctggccgcgccgaaccgacccttcattcatgctgcagtgctgcaacgtttccgccaccaagggggaaaagcggccgcgatctcaaaccaaacacaagaattggcgtgtgactcatctgcttggatacctccagtccccaaactgtgttccaggagttttcttggccgaagctgcccgatgtttgagccttttcttcccagagaagaagatggactgaaagctgccagttggggactttttgtgatcacggcgttgcagcgttttaaaggaggtgatggggcttgcgctggcttgtcttcccacccaagtgaagagttgatgttcactggttatgcttagacaatgtgcagtttgtgttaatttaaaattttgggtgggataggggcataggcttgtgaagggcagtccggatccggaggaactcctctttgtccctggtaggagagacacccccagtctatcctcgatgccgtcagccttggccatcttcacttgccgcccgaactcgcacccgtttcaggagcgtcatgtctacctggacgagcccatcaaaatcggccgctcagtggcccgctgtcgaccagcgcagaataatgccacttttgattgcaaagtgctatcaaggaaccacgctctcgtctggtttgatcacaagacgggcaaggtaatgtcaccacattgtccagcggcattgtttaacaaactttttttccccttttgccctccctgagaggactaatgtatgcaggatcccagggtttgc

SEQ ID NO: 30509 - DNA, 1033 bp, Homo sapiens
atgctttacttgttaacttatttaatcttcaagtaactctttgaggtgcttgttttttctgcattgacctgtgaggaaattgaggcacagagagatcttggtcaagttcacctagctattaaatggtagaattgagatttaaactcaagctcataaccactgtgctattctaaaggctttataacactttagatatgatgtgattttgtgagggcatagaccaggttaacagtaggaatgaaaatgattaaatgccagaaaatgaaaaaagataagagtattaaattaacttgcacattaggacttcggcaaagcgcaaggtcctgtgtgaactgaagactttagggaaagtttaatggatgaaacagtttcatggatgaaatccaatttaaactagaccttaggacttttaaaaagaggaagaatggccaggaacagtggcaaatgcctgtaatatcagctacttgggaggctgagtctggaagattgcttgaggccaggagtttgaggctgtagtatgccaaaattgcacctgtgaaaatccactgcactgcagcctttgcatcatagcaataatttgtctctaaaaaacaaaaagttcaaaaacttgtatttgccaggggtgcatcaggtctgtagccccacctatttgggaggatgaaacaggaggatcacttaggccaggagttcaaggctatagtgcactatgattgctctagcctgggtgacatagtgagacccatcttaaaaaaaaatatggggttaagggatagattgtagttagggtcagtcagggaaaggagttttgggtgggaggaagaagcagggatgatacggcatgttccaaggacattgtaaggaagacattgtgaagagcctgctgaatttgacaaccaagattgtttcttcttttttcctccacacatctaaacatgaccacaaagatcctagcctcagcttttgggagaatggcaggtcatacattcttttactttttatttgtttgtatgtttgttttaacagatacttaagt

SEQ ID NO: 30510 - DNA, 1032 bp, Homo sapiens
aggttttttatatcatttaaaatactgcagtaagctcatttaaatactatttctgatattgccagaagtatagatttaatactttgaataaaacaatgaaagaagttaaaaggattatgatgaaaatattgtatgtaattgtccaagcaaaaggtaggtattaaatgatagaaactgcttcagaacttcagtatgaaatatattttaaaacataacacctatgtagtagtactagtcttaccattttaaactgatactctaaactgaggtttatttataattgccagttgtgtggaggcagagttttaagatgagcagcagttaagtttgttggttttaatagtttttttacccacttccctgatttgagaactgtattaaaattttatcctttattttagctgcagctattttgaaagctgatataaaaataggtaaactttttgaataatgtgtgaaaaaatgattaaaaagtacttcaaacattaggtgttagtattattatgaaaattagttgttattactgtctcctttcactaatctttattattattgctttgtcatagtggtatgtagtcttaggcacaagagaaattagactttaatagacaattattattattattattattattattattattgagacgaagtcttactctgtcccccaggctggagtgcagtggcatgatcttggctcactgcaacctctgcttcctgggttcaagcaattcttctgcctcagcctcccatgtagcgggcattacaggcatgcatcaccacacccggctaatttttgcgtttttagtagagactgggctttcatcatgttggccaggctggtcttgaactcctgaccttgtgatccacccgcctcagcctcccaaaatgctgggattacaggtgtgagccattgcgcccggccaacagacaattatttttaacatggctgccttgttgtaggtctgatgattgtgcttcatatatttaagcattaatatgtattcatatatatacttaaatgcaaagtta

SEQ ID NO: 30511 - DNA, 1044 bp, Homo sapiens
ccctaaaacttaaagtataataataataaaattttaaaaaaagaaatttgacttttttaaaaaaacctcttagaagaagatataggataacatccttatgaccttgaattcagggaggctataataatttacaggaagcatacattgagggaaaagattaatacattcaaatacattaaaaattaattttattcattggaagatagaatagccaggcgcagtggcacttgctttgtagtcccagctacttgggggctaagacgggaggactgcttgagcccaggagtttgaggctgtaatgtgctttgatggtgcctgtgaatcaccactgtattccagcctaggcagcttaaaaaaaaaagaataagaaaagttcagaagaaaaaaattggcaaatatatttgtaaaacatatatcacttgcaaaaggttagtattcagaaaatagaaataagttgtttaaataaaagacaacccaacagaaaagaaacagtcaaaagacacacataagaatttcaccgaataaataagatgcagcaataaacaaatgctcaactttcaacataagtaaggaagtgtaaacttaaaccatgagatgccgtttctactcaattaaaaacttggataatatcaagtgtgagtgataccgtagagcagtagcaactctcatactttgttgttgatatggtgaatttcattgattgatttttgaatgttaagccaagtttgcattcctgagataaactacacttggttgtgatgtattatcccttttatatattgctggatttgatttgcttatattttgttaaggatttttgtatctctgttcatgaagtattcgtcttaaatgcttgtgagaatttaccaaaggaagccatctggacctatttatgttctgtggaatgttgtaaactataagttcaatttctttaatagaaacagagcttttctagtcatctattttttcttgagttaactttgatattttgtatctttcaggaaatttgtctgtttcatctaagttcttgactttattataaaa

SEQ ID NO: 30512 - DNA, 1045 bp, Homo sapiens
ggcttgagggctggctgttcagtagagtgatgaatgtggaagctcgccggcagttggttaagaaggcagtgagttagggagtgtgacagggagtgtgacagttctgtacatgcattactataagtggatccggagagtaattaagttatttccataagaaaggtagtgtttgtatacttcagtgatgatcatttgtttttctccagttttaattgttgctgctcccaaggagcctgtggtgattctgcccttgtatgtcgggggaaatgtggcattaaaaaagcagtacaggtcaggcactctctgtccagattaatttctcaatagagttatgtgtaaattgaaatcttactgagttgaataagtttgtgcaaatgggatgttggtaaggaaaaaattattcaatgacacttgttaaagcatggtaaggaagatttattcaggaccattgagataggtatagaaaccactgcagtggggtgtggggattgcggggcgagggtagagagagactgggctcactctgaatacagcatgggcaattgggaatctatagccaaggatcagtgtgagggtaagtggttggaaaattactaagaggaaacatcaggggtaagggggattctggctaaatcgacctaacaggattcttggtggagtcaggccagggtgttcagacatcacctgagggatggtagataatgaggaacctgatcatacatcaaggatgatcagatgtcgaggttgagggggttctggctaaactgacttagcaaggttctttggctaaaactggattttacaaggaagtacacagatgagcctagaagagagttcataagcctgagtaaagtttggccaagcaaagaatctttgtcaacatgagtcacattgttaaaaatatatggaaatgttaaaactctgtaattcaacacaaattagaaattcagcagctatagatgatattcccatagatattttgatgttctgagttctttttttctttatcaagtccaaaatgtcatgttctgagttatttttgttt

SEQ ID NO: 30513 - DNA, 1023 bp, Homo sapiens
caacctccgcctcctgggttcaagcgattctcctgcctcagcctcccaagtagctgggattataggtgcccgccaccactcccaactaatttttttatttttagtagagacggggtttcaccatgttggccacgctggtcttgaacccctgaccttaggtgatccacctgcctcagcctcccaaagtgctgggattacaggcatgagccaccatgcccagccaatcatgttctgagttcttaaagccagaaacttatctttgcatttctgatgatagcaaaaattaattctatgaaaagtttgtgtgtgtatatgtgtaaatatgtatgtggatagctaagtatacattcagctcttactatgtccaaagcatatgaatgagaggctaaggactgcttactatggggaagaatgattcttactttacatttggccaagatcacagatcttataacaaaaggattaaatgttttagtattgatcctgatgaacacctgacttttaaagaagggttataagagcttataaaccaaggttaaggaaaaaaaaaagtggaacacggtggtaaaatattaatctttttgcagtagatatatattttgtgaattatcaaattctacctaattttatgttattttagtcacttattttctatttgtataattttgtagttttctagttttgcattcttgtttttataataggtgctaaatatgtgagtttgttaaaatgtactttcaacattaagtaaaaatgaaaccatcgagcaattattaaacacgtaagactaataattctcctgaatttataccatataaaataaggtcatgtatatggaagtattttataaactaggtagctagaaattaagtcgttatttttaagtagaagataagttattaaatattcactgtaaattttaagaacataattaagttgctttggagcaaaggggtcacataaaataatttcaattttagaaaacaatatccatgaatataaagataataaggatatactgaa

SEQ ID NO: 30514 - DNA, 1934 bp, Homo sapiens
tatgaatttagataatatatgtaccttcttaaccttgttcttttctgatgggtaaaccttcgcttattttttaaagctggtgcggtgactcatgcctgtaatcccaacactttgggaggttgaggtgggaggatcacttcagcccagaagttcaagatcagcctgggcaacaaagtgagaactatctttcttaaaaaaaaaaaaaaaaaaaatcctgctgggtgtgatggtgtattcctgtagccccagctactcaggactctgagatgggaggatcattttagctcaagaggttaggactgccgtgagatgtgttcgagttactgtattccagcctgggtaacagagagagagagaccctttcttaaaaacaaaaaaacagttttctaaagtcatcaggaaactttttagatgagtcattcagtgatttagttttggtggctgttctttttattttctccctattctgaaactcactttcctaacttctttagtgtgcattttaatagaactttccaaaattctgttcgtacgctatactctcctggttcttaattttctgacagttttggcatttctatctttgtctccatggtctgtagttaccacaaagactttgtctttatcctttggcttttactgtcctgagtctctttcaaaagtcacatacttacagtcttatattaacacttataagcacttcgtttcaaaatttatgtttttttatgaatttctcaaccattttagtttgtttttactttttaagtgtacactatagtggtctttagtatattcacaaaattgcgcatctattaccgctacctaattctagaacattttcatcactcccaaaagaaagtttgtattcattagcagtcacccccccattttctcctcccttcagaccctggcaaccactaatctgctttctgtctctctagatttgcctatctggacattttatatcgatggaatgatacaacatgtggtcttttgtgtctggcttctttcatttagcattttcaagcttcatctaagttctagtttatgtaggtattgcattgctggataaaattccattctagagatagctaccacattttatttgtccattaatcagctgatggacatttgagtttctgttttctactttcggctgttatgaataatgtcactatgaaagtttgtgtacaagcttttgtgtgaatttgtgttcagctgtcttgggtacataccttggaattgaattgttaggtaatatggtaactccgtgtttaacatcttgaggaactgccaaaatgttttccaaggtgcctataccattcccaccaggaatttctccacttcctggtcaatacttcttaatgttggtcttttttgtagccatcaggtgggtaggaaatggtatctaatgattttgatttgtatttctctaatgactaataatctgataatctaatgactaataattgagcatcatttcatgtccttatcagacatttgtatgtatcttttttggagaaatattgatttatatccttttgaaaaattggggccgtgcatggtggctcacgcctgtaatcccagcactgtgggaagctgaggcgggcggatcacgagttcaggagtttgagaccagcctggccagcgtcgtgaaaccccgtctctactaaaaatacaaaagattaactgggcatggtggcgcacacctgtagtcccagctatttgggaggctgaggcaggagaattgcttgagcctggcaggcagaggttgcagtgagctgagatcacgccactgcactccagcctgggcaacagagagagactgcgtctcagaaaaagaaaaaaagaaaagaaaaattggattatcagttgtatattcaggatataattcctgtatcagataaatgatttgtaagtattttctctcattc

SEQ ID NO: 30515 - DNA, 1068 bp, Homo sapiens
tctattctactttctgtctctaggactttgcctattctaggtgcttcaaataagtggaatcatatagtatttgtcctgatagtatcttttaaagtgtaaatatttttaattttgatgaagtccaatttatctatttttatttttataagtaatttttagtaattaaaacattttaaattcatgttgtcacttgtgcctttggtgtcatttctaagaagccattgcctaatttaaggccataaacatgtattttaaccattttgagtactctcttacttggctctcccttctatatttaaaacatccaccaatataactatcaaaggttttatgggaggagttttattaagtgttctgctcttttttgttgttgttaagatcagaatagtagttttcaaacggtagagtcttctgggatgtttagtaaaataaaagtccctcagctgttttgtgtatttgtaataaacttccaggagactttgcatgatgtggttgaaagagtgtggaattaggatagtctagcctggtaattaagagcatggatcgtggagcctgactacctgggtgtgaatcgtggctgtgtcacttcctggctgattttggacaagtcacttgttctctctggaccttcgtttcctccctcataggattgttgcaaggattagctaggatatagctataaagcacttagaatatctgcaaagcacttagaacgatttggcaacagtcaccatataagtattagctattattataccctttaagtcacagtaatgtcatttctagagacctaatctaagaacattatcagagatgttacataaagatgtgtgtataacagtttcatcacagagactgattataaaattaaccacatatagtcagtagacatatggttaaataaattaatgaaatgtcatataaccattaagtcacattgtcaaaaatacttaatgccttgggatgatatcagtgaaaatgtcaaaaatgcaactatatgtagaatatgtctctaaaattttttaaaaattcaaggcaaggggctggatatggtggctcatgtctgta

SEQ ID NO: 30516 - DNA, 1036 bp, Homo sapiens
aaatcaaattagtgctagtgctagagaggttgtgatgacattaactttgttggtctagtctgtgtgccaagcattgttgcaaagccatctagatccttgtagatgtaaaatgttgaaataactttcatttttgtttccttgaatgtaatttaaatgttttagtactgtataaataaaggaagaaataaaccaaaagataaaacagttttagattctcccatgtgttgaagtcaaatctggtcatgccttcctctccactctctttttgtctgtctgactcaaactctggaggcacaaatccaacatgggtttttttctttttgggccagagagctgcatgcttgctctgctgtgttttgaatcctgcttttctagctcgcctaaatcctgaatccagttgttctttaatccaatgactcacaccttgggagtttccctcaccccactccaagaaaatgcaattaacttttccatttcaagtaaataattctgtcacgtgctttctactctttaccgattttgctttaggtgctcatctgaaaatatgcttcctgttgactttttaaaagttccttgtagagttcttctgtatgggtgggaccaaatatctgtgaatcactcccagttagtatagcatagtacagtcatcttaagagtaagtgattttttaatttgacagattgtctgccaaaaagtgttaaagtagagccaaaagcaagaacagaaattgactcttgctctatttattttcaccttttctcatcttttttcatctaacatcaaagattatttccatttctgatacacttttattgtatttgtattatttttgtctaattactagcctaggtttctacatcatccatgcttaaatgcttttcgttgttacatagggctgtaagacatttatactgtcagtagttgagtttacttgaagtcataggtgagaaggtaatgtgtgatgattaagaagtcaggaatgataaaataaaaattttctatttgttttatcgtgcttgacaataagttttgactt

SEQ ID NO: 30517 - DNA, 1030 bp, Homo sapiens
gatagtttgctgagaatgatggtttccagcttcatccatgtccctacaaaggacatgaactcatcattttttatcgctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttataatcctttgggtatatacccagtaatgggatggctgggtcaagtggtatttctagttctagatccctgaggaatcgccacactgacttccacaatggttgaactagtttacagtcccagcaacagtgtaaaagtgttcctatttctccacatcctctccagcacctgttgtttcctgacattttaatgatcgccattctaactggtgtgagatggtatctcattgtggttttgatttgcatttctctgatggccagtgatgatgagcattttttcatgtgtcttttggctgcattaaaaaaaactttatcttaaatatacccacagaggtgaaggaaatcatggtcaaagaactaaaggaaatcaggaaaacaatgtatcaatgggaaacatagtacagagatgaaaattataaaaaatataattcagtagagagttcaatggcagatttgaacaggcagaagaaagaataagtaaacttgaagacaaagcaattgcaattaccctgtctgaggagcagagagaaaaatttgaagagaaatgaacataccctaagggacttatgagaagacatcaagcttaccaacatatgcattgtggtaatcctagaaggagagagagaaagggacagaaaaaatagtcagagaaataatggccgaaaagtattttatggttttagcttttatatttaactctttaatttattttgagttcatttttgtgtatggtatgaggcaggggtccaactttacttttctgcatgtgtctctccagttttcccagcatcatttattgaagagatgat

SEQ ID NO: 30518 - DNA, 1045 bp, Homo sapiens
tgttaaatgagggcctgatggcaaaagtatattttgatatatagtgtattaggtgtctttttacctttcttccttaggaagaaattcagcgaaaatgtgttactaaaataagtagggctgaagagtgtagaaaaatcgaaaaagaaaggtacgtctttttttactggtggttctcttcctagtaagtctattgtgtgtgatcccagttgtgctgaaatttttaaggatttgtaagtgataaataggtaggcttcttgtgcctcctgctatcctttctgtttttaaagagggagggttacccaagtgatgagaagcaaatttggacaaccatcaccactaattttagaatattttcatcatctcaaaaagaaaccttgtacccatcccattcctacctgccacttcagccttttgtaagcactcatgtactttttgtctgtatagctttgcctattctggatgtttcatataaaatgaatcattataatacatcagtcttttgtgactgacttcttttacttcacataatgttttaaacgttcattcatgttatagcatgttatcaatacttcacccctttattgccaaataatattcagttatatgaatgtctaccacatttgtttattcatttatcagttgatggatagttggattattttccctttttggctattatgaataatgccaacatttgtgtagaagtttttatgagaacatgtttttagttctcttggatgtatacctaggagtggaattgctgagttgtatactaactttatgtttaacattttgaggacctgacaaactctttttccaaagaggttgtaccgttttatgtagctgaattttaaatcacctagttttcagattctaatttcatatatattaaaggagaaccttagctgaaatgagtggtttgaattaataggggaaaaattcacttgcaatagttggcaaagctggaagcatttttttaaaaagtacatttggaattattactattaatatttggcccttttttgtttttgtttttttttgcagt

SEQ ID NO: 30519 - DNA, 1032 bp, Homo sapiens
actgtattatgcagaactttagagttttgtgaggtgtggttaggtgtgtaataggttggggaagggaagatttggaataagaactatattttaaatttgggaatagtcagaccttatgtttgatactggcagatggggaaaagtgtatttccccctcacaattttatttccatatattcaactgactttttattgactattattacagaattggagattaagacacttttcaaaatgattctatccttatttctaccttgaaattgtgattcgttatggacaagatgagtttctccagggtaataatgtcattaaaccactagctttattttctttctgagaaattgttacttttaagaataaactatgtttacatatgagaggtgtgaagttttatatttttaaacaattatttcatccatattatttgtttgtttcaaccagttacccatgggtgtattgtttccacaataaaactttttctaccagatggtatggaagcccggctccgctcagagtgagtataatttagtactgtgaagtttttgtgaagtttagtactgtaaagaatttagtaataatattctaggtgatggtgtactgctaatacctgcttcaggactatttaaataatattagaaaattgattagtactttttggaatataatacacttcagtttaaattgcttctttgctttagttacaattctagtaaataataatgtatcaaaggcaaagattattttgtttccaaatttaatttatattttgatggataattagttgtttttcacaatgtttcaagtatataagttactggtaagtgatagcttcattcctttttattttcatttaatataggacttcttaaactgtgatcacttctggtattaatgccagtgtcacaatcttataagaccttgaggataccaatatagttgttagcttattttggtgggaggtttttgaagatttttccaatgtcctatttactttttgtatgaaggagtgtaaaggtcatttagaggccg

SEQ ID NO: 30520 - DNA, 1028 bp, Homo sapiens
tgcagtggcgcaatcttggctcactgcaacctccacctcctgagttcaagcgattcttatgcttcagcctcctgaggagctgggactaatggtgtgcgccaccacgcccagctaatttttttatatttttagtagagacagggtttcatcatgttgaccaggctggtcttgaactccagacctcaggtgatcctcccgcctcagcctcccaaagtgctggaattacaggcatgagccaccatgcctagccgaaaatggataaagagtactccttttctgtatagaaattcgtataatcaagtaattcatcatatccctcaaaaagtagtggctcctcaaagagcatttaatacattttggatttggaatttgtttttagaactatattgatgtgtacaaggtaggtttacatatttttgttttctaagaattttatacatttatgaaggattgaaaaatagttcacctttttttaattacatgaaggcaaatgtataaactttgtggtgtaagatattctggtgctctcatactctgtttcctctattgtccggatattagataaaacttctaaattttacttttcagtgtcatccatgcaccattaccaagtcctgttgacaaagtaagttgctaatgattattttttccaaactgactcagctatgttgctttgaaaatgtttgtttttaatatgctttacctagaaatttatttctcttttataacaaaatatgtagaatgcatatagctatatagttattataatcttctgatcttcaatatctggagaatctaagatggatgtttcttcagaaaaaggctttgttatctcagttaaattattcactgtgtaaactaggagtacctgttttgtgtctagccagggataaggagtattcgctgttactttttattctgagatacaagtctgtctagaaatttgtttaagtttctacctaaatagttcactcaacatttcccaatacagggaggtaatacagaaatacaggcttacaaaaattgtt

SEQ ID NO: 30521 - DNA, 1035 bp, Homo sapiens
tatattttatgagtagtccagtaattgcccaaagtagtttattgtgttaattctgttacagttgtcagagaagaaaagtgagttttaaagcaccatattgtcaagtcacttttatacatagggaaattaggcaaataaatttggtggcatgtgtttatcatagtagaactttcattagactataccagtataaaatttaaaactagattcacagtccttttggccaattaaaacattgagttacaaaagtttgagatacttaattttagtacattctattttattaaagtaactggattcatttgacttttttaaccatgtaagaggatggtgttatttcaaatatctcgtggtttccattctgaattttgtgcacggcagatgccatatttggggaaaaaatgcatagaatatgcatcattaatattgttttggcaaacaggcattgagtttcagaacagtgaactatttttagtacatatggcaatttttttcaccttattaaagtgagatgagaacagaccttaaaatagcttttacctcaccatccaaatacctattcagattagttggttgaatagccagcactttgaagtagagccttaggaaaaaaaaaaaaaatgcttctttaattaaaatatcttgctatcttatcacttatatttaatgcattctaaattagaaaatattttcttgaaattatgttttatcattattggaaaagttttgtgcattactgatttccctttttaatttattgtttttatcttattgatacataatgtgcatattttcaggatatgttttatagtttgatacatttaatgtataaagatcaaatcagggtaattagaatatcatcactttaaatatttatctttgtatgatttccttttaaacctggctataaactgtttattggaagttttaaagaacatgccttttgatccaacaattccacttttgggtttttaacccttttttttttttccttgagacggagtttcgctcatgttgcccaggctggagtgcagt

SEQ ID NO: 30522 - DNA, 1064 bp, Homo sapiens
tttttagtagagaatgaggtttcaccatgttgaccaggctggtctcaaactcctgacctcagatgatccacccgcctcggcctcccaaagtgctgggattacaggtgtgagccaccatgtccggcctgggtttttaatcttaaagaacaaattggactaatgagcaagaatatttatttcagtgttgtttaaaagcaacaagaggaaagcattagggtccattaataagggtatttattaaataaattatggcaaataagtccatgtaaatgaatagaatatattctttaagaataatacaaatataagttttaaatactcagggatttttctatcagtagtgaacattttactagcacctttcacagttaataggcaaagatatgctaatccttgtaacaaaccagatggctgaaataagttacattttaaatcgagctataaagtgttttcttttggatttggctaaattgtctttaattggcaatgtttttggtggaattttcttgtttggactgaaaatagcagttgccataaatgaacaattaccgactgttaccagtcttacctcttctcttacctctagaagatgtatcacctaatgcaaaatgtgctttctgtttaatctctaactcaacttgcagtcattacatgtctatatatagctttggaggtagaggtagaaagaatatgtgtagataattctaccactaactagctgtacaccctcaggcaacttcagttctttaaacctcagttccctcacttgtgaagtgagattgacaaaatgtgagccaccactcatggtcttgtgtttcattcttgaatagatttgatttgcctctatgtaactatagtatcaggacacaacattgaggatccatgacttgacttgctaaaaacttgctttctggccaaccttggtgactcacacctgtaatgccagtattttgggaggccaagataagaggatcgcttgagcccaggagttcgagaccagcctgggcaacgtaacaagacactgtctcttaaaacacacacacacacacacacacacacataca

SEQ ID NO: 30523 - DNA, 1034 bp, Homo sapiens
ttgagaatttattatgttccaatttgcagaaactagtgtaggtacaatgactttgccttggcagtatgccagtaatcttctgccttctggaaggaagtccacagatcttcacatcaactgaaaaaagctatcataaagtccatgaattgtactcctttatttcattctctggcatactatccaggcttgttgtgggaatgttgttaggtaacagggagtttctttcatattttacctccctctctgtacctatatctttcttctctttttctggtgacctctgtgttgaccctaagccccatctctcctgtctaatgtttttatacatttatattccttcttaatatttatctttcttgagcatgatgatgggctcctgataagtcattccaaggtgtttacatttttcagaagcacctttataaaggtttcctttattgaagaatttctaggatataagtagagaggaactggaaactttctaccctcataagctacatttagggacaaggaggaacctttctggtatacgttacctatggtatatctattttatattcaatccttgtctatcttccttctaaaaccttcagagatggcagaatagggccgggtgcggtggctcacacctgtaatcccagcactttgggaggccgaggtgggtggatcactcaaggtcaggagttcgagaccagcctgaccaacaaggtgaaaccccatctgtactaaaaatacaaaaaaattagccaggcatggtggtgcatgcctataatcccagctacatggagggctaaggcacaagaatcccttgaacccaagaggaggaggttgcagtgagccaagatcacgccactgcactccagcctgggtgacagagtgagactcagtctaaaaaaaaaaaagagggatggcagagtggggtagtggaagtggagacaaaggcacagccagtagcagaacaatctctgttctttgactgtgagcccagtttgcgtgtaagatgctgtatctagaagtggaaccagtctagaatt

SEQ ID NO: 30524 - DNA, 1050 bp, Homo sapiens
tcggctcaccacaacctctgcctcccgggttcaagcgattcttctgcctcagcctcccaagtagctgggattacaggcatgtgcaccatgcttggctaattttgtatttttatagagatggggttccatgttggtcaggctggtcttgaactcccgacctcaggtgacccgcctgcctcagcctcccaaagtgctgggattacaggtgtgagctgccacgcctggcctgtttctttttctgctactccatgttgtgtctccaggtttcagtggtttcatatgcattcatttagcaaatacttattgagtgtctgatgttaggcaccgtgccagatcctgacaatactcagtccctatcttcatagagcttttggtatggaggtgaaatacaggcaaggaagctggcaattaaaatacaatgtaatagaagaagacactggagactatggaaccatagaagcattgagtgcatttcctctcaccttcaaccactcaaccttccaagctggggatatctggctacagagccaaaggtaagtttcccttctagatcgtctaaggaacaggtctggtttctcttgaagcacatgtcattgaaaaccattaagatctgatcttgattttctttaaaaaggcattatgactgggaagcatttttaaggctttgtgtgtactctcctggagttttcccctgttaaatggtttgaactgtaacttgcgagtaatgggtaactagtgaaggtttttggttttttgtttgtttttttgagacggagtctcactctgtctccaggctggagtgcagtggcaccatcttggctcactgcaccctccgcctcccgggttcaagggattcccctgcctcagcctcctgagtagcttggactacaggtgtgcaccaccacgactggctaattttttgtattttagtagagacaggtttcaccatcttggccaggatggtctccatctcctgacttcgtgatctgcccgcctcagccttccaaagtgctgggattacaggtgtgagtcactgcgcctggcctaagg

SEQ ID NO: 30525 - DNA, 1051 bp, Homo sapiens
acttgggaggctgaggcaggagaatcgcttgaacccgggaggtggaggttgcagtgagctgagatggcgccattgcactccagcctgagtgacaagagcgagactccatctaaaaatacataaataaataaacatgcaaatatttagtatcttacacagtttctaagggtcaggaatctaggagcagcttagctgagtggttctaggtcaaagactctcctggagttgctgtcaagctattgactaggcctggaggattttctttgctcattcagatgctattaaccggaatcttcagttcctcaccacgtgggtctcgccataaggctgctcagataaagcagctggcttccctcagagcaagtgattcaagagaaaggcagagggatggaagccaccatatctttcataacctaatctctgaagtgacataccatcactgtgcaaaattctgttggtcacacaaactaactctgatacagtgaggaaggtaataaccaagggcatggatactaacaggcagcagaagagagccaggttacagactggttcttcaactaatttcccattaggaaacttttgaattgttgataagcttcttttaatgaagtatatcaaaagagacaaactaaatgacttctataaattacatcctggctgggcgcggtggctcacccctgtaatcccaacattttgggaggctgaggcgggtggatcacaaggtcaggagatcgagaccatcctggctaacacggtgaaaccccgtctctactaaaaatacaaaaaattagccgggcgcagtggcacgtgcctgtaatcctagctactcaggaggctgaggcaggagaatcacttgaacccaggagggagaggttgcagtgagcctagatcgcgccactgcactccagcctgggcaacagagtgagactccgtctcaaaaaacaaacaaacaaaaaaaaagaattacgtccttccccaatctattgattccctaatatcagtaagtcattgatactgattctaaagttataagaagtccaaaacaagagag

SEQ ID NO: 30526 - DNA, 1036 bp, Homo sapiens
aatggtggtgtcttggttcactgcaagctctgcctcctgacttcaagctgttcttgcacctcagccttctgagtagctgggattacaggcatatgccaccatgcctggctaattttttgtatttttagtggagacgggtttcaccatgttggccaggctggtctcgaactcctgacctcaggtgatccacccacctccgcctcccaaagtactgggattacaggtgtgagccaccgtgcctggcctagtacattttagatatttaataaatatttgttgcagaaagggagtagaaccctggtctgaaggtggacttgaatcaatactttctggttgctaacagtggccattcatagatagtatgatggtgtgccctctggtctggaataaaatcacttagtggcagtaaacattgttaccacgaatgtaaatttgactgcggcaaaggaccttatttcttaccaaattttagagtttcttaaagcatacacttaatgagaaaagctgaacctagttttcaccaattactagatagaaagactgaataaacatttatttatgcctgccttgtttcagtaaagctttaaggtggccttacacagatatataaaatatggaataggctgggcacagtggctcatgcttgtaatcccagcactctgggagtctgaggcaggaggatagctgaatccctgagttcaaaaccagcctgggcaacatagcgagagcccacctctacagaaaattttaaaattagccacgcgtggtggtgcacaactgtggtcccagctactcgggagactgaggtaaggatcacttgagctcaggaggttgaggctgcatgagccaagatcatgccactgcactccagcctgggcaacatgaggagaccctgttagataaaatatagaatatcatggcttaaatcgggggttgggggggagaaaagaaagtaaaataagagaatataaaattgagccaaataagtaaaataaaattgggccacgactgaggaggaaaaattaccccatgccac

SEQ ID NO: 30527 - DNA, 1049 bp, Homo sapiens
gttatagggcttggacttcggacaagccagcagcctcagtcattgtgagtgtgattccagattggaaggttctgctaggaggaaagtggaagttttgagaattcctagttggacagaatgcctcttgatcacggccttagctaaaggagaccactctttgctggatggatcagtcagctacgtgtgaagtttggctcagtacaacattctcggcctggggcggcagcatgggaaagatttttattggaattaactttctacagagatgtactttcaaatgagaccatccttctctcactggtgagctcacccgggctcttattccacaaagcttaattgttttggacccatacatttaaactccttaattaattgactcaagacttaggacagatttgcttttctttataatgactccatggctgtaaatgctgctgattcagatgaaagaggaccctagagcacagaatgagaaggacgtggactcaggatacctgtttctttattctgactgtgctcttcgtcagctctggggctttggaccccagttttgtaaccacctaacgagttcaccttgcctgctgcctagacggagctgatttatcaagacagaggaattgcaatggagaaagagtaagtcacccagagccagctgtgtgggaggctagaattttattgttactgaaatcagtctcccgagcatttgggatcagagtttttaaagataattcggcaggtaggggctcaggaagtggggagtgctgattggtcaagttggagatggagtcacagggggtcgaagtgacgttttcttgctgtcttctgttcctgggtgggatggcagaactggttgagccagattaccgctctgggaggtgtcagctgatccatggagtgcagggtctgcaaactatctcaagcactgatgttaagttttacagtagtgatgttatctccagaagcaatttgtggaggttcagactcttgcagtttctgacccctaaaccttaatttctaatcttgtagctaatttgttagtcctacaaagg

SEQ ID NO: 30528 - DNA, 1050 bp, Homo sapiens
gagggccacctctggtcctagctctggcttttttgcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtaggttgtgaggcagaatcctggctgttttatggaaatgcctggtcatacaccaggtctgggatccatgcctgacagccaaggcagacatatggaaggaacccatccctggtgggccttgaatgatggaggggcccgaagggcagagtgctccagcctgctcagaagaactatttctaacaatgttttttaatagtattttactgggtccaagtggaggagaacttgatgaccttctccatgtcttctctaggtcaacatcgggcaaggtagccatcctcagaaggtcaaagtgtttgggccaggtgtggagagaagtggtctgaaggcaaatgaacctacacacttcacggtggactgtactgaggctggggaaggtgagaaagggctttgttcaacccagtgatcattgctccgtggggaaggcagttcttttcataacgtttcaatgccttttgaactaggaagtagtccatctgaataggtaatcatctactgagcctctgagtcattccttagtgatatctttgctaatccatcatccctttccccaaatccttactctttctcaggtttcttactagaaacttcccaattgctttttgagggtgttaacctgagctggaagagattgcacaggacatgctgtttcttgtaagctggtgctaataagctggtctgttccaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggtacgtggtggggcctggga

SEQ ID NO: 30529 - DNA, 1050 bp, Homo sapiens
ctgcagtgggagggattccctgggcgaagggattctgtgtgtcgtgttataaatgtggccccttacatccaggcttgctgctgtttgtgctttcttccccaaatttttatttttatttatttattttttagacaaaagtcttgctctgttgcccaagctggagtgcagtggcatgatctcagctcactgcaacctctgcctcccaggttcaagcgattctcctgcctcagcctcccgagcaggtgggattacaggcacatgccaccacacctggctaatttttgtatttttggtagagacggggtttcgccatgttggccaggctggtctccaactcctgggctgaggcaatcctttcacctcagcctccaaacctgcggatattacaggcatgagccactgcgcctgacctcagtatttgtctttttgtgactgatttatttttcttcctatatgtcctccatgttgtagcacgtgtcagaacttcattccttttcgaggctgcattccactgtatgtatatatgttttgcttctctcttcgtctgttttttgtttgttttttcttgagactcgctctgttcctcaagctggagtggcactgtctcggctcactgcaacctctgtctcctgggttcaagtgattgtcctgcctcagcctaccgagtagctggaagtacaggcacgtgccaccatgcccagctaatttttgtatttttagtatagatgtttcaccatgttggccaaggtttcaccatggggtttcaccatgttggccaggccggtcttgaattcctgatctcaggtgatctgcccacctcagcctccgaaagtgctgggattataggcatgagccaccgcgcccggccatcttcatttgttgaagaacatttgggttgcttccgtcttttgtctgttgtgaataatgctgggtgtacaaatatctctttgagtctctgcatttaattcttgtgattataaacccgaaatggaattgctggatcatatggaaatctctttttaattttttgagaaactactatactgtatt

SEQ ID NO: 30530 - DNA, 1092 bp, Homo sapiens
ggcttactgaggcagggctgagtgcatacccccaggacggggcctcctgtattcacctgtgagggtttctccagagtaccactagcagtgccattagtgagcatcttccttcactcgtgacccaagtgcacaagttgcaagcaaggccagctcccagttgcagagatccaaagtgagagctcactgttggcttttgtggctggagcagccagctctgagtgtgtaaacgtccactgcccaaccctgtcatgtgtccccttgtcactcctttccccaagacactgagagctttgactccagaacaggaaaagcagggtgccaattaggaaagcctcttttccggtgggaagtagcgatccgggacctccttgcctgtggttcggcagtgtccatcttgccaggccctatgttccttcagagtcaaggttctctgggttgtggcaggggccctgtgttcccagtgcttttgttttgggtaaagtcctttccctgttcttgtctaatctaacacttgggcttcctgcagccctgctttgcagagaccttttggaaaccatcacggtacagtcagttctcagcacttgcttcaatcggctcgcatttggcagctctgtgacttctgctttcttgagggggaggggtgcctataagatggagttggctgccaagaattagtaaataaaacattgacttatgagggtgtttggatatcaagttaacaccaaaagtaagtaaataagagacgacagtgtcagattacaactttctggtcagcaaagattgtggggtcaggtaaatttcactttgagtcccagcttggcaggctgctgcatatgtcaccctggacaagttacttaacctctctgagcatcagtttccccatctgtgaaagccattggttaataataaataccccataggattgtggtgaaaattaagacaataacctatttgtgcttggcatataaaatgcattcagtaaatgatagccgttattgctgtcatcactaattgattattgtgccgacacttgttgttactgaggctgagatgctgatgatacttactcagctttgctgcttgtcctctgca

SEQ ID NO: 30531 - DNA, 1083 bp, Homo sapiens
gattgttttgttttgttttgaaacaggatgtcactctgttgcccaggctggagtgcagtggtgtgatcacggctcactgcaggctcaacctcctgggctcaaatgatcctcctgcctcagccccctgagtagctggaactgcaggtgtgcaccaccacactcagctaatttttgtattttttgtagagatggggtctcgccatgttgcccaggctggtcttgaactcctggactcaagtgatctacccacctcggcctcccaaagtgctgggattataggtgtaagccactgcccccagccacattactgtgtttttaacccccttttccaaataacatagtatagcatgcagacttcgatgctagatgaaactctgaagtagagaatcatttttcacaaataggggatttgtatgcaaatatgcgtttctgtttgttgttttgagcaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccaggtaggcaaggccctacatttggtgtcttgagtctcacttttgtggctagattctacctatgtgtcatggtttcctaacttttgataagatgaatttttatttttataacatgtatttccttctgtagagacttatgttacatagaaagaccaagcatacctaaaaaacataccaaagcacttgataatggtcatgaaactatttagcaaaccaggagtcaatcaagctctataacttgataatgtaaaaatttgtagccaaccttgtaagtatttttattaaagttggttgcaaggcatatgcctgcgttgtacttgcagtcctagccagtgcaattagataagaaaaataggctgggtgtggcggctcacacctgtaatctcagcacttcaggtggccgagacgggacaattgcttgaggccaggagtttgagaccagcctggccaacatggcaaaaccccatccctaca

SEQ ID NO: 30532 - DNA, 1031 bp, Homo sapiens
ttggtgaacctgcaagtagttttctgattgggacaggacaaaggtctttacttcagggtttgcttgataaaagcatttccaaaaggttttacatagaaaccttgttccttgttgatattaatacaaaaaaaaatgttacataagctcttcacctcttggaacaatctctaagggttttcttttctttttttaaaaaatcatgccccttaagatgaaaaactttcacccatatcccctaacacatattttatatagagataagcatattagctctatgtagaaatatgtaatttataaattacatttgtatattgctttactaatataccatgtaccatatgaagcatactatagaataattatagatacagaatatagaataagatgagatataaatattaaaactgaagttccagtattctctttccatttggtgaccatgatcttagcataacaaaagtggggtaaatgtgtttaaccctgtgtttcccaaactaatttgtgaactcttcctccccaaactacttgtatcccttggaacagaggtccccaacccttggagcgtggactggtgtgggtgcacggcatgttaggaattgggccgcacggtggtgggtgagccatcattactgcctgagccctgcctcctgtcagatcagcagctgcattagattctcataggagtgcgaaccctattgtgaactgcacatgagaaggatctagattgcacactccttgtgagaatctaactagtgcctgatgatctgaggtggaacagttttatcctgaaagcattcccccaccaggccccctggtcttctacgaaaccagtccctagtgccaaaaaggttggggaccgctgccttggaacacactcaggacaaaaccagtctgtcatatgatggttactacctcatagttgtaaatttctgctagacttaggcaccttgactaactcactgtcttatctgctgtagaaatccccttttccatcccactcttatgtgtaagaaaagtcagatgcagctggg

SEQ ID NO: 30533 - DNA, 1059 bp, Homo sapiens
ttctcacttgctctcacgagcttcccagaatggtgctggggaggtgtgtccactgtcccccagacccaggctccttaacccagggtcacgagttcttggtctccggtgttgggccgtgggctcctgaaactacagaatatgccacgtgtgtgtttctctgaagaagtggctcactgacaacttgcattactttcttgagcagtcccatgattctctctaggttaaaaactgctgtgtttagatacctcatgactgtcgggttcttgtttgcccctttttcctgccttctcttatttgacttttccagatgtgactttgacactgagtctgtcatacaggagttcctttctcccctcagcctcttttcaatggcccacttctctttggtttgatgctctatgtatccagctggtttcatggtgttctcaagtcctttctgagcttgattttgccagttgtagaaaactctttaagagttgtctgctatattttgtggaagccaaatggaactggaaaaaaaaaaaagaaaagagcaaatggtctctcccattgtgggacttgaatgttttaggcagcaacgaatgttcttgggtctggaaacctttattttgaatacatctgtgccttgggctctgcttctctggggaaggttgctggtgggcttcattgccccgtctctctgtgctccataggagaggtccacatgccttctgggaagacagccacacctgagattgtggacaacaaggacggcacggtcactgttagatatgcccccactgaggtcgggctccatgagatgcacatcaaatacatgggcagccacatccctggtaagctgagtcagcaggcccagcagggctccaccattcaggggcatccgggcagcctgcagacactcctcagccgctttgcagggagcagctctcggcagcaggctggagaatgcagcgttggtacccctgtgaaaccaaacagtctgggaccctagcaggtccagctgatttctggaagggatgatgtagctcagtgtcttgggtcacagtgcaggcctttggg

SEQ ID NO: 30534 - DNA, 1021 bp, Homo sapiens
gagcacacttttattgtgccagtgtgactctagggtgcaaagagaaagctctcagatggagtgttcgaatcatacttactgcaatagtgcatgaagtgcatgagcttagacatgcccttcagcgtcactactaggtaaattttctgctatcccttttacagatgggaaaactgaggcttggcaaggtagtggtgtagccaagttcacatataggtaaacagatccaggttatcaaattccaaagcccatgctcctcaccttgctgtgttcaggttatgctttcagtgggttataaggaagatgcacaaggcagatcctgtttccccaccgtatttagacctgtctgtgaagcagccagtagtactgtgtggaatgtggtcattgtttacctagaaatgcccacagccatgccaggcaggtatgaggtgccttcaactaacaaaaattcctatattttattttatttttgagacagagtctcactctatcacccaggctggagttttagtggcatgatctcggctcactgtgacctctacctcctgggttcaagcgattctcctgcctcagcctcctgaatagctgggattacagcacccaccaccacacccagcttatttttgtatttttaatagagatgaagtttcaccatgttggacaggctggtcttgaactcctgacctcaagtgattcgtctgcctcagcctctcaaagtgttgggattaggcacctggcccaaagattcctttaaaatgtggtccatgaggactcaagtctctaggtcctgccagcttcttgtctttgctgcaagcaggcatgaatcccatcattcttcattggttgggtctactcagtgttcaaggctcatttttttttcacttaactttgtgtaattagttcttgcgtgttcatccgtgaacagcatatggcatggcagctctgtgaagccagggtaaccacatgtaacgggagtcctttttgggggatgtttcccagatgacagcaggcggtgctcccaggt

SEQ ID NO: 30535 - DNA, 1001 bp, Homo sapiens
gggcctctgatacagctggaattctagtgccccaatggtgtgtcaggtcttagtgttggtgctggggacacccagtccttactctcatgcatcccacattctagccttcagatgtgtaagtctttaggaagacatcagaaagtacactgaaaactacctttttggcttattctcccttaactttgtattatgtatttattttttgaattggttacatatttacataacaacttaaaagttttaaaaagtgaaaaaccaagtttcctgtctattcctgacacttagctatctacttccccaccttagatcaatcactgttactggtttcttgtatccatgtgtacatgtatatttgttcattgatttctttaaaagtctgtcttttttttttttttttttaaaggttctcactccgttgcctaggctagagtgcagtggtgcaatcatagcttactacagcttcaaactcctgggctcaagtgatcctcccaccttggtctcccaaagtgctggatcacaggcatgagctaccatgcccaacctgtcctccttttttatttttatttattttttatttttattttttgagatagagtcttgttgcccaggctagagtgcaatggcacaatcttggctcactgcaacctctgcctcctgggttcaagcgattctcctgcctcagcctcccgagtagctggaattacagtcacctgccaccacgcttggctaacttttgtgtttttagtagagatggggtttcatcatgttggctaggctagtctcgaactcctgaccttaagtgatccgcccacctcagcctcccaaagtgctgggattacaggtgtgagccactgcacctgtctccttttttatttttaaatactgcaagcctacagaaagattgaaaggataatatcatgtaaccttcacctggattccccagtggttagcattttaccatatttgctttatttctctctcttttcctcccaccaacacac

SEQ ID NO: 30536 - DNA, 1207 bp, Homo sapiens
aaacacatttgtattcctttttttcctccttcatcctctctaccctcctacccttcccagcctctgataatcaccaatctactttctatcctcatgaaatctactttttgttgttgttgttgttgttgttgttgtttttctttgagatggagtcttgctttgttgcccaggctggagtgcaatggcacattcttggctcactgcagcctctgcctcccagattcaagggatcttcctgccttagcccccctggtagctgagattacaggcacacgctaccatgcccaactaatttttgtatttttactagagacagggtttcgtcatgttggccaggctggtcttgaactcctgacctcaggtgatccacgcgccttgggctcccaaagtgctggattacaggcacgagccactgtgcctggcaagatctgcttttttagctctcacatatgagtgagaacatgcaacagttgtctttctgtgcctggctggcttcacttaacaaaatggcctccagttctattcatgatgctgcaaatgacagaatttcattcttttttatggctgaataatattccattgtaatatataccacttttttttttttatccattgatgggcacttaagttctacattttgcctattgggaatacaataaatatgagagtgcatatgtccttttttttttttttccccaccttggcttcccaaagtgctgggatgacagcatgagccactatgcccagctgcacatgtctttttgaattgatttcctttctcttggatttatgctcagtagtagacttgctggattaaatggtattctatttttagtttagtttcttttgttttttgtttttgagatgaagtcttgccgtgatgcccagggtggagtgcagtggcatggtcatggctcactacagcctcaacctcccaagctcaagtgattctcccacctcagtatcccgagtagctgggaccacaggcgtgtgccaccacgccaatttttttacttgtagaggcaaggtctcactatgttgcccaggctcctggactcaagcaatcctcctgccttggcctcccaaagcactgggattacagacatgagccactgcacctgacctatttttagttttttgggaaacctccatactgctctccacagtggttgtacatttacattcctcccagtagtgtgtgagggtt

SEQ ID NO: 30537 - DNA, 1024 bp, Homo sapiens
gcctcccaaagtgctgggattacaggtgtgagccaccatgcctggccagcagtatctttaacaaactaaacgtgcatctgccatagaacccagcattagcactcctgggcatctgttccagaggactgaaaacttaagttcacacaaaagcctgtacatgaatattcatagcagctttatttttaataacaatgaaactgaaaacaccccatatatccttcaatgggtgaataaactgtggtacattcctactatggaatatactcgacagtgaaaaggaatgacctatttagacacaatatgaatgaatctccagagaattatgctgagcgaaaaaaagccaatcccaaaacatgacatactgggtgtttccatttatagaagactcttgaaatactatatataatctggagaaaggttagtggttgctggggtgaggagtaggggaggaggggtgggtgtggctgtaaagggtagaataagggagtcttatgatggtacagttctttatcattgattgtggtggtagttatatgaagctacctatgtgggaaaattacatagagccacacacaggtataaataggagtagacatacaattggtaaaatctgaataacctctggtttgtaccaataccagttttgtagttttgctactgtactgtagttacgcaagacattgacattgtgggaggctggatgaagagtgcatgaacctccctgtacatttcttttttatttatttatttatttttgaaacagagtttcgctcttcttgcccaggctggagtgcaatggcacgatcttggctcaccgcaccctccgcctcccaggttcaagcgattctcctgcctcagcctcgcaagtagctgggattacaggcatgtgccaccacacccggctaattttgtatttttagtaaaaatggggtttctccgtgttgatcaggctggtctcaaactcccaacctcaggtgatccgccctccttggcctcccaaagtgccgggattacaggcgtgagc

SEQ ID NO: 30538 - DNA, 1059 bp, Homo sapiens
ggtctattacatagtaggtacttagcaaataattgttgaatgaatgtacgaatgccctccagaaaggtggcgccaatttatactcccacctgcagtaagagaaaagagccttgtcttggtcagtccacatcacaataggagtaatgattatagctggattttggtttctgtgactctggcagagaaataatctatttgccttaaaacaaagaaatgaaagtaaaaagttgaatcctccctaaatgacatatggttttgctttaatagactgctgcttttaaacacactggcacaaaagtggaatggagggagagttctgattattttagggctgaatcatgaaggtccaggattccttcttcacatctcgctctattagatcttggcccctgggaccaatctcatggctacttgactcaacggggctgcccaccaatcccaataagcttgagatctggagaagggaccctttatgtatgatgtgggcctttcctgtgatgtcaaattttggtggtggtggtgggattaccaaggaactttgttcccttatctgaagtgtagaaatttagtggaggcaaatttaagagttaggaaccttccattctgtcaactgtaggggaaggaggaaactaatattgactttgttttgttttttttttgtttttccggagacggtcttgctctgttacccaggctggagtgaagtggcatgatcatggctcactgcggcttcaacctcctgtgctcaaaaaactctcccacctcagcctcctgagtagttgggaccacaggtgtgagccatcatgcccaggtatttttaaaatttttttgtagagacggggtctcaccatattgcccaggctaaactcctggactcaagccatccactctcctcagcctcccaaagtgctggaattacaaaggtgagccatcatgcctgaccacggtttgaggtgtttttgtttgtctgtttttttgtttgttttttgagacagagtctcactctgtcacccaggctggagtgtagtggtatgatcttggctcactgcaacctccccc

SEQ ID NO: 30539 - DNA, 1027 bp, Homo sapiens
tagagatcagtgctttagctaggtggcgaaagatgtaataggattctgtttttattgtaagggtgtgtgtgtgtgtgtgtgtgtgtgtgtgtctgtgtgtgtgtgtgtgtgtgtgtgtgtagagacagcgtctcaccatgttgtccaggctggtgtgtgtgtgtgtgtgtgtgtgtgtgtgtgtgtgtgtgtggagacagcgtctcaccatgttgtccaggctggtctggaacgcctgggctcaggccgttctcctgcctcagccccacaaagtgctggtatacagatgtgagccaccacacctggccctgcagatcttttctttaaaaaataaaataatttagggtagaaaatggcagttcttgtagggatgactgaccacaaaagacagtgactcacaggagacccatagaggcagatgtggtagagtaaaaaactgtagcattgtcttgcgtaattttttgactgttctgtgttcttgtcattttagctgtaaagtttgactgagaaatgttgcatcagccctgaagtttattgagaaaatcttacgctgatgcaaactttttggactgttagtgtcttatgagtaagtcttttttaaaacaggaactgttggaaattattttggaaagaagtagttgttaagaggggtatgtagaagagaaaggcactgttttttcttggggagattgaagttggctttccagcttggtagctgaagggagatggtgttccagaagtcagagctctactctcgctttgaaatgctgaatctctaggaagttactccttggctgtagacagaaacatacggagttagagacagacttggggttggaagaggcaagaccttaatacaggtctgagctgatacttgctagtcatgtgatataggctgggcaagtcacttaaacctttttgaagtttagttttgtcatctgtaaatgggagtaataaatgcctgccctgcctgcctcccaaggttgttaggaagatcaaatgaaatcatcttgatgaagtatttgta

SEQ ID NO: 30540 - DNA, 1050 bp, Homo sapiens
tctattgttatcggaattgtttcagaaagtattctaagcacaagttctttagctcttcgggcccaactcctttaaggatctcatcacagggactgcttccctgttcataaatacccataaacatgtctttgtgaactctcagaacctcactgacctgaagcccattcttaggctttggatcttagggtaagaatcactgccggaaaaacttttttaggccaggcacggtggctcttgcctgtaatcatagcactttgagaggctgaggtaggtggatggcttgagttcaagaccagcctaggcaacatggtgaaaccctgtctctactaaaaatacaaagattagccaggtaaggtagtgcatgcctgtagtccctgctcctcaggaagctgaggcacgagaatcgcttgaacctgggaggcagaggttgcagtgagctgagatcatgccagtgcactccagcctgggccacagagtgagactctgtctcaaaaaaaaaaaaaaaaagaaaagaaaaaaagaaagaaaaactttttaaaactgtaaacttggagtattacttattttagttggtgaaatatgtgcatctgaaaaatgtactataataccatctatatcctactttaagaaaatcctgtatttagaacaatagatgaactatgtcctcttagtttgaaaacaaattgctttgggttgcagcttgcctggcgcgtttaagtgtgtgcacagatgacttattagacagtggcatggggaagggcaaagggctctgtgccggagagcagggttctaggcacggctctgcctgctgtcgcagcacctctttataatatttaaacaaggctgctcacatttctttgatgtgctcatcagaaataggtcatttctcctcattaattcagttgaggcttttttgctggactggagggaagtgaatggagtgttggtatgggagaatcctggatctcaaaatgtctaagagccacctgtagtggtgaaaagggaaagcagtgtcgttcattcattgccttccttttgagcctgcccttc

SEQ ID NO: 30541 - DNA, 1060 bp, Homo sapiens
caaataattagccagttatggtggtgggcacctgtaatcccagctactcaggaggctgaggcaggagaatcgcttgaaccttggaggcggaggctgcagtgagtcgagattgcaccattgcactccagcctgggcaacaagagtgaaactccatctcaaaacaaaacaaaacaaaacaaaaaacaagtgggcaggccatagggctcagccatgagctcccggaggccagacctgaagggaggcagcccccagcaaatgcccatttcagctcttcccctctcagtttttgttaatccctaaaggggttccaacatcagtacatagacatttgatctcaggaacattaacagatacttaaaaagagtcttctgcgtgccaggcactgtactgcctattaagataaaaagatgaatgaagcagggagctgacatcctagtcaatatagcagccacaaaagcaaagatgaagcaaagtactaaagggcccctctgcctgggagagcagggcacaggggagaggctggtcaggtcctccctggggcttagggaactcggagtggttaacagaggagccagcattttagagaaaacgttctaaatcagtatgcctcagccttttctaacttgcaaactcctttcatagtaatagggaatggtacagactctctggaagttattttaaatataaaaatattttatttagatcagtatattactaaaaattgtttgggatctgaactatatatatttttaaattgtgttcagaggaatacaacttaaggccctgagaaacagcatcttcagacaacttgtagaattaccgtttttatgataattctcacttgtatttctcactaacttctcactaacatgtgttttgtcattggcattgcttgagcctacatttagtcagcggtttattatggatgtaaatgaaatcatatatgactaagagcaaagtcaattaaaatactgtgtaatggtaaaaactgtgataaaccaactgagttatgagcatactcatgacttccacaactcatcccatgcttcctgtgtgccca

SEQ ID NO: 30542 - DNA, 1025 bp, Homo sapiens
attgttttaatgtgaataaggacatttacttattctagataagaaaagggctgtgaaatccataaactgaatagactgaccctatctagttgattctacctgctgataaaatggaacttcggcagaatgcgttactgggtggatgctgtacggggcactcccttcctttggaagcccccagcaggctgctctgcacctctctgtctgctgtaccacttgtggcttctgtcatttgtcattacccaggagtggaggttgcgtcaggaagagatactgcagccaattgcctaagctgttgatggtgcaaagtttcaaaccaggcaggccatggggagcagtgggaggcaaggagcttttagtggcttggggaaggaggtggaccctgcaccagagtaaaagcctgtcactgggtccggtctctgagttttttgtccctcatcatcttgtttcacaaggctcacacactaagccaaatgtagattctcagacagcagtgggtcccagcctgggccaaattccaaatgtctttcgttggtccccatgagggtttctctgtgttttatcttagcaggatctggggccagctcacctctcacgtccccgtcatcgccaactccaccctctacatcaggttagtgatggagtaaagtgacatgccaccttcctgtccgccaacaggaggagcgggctgtgcctcttcctgccttggcccaacaatttcaggggttagatagcagcagctttctcaagagaaatcagtgggagtgcaaattagcagtgtcatttgggagagctgaggggctagatttccaagctcggctttcacagggaatggaccggtttcagggccactagccacccccgggctccagcttgctgtctttgctgaaaagcttcatgcagagcttctcagattggagcctgtcttggtacatgcttagctgaacaacacaaatgcgccgtggcccaggggtcccgtcctgccaggcctctctcctcagggagcccgtccatagggtcagttt

SEQ ID NO: 30543 - DNA, 1079 bp, Homo sapiens
ccaagtgggcagagctcactccttcgggcccacttggtgttgcagtcaagagactcagttccaaaaaccttcagcagaggtctcccctcctcctggtatttcactggttgctctccagaagtcctcttcagaggaatgctcatcacacatgcttattctccgttttcccacttcaacagttacttcaggtttaaagtcctttttatctctgtaacctggtgacataaagccaggaacattttcccacaatccaccttagcataaaacataacaatttcattcatcagttgttattgtgtagaaccaatgaacatgttggtcatttgtctgtatttagtctttatttgtattgctatctttgagcattccaagattgcagagcatgagcgtgtgtatttgtgtgattctttaatttcagctgccttaggtttgagtaaaagatgtaaagaaaggtaagtgattttctattgtaagactttaacccatacctgtcacacttggtgaaaaggatgtacttacctgagtattgtgttggtgattctgagccagtcgtccatacaaacttaagtagggtagctttacctgttacttatcacaactcagtagcagtgtaggggaaaccacctggcagaatgtctccctggagtagccctgggagggacagagacagcatctgacagagtctcagagagctgcaaggtcacaggagacgaggcaactaactgtggcacaggaacattctttaaggcaaggctttttctgaactcgggtgtttattctgtcctgagagaaccattcattgattctaaaatataaaattcgagttgcaaatgtccatgtgcctggaagctgagggaagttttagacacctgcccagtttccctctccttgcccactgcggtacagcacgacattctagtttctcctgatgcttcgtcaaagacatttagtgcagttatgtcctgttccttggttgggccacaatggagagaacagtacttgagaaggatttctctgtaagaataccatggcagagagacccctctgccccctgctttgcattgctaacagttattagc

SEQ ID NO: 30544 - DNA, 1082 bp, Homo sapiens
ggccagttttttttttttttttttttttgaggcggactctcgctctgtcacccaggttggagtgcagtggcgcgatctcggctcactgcatcctccgcctcccgggttcacaccattctccttcttcagcctcccaagtagctgggactacaggcgcccaccactacgcctggctactttttttgtatttttagtagagacggggtttcaccgtgttagcgaggatggtctcgatctcctgacctcgtgatccacctgcctcggcctcccaaagtgctggtattacaggcgtgagatagttatttttgtagagatggcatctctctatgttgctcaggctggtctcgaacttctaggctcaagtgatcctctcatcttgacctcctaatgtgttgggattacaggcatgatccaccacgccccactggaaattgcaaacacattcagaagtagagaggatagtgtaatgaacactcatgtacctgcccattgaccagcttcaacaactgttcactttggcttttttctcctatggattattttgaagtaaatcacagatattatttcacatatatcacttcagactgtatctaaaagataatgactctaaaacataaatatctaatttaaaattttaatgttgcatatatgccatagtaccattatcacatgatggtgctggttgcttcttgaatactgttggttatttcatagcttggatctccaactttgtaaaagtggtcttatatattcctcataggcagggttctcctgtttgtagaaagaaacgcattattaacacagtacatttctgccaggattaatgactttcactttcaaattaagtctctagcttcaaaaagtaacattacgtaagattcttaattttaaaaattatttctaagactcattttgtgtgaacatatggagaaacattttttccaaagggcatccttccttttctcatgcagattttaaattgtggatgcaggtggccaattaaaaacacagcttatcacttgcttttggaatttcatacaaataaaaggcttgactctttgaggctctctgaaactgaacat

SEQ ID NO: 30545 - DNA, 1039 bp, Homo sapiens
cttcgggcctcccaatatagttataattttggccagaccaatatttagtattgacattatgatgattgtgtgtcattaaagcattggtggtaactgggatactgtatccaatgtaatcgtttcttgatgatccccaacatcatatgagccctaccgccaatttaatgtccccctgcccccttgtggtctcacttcattccttatccagctgaaattccatgttctattactctctcaaaaatacattcaacaggccgggcgcgatggctcacacctgtaatcccagcaatttgggagaccgaggcagatggatcagctgaggtcaggagttcgagaccagcctggccaacatggcggaaccctgtctctactaaaaatacaaaaattagccaggtgtggtggtgtgtgcctgtagtctcagctactgggaaggctgaggtgggagaatcgcttgaacctgggagtcagaggttgcagtgagctgagatcgtgccgctgcactccagcttgggcaacagagcaagactcccgctcaaaaaaaaaaaaaaaaaaaaaaaaaaaaaaaatatatatatatatatatatatatatatatatatatatatatatatacacacacacacacacacacacacacacacactcaacgatttttcttgctttgtcatacctgtttagcaaaacgcatacctctttgtctttagttttccacccactttgtgccaccacctttgtaactatacatggctggaaaaaacaatcataactggtgtaataagggctcaagtgggccctgattgcagctcagcaatcgtattacattgctatatttactcattgttcatttactgtttctttttcttaggcagttatttcttaccatctctttgatcctcagattgacactatccacctttcccatctcttttgcctggatggctttacatcgtatttcactaatgaagtggaagcagtaagagaatctgtgtaagttcccacccttgcatttatacatacaatgctttctctcttcaggctc

SEQ ID NO: 30546 - DNA, 1047 bp, Homo sapiens
tggtactcttgctatgctgaggattaattctttatatgtaaggaagatatagaaataatacttaccaaggagttgctaggtgtattagtttgttctcatgctgctaataaccacacactcaagactgggtaatttataaaggaatgaggtttaatggactcgcaatcatggaggaaggcaaaagaggagcaaagccacatcttacatggcagcaggcaagacagcgtattcaggggaaatgtcctttataaaaccatcactatcaatcatgagaacagcatgggaaagaccctcccccttgattcagttacctcccactgggtccctcccatgacatgtggggattatgggagctacaattcaagatgagatgtgggtggggaaacagccaaatcgtataactaggtatgtccaccccaaacattaagtcaagaacatctttttggtcttatagtctttattcttatatagggcatctctggatataggtgttcacattcttctttgcaacctgttggttttcaagacagactgtcggcaagcaaaatgtcagaggcaagcactgagatttgacccatcagccctagggaagctgactctttggttttcccccatgcaccttgtcttcttgatatgcctgcaggggttggggggaggtgggtgggtggaaaggagtactggtttagggttgaagcaagtctaaagccagcttgctctgggtttaagatctggcctccactgctgtttctccaaagttgggagtcagtcatattcctgtttaagataatcttaagtgatctacattgaatctctcagtaggttattctctttaatccttctgaatatgccaaatggagagtttcggtttggtgctagaattaaatgcccctctaatggtggctagcctcactttttaacacagagactgaatctcactcctagttgctaaggcaagcaactatgcagagctggaaatcatcagcattgtttttctcttatgtttatttttatgcttaacttctaattacaggtagtacttgtttttct

SEQ ID NO: 30547 - DNA, 1355 bp, Homo sapiens
gacctcaagtgatcctcctacctcaacttcccaaagtgctaggattacaggcctgagccattgctcctggccaccgtttttaagtgttcttaagagatttggataggagtgtatggaaagcggacggtggaactgaaaaggacaactgtatgtatagacaactttttgaaaaattgtataaacatacgtgatgggtttttgtatctgtctttgctgttgagggtgaggaggagtagggatcagcatggggacattctatgtaagattactaacaggttacattttgaggtttaaataaatgagaaagtcctcatgaagtctgagatatcaccttgcccacattgcaaaggaggtctctgctttctcagcttaaagtgggaaaaatgctttctgtgggcttaaaatgtgtctcataagtcttccaaatccctgtgtagaaagagtcgcctagtcctgcaccctcagatgttaattcctcttctcaggctttatggacagtgtggtaatggagggaaataggttactcattactgggattcaatttggctccactgatgggaagcaaacagtagttgggtgtttgcttttattttacacttgtgtgacacttgaacacattgatgtcctgtctctatatgttcatggattcagagctacagagcatatgagagagaaccaaacactgatgcacacctcgtaccctctaatcttttcttttttttttttgcagactgaaatcagcatgatatttttctggccaaacaacaaaatgtgattttaaactactcagtttagctatttttggggagtagcaaagtgacacagttggctgctgaattctagcaactaaaaaagaaaaaaatgaaagcatagttcatggaatatgtaacacttccatgtaagaaaataggacaactggtcttatttttgggtctgtgatactgtctttctaagtgagtgaagcagggtgttgtataatgcagtggatatacttttgaggaattcatactagttacaatatacatctaagaggtatttgagttttcatagcattgctgcctcatgaatcctgcagtgcacttaaatcagatctgttcattaattgggaatgatttggataaggggacacagccataagcaattgaccaagcataaaagcatagtccagattagtgaggaaatattactgactttttaaggttgtctcgagaactttttaagaattgtcaaaaggatttatttacaaagcggtggttatttataaatgagttctacctgtttttaaaatgacacttttccagaagcgtttctcttcagtaagtgtggaggcttagctctgtctgtgggtagctaag

SEQ ID NO: 30548 - DNA, 1028 bp, Homo sapiens
ttgagacagagtcttgctctaacacccaggctggagtgcagtggcgtgatctcccctcattgcaacctccccctactgggctcaagccatcctcccatctcagcctcccgcataactggtactacagacgtgtaccaccatgcccggctgatttctgtattttttgtagagacagggttttgccatgttgcccaggccggtctcaaactcctggtctcaagtgatccactcgccttggcctctcaaagtgctgggattacagggtgtgagccactgcacctggcccttattttgttttatttattaattttttggtgctgggaatgctgagtatatcatatattcatacatgtcattatatctaaatgataaaaatcacaagagtagcaaccacatgtagccaaagtggaaagctgtccagtacattctttttcgtcctggcacaactctgagattgatgctgtttctctaggggggaatggggacagcatgagatagaacaatttatccgaagtggcgagtgcagccaggacgtagcctgataggaacccagaagcctttgcctatgtttgataagagtggaattcatgttaactttaaccatgtattctgtgtttgttgggatgctgtgaagggaaggatgaccaggctcactcttgggtccagctgttgacttctggaccttcctgtttccaggctgtagatacagaaatgaatgcctgagatgtccagtgggacgttatgatttttaactattagggagtttcctcttgtacattattgcaaggaagataatggattcaagtcaactgttagtggaaacgccatgtgttagcactttgcttcgggttttgggggttcaaaaaatgtgtgcaaaaagtccctaaagcaatgtgttgcagtgtaagactgaagctaataacatgctgaaatactgattcagatcccaagtgttcaggagcgatagaataatgagataagataccttcctacgggtatcctggctggtattttatgtacacaatgaa

SEQ ID NO: 30549 - DNA, 1033 bp, Homo sapiens
cagcatgagaggggggtgtgtgtgcctgtgtgtgtgtcctgctcacatttgaattgtgaattcacattgcattcccttgcaaggatgtgccatttttaattaagactaaagcatggtggggtattctaaattgggcctgattataattgcagatggcaattgagcttttggaagctggtttctttaactgttaaataaaaattgtcttttttagtattggtttgcagaagtttagcagtggatgtcgaggggaaaaaaacggtaacctctttctttccttgaaactaaatgtcacagcatatccatcttctgttaaaggggtttagctctgaagaaatttttcttaaggcctttttaaacaattgatcagataaaaaattttggctcataaagctgaactttccagagactttctgttgatgagagtcaatacagtaaaaaatgacagtattcattgttattataaagagtacttttgaccatcacacttttagtgatcataattagtaccttaggctgggcttggtggctcgcgcctgtaatcccagcactttgggagcccaaggcaggaggaccatttaagcccaggagttcgagaccagcctgggcagcatagtgagatcctgtctcaaaaaaaaaaaaaaaaaaaaaaaagttaaaaactaccctggtgtgttggtgcgcatctgtggtcccagctactcgggaggctgaggtgggaggattgcctgagcctgggagatcaaggctacagtgaaccgtgatcatgccactgcattccagcctgggcaaaacagtaagaccctgtctcaaaaattaaaaaaagaaaaggtaccttagcatacagagccttcttctgtttggtaggcaaacatggctttgttctgtgctccaaaaaggatgggcttgacagtctgggcttttaatgaatttctgtatggagttctatatacatacaatttctgcctattgatgagtatgtacacccacgagaccagtggtttgtaactgagggagggttaatagttttgtt

SEQ ID NO: 30550 - DNA, 1029 bp, Homo sapiens
ctataatcctaacactttgggaggctgaggtgggcagattgcttgaacccaggagttcaagaccagccttggcaacatggctaaacctcatctgtacaaaaaataccaaaaaaattagctgggtatggtggcgtgtgtctgtagtcctagctactttgcaggctgaggcaggaggatcacctgagcctggggaggtcaaggctgcagtgagccgtgattgtgccattgcactccagtctgggtgacagagtgagaccctgttacacacgcacatacacacacacacacacacaaatctatagtctagaggaagttataaggcacataggtgtaatgcttataattgataggaagtgatgagtatgaaagcaggttgacagataaagtgctctttgtttctagagaaagaaatcacttctgttctaggatattagggaaggcctcagtgaggaggatgataattttgctatatgttcagcagccattttcagatgagatcaggcacgttcagggtggcatggccatagacacagcagccattgtcagtttgcaaagagctttcaagtacatcatctgctagttatttggaaaccctgggaggaagttgtgataatttagataatgacccagagaggtagggcaacataccaagggccacccagcaagtgatgatgtaagcatgtgtttaagttgagcatttctgaccaattatttcacaaagaactagagtcattacatcactttccttcatccccttcatccccctcccctccctgcccatggcatcacattacatgtaggataaagctttcactctggaccatgttctgcaagattccacatgatccagcttctgtctttcttccaggactagccttcttgcttaccttgcatgccggctgtttccagaatttatgaaacttttttccaccccagggttcttacacatgctgttcagttacacagaaagagtcatccccaccatccttcttcttgatttggcgcattgttagaatgtcacctccttag

SEQ ID NO: 30551 - DNA, 1046 bp, Homo sapiens
aagccttgtggctagcaagggtctgagctgtctgatcagagtctaatggttgccattaagcagtcttcacccttttcatgatgcaaaatggactttcaggtttaaagaaacgaagtctaacacaaactgcagttatttaaaaggcaatgtagtaatttaatcaagatccacttgcttttggatatttcacgtttctacttctggtttcttcttggatcactttctgaatataatggatctggagtacagggccacagcctttagagtttcttttctcttccctcagtgttttaagtgggaaggtgtttgcccatcagaagagaaactgttggattgcatggtgccccttgctgtttgaggtgcctctgaggaacttggtgtggagataggaggagatcaggagaagattcttcgagcttcggctagaagatgtccaggcaggttatcttctaactacatgcaactagaggcatatttacagagaataatctgaagcttgactctttgatcatcaactccttggagtagcctgttagctcttaaatactctcagttctagtgaaacaaataaaattcctacctccccctccaccgttccttcctcctcctctctccagatttcctccccctccctccctgaaatatatatagaatacccaccatcaagcattgttcttggctctggggatgcagcagtgaatggaaacagatgaagtccctgtccttatgggatgtttctattggggaacaaagtggaaatctcgggagggcaagacgcccagcacatggttatcctgtggactgcaggaatagtgagtagtttgttaagcaataattatttttattaacttgggggagagaaagttttcacatgtgtatttctccttgccttctctccatgccacccattttactgatatgtttttaaggaagaatcaccgagttagttctgactctcatttaggtaaatgtttccaattcatttaaggttatcggcttttgtgttttgtcccactacagatgggcttgcggttctgtttaaaaga

SEQ ID NO: 30552 - DNA, 1033 bp, Homo sapiens
ctgttggttctatttttctcaagtacagtttgttattttgctctgctttgctgctcatatgcgaggacctttcttggccagcctcttgagatcttctgttctggtgatagatgcttgattcaggtttggagagcagcttagtgtcctcagataattctgggaaagcaactgaagagtgatctggttctacaagctggtgactggacccacaatacccagaagaggtctgcattttgcccctggcaccgcagagtgaaagggaggccagagttctctgcagactccacctgttctccttactgccctttgtagtgaatggacattgactcaagtttgtctatctacactctttggggagccccttaaaacccggatttgacttggaaatgaagcttttggttatggcttctgatcatgctatatgtggtagaagcttagtgtctgtatttttaaaattcagactggcttttaatactgggtaactaagtcatagatgaggggaagttgatggagtgatggaaatagacaattgccattttgcagcccatcaatgaattgatggatctgggcatgagacatcgacacttggtaatatcctccagagacaataagctgttgtttgcccctgacagtagaatactttacctccaaggaagtagtcttataaaaacaaatacagctgatctgttcaagtaacaatttacagtaactacagaggacacgaaaacatggtaaaacaatgttgttagggataccattggcctattccagactgaccaaaggtctgctttctttaacaaataaattacaagaaaggaaaaaatgatggaatggaaaacctacagattaaagaatttgagacatatccatgaaagtctgtagtctcagctacctgggcggctgaaaagggaagattgcttgaccccacaagttcatttctagcctgggaaacatagcaagaccccatctggggagagagagagagagaaagagagagagagagagacagagacagacagacagagacagacat

SEQ ID NO: 30553 - DNA, 1031 bp, Homo sapiens
cactccagcctggcgacacagtgagactccgtctcaaaaaacaaacaaaaatgaaaaaagcacaaagaatgaaattctggaaacactaaggagatgaatgtttacctacctgacagaattgttttgggagttttaatgcaggtggcagcttgctgtgacttctaaaggcagtacagaagtatcacagtgtggttaaacttctttttttgaccaggaggtaaacctgaactcaaagtctcccaaagccctctctgaacaagaaaatagaatagtggtccagagtttggatactgaggctggactgtctgggtttgagccccctctcgcctctgttcacatagttagcgagtgatatatgcatttaacttccctgagcctcagtttctcatttgttaaaggcagtacctcatggtgttggtatcaggattaaaagaccatttcagaggaagcttctagaacagcacgtggttcagtataacacggcgtctacgggttgacaatgataatgatgattggatattaaaaaaacctgactggatgcgttggctcacgcctgtaatcccagcactttgggagactaaggtgggctgatacctgaggtcgggagttcgagaccagcctggccaacatgttgaaaccccatctctactaaaaacagaaaaattagctgggcgtggtggtgcacaccttgtaatcccagctactcaggaggctgaggcatgagaatcgcttgaacctgggaggcggaggttgcagtgagcccggattgtgccacttgcactccagcctgggccatagagtgagactccatctcaaaaaacaaaaccttacacaatttaatacattaaacaggtttggacactttttccccccctaattaaaaattttttttttttctttaagagacaagagtcttgctcagttgtccaggctgagtgcagtggcatgctcctagcctactgcagcctcaaactcctgggctcaagcaatcctttcgcctcagcctcccgagtagctaggactacaagtgc

SEQ ID NO: 30554 - DNA, 1062 bp, Homo sapiens
tgtagctagcgtgttgactagcactggttagcacactaacaaatagaaaccaacactatactcaccttctaggttctaggtttatagttaattaacccaagttctcctgaagaccagatttcttcttgtcttggaaggggttagaaggtaatagtcatttgaacatatgtccacaaaatcttttttcagaaactgaggtttaattgtcctcctattgactatgagctagacttcatgtctcctgatgaacataataaggttgaagtgatagtgactttagagacaatatctctaaagagactttctgtcttggataactttgaggaaagccacctgccatgttgtgaggacactcaagcagccctgtggaggggcctgtgttgtgaggaatggaggcctcccactgatagccatataagtaagcctggaagtggatcctctatcccagattaaatattcagctgactgcagtgcagccaacacttgactgtaacctcatgagagaacctgagccagaagcaagccaactaaactgctcttacatccatgccccacagagcctatgagatgataaatgtttgttgttagaagccattacgttgtgggataatttgttacacagtaatagatcactaatgcacaataatggtgggggtcagatacacaggaacaaactgaatccataagaagatgatggtccttggcatgcccttggaatggggtccaatgatgttgcagaactaggtaaggcctttctaggggcagaaaagggaatgttttggggttagatttggtacttagcatcaacaaggaagatctgttccagtagcattttaaaaaggcctctcaactaagacttattgatggtgatggtgcatatgtctgtcggtctgcggaaatgcaggtgagcaagggaatgcagaacagatgcagagtatacacataggcgtctgatgcaggttcaagtcgagtagcttccgatatgactgttttctttagttttcacaaccattgaaaagagcaggccaggtatggtggctcacacctgtaatctcagcactt

SEQ ID NO: 30555 - DNA, 1043 bp, Homo sapiens
gggtgtttagtaacatctatcctagatgccagtagcacactcatcctctttgtaataccagagatgtctcaagagtaatttgtttctgaccactgacagaagcctacttaagaaaagctgacagctgatgtcaggtgttttctttgttcaaaaatggtgtagaacagtacttggagtgaatgggtgacttcaatttagtaattgtttttacatttagtaaagaaattatgtaatggtagtgtctcctctcccttacccccccaattcatttgaattaataatttaaaaagtacttttaaaacttagacccagccatctgttccttcctgttgccttacagcagcagtaattgctttaggatgggcttggaaacaagagcggaaatggtctccagtgaccccaaatcataacagaactcgaatcctaagaaaaaccacaagtggcttatgaataagctgaaaacttaaatgcctcctcaacaatttaaatttggattgcatagcttatggatttggtgggacattctaacctcgatgtatctttaacattttctgcttttaagatgcaaaggcgttaacatagggatggagagaaaacttccttctaagttttcctagaaagtctggcacctttgacatagctataacagaaagaaaaatatatatatgtatttgatactggttctagataatgccattaattagatttaaaatgatgcttatagcaagcatatgtacaacgtaatatgttccagctacgactctaagcacttttcccattttaattcacttgcttctcagaacagttctatgagggaggctctattaggcctgactcatgctcggcattttgtacacgaggaaactaaagcaaggcaaagtcgactgcccagaattaccggctaataaatgtcagtcttgcctggtgctgcacacctgcagtcccaggtacttaggaggctgaggtgggaggatctcttgagcccaggagtttgaatctaactgggaaacatagtgagactttgtctctttaaacaaaatttt

SEQ ID NO: 30556 - DNA, 1712 bp, Homo sapiens
gtgtccttgatggtcccaatagggatctgactacctcagggatgcagatactgagttagcagtgcaaggaattcattgggggttagtgcctgtagcagaagtaaagggaagaagcaggattggacagggagaatctcagaatgtgctgcagatctgccatagtggacagaaacaggcagaccccagtagtacccctgactccttgcagcccttggctggggaagagctttgccttgacacaaaagctgcttggaacctgaaggttctttgcagctgagtagcaagttctttgctgaagggagctccaagttgtacccctgctagggctagctagagatacctccactatctgtgttggggtccctattctgtcttacttctgtcacatgtagtttatttcctacacagcattttatcatcaactataataaaaaggtaatgaaaatgtatcctgttagtctctgcccctagagtgtggcctttgtcagtgtaattgactgctggcacattgaggagcacaggagagggcatttcctggcaacctggcatataatggtgtcagatttcttattgccgtgttctcttttgagcttggaaagattagttaccgcttgttggggtatgagtgggagcgccgtgcttctgaacatttgcaaagcatctgccaggaccctgcaccgtgaggagcacttggtgctcgttacctcattcccgtggtcttgcgtggggagggacttgtttacatttgttttagtaccgagatgcatgcatgtccacttgatgggtaaggaaactgagtgttagagaacttaaatattaaggttctctaggaccacttacctcaggagtggcagagatgggacctcagctctttctgcccactaagcctgtcaacttaatggctctgctgtcatgtgacagatagagctggagctagggaatgaatgcaaagagaatttggcccatactagccctctgatacttaccattgttctctgtgccagggttcatgttagaactggcctgtgccgtgagtagttggtgagactgggggaaatgagtggtcttagacgtcactattggggactttaaatgagcacagcttctgtgaaggcgactgggccatgtccatcacagttagatttgcctatacccttggatcaggaaactctgcccccaggtgtgtgccccacagatgtacttggccacagtgcaaaatgactcatgtcaaggttattccttgcatcagtgtttggattttgaaaggattggaaataacctgacagcccattaataggggctgttttaataaattatactatgctaaataatggcatatgtgcagatgttacaatcagagaagcattgccctatgaacagatacatatgtttgtctgtatatcgaaatctctatttccctagatagccttgttaatcaggtgggggaaaagcagggcgtacaacggtatttagttaaagctactttttttatgggacacatacaggattatctttagcatcatggtattaatggttggtgttgtcttgagaggtatggggaagaggtgagataaggagtccatgtttttatactttgactttgatttatagaatatatacatacattatcagttcagaaaattaaatttaataaagacatccccaaaaccagccaaccaaaaatgcatcaaccgttgaccactgggactagc

SEQ ID NO: 30557 - DNA, 1051 bp, Homo sapiens
tttgtcaaggccgtaaatggactttggggctgtacattaagagacctggcctgacttgatctggctaaacatggctttgggaccctcttgaagtttccagttgatattttttattcttttcaaaccaaatcactgcagtgaaaagaaaacaaaaaaaggagtttttaaatttatacaaaagtatgaaaaagaatgagaagttaggaaagtgtgaattatattttaagtaaggctttgtggctttgttgatcatggaaatctttttattaacacattagacaaattctttacatgccagtttgcattcacttaaacatttgtgggggtggtgtgtaaaatgtgcagcaatacctgctcctttttgggaaatccatttgttaaatagccctcagaatatgacagttttatagtaggattatgacttttttttgtttccatgtctgctaaaaaggctaacagaataggacaatttaatcacatgccattatgttcataggggtttgggaagctcagacatgtttctagaaaaggaatcgcgtacccagcttttccaagtttcttagcaaaattcgataattacttgatttggagatgtccccattcagccccttcttctgagggcatctggccttcctgagtgtggctgacatcactttcatgaccttggctctgttgaggtggttgtcagggaaggtgtgttgccagaactgtcctgtcactcttcgacagagagagacagagagacatttcctggactaatccatgtttccagccagatttatattatttacagggtattaggcaaggaccaggatttagccaggtgttgccctggagaattgtttcggacctcaagtcaaaaaaaggctgcatgctgactagcggaggaaacagctccccacgggccagcctagactctgtatcctggcatttgtcatcccagctggagttttttgaggcatcggagctagaataaagcaggagctcatcagaggctctcttttctcagtcgcctccatctttccagagactcagaggccaccagctgtgg

SEQ ID NO: 30558 - DNA, 1047 bp, Homo sapiens
tcctgccctgcttctcaatgcatcagggaaaatatcctaacatgtctggcgtgccctttaacttgacagagagggcagaggctgaggaagtttggtggtacgactgcacttggttaagcagccagtgctggcgaaacaggccttacttagcccaggcattctgactgccatttgaggactgtttttactgtaataatccatcactctggactttatgctctaggaatgaaaattgtatttactattggcctaagaaaaacatattgcaattcatatttgaagctgcttagcaaagatccctaacaccagccagaagtgatttggctattggaattacctgttttggagagtgattcctataactgcttccctatcatcatctgtaatggttgaagctatgtgtatacattcacacgtttacacacaaaacaagataatttctttactgggtcttagcaaaaagtctagaagaattttcaataaaactggatgcatatttatgattgtctgacttaaaatgtagactgtgtggcatgtatgaatttcactttggagggaacagagtcttgagcaagcacctcaaataaatacataggccattactctctgctatggcagctgaaactaagaaacagtgagagggctatgtggctgcttatgtgggaagatttaatttctgttgtaggatgctgaggaccttggaaattgaggcactgaagctgaagtggcaagggcaagtgtgaattgcatcagatctttttctctcagggtaatttcttcatatcccaggtaaggtagcatttggatttctagtctttatatttattggtggtgagtaattctccccaaaaatggagggggagaaactagtatgcaaatgatgacaaaatagaagaaatctatctcattttgcagtgttcttatcccatcataaaaattagttgatcagataaattgaagttttaacctgattccatttatttcctactagacgcattttggaaatctcagtttgtgttctgaagattttctagctagaaagtttta

SEQ ID NO: 30559 - DNA, 1053 bp, Homo sapiens
gtaataattaacaaagagattgctaggttacaaatgaacgataatgccgtattttaaaaatacagcattacatatctgtgcaaagtgatatatgttatgaaacattaatatccaaatgagagatttgaactgaatgatctccaaaatcctttctaatatgtcttttctggctttctaaaatatgagctctatgactattaatatattttgtgagatgtcaactgtgccatatttctgcaaacctcaaggagaggccacagcctatctttagtcttatgcaagtatattaactgaaccttgcatggtggactagaggttgctgattgtcttctattatttctccataatagaagccctgtttttctaggtgggcccatagctgcgaggaataaagaccagccttcaccctcccttgtagttagccatggtttaagtgtgcaacttctaggacatttcctcagtggaagacggtcatgtccttagtctgttcttcctccctgatagctggaatgtgaatacaatggctggatcttaagcagccatgatgggaccacgagattggtactatgtgccgaagatgggagagccacaagatagaagcagtctggcagctgtagatactcagatgtacagagtatttcttgcagaaaagtctgctactgagggaaggagttaggggctgagattcaatccaggctctttctcaagttgtgttcttagagaaaggtggggccttttactttccacaaaaggatcatatgtttgctaaaccatatacttgcagggctccttccaccaggagggctgcctttctgtcatttgttcagaggcgccacgtgagccttgatactgtgaaatgtcccaccatcccagacttccctacctctgaactgtattaatggtagagagaagttacaagttacaagaagtatcttgttttagctactcctgttttgatattttccattactggtacctgagtctaatcctgataaatatatcactgtctttttctttgcaagagtcactttggattttttgttcacaaacagc

SEQ ID NO: 30560 - DNA, 1100 bp, Homo sapiens
ttcattgcaaatgaccacagcactccctgagaaatcttccctttcatgtggcacatttaatcctgagggccagttctaacggtttggtaatgtcttatcatctgttttattcctttctggattccaattttaagtcagatcgagagaacaaggcctggcccagcaggagagttctctgatccttcggtcctatctgacttgggtatgataggtatgtggtatcaacaaagctgggtttttgcctcactggtatcaaataaggcactgctgagtgttagttggagaagagccagaagcttatgactggctgggatgagtggtagagaacaggccttccccacatatttaatctaacctctctagtttaaatatttccagtggatcatcatactctatgaccttgtgacataaatctgcacagagcggcagttcttatcttcagacttcagtcaagtttcattactgtggtttatgtgtagtggctttgttttggggcttccgcttatactgctgtctgcttgtttaccatctctttcaagcgaaagggtcttttgatttatgacttggtgggatccttttcagcattgatagagagatgtatgggttaatggttgaaaatacataggatttggttgttagagtatatctagagaaattgagctactttgagggaaatataatatcaaatctcacttgtactgataatttgtataatggaaatatactgccattaaatggataacacaaaaaaattgctaaatataattgtaagtaggcactttcctacctaggacatataagataaccacaaagccattttataatccattaaacactgctgatagaattatatcttctccaatgcatgccccctaaattgcctgtttcgatgcctgaagttttgccattaaggattattattattgtatttttgcatccctagaaattttctttgttggattgacagttcccttgagtttatgatttgttaagctgttccaacttattaagattgaattggccgggtgcggtggctcacgcctgtaatcccagcactttgggaggccgaggcgggcggatcacgaggtcaggagatccag

SEQ ID NO: 30561 - DNA, 1060 bp, Homo sapiens
gaggatccgtaaaggcattcatttgcataatttaattttctgcacagaagatattgaaaatcaatagcatgattcatagccataccatatcattgccacaccgcctttggttgtctgtctgagcttagaagagtacaaagagtattaaaattgattgaattttggtgtgctgactctgtatctttacttgggaaccacagactgtttctatttgcaaatcactgctccttgccaataaaatattaagttgcttaatatactctatatatactttttgactgctgttcaaataatagttttaaaagttggtttttaaaaaaaatcacagcatcgtcgattaaaatgcatttgaggagaggacttaaagtgttgtcttattttaaattatgtgagtgccagtaataatgataattagtcctcagacgcttttgttgtgcgaacatcatagagtgtacttaacaaacttagatggaatagccagcccactgcacacctagaccatatggtgtagcctaatgctgctaggctacaaacctgtacaatgtgttaccgtcctggatactgtaggtaattgtagcacagtggtaagtatctgtgtatctaaacatatccgaacacataaaaggtacagtaaaaaatactttattataatctcatgggaccagcatcatatatgcagtttttcattgactgaaattttatcatgtggcacattacttgattatgctcttacagataggggagggggagaggtcacacattactgacagagatggaacaaaagggaaaactaaatatagtcacctttaatgagtagtttatctagttaaaaaataaaatgtggtgctgaggttaaaagtcctgccctgttcatttctgaacaattgccttcctaaagaattgcttattggttactcagggccattttctttttgcttcatgtattaaatgcttgctgtttgtgataggtgggcagtggctagagagtcagtgaggttctgggtggtggttttgcctgtggcttatgtaaacaggtacataacatgcatagatacacaca

SEQ ID NO: 30562 - DNA, 1088 bp, Homo sapiens
ttttgagacagggtctcactctgttgcccaggctggagtggagtggcacaatcacggctcacttgagcctccctggctcacgctatcgtcccacctcagccagccaagtagctgggactacaggcgtgtgccaccacacactctaattttttttttttttttttttttttttttgagacagaatctcgctgtgtctcccaggctggagtgccgtggcgccatctcggctcactgcaagccccgcctcccaggttcacgccattctcctgcctcagctggggctacaggtgccgccacttcacccgtctaattttgtttttgtatttttagtagagacaggatttcaccgtgttagccaggatggcacacgcgctaatttttttattttttgtagagatagggtttcgccttgttacccaggctggcagagtttaaattttgtcaacagaattgattttttggtccccctggctttggttctaattttaaggtcctctgttaatcccttacttggtcctcaaccaccccccgaggcttccactttgtctaataccttcaggaaggaagaagaatctctctgactggccagtgtgcccatacctgaatgcatcactggggccacgagaatggttaaaagtgattgactggcttgaaccaaacaaggctcactcctagagctaacattggtggtggcgggttagctgtccaatgcgtgatacacagctagctggagtggggatatggttattacaaaacagatcctctacagcaaatttccactatgttgtcggacactaaaaagcactagggctgggtgcagtggctcacacctgccatcccaacactttgggaggaccaggtgagaagattgcatgagcccaggagtttaagatcagctacaaaaataaaaaatcagctgagcatagtggcatgcgctgatggtcccagctactcaagaggctaagttgggaggactgcttgaacccaggggttaaggttgcagtgaaccatgatcttgctactgcactccagcctgttcgacagagcaagaccctgtttcaaaaaaaaaacaaaaccaaaagcagtgt

SEQ ID NO: 30563 - DNA, 1050 bp, Homo sapiens
gatttggtgcatgtttttcaagtggacaagtggatacacggataaattaactcaagccagagtctgtccttgggaatttactaaggggagtcctgccatgaaattcagataaattagtgggtgatttgcaaaaggtttcactgttggatccctttaaataacaagctcccctggtgaacttaagatataattaaattcctaaaattacattttcatgtctatttttaagaatgtctgtacaggataaagcaaaatatacgtgcctgcagaattcagcttttgtcattagaagaatggaaggcactgtaggacctcaaatttaatgttaatattgttgtgttatttgcctctctcctaaagcctcctccaaaatctcttaagggaatcatttccttagagacattctcttcctaatagagacctccttcttcttcttctttttttttttcttttgagatggagtcttaccctgttgcccagatctcagctcactgcaacctccgcctgtcgccctgatctcagctcactgcaacctccgcctcctgggttcaagctattctcctgcctgcacctcctgagtgtctgggattacaggcatgtgccaccacgcccgactaatttttgtatttttagtagagttggggtttcgccctgttagcaaggctggtctcgaactcctgacctcaagtgatctgcctgtcttggcctcccaaagtgctggggttacaggcatgagccactgcgcccagccctaatagagaccttctgatcggaaggaaccacaccactgaggaggaatcagccttgagagtcttcctccatgtctcagctcaaaggctccctgtgccttggtgcttagcctgacccatttctgcctaaactcctcagtctcccctttatttatttttaaaattaatgtttatcttttctacatatccctattaatcttacagttttaaagtagaatttctttacttatttgtttaccacacttactaattgtctactgtgtgccaggtgttgtgctaaatgtgaagggccagagaagct

SEQ ID NO: 30564 - DNA, 1039 bp, Homo sapiens
ttacctgaacatccaccaaaatggaggaggttgaactacaggatgtattaaaataatatgggtaatatggtcccattaatgaataaagctgaagaatccagagactacacccaaaagttaattgcggttatcattgagaaatgagggatactaccttttaatacttatatttctataatattttaatattttatagaagcatatctagaatatttcaatttcttctaccagtagattcataattttttttaatgacctttttattttagagtagatggctaaatggtatcaaattcaggcagttttctttgtaacaattttgagggggagaaaaagaaaaaaacctaaaagggaagccagaaggaaagcaaaaacctttttgtctctttaattggctgtatctaaattttttaggtgaaacattgtcagtggcatttcatttttttataaaatgctgatatgaaccttgcagaaattaatgaactgatattgacttagtttgaaatgaacatcaagatttattgagcaaagcagtaaatattgacccagccaaagataaggtcaatatttactttgacatagcataaatcctaatattcattaatgtataaatttattgtgtcaacacaaggcatacagaagttgtatataaatatttttttcatatctgcgatgaatcagagtcaaacatcttttttcttggttataaatttaaaaggacaatgttctcttctttgaaactaccttctttggggagaggggtgtgcgcgtgggtggaaggacatgattaatttaaaggttcaaaggaaaaatatacctagctgaatacatgtgttataattagagcacagtgatttgcatgtgctctgtgatttacttaagggctaccagttttcctttctaacctaacaaaacgttctctttcattacatctgatttgattcataaagcccacccacttcttttttctttctttttttccattttttgagacaaggtctcactctgtcacccaggctgaagtgcctggtactgacta

SEQ ID NO: 30565 - DNA, 1755 bp, Homo sapiens
aactacttacgtagaattttgtttggtaaataacatattgttggtgtatatcatactttataatactttattggctgaaatttcccatgttgaaattatcttagtttattattattatttttgagccagagtttcactgtgttgcccaggctggagtgaagtggcacaatcttagttcactgcaacctctgcctcctgggttcaaacaattctcttgtctcagcctcctgagtagctgggactacaggcgtgcaccaccacgtctagctaatttttgtatattttagtagagacggggtttcaccatattggccaggctggtctcgaactcccgacctcaggtgatccgcccacctcagcctcccaaagtgccaccacgctcggcttcatgttgaaattatcaatttgagttgaactctcattctttatcttgtgccttctcttggtggggtggtcttggtagcagtaagaagaacgtaaggaggacccatttcactggattgtgaacttttagaattgccaatatgtagttggaataagtgtctaatatatgcttaaagactgaattttctcgctgttcatttaagcgaagaaagtaactcagtcacaagcttaagtataatcttgtccctatgcaatagtcttatatgatcctgttgtgctcagtccacctggcatgttctttgagtgtaaagtggtggtgttagtttcagtgtttggctgatcttgaaatgaccatcacttctctctctcagctggtaatctcctatgaccctgtttgagatcagctacctgaagggtggttatcttcttggttgtctttcttgctattaaaacttaactgtcctatgtttcgtttactttaaggcccattttctgttatgtaactgataacttgtgtaggttaaaaacttatcagtggtgtgtatataacatagaactttgccttcttgagaaatgctttctaataacttcaggaattctcacttttcattcatgtcactatagtatataataatgttttccactgcgtgtagtggctcacacctgtaatctcaacactttggaaggctgaggtgggaggatcacttgagccgaggagttcgagaccagcttgggaaacaaagtgaggacctgtctctacaaaaaaattaaaaaattagctgggcatggtagctcacgcctgtaagtcccagctactcggaaggctgaggtgggaggatcgcctgaacccagtcaaggctggagtgaaccctgatcacaccactgcattcccagcctgcgtggcagagtgagaccctgtctcaaaaataataataataagaatactaacaatgtattccttgagtgtagtattcattggcatttttatgtcatgtgaaaaatgactctatgactctcctgtgatacaaatatttgactttcacataataaagtcatttcttcttgaggttttttttttttaaatcaaggagaaagtgagttttgtactaataggtctttaacatctctctgtcacttgctcatacctctttttatcaagaagagataggactgacctcagtctgctgggagagtatcttagaatttgatctcgtggatttcattataccctggtacccttcatgtctggcaagccatgttagttttccgttttgatgtgttacatttcctattaagtcatatttgagattttataaaaagtgggccagtttaaagaaaaattttatctaagcagtagtacagctggctttc

SEQ ID NO: 30566 - DNA, 1033 bp, Homo sapiens
ttgcactccagcctgggcaacagagtgagactccgcctcaaaacaaagaaacaaacaaacaaacaaacaaaccgtcatcctgactggcatggcgtggtatctcactgtagttttgatttctgcaacccatttcttgaattgagttgatcttgagagtttccttggacacgggaagccacttaatccagatttcctatttctgttgatccacattcttccagcttgaaagcctttttctgggggaggaaaacaaccttcttcttaaagctgcatgaaattttgctgctcccaaaggcatcatttagtagctctgccccaattattgttggccacttttcctcctggaaactgtttttctctgtcccacccttccccctagttccaaatgttaggctgatgttcttctttttagcagagtgtgcatgccattagtacactgagtattgattggtcattgagagattttagcaggaaaatgaaatatgaagctcttcttggctgttggactagcacctgcaaagatgagcgaaggcatttttagtgtgtttctggctctggggctcactgtgataatgggaggtattttcttctcgctgttgataagtacatggtccacactctcctcttggggagtgattttgacactttttgatggtcctatggcttttacattcttataccatttcctaatgagttatcttttctctcaccatctactagggtgtgaaaagggagtttcaacactcaaggccaattgagctgcatacctgctgtgccagaaagaacgagttaagatttgcttctggctgggcatggcggctcatgcactttgggaggctgaggcgggtggatcacctgaggtcaatagttcgagaccagcctggccaacgtggtgaaacccgtctctactaaaaatacaaaaagtagccgggtgtagtggtgggtgcctgtaatcccagctacttgggaggctgaggcaggagagacgcttgaacccaggaggtggaggttgaagtgagccgagatcatgccc

SEQ ID NO: 30567 - DNA, 1046 bp, Homo sapiens
caggtagacctccctgttccttttggaggtcttgagaagttgacctagggtatattttctgagccttgtttttaccaaggttctgaatctttggagaaatacagtgagtggagcgtagaagtgaggaggcatgagggcatcctcataccagtcttcattcattgagtcattcagtaaaagtgtttatcaagcacaagccaggtggcaaactcagttcgagattagggctaactacaacagagaacaaaacatacacagttctattcctacctggtggaggtggacagagcagcatatacaaagtaacatgtagtatcatcacatcattctgtgaaataaagtgtaaagtgaggtggtgcctagagagggatttaggggagagagttgttattttagcctgggaagacctctctgatcaggtgatacttgagcagacatctgaacacagagggactgagccttgtggctatgtgaggtaagcattgcaggtagagggaagcgggggagataatagcacttggaaaggttcaatgttataccttaaactactctgtgaattttaattaggcctccttctagaaccttctggccctgtattcttgcttaggataaattttgcattgttctagagaagtagttctcaagtggggactctttcctttttgtggaatatctgacacagtctgcagacattttttggttgtgacaattggagatggttgggtggccaactggcatttagtgggtagaggaacaagatgctgttgaacatcctacaatgtacagaacagcccccacaataaagaattatctggacccaaatgccaatagtgccaagattgacgaaccctaaactgaaggctcaccagaatccatcgtttttacacagttggtctccatgctgctgtgaggttctacctttctagccagtccttaattgaatgagtacgtggcacaaacacagcaaggtgtgttgtgcacagtggctaaggtattagagaataaagtgagtgtcatggtgttcaatcatctttggagattaaaga

SEQ ID NO: 30568 - DNA, 1046 bp, Homo sapiens
agtgtagatagaccatatgttattcaaacatttccttcatgatggacattcactttgtatcaagctttttcacactaccaaagcactgcagtatctatcctcatgtgctggtgcgtttatttttgtaggagagatggtcaaaaatagggttgctagatcagagaatatgctgtaactttttcccgtgtccttcagtatggggattttcagatttgattatttctaccacaacgaatgggagaaatgagtggaactccataataatatagactgaaaataagtgaattgatcaacaatgaaggaattgcttttagaggcaacatttgaaaagcaagaaagacaagataacatttgaaacattagatgttggtttgctgaacttaaaacaaaacatgcaggtgtctatcttaggaaatatgtgtgttatcggctggtgtagggtagggtggtggtaggtttgcagaggggttgaatgtatgcaataaattatttggaagagtgtgttattgatgcagtcaggtggaaattgttcagaaaaaaagtgacaaagaccatacaatgatagttaattactaattagaaatttagaagatgaaattttaccaggtagaatatttgagaaataaaagtgatctgttgcttgagctgaagaggaagaggaaagataaacgcctaactacagaccattggtagcaatgtaataataataaaagattccaatttgatagaaagaagtggtgaaaactttcagggatgctgtggatttggaagatcgatacatgtggccaaaataaaagacttttgggattggacatggttattggataaataataatgtattgagcatttcttttgtgtaaaagtgttttaggttagtaatgtcttttaattcctcctatcagtcctaagaggagagtatgattactgctgttattatatagctgtgaaaattgaggttcataaagaacttgtccaaagctcactgctgtatcctgagatctcaaaaaagagcctaggatgctgtgtatgcttagggaaaaaaaatt

SEQ ID NO: 30569 - DNA, 1022 bp, Homo sapiens
cttgcctcaagcaatcctcctgcctcagcctcctaaaatactgggattacaggcatgagccagcacacccagctcagtttggttgagtattccatttgtaattcactttttaaaatatatttcaacatggcaagaccctgtctccactaaaaataaaaattagttggacatggtagcatgtgcctatagtcctagctaattgggaggctgcggtgggaggattgcttgagcccaggaggttgaggcagcaatgagctgtgtttgcaccactgcactccaacctgggtgacagagtgagacccgtgtcaaaagaaaaaagtgtatttattgattatctgcttcatgccaagcattcctaggaactaaaatacttaaagagtgttcattgtatttagggttgagtagatatagatgccagttcacacagtatcaccatgtgataactacaataatgcagaaatgcattggttgctataggaaccagctataatgtgtcctagggtgtggcttggtggacagggaagatgtctgtgtgtctgggtgatatgtgtgctgtggttgaggagggttgagatggtgtgtgctgcgggttgagattgacgttgagttggggtgggagtggggagctggcagcagcatgtttggtgcagtagagaaagtatgaacaaggggtggaagccaggactagcatagctcatgctgggtggagggccacagtgaggtcctaagccctggaaggaatgtgaaggcaggcactggagacagatgaacttgggttgcatatcggggccttgtcgtggagagccttcatgccaagttttggactctaaagtggagacatgacagggatctgtgcagtgattgactgagttaattggaggtgctagctggatgtactgttggaaaagttcatctggccattgggcatttgaacctgagcatgggatggggtcagaggtttgggattagcttagatgactgaaggaaaattatagagcaatatcccctgagaaacaccaata

SEQ ID NO: 30570 - DNA, 1121 bp, Homo sapiens
atatcgtctccagtggtgtctttttttcttgaagatggctcccgctatctcagacaaacttgtgagtttgtctgaggaaaataaaggatttgtagcagtattcaaaatgttcccagtttgacagtagctcccagttagagaggctcctgctgcttgtgtctacctgtcctcaaaggacacacggccaacttctttccttttcccagtttaaaagtgatttactcccatggttgagactggttttcagcatcaacgtgtgctgcatggcgtcttctaagtatcaaagcagagattcacttttcatttctgggtatttggaagatgatcaggtgcctaggactattagatgtataataaatatgtttcacttctcaaccagagtacacagggttacagagggaactaattttattgagttatcaaaatattaaaatttgtgattggcaatgcgtgaacattttattaacacattacaagatctactagcacgtataacaactatcataatattaaagttgtcatgaatgcctgtgacattttgagatacctgcagcaactgtaatgtgagtgatttctcacaatgacaaattctcaaatattgctaatagtactgtggattttcctacattggtaaattgaaggaattgctaaatgctgaattcagcaaccagtttgagattgttgaaaataaagattgtttctttttcaatgcaagttcacagatcactggagttctagctacagtttgttctagaccagaggttgcagatatttttgtcctataaagagacacatggttaatatttttggctttgtgagttgtatagttttcgttgtagctgttcagctctgctacatgaaagcaaccatagaccataccttaacaagtggtcacttttgagtaccaataaaactttatttagaaataacagagggctggatttggtcctagtttgctgaacccttttctagatgaaggctcctcttgccaagactggctccctaccttggctgacaaattctcactttgggacttagtcattgttgctgctctctgttattttgcatgtcttttctcatgtttaggtgctgtgtcttaatacttttttcttacatttaat

SEQ ID NO: 30571 - DNA, 1055 bp, Homo sapiens
taagcacagagtacttcgggaacaccatcttgtcttcatcactatcttgggcatctatttattacaaacttggaattgaacaaaaatgttttagtccagtggtttggattaaaatcaaagttcataacaaaactcagaccatgttctattttactgaaaacatcaatagtgagtgtactagagcttttggagttagaaaaagaaccatggaaagcagagttgctgctgatgtgttttgcttcttggctaagtttgtgtataagtttatagatgtatactttccctatgtatacacatgaggaagtactaaagcagaactttatagctatttactttacccttggtttcacaaatagcttcactgaaacattacaagagaaattctcagtctcagaatccctttcatttcagaaattctttgacttctgtgatttttttttttttttggtttggtaatttttcctgaaattcagttattcactttgtgatttaattatttcatctaggaaaatatgtcgaataagtcattcatctctgacataggtaggtacaaggattgatttgttgatacttttttgaatatcaataagattaaagtatatataaaatctgagtttttgatctgttgtatgttagcaaggatatttgtaattaaaatgaattatcagtcagcacctcctttttccttttactgtggttaaggtaaagatgtcggttaacagtttaaaacaatagtctaatcaatggttgccgtgttgctaaattattaatgaaacagggaagaagtatggtataatttttattatttgacttgacttctgcacctgtttttatgtataattgatcctaagctattagagctgaagctttgagaatagttttgagaagcaagaaactgtcctttcttagtgggctggaaaaacaaagtcagcatttatctcaggtatttacaatgtattgtttcttagatttgtcatttaggcttactcccacagagtctgggaaataagtttctgttgcaacggtttcttgaggcatgctgttccagcctttga

SEQ ID NO: 30572 - DNA, 1022 bp, Homo sapiens
tagaggccaaggatgctgctgaacattctacaatgcactggactgtccccacaaaagaatgttctgtcctgaattgttgatagtgccaaggttaagaaaccctcccataagggatgttttctaggcttaaacagtggcctgtatgtgtctttctccttatttctttatttcaagaaaagaaaaacgctgccaaagcaaaagccatgcagtatgttcataataaattaccttttaaaacaaatcccaggcctactcttcccgaaaatgggaaagacaaaaaaaaaaaaaaaaaaaaatcaaagtgccccatggcacaagttatccactgatgacatttccctctgaggactgttttctgggttagggtaattaccacaacccagaaggtcatggagtctaagttaaagggcgtcactgattcagctctcagatgagccaccccactgggatgtatgatggtataaactgcaattaaatcttgtgctgtatttactgtgtgattggaaggacagaagggagatttccctttagtcattcttacctagagcaaaactcatgtttttttagtgtaatgtgatttcttgagaatggtagatgttagtgaagtggggcagggagatggatttacaaatcttggagtttgcaaaatatgacttgaccttttgttcttatgttgtgggctgtgttttctattaagctctcgatcatattctctctttgccatttaagaaaaatacagcacaaacctctgtcagattttagtatatggtgacctaatttggtgggatgattgctaaagttctggaacaggccctttgtagctgatttttgttgaattgataagcatcgaatatactaaatataattttttgtgcctaggtctcttccaaaacttgcataccatttttagcctgaactcagtgttatcattttggtcttttaaagtggagggagggggagagggagaatccaattatagcaagcctgacttgattgaatgatcttagaatgaaccttgtggg

SEQ ID NO: 30573 - DNA, 1050 bp, Homo sapiens
agaaaataatatagttattctgtattaatatgaaggggaatagaaagacataaacttgaaacataaatgtggaccagataattaaggcatttgaatcctgaactaaggagcttagattttattcacttgacagttgagagccacggaagctttttgagcgggtgcacagctattgaagctctgtgctctcttgatttcaaggtgattaagcagaacagttttcccccagctcctgtatcagggaggcagagctttcccagaagtcccattgcatacttcacctcaggtgtgttcttggaattgtggccatgcccaccttatagctgcaatggggggctgggaaactgtttagcctgttgagcctctgtagctggaagtgggctgtgcctgcacagcctaaatggcttttggtctgtggccaggaagccagtgatacttgcaactgtgagcataatagcatgttggaggccaaagtgtactctacagggagtgcaggataaaataagaacaatacgactggtacagagaatagaggaaagggtagaggtttgtatgaaagctggcaaattcagttctagaccaaaaatgagtttagggtgcaggtaggatatccaggaagaagtgatgcatgggcaggagtaatttaggattagagtgcaggactgaaagtattgatcagtgaatcattgatttggaagatgacagtaaaaccctaagaatctgaggtaaggaaggatgagagaggaatggacaagaaccagataacaagcttaaaggaatgatttctttttaggtgccctgtataagcaacgacagtgcgaagggataccttatttagcattgtttaaacctctttatctgctccataggcatatgacctcaataaaggcagcagtgtgtttatgatgcagacccagctagaagacaagttcccaggtctggctacccacccctactcttggccacccaactcctacctcttttggacagatttctcttctcagctctgtctgtgtaatgcaattgtccctacaatggcctttgacagag

SEQ ID NO: 30574 - DNA, 1056 bp, Homo sapiens
gtctacattttgcagtattctcctcagcatagatttctccttttaatggctacttcttcagctttatgagtttaactttttcaataataaaaacagcacaaaacatattaatcatattagttatgatcagttctcatttgtctgctcttcttgttttctttttttttttgagaccgagtctggctctgttgcccaggctggagtgcagtggcgtgatcttggctcactgcaagctccgccgcctgggttcatgcccttctcctgcctcagcctcccctgtagctgggactacaggcgcctgccacctcgcctggctacttttttgtatttttagtagagacggggttttaccgtgttagccaggatggtctctatctcctgacctcgtgatccacccgcctcggcctcccaaagtgttgggattacaggcgtgagccaccgcgcactgccgtctgctcttcttaagttgacagaaaaggagttttacagtttttacatttcttaatcctttatgggaaatagtatttctttcgttttgcatgccagagaactgaggcttaaatgataagtaatgtgctgtgacttataaagctaataaaggaaggctaggatgaccctaagcatagaagacagaggcaaaagaagaggggaaatatgaaagttaaagagatataaacagtagagggtaaggggtcgtgaggtgagtgtatgaatagcagtatgagcgatgacaatactgaatatgataatgattgagaacatccgcccaagatgcatgctaagcgctttactagtattatatcactggatttcacagcacctttatgtggtagtcacagttattttctccattttacagatgagtaaacagagctgttagaatattatgtaatgtgcactgggcaggctctgccaagtgcgtgcagaagcataagctagcaatttaactgcctctcaaatgcatcatagtaatctatcttcctccttcatcatcagggattaagtaactgcaccatggacaatgtaagtaacttgcctaagtaattagtttcagtc

SEQ ID NO: 30575 - DNA, 1033 bp, Homo sapiens
tatttttagctctccatctccaggcgtatggtagccttacttatcccgccctcttctaagttgagcatgactctcaaactcaatcaggcaactagaatgagaatatcgatatgaatgaggatatagacgtttgttgcctttagttggaatctttcagagtaagggcatgctttgctgtgttcttctatcctctatagtcagggaagtgtgaaggtggagctaccctctcagcctgggtaccccagtaagggagatgttgggcctagtcccctaagtggtgcatttgcagcatgagcaagaaaacatcttgctgttgtaagattctatttggaggactggtttgcggcataacgtagttcacccagagaagtatgtggtaaatatagggctttgatttttagtctttcatgtaatcagatgcactttcggagaagggtttcaatctcacttccaacctttgtataccttgttcctaatcacaccccatcatactataggaaaggtggaaggtggacagaatctgggatcccagcctcactcatggatccaaggtcagaaatcatctcatgtctttctgccagtgaatgtccttctcgtgacctcatgatattttgtgacatccctgatctgtccttcagtccatggaaatgcccctggctgtagtcatatttctctgtctatctaaccatgtgtctatctatattttcatatttatctggttggaagcatatatatatatctttcaaatactgggaaggcccaatattttgcctcattaggttatacatacatgataaacagcatgatatacattttaatatcaagtagataaaatacaagcttttctaagctataggtcatcactggtgaccctatcctgatacagttactttagagatctaaagagattagatattatattttcttattatatagtaccttaaatatgtctataacagataataaaatagtgcattagctcatatatactacctaaagagagacacttaatcttactgtatttatttggaaa

SEQ ID NO: 30576 - DNA, 1028 bp, Homo sapiens
cattcattctgttgaggacagcatccatctggtatcttcttactttgttaattcagttattctatctacaattgtttctcacattgatgacttaggaatttcaggaatggatgagttaggaaaatgccaatgaccatggaaatagagaaaaaggtataccaaattttgggtgctttttgagttttctgtcttatgggtaaatgatatttttgtgcctttttctccattgcaaaaaggaaatagtttttcataagaattgctggttcaaactgtatatagataaacacacacataggatagatattgatgggtggtaaaagttttctaattggttcagatgagaagatttaaaaattacttaaaagagaataaacaacatcttgtctataactattctaggtggtttgtttttctaaaaataatgtaatattttaaaaatgtttctagatgatttcatttatacatggatttatacatttgtatcttataaatatcccagaaagagtcaatcaaaaaattatatctgccaaaataagtgtaatcatgttgttcagcctaacaagaagggggtgctttgcatgcacaattccatgcaaatgaattcacatttccatttagctgtaatgggcacattctccccacagctgtgcttttcgttgtgacatggagatagaagctccactttcaaaattattggatttggaaatggagttagaatattgaatttggtgcctaaaataataactatctctttttaaaaacattattatatgctcaaaaccccttccctggactaagtcatttaattctcataaccctatgagataggtactgtgatcatcttcagaacagagttttggagcatagagagtgggtaagcatctggggcagggtcatacaactgggaagaaactgacctggacttgaacccaggctttctggctttggaactagctctgttaagtgctgtgtgtacagccttcagggtatcaggtccttatctgacattatctcaccctcttccccca

SEQ ID NO: 30577 - DNA, 1035 bp, Homo sapiens
ccctgcctcccagaacctgcggccctcctccatggccaaggagcaattgcatgtggagccataccagcagcccccattgagctgacttggttgcctgaagtgagaatggttaaatgggtaattgatggaagcaaaaagccaagggaaggaggtacccgctgggtaactggttagtgtaagaggctatgtgtgtgtagctgaagttgatcaccattccaaggcgagtcttttcccctctcttctttccctcctttttatttaacaataataataactttattgattcattgctttttttgaggcatgcattaagcccttcacatttattaacttgaaaaaataggggagttgagggcccagaaaggtaaaatgaagtacccaaagtcacacattttagtgagtggcaaaaatgggatctcagggcatggttcctatctcttgacaatctaagctcttcaccctgtacctcttttccatctctgcagccctctctccctctcttctttatagatactctgagcgtttatcttgcatccagttagcaatgcagtttcagagatagaggacataggacgtcccttacggaactcaaaattgagtttgcagagacaaccttaacctttgtaaggtgagggaagcctagagtctcatgtggtgtgtggggcccagggatgcgtttgtaaagcttgggtgcagtggtctttcttccacagggagtctgagaccttggtctgcttacctttctctagggcacccagggcatgagaaggtggtggtgttccttataaccttggccatccagtagataaagttcaacaagtaggattggttcagtctgatacctgtagtcccctattttacataagcccctccccacattctcccttaaacacatgaagaagtgcagaggagaagggagagggcatgtcttgagacccagttatgtgaaggctgtggattgagagtttacagtgttagtgatctcttgtcatcctcacaacagctctatgcagtggaccctgttagatcttatat

SEQ ID NO: 30578 - DNA, 1044 bp, Homo sapiens
attttctatttctgttctaggaaaatgggttgttttttttgtttgtttgtttgttgtttttgagaggggctcttcctctgtcgcccaggctggagtgcagtggtgcaatctaggctcactgcaagctccacctcccgggttcacgccattttcctgcctcagcctcccgagtagctgggactggcccctgccactatgcgcggctaatttttttgtatttttagtagagacggggtttcaccgtgttagccaggatggtctcgatctcctgaccttgcgatccgcccgccttggcctctcaaagtgctgggattacacgcttgagccacagtacccagccaaaaaaaggtattttcttacataacaaaagtatagttatctgaattgaggagttcagtgttggtatgattttattctctcaatccttattctaagtttcaatctcagcctttgtctctttgttcctattataggagatttcttcccaagccagatcatacattgcattttgttgtcatgtctttttagtctctcttaatctggaactgttcctgagtctgtctttgaatcttatgaaattgacattttgaagagtatatggcagttattttgcagaatgtctctcaaattaggtttccctgatacttctttgtgatttgatttgggtcatgcaggaataattattagtgatattgtgtttttctcagtgcatatcaggaggcagtggatgccagtttataaaatttctcaactgtaaagctaataatgttttctcaagttaaagtgacttgtaagatgatactttgaatctgtgtaaataccatatttttcatcgaacctttacccattaacttgaatatactttgataattgttgctattactattatggttgccaagtggtggttttctaactctgtgatttctatatatgtatttctgtacctttgttgtcattctactggaaagaagcactttatttcctcctctagttatttattcgtttgactttatcattggggctcatgtattcttgccttattcg

SEQ ID NO: 30579 - DNA, 1004 bp, Homo sapiens
cagaaaattcaaagatcagctactgagaattttagatttcctgttgtaagaggtcaaacaaatggtacaagttacataagcgtttcttcgatgataaaggagctgttttctctagataggtgtacccttttcagctagctaatatgaatctgtgtcaacacaggttttaattttttaatttttatgtattcattttttgagatagggtctcactctgtttcccaggttagagtgcaatgctgtgatcatggctcactgcagccttaacttcttggggccaagcaatcctcccacgtcagtcccccagttagccaggaccacaggtgcaccaccacacctgactaatttttaaaaatttttttgtagcaatacagtctcactgtgtttcctaggctcgtcttgagctcctgggctcaagcagttctcttgcctcagcctcccaaaatgctcaagcagttatcttgcctcagcctcccaaaatgctgggtttacagttatgagccatggcatctgacctcaactgaagttttaaaatctgtaggactatacagtttaaacctcaagggtagcaaagtaataatataaaaactacaatacatgaggtttgttagagaaatcgaattgctaatattgctgccatggtatttgtatacaataatataccaagtgagatttttatcgctgataaatattaaagtctgttccaaaatcatttaaacacttttttaaaatttggacatcaggttcagagagtttagtgatcatactcttcatggcatactgtcctccttggtttgtgaaggggctccttgtggtttgttttgctttacttcatttttctctttcactcatattccattcttttttccccaaagatgctgattagtagtatttttaattcacttatttttgtgtgatatatctcattatgctgttatgcattttaaatcaatgccaattttcaaagtctgttcacatgccttacgtacctcttcattgctttt

SEQ ID NO: 30580 - DNA, 1044 bp, Homo sapiens
tacgtgacatgactgtccccctagaaaggtattgctcattaatcttgtctttatgaataactagtcatacaatttgtgagttatttggagccaacatgcaaggtaaatcttacttgttagccttgaactagaactcaagttgccagtcaccttgcccagtgctctttgtactctgttgtatgacctttttaatccttggatgattgtttctattatgtctcgatggaaagtcaggattctaaaagaacatattagtcaaaatgttgactatttgggggtgtacctaactttaaggttgaaaacttcaggtctggaacgaactcatctccattttataaacacttaagatgtttggcattggctagtaagaattgtgataactttgttagtatctcagatacttgttgaagccagtttcctgttgtatctatgagaagcaggaataaagctggtacaactttaagtcagcctagttaggtttggggtgaataaatgatcccaattattggtagaaatttttaatgaatgtttggatgtggggtggattcaacttgaaagatataacttttaaatcccagatacacctaaacatgcataggtcaaagacttttaagtctttaaaggaccttcagaatcttgcagtgtgtggatggcatgcatattcatggtttgcactctaataatgtcatattatacacccatgcgggcatcactaatcagtcaactccttttgagcctttactcagcctagaggtctgtggctcagaactaaaaggtagccattattgccatctttactctttttaataccctccttttccagaacagtaaaacaggctccagagaagctttttaccatcaggattagagtctgggacctccagtttaggcattggtactgaatgaaattttacctgaaatagttttaacatccagtcctaaaatagacaccctgggaaattagacagataatggtattaaaaaatgaacaaagtagttagtttctatttctggtgttattgtctgatattacttctggtatta

SEQ ID NO: 30581 - DNA, 1052 bp, Homo sapiens
ttaaaaagaaaaatcttgctctctagatgattttgaccatcaagcagttttaggagacactgattcagagcgactttttctgtcattgtttccatttttttttttaaatctgttaaatggataagtaattctgagatcattctctggaaagtatcatgatttagggccaactggtgctctgagagcattctgcagctagaatgaactaatttattcaggcgggtgtgttcaacatattttttcataggtacatgaggacataattcatatcatggtaatggtgaactttattagaagtaacagaaaaactccatttggttttgaaactcactttgttttcctctcttctcatttgtttcacacagtcgccatccttctgaaagacgactattttgtcagtggagctggtctacctggcagattcaaagctgagaaggtggaatttcactggggccacagcaatggctcagcgggctctgaacacagcatcaatggcaggaggtttcctgttgaggtgagagaaagtcaagatctcaacgtgtagctgtgcttcggtctttatgttaatcagatgctgtgcccttaccctcagtcattttgcaaatcacagctgtacagtacctaacttcctctctctggaaaccctttatccatagtatggcaggtgggtatccatccttgtttctcacctttgtttaactggagaaacacagaagccacaggcatcatggtttgagtagactcactactggttgatgatgttcatcatgtgtttcatttgacacagtttcttttcactgtctgttcccatttttgaaaggtgacattttgtacgaaactgggttgacttcattttcacccttaagaaaatagaaaagttggcaacatgaagaggagtctctctcagaaccttctcttggtagcaaagttttaagttttttttgctctcactggctgttgaaaaagaggctgtggtggtatgagtcactgttaattttgttaggattgatggtgacattttgcttctgctgtgtcagtcttctcagtgatcc

SEQ ID NO: 30582 - DNA, 1031 bp, Homo sapiens
gtattgtatgcagtattcaggatttttgctaaacgtgtggattatctctgctcttgcagcagggcttgggtagctatgggaaatgatgggtatattaatatgtttcactataatcatcattttactatctagattatgtacctcataatgttgtataccttaaaataaaatttgttttaaaaatacacatatagtagttcagttttatattggaatctgatttatttattgaaaaggcttcacttagatgctgtacaggtttttttttttcttcttctttataagctttaacttttttcctcttattcttttttgcaacatttgttcctggagctttgaacactattcttctcagaatccacttccaagctcgggaactcaaataaagctggctggggagacctttgtgcactgaaggtagagacttcaggccgccagatcagatgtattgtaagttcaggtcaagaggatttatgggcctgtgtatcagcaacaccaccaactgcctttttctcttgtcctgtcaaaatttgagcgggaaggtttcaagccatcttaaatctaaagcctttagcaagttctttagtgccaccgtcactcagaagggacagtcagaaagatttataaggaatagaagggagtcaagtttgaaagaaagtctatttcctctcttccctttaaatccctggcatagaatttcattgcaccccccctttaatggaatgggaagaaagtttcaaaagcttctcagtccggattgtttggcctggcgctgtattgagcacggatactgctctggatacgtttactgtgatggatggagaccagctgggcaaatttaccaaaaccctatcttatttaaaaatataaatttcatctcttgagtgttggaggatgtcttagcaagacagggtactttaaaactcaggttagtatgtggaagatatttaggttaatagtaaaataacttctaaatcccagctattaccacacagatagagcttcaactcctgaatctccctattaaaacc

SEQ ID NO: 30583 - DNA, 1078 bp, Homo sapiens
ttggggtgtgggagtgggtgttcagtgcacttccacaattcctgattactgcacaggtctcttctatacattgactgttcatcgtattttataaagagctttctttttttcctatataaccaaagcattgaaaatattaggctattaacataccaagaaatgcaatcaatcagctgattatcatctaatgttttaatgatcacatttttaatccaattatccatgtttgaatctttcagattttctttaattaaaaattgcctccttgcactgctatcagaagtaagaaattgaacagaatcagccagatataatttaatgttgaaaggaaactgcaaggataactgggccgcgctgggcttaatggttgaccatgacttgaaagcccttatacaaaatttcctaattgataagaaaaatttaatcatcttcagatataaaccctttgcattcaaataaggtatttctttttccaaataaatctcccctaactggttattcatattgtcattcaaaatgcttaaaaatgaaagaaagcgttgggtgaaatgtagactacttaatacagtgtgtatttaatataaaagtcatacattattcatttttgcaatttgaataactttgaatttagcatcgctgttcctcatctttttctttgatgaacaattaattattaaaatataatattgtctgcatacagcacccgggatccttgaaggtggaatacgagatgcatttcttttcaattcttttatctagtaatgcacagtacctgcttattatggtataatggaatgaatggtggtataaatagtttttcaaatatttttctcaactagtaagtggctgggacaggaatgttttgaattcaaatgactaattatgataaaagttggaggcagaatgcactgatcaggatgggcatggagtcacactgcccttttatagcaagacttatttaacaagcactatgcatgcttactgtgtcaagcgctctcctaagctctcacctgatgttaactcatttgagtcatactcagaacctccttgtaatgtcagtgttattatcccattttac

SEQ ID NO: 30584 - DNA, 1045 bp, Homo sapiens
aggagccggacaacacatggagatggttgcaggcaacatattcatgatcagtcatagaagatgattagctttcagtccagttaactaggatttgttttcttctagaatagtgcttctcagatgatggttctttgcccataggcaactaacccaacccttcctttccaggactgtttgcatcttgtaggttaaaataaggcactacctatgattttccccagcttgaattttacttaagtgcttgtagggggtgctatcaaaaaggcaataaataagtctgactgcatctactttgtttacctttagatgtgtgattttttttttttttttttttttttctgacagtaagctggagtggacagaaaaggtttaattgcatgaccctttttaaccaaaggtatctgtgagaaacagtagagcagctctttgaaattaagactgtgtgctttggaggcaaactgcctgggttccatttatggctttgttcttcggccaaattactcaagtactctactatttggtgcctcggttttctcctctgtaacatcatgatgataatactcccctcatggagtcacaataaagattaaatggtggaatatgtataaaatgcttagactagaatatgtataaagtgcacatcacaggaagtgctttggagatattaggcgttgttgttgttgttggttttgttgttgttgcaggtattaaatgatcaccagcctttaaagcaggactgtctggtagaagtaaaatcacatcatttaaaatgttgtagtaatcatgttaaaaaatgtaaagagaaacaagtgagattaattttagtagtataatttatttaatcaaatgtatccacaatattatcactgcaaatgtagggctagccatatttctaatggaatagccacgtgtggctactggctgtcacagctgtaaggtttatctcaaggccacgacaactggtgagtcacttaattcagaacgtttctatttcaacacatgacgtgcagtgcatgtgaatgaaggaggttttttaatgatgggg

SEQ ID NO: 30585 - DNA, 1073 bp, Homo sapiens
ccttcacttcttgggttaaagtgatcttccaccttagcctcctgagtagctgggactataggtgtgcgccaccacacctggctaatttttgtgtttttttctagagccggggtttcaccatgttgtccaggttgctctcgaactcctggcctcgagcgatccacccaccatggcctcccaaagtgttaggattacaggcgtgagccaccacgcctgtccttgaagccggatctttaagggggctggggtgggggctggccagagatgcgtccatgaagaggaagatggcaagccatgaggctgacgatgtggaaggggaacatgtcacacaggacctgtggaccacgggaaagactaaggctgttactccatatacaaccaactttctgttcattcagcaagtattgattgagagcccactacgtgccaggcactgtcttagatgcaaggtaatgaaccagacaagacagaaaaggcgccagccttgtggagcttccacctagtgggggagatagataattacagatcgtcaatgaagtcaataatacaactccacgtactagtaagtgctgggaagaatctaagctctgtgaaggagcaggcctgtcagcctgtgcagaggggcagaattcagtgccaagaatacagtgcagttgataattgtgtttcaaaaaaaggcttggcctctccttactgtcgcaatctgggatcagcactgatccacgggccgaaacttactccccaccaccttttgtgtaaccatgagctaagaatggtttctatatttttaaacagttggagaaaaatcaaaagaatattttgcaacacatgaaaatcctatgaaattgaacttgtgtccatagatatttctgctggagcacagccacactcattcatgtttacatactatctgtgctgctttgtgcttcaaaggtggaatcagtagtggttacgagagaccatgtggcctgcaaagccgaaaatatttactatctggccctttacagaaaaaatgtttgccatcctctattctaggccctcctagtactctgcaaatgcctcctccaaatttg

SEQ ID NO: 30586 - DNA, 1023 bp, Homo sapiens
ccatatgatttagcagttctacttctgggtatacacttgacccttgaaaaacagtcttgaactgcttatatccacttatacacgagttttcttctgtctctgctacccctgagagagcaagaccaaccccttttcattctcccctcatcaacctactgaaagatgatgagaatgaagacctttatgatgacccacttccacttaatgaatagtaaatataaatatgttttcttccttaggattttctttataacatttttttctagcttactttattgtaagaatatagcatataatacaaataatatacaaatatgtgttaactatttatgttattggtgaggcttccggtcatcagtaggctattagcaggaaagcttttggagactcaaaagttatacatgaatttctgactattcagggattagcacccctaatgcctatgttgttggtgggttaactgtatgcccaaaggattgaaagcaggatctcaaagaggtatttgtagacccatgttcatggcaacattattgacaatagccaagaggtggaagcaacccaagtgttcatcaatgagtgaatggataaacaaaatgtggcatatagtacatacaatgaaataactgtttagcctgtaaaaggaacgaaatcctctcacatgctacaacatggatgaaccctgaggacattatgctaagtgcaatgagccagtcacaaaaagacaagtaatacatgattccacctatatctagcatagtcaaactcaaagaaacaaagtagaatggtggttgccagaggctgatgaaaggggaaatggggagttgtttaatggatatagagtttctgttttgcaagatgaaaaagttctggagatcagttgcgcatcagttgcacaacaatgtgaataactaaacatcactgaatgggacacttagaaatggttaagatggtaaattttgtgttatgtgtttttccactatttttttttaaagcagccaccttaattcacagatgtgggaggtt

SEQ ID NO: 30587 - DNA, 1029 bp, Homo sapiens
gcaagatcagaaagaaacactactgtgtctagagactgtaacacgggcctatagtcacatagcctggatttggagccacactccaccacactgtttatctgtgcagctgtggagcatgtgttcctaccagcagtgctgtcatctctaaggtgtgaatttgttttggggagatttttataaacttattttgtgtataaagcacagatttacatatacataaatagcattgtgcattcgtggtattaaaattggcactgggcaattgggggggcggagtctaaaagggcccctcagaggaggtgccaatgaaaaacaggttgagaaacactgctttagacaaagacttctccaccaacttcggtttcctcatctgcaaaatatagttaagaaatgggccacaagttcacgtgaggattcggtgcaagctatggaaaatgcttgtcctggtgcctggcacatggtgaatgtgaggtagtgttataccagatctgactttagggaaaaatggaaaatgtaactctgggtcctggtatgcctcaaatgaagtttttttttaataaggaaaatcaaatgtacagagctaaatgaattttgtcctttaaatgtcatcacattgtatagctgtacagagtttccaatatgtccattgcatacaacatgcttgaaaataacttttggaatttctttctagagttcattcttttgaaggatctcagttgtgcaaagtatttatcctagaaatagataaaactcatctgtttagagctaaatatagcataaatgtaggttaaccaactgagcagaaccactttgggccaaaaaaggaaaggggtgactataatgttaatgaaattggtttgggtgatgctcctaataggccttaaagtcaattccagaggaggacatccctaaataactgggttaaagacatgaccccactcccacccgcaaccccaggaaacaactctgaagcccagtggccagcctcattaattccaggttggctgtattagagtaagcttcattgat

SEQ ID NO: 30588 - DNA, 1065 bp, Homo sapiens
atgtcagtagtgctcaggttgagaagccctgctttagaggatagtattctctggttatcttcattaaccagatattaaccagatattggttatcttcattaaccaataatgattgttcattaacaatcagcactgagaattggttccaagctaacagagatcaaaaggacatgaagaaggtataggtcttgactataataaattcaaatgattttttttttagtttttttagataacatttatgctattgctgtttctctagtgtgtttttcacaattaccattttaattggtatttccaccttatgtgaaatcactaaactgttctttggctcaaactgtcttcctcttgtttttcaggaacaataccagttcatctataaagcaatgcttagcttggtcagcactaaagaaaatggaaatggtcccatgacagtagacaaaaatggtgctgttcttattgcagatgaatcagaccctgctgagagcatggagtccctagtgtgactggaatcctgaaagggcacttaatttgtaaacttctgaagactgagaacttttttgaggccttttttgccagactctaggttatacaataacccagttacttttttacactgataaaagttttgatatttattttttgccattttatgtcttaatggtatcctactgagcatttgcacctctgttcatttcacacagtgaaacgcaattttacctagtttgcactatatgatcagtgttactgcctataatcttatacaacagcaaaccctgatgtgacattccatgacgacatacatgctacttttttttagttcaatacagtgaaggtctttgttatgacagtgaatattgcttttattattattattgctgaagtggttgcattctactagcaggcaatgctgtacttttcttcagtcctcctctcctttttattttaggcactgttcaatactgtatgccttctgtattttaatggagtggatagcattgttttcttttacagactagcaggctactgggacctaaaaaggtctgttaatgtcatggccttgaa

SEQ ID NO: 30589 - DNA, 1035 bp, Homo sapiens
aacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccaggtttgttattttattcagccataccgttgttttccaattttcctgtcccccaagtagatcttgcatcttcatatccgggatgaagaagttgtgtaggataaacttggttgtttcactttccttactaaatttaggtacattctccctgttttcccccagttctttcaaagaggagaagttgcagatgcaaatgtattaaagtgaagtgtgtttaacctctagcaagaaatatgtacaattttagtcatattatgtgagaccagtgacttcaataataccattacagtgctctcaagaattagtgctcaagaacttgacttttgtcacaaagacaaaaattactttacatgaagattctgagatgtgacttgctctcccctaaggtatgaagtttccgactttgaaaaaatactgacctaaacgctggctgtaggtgggcatcatcagaccctgttcatttccttggttttaggagacagggcactctaagagaagaattgttttaaatcttaagtactacagattgtaaactgaaattgtcaattgattggggttcacaataccaagttgcattttggtggggatagttattgtttagaaagtaattgtcggccgggcgcggtggctcacgcctgtaatcccagcactttgggaggccgaggcgggaggatcacgaggtcaagagatcgagaccatcccggctaaaacggtgaaaccccgtctctactaaaaaaaaatacaaaaaattagccgggcgtagtggcgggcgcctgtagtcccagctacttgggaggctgaggcaggagaatggcgtgaacccg

SEQ ID NO: 30590 - DNA, 1030 bp, Homo sapiens
cggcatgttccatgatgcctggctaagttttttatttttatttttgtagagacatgatctcactatgttgcccaggctggtctcaaactgctgggctcaagcgatcctcccgcctcagcctcccaaagtgctgggattatgggtttgagccactgtgtccagcctgaaagttcttgactcaagtggtgggaaacacataatttgagcctttatgaactctaaaatctattttgtcagctacatgattttacttgcaattgcattgacacagatctattcattgaacatttaagaattgtcttttcatcatatcgtatatctcatatatatgagagaacatcttttagtaaactttacaagtggtcttctttttacatattaacatgttgatgaatgttaaagtagcaaagactcaagcccttaccatactaatgtttcttcttttcaagacagatctttatgggcagaaacacagaaatggaagtagcagattttaagaaaactgattcagactttgaacttgtatgaccttatatttattgatttatttgagtcataagatttctgggtttttttttttttgagaatatgaaagactagttaagaaaatttgtgtgtttatttgatatttgctttctgaaaatataaaaaattatgagagagctagctatatatggtctttattctgggtctgtgaaataatgtaaggaattttgtactatgcttttagagcaagagttatcctgggggtctgtgaccctccaagggttggtttcaagggattcctgaactccctgtagttgtgaccagaactttttgtgtatgtgtatttttctggaagagggtctgtagttgttttagaaaagagatccaggacttaaaaaaattagagacacatctttttattgaataaaatggaagttagaattcttttcttttctttcttcttttttcctttttcttttgaaacagggtctcactttgttgcccagtctggaatgcaattgcatgaaactggctcactgcatcc

SEQ ID NO: 30591 - DNA, 1032 bp, Homo sapiens
actgaacagaaaggcatttttagtgttctggctcatagctcctcttagctgctctaagaggagatatttaaggctcaattctctgtgtcctccactccgtaccctgtttattattattgtggtagttataactataaatcatttgcagatcgaagttagaaaagagaccatttgtcattacattaagacagtttaaaggaatcgcttgttcaaatttactagcttcctgaagctagtaaagatgtttatggtttccaagattccctgttaatatatttcaacactacaagacagtgaataacacatgttcagctattatagattatgaggaaagctagctcctagaaaagatttttcagtactataaatggcactaaactgaaaaatcagttgtcataataaacagcggtcctgatctgagagtaggcaggtttcttggtgtgtctgtgcttttagctaatggccagcaatgagtagctctcttttccataaatctggtatcaagtattaatcagctgtagactggaaagtttttatttgctagcatttgtagtggaggaaacaccagtctgttttatctgtctcttagccatataactgcatatgatatcatctgcatggcgttcttacagagagaaatagttgtattctttttcatttgtagtcggagtacttcagaatattaaaatagtgaactttgaccttgaagcatctaaattgtctcagttaagattgtgatgtataccagaaaaaatttacaccttaaattcaatttagcattcttgttttgcacattttgaatggtttttttaatttaagagcaaagtccatagaatgattgtactattgaaaaatcttaaatctcaaaagctaagaaaggtaatttagattttaagtttcaagaattacataaatttgggtcttaaggaaaaactgaaattcctgaatgcttacagaggtttttgtttaattttttttcgtgattacagaaatcataagtgtttgtagaaaactcagaaaattccacagata

SEQ ID NO: 30592 - DNA, 1044 bp, Homo sapiens
cctcagcatcacctcgtgcttgttgaacattaatgcacatgtaaggagcagtcaggtgatttggttacagatcgcccacacttaagaaacacctccatagatgagaatcagcgtggccgtgacagtgggcattgtccttgctgacagctcctgtgcgtgtctccttccttgtaagctcttcactaacgcgtaggtgcaggaacccccagagacccagaaagaccctcctgtagcagggacttttccccagttgcagcgtgtgggccaaatcttgcctgcatggtttttgcattgcattggttggaataaaaactcaaaagatttcatgacatgtgaaaattatatgagacttcagtgtcagtgtccataactaaattttattgaaacgtagtgacgggcattcatttacttgtctgtggctgcttgctgcatacagtgaacagcagagttgactacacacaacagagaccatatgacccaccaatcccaaaacacttactattggttctttacaggaaaagtttgctgaccactgttctgatgaattccttggttgataaaaggaaacccaatctgcagaatcgcagaatacagtcttattattcttgaactgtctattttgaaggggagaatcttcaaaataataaaatccgttagtcttaaaccaagagttcattcaatattaaagaaacatgttgagttagaaggaaataatggagagtagaaatggtttcacataagaaggttgctgtctttgtccacttttatcattcactatctttttttttaattattatactttaagttttagggtacatgtgcacaatgtgcaggtttgttacatatgtatacatgcgccatgttggtgtgctgcacccattaactcgtcatttagcattaggtatatctcctaatgctatccctcccccctccccccaccccacaacagtcccaggtgtgtgacttttttatggcatacacctggttgggagcagttcacatacagagcacgaatagcgctgttattgccccagcttccaagag

SEQ ID NO: 30593 - DNA, 1034 bp, Homo sapiens
gacagatgtggtgttgcaatgaacaaaagaaggaatggtattcttaactgagtcatgagattataatcataaccacaataataataatagtaacaaaataaacactgttctttatcgagcccttatgtgtacactctgcttactgtgtttagacagatatagaccgcaactttttacatgaattatctcattccgtccaacagtccattaaagttgatactatcattttcaaatgtagaaactgtatgcctagatgtgcctagaggttaagtacattgctggagattacaaaaccaagctaagtggtagactcttagagcccgtatcctactctagactacatgcttgtccaaatggtagggatgcagacaagatttataaggtttttggtaggcacttccagatttgggacacatggcattgaaagcttgttttctgacttgagaggtcaggatttgctgacagtattttgaggagtagcttaaggaacccgtgagacaaacctgtcgtgtgtactgccatgttggtcactgttgtagccccacctgccattcctaacgcaggttcctcaggattttgatatttgcctactctattctatccccagcattttatctcaatttcagtacaagcaatgacaatgtaaacactgtaactcttacctgttaggggtcactattgataatattggccatttgtaattagtgagtaattaatattaggaatattttcatctttctagctccttggtcgtctggtgcaggggtccccagtctctgggcagtggaccagcaccagtctgtcagtggcctgttagcagtcaggctatggggtggggggtttgggagagagagaggaatgagcattaccgcctgaactctgcctcttgtcagatcagcggtggcattagattctcacagcagtgtgaaccctattgtgaactgcacgtgcaaggtatctaggttgtgtgctcctagaatctaactaatgtctgattatatgcggtggaacagtttcatcctgaaaccattctc

SEQ ID NO: 30594 - DNA, 1003 bp, Homo sapiens
ttccttgctaaaagttgtaggttgcccttggcttgcagtattggccctctgctgctggagccccagcatgcctcccctacctctcccttgcatggccttcagggaggagtgtgtggccagcagtaggagcacaagaccacttgagagttaagctcacattgtgaaatagtcagttgctaattggtgtatatagttgttcccccgtatctgcgggggatactttccaagatccccagtagatgcctgaaactgagggtagtactgaatcctatatatactgttttttcctgtacatacataactatgttaaagcttaacttataagtcagacacagaagagattcacaacaataattaataataaaataataataattataacagtatgccagcatttttattcttgtgctttggggccattattaagtaataagtattacttgaacacaagtactacaatagcaggagttgatctgataactactaagtgactaatggacaggtagtgtagacagtgtagatatactggacaaagggatgatacatgtcctgggcaggatggagtgggatggtgcgagatttcatcctgctgttcggaatggcttgcagtttaaaacttagaagttatttctggaattttcattttaatattttcagaccacaggtaactcacacctcagaaagcaaaaccatgaataagcggggattactgtagaccagacttctgttaattagtaagagccggggaccttgagacaaacatttctaatgtggatcaattttgtgagttatgtttttttttgttttttgttagtttttggtttttgttttttgtttgtttgtttgtttgagacagaatcttgctctgtcacccaggctgaagtgcagtggcgcagtctcagctcactgcaacctttgcctcccaggttcaagcaatcctcctgcctcagcttcccaggtagctgcaattacaagtgtaaaccaccacacccaactaattttt

SEQ ID NO: 30595 - DNA, 1014 bp, Homo sapiens
tctgtagtcttaatttttttcttagggaaaaagaaatatgaccatgtccccagacctagacaattaacgtctgagccatcattgggatatttaatatcaaaataaactttatttggataggatatcgagaaacggtttgaagaaaattgtgataatgctttacaagcagaacaaagcagtatttgcttaaacattttattcagggcattaagggggcacatgtgagtgtttaaaattttaatctgagctttgttctcaatttctgtgtatgtgtacaaaattaatattttcctggcatacacgaccattcatcccttttctgatgtaggtcttaaaaataagttaaaattcgtttttctcttgtttatttgtgaacttaaatatagacgtttgtttgtagcatttaagaacatttgctaaaattcaccctggttttttacagggttgcagaacgacttgattcttagaactgtcttggattggctgactctcataacgatatttttccccactgtatttcgtacaatcactgtgtacgaaagggaatattagaaaggcaagcatttgtgctaggaaggccagcaaggactctggtgttctgtcatacaagtacagtgatagggaagtgagatttagctccagaaagatcctcctaccctgttcttttctgctattgatggcattaaggagattccttggctacccctgcagggagggcaggtgaagtagggtgaacaatactaagacctgtggcaatcaggttttacagccatggaattttttttttctagcttaagaaaagcttcagtgaattaacttaaaattcttattttcgcttatgagcttttaaaaagatttgggagatgtatcctcatcctgtgcttctaaggcttgctgatggctcttcccttgcgttcttctagtgtcttctaagggcttccatagttttggattgtatgaacgttactgtaaggaatctgggggaaaaaaagtgggtttcagaaaaccccctgg

SEQ ID NO: 30596 - DNA, 1071 bp, Homo sapiens
gcaactcttctagccagttggctagaagtgaatctttgcaatgattgtgcccagtagtagtgaaggcatttgaaagctaagaacaaaatctatagctgactgttcctggtgtcactcagtcaatggagactttagtagcgtgcagcctttggaatattcttgtttagaatcaatagagtgcagtgtacaaacgcttacttaccatttcattatttccccaccccctcttttttgaaagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcg

SEQ ID NO: 30597 - DNA, 1029 bp, Homo sapiens
ccatgtttaggagccttagtccctattttgaagggaatgtagagaaagcatagctttttttttttttaaagagccagaaggaactataggcatcagctagcccagcccctattctttgctttaacttgttcagcccccaacttggaacctgactgtactgacatttgcagttagtagaggccttcttggatgccacctggagggtggagggaggtttggaacttatattcttaaagaaccttttatgttacaaaagaagccataaagtcagatgaagttgaggtggttaaccatgaaatggaggaagttttaccactgtctctctcccttttcttgggggttaggagggtaggatgtagagtggcagaacttaacagctgaatgcaattagaggtattatagctgcacatttattaagtgggctgaagtgggaaaaatcacatgaagaaacacaaatgggaatagacttgtgttaaccaggtaaaactacctgaactggtcattattcattcatggacagagtgcctcttcatttagcctagtgtatatttgttagcacgtgaagatcctttacaagcttttgttgactttggagaactgattttcaccatcaagctgttttccttagtgtttcagagttagtgacatgttcagatgcccttcagaagatgaatttgtcattcctttatctcttgtgccttatcttttatccaactgataaacattttttggttaacagtacatagaaagttttaaagccgtcatatgcagctatgattagttcattgtgataggggtagctttttagaggtttttagagattttaattaaatggctgattgttttcttgatgtaaaagtgaattcatgcagtaaaaaatagccatgattattttgagtaaccagtaataaaacattatagaatagacattttctttaaagtatgtttgcaattttaacctgtttattcatcaatgtagttgattgttttatggccatccataatgatattttggatcacagaaattca

SEQ ID NO: 30598 - DNA, 1050 bp, Homo sapiens
ggggcaggtttactttaacggtacatatgctataacattctaatggtagtgattttcttttcttcaaaggttttaagatttgacgtgttgtatcttatcctacttttgtctttattcatattgtcagaaatgaaaaaaacattgaaatttcttcacccttgaaagcagcaacactgtgaatgtaatgtatgttcataggtgacatgtacatgtcctcatacacttagatgctggtagagtgtccttttcaagtgtcctttatggtcctgttctgacttgggattgaaaaagctaggaaataaatgatatcatgttttgtaaatgtttttctgacagcctctaacagtacttccccaagaaggcccgatgagcatctccccatacttcaccatcagttgcgtaggtagctagttacaaatggggatttttggagatgacactagggttcctgtattttaaacacaatctctagatgattgtgcaactcaccaatatttaatgccactgatctaggcacataaaacatctgaacttacaccccagtagtaaatatttttactgaattggctcagtaattccctacataatattttagtaggtgcacaacactgggtgtggtgtaccacttgtagatcaaatgtgttattctttctgttctcctcaaaatgacatattttagacctaaaaaggctagtttaataaactggttatttttgagtgtgacaatgaactcagacatgtagatttggatttaactggagttagaatgaggttttctccaaggcccatgctgtcatagagcctcgtaggcaaaggcagcttgttttatggtttagctcctttagtaactgacaaggccgttggaccccctttgtaccacagtccattccagggtctcctttggtatcagcatatggggcaaacatgttcttattcagctttcccactggttaaaggattggacgcatagatgctgtgtggtgtttttcagctccagagcatggtgcacattttactgagtttttccctagttgtggcttaagctgtttt

SEQ ID NO: 30599 - DNA, 1068 bp, Homo sapiens
cagcttttgctttgaatacgatgaagctttgagtggctctgttcagtgtattgttaaatttctgttgaattggttatagagttgcctgttgaaacatgaagcattagctgaaattaaaccttgaacctctaagtgcattagatgtgtgtaagtatgacatctttattgaaaaataattctggagatgatagtcagaacacttgggtttcacccatgcttcctgagctaagtagctctctgaccttcagcaacttctatgatctcagattgatttatatataaaatggtgacataattagcttctaatatcagaggaatatttgcaggtagttgatggagtttcttggagaaaaatcttaaatcagaattttttttgtgaactatgttgaaatagttgcgaagaagatgtaatgttaataaaaggtattattggggatacttagggactttgaagagcatttccagaactagaggacagggtgcagttgtaaaaccctggtggtgatgtgttgaaggaagggaacttggctgtggcaatgaaagaaccaggggttttagcagcatccatctctcttttcctccactcagtacctaaagtgaggccgaagttcactggaattttttccctttcaaatgtttagttttatgatttgtagtcttgcatcttgggtttttgtttttgtttaaagagacaggatctcataggtggcctaggctggctccaaacttgtgacctcaagttatcctcctgtcttcacctccctgagtagcaggggcagcatgcatgtgcacctggttcttggtgtttcatttaataaatatcaaaaggaaacattcagtccttagctgcagcagtcaattaaaaacaacagaaaatattttatttatgccaaaggaagaaaaatcttggtagcagcatcatgatttaatcaacattttaatctaaggtttcatattttggcatatttaaggaggccagcattgcattttgattttgataaagtatggagggagcatgttttttttttttttcctttatggaaaaccttagtagttcttgtttttaga

SEQ ID NO: 30600 - DNA, 1054 bp, Homo sapiens
gttaaaaccacactattccttgaccctgtggccctcttaactctgaatccatctcctaacacctagccatcttcacacgacggtagtgtacacttgctcatctccctcaatcccttatgaattgaccgtaatggatctcccaccccagccactctatggaagcaataccggtgaactctgtaaaccttcatatgtgcgctgctcgagactcttgatgcgttgctctgccagtctccatttgaggcttctggcccccttgcacatcaagtagggtgcttggttgcttgccatcaacattgatcctggctaacttatggaatgaagaatattttttggaagattggcagacactgttgccttccacttctcctttgcccacagaatactgatttggtttgtgtctcatgttcctaacgctttgctagatctagatatcctccacctccctaacaaggggtggccatgtcacacaactctggccaacacatgcaaggagatgtctgcgggggaaatctgagaaaagggaggaggcctgttctccttgccttcaactctgttgtgtgatagggtggtgctggaggacgtaagagctgtcttttatctgagagtcaggatgcccaggatgagaggccaggaagctgggtggctgggtagaaggataggaagagcctggcatcttgttcactttgaagttctggactaaaatttgaactgcctgtcaccaaataacttaagtgacttaatgtcatttgtagtcatggtcctggcacttgcatctaaaaaagcaattatttctgtaaatgaatgttcagctctcccgcttgctccaaacagcactgttcaatggagatataatgtaagatgcaggtgaaattttatattttctaatagccacattaaaaaaggtgaaaacatctgctgggatgaattttaataacatattttattaaaccacacacatccatggtatttagatttcactgtataattaatgtaaaataattattaattgggcatggtggcaccacctactcaggaggccaaggtgggagaa

SEQ ID NO: 30601 - DNA, 1005 bp, Homo sapiens
ggctagggtttttttgttttgtttttttttttttttttggtgttatactggaatttagccattaccaatattacttgaagtgagcaggccattgactgcagtttgggagaccttttgtaatggtcagattttagttatagtgacattggcaatatgatttgaactttattcttttccaaaggaaataattgaattagccacaagtaaaatttcttgttctttgcatatatttcaaattaccttttcctatttgtcttaaacaattttgaacaattaaaatcttaaaagtactttcttaaagagtcctttggtggtggtgtcgctgatgctcgttttttgtttttaagatccataacagaataaggatttatatacatcctcctagggataatgtcatggtttctgcatatttgcatagcattttgagagagactttttcctttttgcttcatgaaaaaaagtttgagcagtataattttctagaaagaaggaaatataaatattttagactgtagcatatactaaagggaggtggactagtactgatatttttagtgctttcttcaaaatgattgctaacacgtgtattatattttagtatcttgttgcattcacttgttaatctgtatttatgcttctgtatatgcagagttttttgttttttccaacacaatttaaaattctacttaaaaattacttgtttggatttctaagcagatttgggaattacggcattgaaaatactttgttgctttttatgtctcaataaagtctatgcatttttataatattggaccagtgtttgacctgccagaataaaatgatgatagaactcattgtgtcctcaaataattggattctgaaatggaagatagggttcatgaagaataaaaaatagtagatctcatgtaaaggtgaaaatttacttttctttttagtattcaactcaaaattgccagtttccctgaatttattatagcaatttctcttgttttaaaatgaagt

SEQ ID NO: 30602 - DNA, 1033 bp, Homo sapiens
taaagtcatctatattaaaagatctttaaagtctctcagcattcaagaaataacttaggcatctttttagaagtattatacattcttaatcaataaagcctgtgtgtcttgaacatttcctagttagcagtaaaacacttagtttctctttataagatttttcttttaataaaattacttgcattttgacttatgcccttaagtttctatttgttgtctaaatggcaccatttaaagtgttttaagaaatttaatatttctttattggattaggagaacatatctttaaggaaaaattaccctcttagcaggtgatttacagtattattttctcctggccaacctttttaaaaatccaaaatatgtgccacctagctttttaaaagtttcattagaattagttatgtattatgacgtatttgtgaagtatgtaaagtgcttcagacagcacgtggcacattgtgatcactaagggtttgccattattattcttaccttgattttaaagacgtgaaatatggatatgtgacttttttggtttttacattggaatttcatattaagtcggtggccctttcagtaaaataagagcttactgtaaagttctctgcaaaagattttccattttcatatttaatttgcatgcataccataatttttatttctctcctcttggagtctctctgtaaatttctttttaatgtgtcatacttaaggacctcttcattttcttaaaattctgcatccttctgttaaccaaacacatttagaaagtcattcaaattttatgcttgtaagtggtactgaattggaaaaccaaaggattgtttaccccaggagcaagttggagtgtgtgcctgcttaataatgaaaaacattgtgatcagtttgcttttaactagttctcccttttttttccctatttccttacccctaagaatgaatataagtgttagacaacgttgagatcagtttccattagagttttaaaagaaatttttctattataaaggaattggatatttattacatt

SEQ ID NO: 30603 - DNA, 1024 bp, Homo sapiens
agaccaggctgggcaacagagcaagaccctgtctctatagaaaatttaaaaattagccaagcatggtggtgcgcagctgtagtcccagctactcaggaggaggctaaggtggagagatcacttgagcctaggagggtgaggctgcagtgagttatgatcacaccactgcactccagtcttggtgagacacagtgagaccctgtcttttcaaaaaaaaaaaaaaaaaacaaaaacaaaaaaaaaaaacaaaagacagtggcctatagaaagtcatgaaccctttgagaaccattaggagcagtgtgtctcacatattgagagtgggcatctggccacatacatgtatgtcatgtgtacacattcatcatgtatgtaaacatacacactcattagtttgctagttaatgaaagagcaagataaattgtggagccttgtatttttcacctgagtgggtagagcattttcttctctcatgcagttctgtatcgctgcaaaagaaatgaagcgtgtggataaagattgtgcatgtgtgcatcctgttcttcaatcagccaggtgtacataatgacgaagtgatttgggcagagtcaggaattctaaaaattacaaaattatacagtaaacaggatctcacttgggtgttgggtattatttgtacaggtggatttgccgctgcagtcaccacccctctagacgtggcaaagacaagaattacgctggcaaaggtaagtggtgaaataatgtaatggagatacttcagatgctcatatctgttagcactaggactacaggtgtataaagtgaacacaaatggctaccatttacctgtaatagcatcttatgctgcctgtgcaacctctaacaaaactgccattgatggaacaatgtccccagtgtctacataatattgtaccatttcacagtcattttcacatagggctggtagagccactgcctggcagtaccatcttcaaataaactctgtttttactggtgacaaacctaagggtcagagaggttgac

SEQ ID NO: 30604 - DNA, 1024 bp, Homo sapiens
gcatgcctctgattccttctcccaccaatctgtgccccacacttatcaaattaatctaccccaataccattctcttcatttctttgtcttatttaaaatcttctgattatccctatttcctacagtgatatttcccaaaacatgttctccaagctgttaatattctatgtaaatgaaagaaaaaggaagaaagaaaaagaaaggaagaaaagaaggaggaagaaaaagaagggagggagaaaaaaggaaagaaaaagaaaagacaaactcgtgagtttggaaagcactttcattacagaaagatttatctgactattatgttaatatccatgtgacagtaataaagaaatcatctattggagataaatatagaatagtttcaaaacttgctttctctaaatcagagtgtctgggtttaagtgacctttcccaatgttctatgttctttgtcaaatgacttcgtctctctgattttagttccctgatctgcaaaataagataatgattatgacctctgaaatggcctgcaattatcctctcacactgtgttcacacacttggtagtctcttcccccatgagaaaggaccgacttttatagcccataggatgttgcagagttgtattcaaagctgagtcatgaaagacactgtatctcttccttgctctctcttggataacttgttctggaggaagccaactgccatgtcatgaggatcctcaaagagcccattagaatgcctacgtagagaaaaagccttcaactaataaccagcaccaacatggcagccatgtgagcaagccaactgggaagtgcaccctgaggacataatcaagctctcagagtacttcagctaaggctgatgacttgactgcaactaactgagacatgttgagcctgaactcccagtcaagatgctaccaaactcttggcccatagaaaaggtgagagaataaatgttcaaagttgttttaagccagtttttagggtaatttgttacacaacaataaataataaatacaatg

SEQ ID NO: 30605 - DNA, 1025 bp, Homo sapiens
ttaaggatggcacatgctatttacaagcatggtgttacttttgttgccagaacaatttttgtctttatcaacatgtttcctttcatcataattatagactatagctaagtggagaaataaataatgagatacactaattggggttacacaataccaaggctgtgtagcactgctgtctcaacacagaaatctcgaattcctaactgtcatgtttcggccttggccatagtgacttcctaccttatcttttcccacttgacttggcagcctgtttatatagttatctttatccaatataagccataaggccctgtattcttgagcctcaaaatctttgtatcttttacccttctgggttttttttttttttttttttttttttttttttttttttgggaatagcagtatatagccactttagagactaggatataagttttcaagggttttttctttccccgacacgaatatgatagtttgcttttcttgattgtcacacaatttctctcccgaaaactgtggcttaactggtcactagcaagcataaaggggaaaaaaaaagcagaaaggggggttagtccaaatagtatccatctttctcaggggagagatttcgattatattacacatgtatgtggataccttcatcagttacagtttagtcattgactaacttggacaactgggtgcctacctcattgaatagttgtgaatattcaataaggtgatgagatgctacctgtagtaagggtgcagtagataccagctgctgctgctcaccttactgctgctcctcctcctgtactatgattattgctctctgcctactgctgttttgtgctactactggtgtcattgctactagaacttagaagtttgcataagaatggaagaaatggttaatcacagaaacatttctctgtgcaggtggtattgactctctcattgccttatcactgttgagtaaataagcaacagtttggttctctatcgctgaaaaaactctaaccacatagtcaattctc

SEQ ID NO: 30606 - DNA, 1048 bp, Homo sapiens
aggttagacagtcttacgcaagattacatagcttgggtgtatcagagccaggcctgcttggtaggtctttgaatgccttctccaatccttttctgtttcctctgagagcaatgctatgagactatcatattcttaataactagtgttttaaagaccaatatttattgagaggaaagggaaaaggggagttgtttaatgggtatggagcttcggatttgcaagatgaaaaattctggagatctgtttgataacaatgtgaacatacataacactactgaaccatacacttaaaattggttaagacggcaaattttatcctatgtgttttttaccataatgaaattttttaaaggtatgactaacttccagtagtaaattcccttggccaaaggacaaaataacacttacttaggtacaccagaatcctcagaaaattgagtcttatagttagcattttcttttcttttttttttaaatccatcttgatccaattcttcaagttcacttccttgaactcatgtggggtgaggacttcccttgaaacctcaagcttcttttatgatatttagagtttgtctactttctacccatttaaacccaccccctgattttggaagaaccaggtgttctactattgtgatgaaagtttccatgccatactctccgaacctcttggaatccttggttggcttctgtggaaccttcctgcttacaagttgttgcatcctatgaggccaaactacacttatctagcactcagaatcctaggacaaacatgagtaaaacacttgggggagcatgccctggggaatttataaatatacccaaagacatgggtatatttacatttcactgctctagcagcattaattagcaatggcccagtcatctcaaaagaactttgctgtgagagtggtcattttgctagtggtgtcaaatgggtccctgggcacactcaagtgaactgtagaattgacatgattctgtaaaatcattgactttttttgtaatggcaaagacctttgatatcatttggtctaacctagta

SEQ ID NO: 30607 - DNA, 1049 bp, Homo sapiens
agacaatgtgtacaaactgggtgggcaacactaggcacgtggcaaacactcgtgaatggcagctataattaatgtatgattattttatttttaaaattgaatgcttttaaaaatgatacaatggactttggggacttgcggggaagggagggagggggtgggatgggggtgagggataaaagcctacacgttgggtacagtgtacacggcttgggtggtgggtgtaccaaaatcgcaaaaatcaccactaaagaacttatccatgtaaccaagcaccacctgttcccccaaaactattgaaataaaaaaaaattttaaaaagttcaaaaagaaatggagtgctttgaatattgaattttcattgagcctcaaatcctaaaaatatctgttttcctccattttcatcgcagagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggtacgcagcctgagttgtgtaaagtttactgctttttaccgacttcaagacagtagaaacagggatataatgagccataggggagttgacttacgtgatcctaacacagtcaatccttattatttgtggattctgtgtgtgtgaatttgcctacttgtaaccccaaagtcagtatctgtggcacttccacagtcattcttggacatgtgcagagtggcacgtttgagctgcccatggcacgcatttccaggtgaggtcgaatgaccctgcctgaggttgactgtctgctgtcttgtttcagctctcatcctctaaacaagtgctcctttcgtggtctgttgagtactttctacatttttgtggtttctgttggtgatttcgctgtttaaaatgacccccaagcataatgctaaagcactgtctagagttcctgagggcaagaaggccgtgatgtgcttacagagaaaatacatgtgttggataagcttcgt

SEQ ID NO: 30608 - DNA, 1049 bp, Homo sapiens
cccgtacgctaggcgttggggtgggagaaaaagtaaacggttggtgggggcgggggtagggggtagcatcgcaacttttaagttgtctcagtatgcctttttcagggcttttgaagtcatctttccgcgccctaatttcgaggtggttgccttcactgttcttgattgcacgccttccacgcaacaggcttgagaacagtggcttacaaacttcgagtagagagatttcagcgttttgagaattattctttgacattcagaatcatttggggacggcaacttggggtagttggtgcttcttagaaaggcagatttatggacttagatgaacaattggtgggagtcggggcctggggatttttattttcactggattcccagcttaatataatgctggtgttcccccggaccacacttcgagaagcactgcgttaaaaatggtttgtgaagttgagtgccccctttaggaggattcttgttatctgtaaagagggtgacatgttggaagtagaacttggaggattgaggtggtaatttggttgagaggccttatttttttaattttgtatttaattgatttttaataaggtaaaggactaggaggaaagtttgtttttagagcgcttttgagaaaactgataacgtttttttttcttccttcatctagattttgagaagagggggaaaaaggaagtttgtcctgtcctggatcagtttctttgtcatgtagccaagactggagaaacaatgtgagttgaaaacatgcatttgtcgttatagaccagtgcattattaagaattgctcaggaaagggaaaaaagtatattttgggataattaaataattcattctaaattgtagaagtcctggtcatttaaataatttatatatttacatttaaagaacgtatacgcttacttactttatacatggtctgtaacggattttaaaaacctgtgtatgttaaaattttctttatagctaggctttggcacgcttagagaatgtattagtcttaacgagccagagaaaggaagaatgcctattcc

SEQ ID NO: 30609 - DNA, 1026 bp, Homo sapiens
aacaaataggcttattcctagaattttgtggctttgattctgtttcagagtcttggtggtattttctcatattgtcgtgtgtccagcctttttttggtcatatttgcatatgtaggtgtttaaagtgtcacttctatttatcgtctggaggactctgttattatctgacaaattccagatgctacagttttgacttgtagactttctaagatagctgacttgttacatatgctcagcattttattcagctcgtttccaaatgttctgaatctgaaacttacgctataaagttagggctgtgttcagaaggaacattccaggtcattgttttgcagtttgtgtggtagacacaatctggctaagtttatttgtagacaacagtgcatctttgatgacttctttttgtagtctttgggtgggggctggggcagcaggaaaggggtaggtttctatggtttcaatgttaataagtgggttatctgcccagtatgagtgtagctttcagcaagaattgtataatttctctggctttattattagcaagtgttcatttctcacaagatttgcttatttgtagtctagccttttaacaactagcctaattttagaaagaaaaaaacctttgctgcctcagtgcttgatttaatggtcatgcctgcaagctgagtctccttagtattctattaaaatacaccagtcattttgagaacgtcagtgtgatgtgttcaatgttgtatttctatttattacattaaaaaatgggaccctctgggcgggggaagtcatttttaccttcgcattagggtttcatatagaacatcttgatttagaacaatgtaaaactgttaatttgtgcttatatagataagcctaaaaatgaccacatgccatctttcaaaaataaattaatccctaaaacataaatgcttagactgccactattcctcttgaattgctagtcggcacagacttagccctgtcaacaatgtcaagccaaatagcattttacttttggctgttttttga

SEQ ID NO: 30610 - DNA, 1212 bp, Homo sapiens
tgccagtgaatgtatggaatcataatgtttatggactattactgtatatgacattactggatacctgtcaaaaacttcatgttgcttcaaaacatcattagtaagcttcagatctcattagtaagaagataaggaatttatagtccacagagcaccttgctttctctctgcttgtagactaaaggtcttttccctttttgatgtagaagtttgttattcaggatccatagcaaaaaactgaatcgctgactaaaactaacagtgtagataattgagagtgtttactgtttaattacatgtgcctatggaaaacattatatgttgagaaatgtattttagatcttcattttcaccagctctctgatgtgttcgtttgcttgtcttctctctggtttcacccatgagcagtcctgttgatgtgtcaggctgcccaggttttgcattgcttgtaatacatgtgtgtggaaatctacatgtaaccacttgcacattccatccctatcggataccttgggtaacctattacctgaatattaaatatttttgagaactcacaccattgactataaagtgaataatagctaattcaagtctcaaattagtaatgatatgaaacagtagtaataatgcccttagtggtattttttaaaatgtggcatggaagtagggctttttcgttatcagttaaccacttaacgcaaaaaaatagaaaacttttttgttttgttttttttgagacaaggtcttgctctgtcatccaggctggagtacagtggtgccatcatggcccactgcagccttgacctcccgggcttaaatgatcctcctgcctcagcccccgcccgcagtagctgccagaggcatgtgccaccatgcctggctagaaaaataaaaagctttattgagaggctctgtagagtgaagagccatttgcagctataagtgtcatagtatctctcttgtctctatgcttgtaatttgtttgaccgttgcttagaagacagtcatggttaaaactctacttctttcagtataatttacttgtctctctcgctctcttttttttttttaagacagagtctcactctgtctcccaggctggagtgcagtggtgcagtctcagctcactgcagcctctgcctcccggtttcgagcgattctcttgcctcagcctcctaagtagctgggattacaggcgcccatcaccgctaa

SEQ ID NO: 30611 - DNA, 2503 bp, Homo sapiens
gtgcagtggcgccatctcggctcactgcaagctccaccccctgggttcatgccattgtcctgccttatcctcctgagtagctgggactacaggctcccgccaccatgcccgattaatttttttgtgtgtttagtagagacggggtttcaccatgttagccaggacggtctcgatctcctgacctcgtgatctacctgctttggcctcccaaagtgctgggattacagacgtgaactactgcacccgccctgtttttttgagtagagacagggtttcaccatgttatccaggctggtctcgaactcctgacctcaagtatctgcctgcttcggcctcccaaagtgctgggaatacaggtgtgagccaccatgcctggcctctactatctgaaacatagttttaaatgacatattttaatctaaatataaataaaacatttaatttgaccaatgctgtttaattaagctaataataacccttgacaataaattagatctgaaattatttgaagatgtgtgagattctttgagatgtgggagttttttttccacattttcctttaattctataatattctcgttcacttttttttttcaatgccttatagcagtggttctaaaccagggctgacaatgtctagagatgtttttggttgctacagtttgggggcatgctgccggcatctagtggggtagagggcagggatgcctccaaacatcctatattgcttaggacactccccagcaatgaagaattgtctggccccaaatgtcagtagtgtcaaggttgagagactgctttataggagaaagcatacctgaagattttaaaagtgtcttgaagttttcttctaggacctctgaaatttaaaaaaatggtaagaccaccaattaaggtctttaaccaagtcttagttttacctatcagaattctatttgagacggtaaagtataattttgagaaataaataatatgaatgtcctagatgtttttgtgtttatttaaatatggtgtctgttaactagctttattggttcattgtttatttttattattttttttttttaatacagagtctcactctgtcacccattctgttaactggctttactggttcattgtttcttttttttttttttttttttttaaatacagagtctcactctgtcgcccaggctggagttcagtggctcactgaaacctccacctcccactgaaacctccacctcccgggttcaagagattttcatgcttcagccacccgagtagctgggattacaggcatgtgtcaccacatctagctaatttttgtatttttagtacagatagggttttgtcatgttgcccaggctggtcctgaactcctgagctcaagtgatctgcttgctttggcctcccagtgctgggattaatagagaatgggatatggcctatgttgcttaggctggtcccaagctctgggcacaagctatttaccacctcagcctcacaaagtgctgggattacagacatcagccactgtgcccagccaggtcattcttcatatctgtggggagagagccttcaattcctcactttcttgatggattagtagcctcatggcttcattaaccacaggtaaccatagaggtatacctaacctttagtttcccataaattctgcctgttgtagcctggaagctgtgtgtattttacagtccaggtcacaggccactgctgatacaccaaccagtcttcagtgacagcagtgctgaccacttcccccacccccaattagcacccaaaggagctagctgccctagccactggtgggtcccctgcatgctgtccttgaaagggaagagttagatatattgagtctagaaagagtgagagagaaagagattggttatttctgtcatctttcagaattaagtgtatgttaaagtgaggactctgttccttatgtatgcatcatatatatgcattttggaaactcttgacaaagttggaagaactttggaagaagctggaagtgtggagaagtctactaaatccataccagctttttttttttgagatggagtcttgctctgtcgcccaggctggagtgtagtggctcagtcttggcttactataacctccacctcctgggttctagcaattctccctgcttcagccttccgtgtagctgggattacaggcgaccaccaccacacccggctaatttttgtatttttagtagagacagggtttcaccatgttggccaggctcataccagcatgttttaatgcaactattaacaatattttgttactgtatggtagagatggtaaactggctgggacactgggcgtgcagatacagaccaggttggttttggggaaactaggaggtatggtcactctattttgtttctttgatgtcctttgtacatcattcctagttaatatatttcttatatttttatcctatctttcttatacttttagccaggcagatatacacttgacccttacacaa

SEQ ID NO: 30612 - DNA, 1037 bp, Homo sapiens
aaaggggaagctctgtttatcacagtatttgtgtaattcctgattttacattgtttgctcacattccttctcatgtttattaaggtatcacttaagtcaacaaatatttattgagtatatattctgttccaagtactgcgctaggtattgcgggtgctgtggtgagcaaaccacagtatctggtagtaattttaaaaattactttaacagtgaagtattacatttctatatgtgtgtgtgtgtgtgtgtgtgtgtgtgtgtgtatatatgcatatatatatattttttttttttttttgaaacaatctcgctctgttgttcaggttggagtgcagtggcacagtcttggctcactgtagcctccgcttcccaggttcaagtgattctcctgccttaggttcccaagtagctgggtctagaggtgcctgccaccacttctgggtagtttttgtatttttggtggagatggagtttcaccatgttggccaggctggtctcgaactcctgacttcaagtggtttgctctccttggcctcctaaagtgctgtgattacaggcacgaaccactgcgcccagcctgtttcttttaatattttgcttattgcttttatcagcattggcctgtacaaaatacattaacttcattttaaaaattaggcctggaggaaatcttttataaatgtagccctttaagagagtaatttttttcagttgatttttaaataagcttaggttaggggcctaagactgatgaggtatatagaaggtcaacaaacaattattacttttgttatgcattgaaaagttttagttacaaggtgaaagttacagtgtcaagtgatagaagcctcataatgtgtgaagtgcttagttcataatgtgagagagcttggttagattagatgggaataaaattgaaatttaaattttttcctttagaattttttctgttacatatgtaaattccaaagattttgacacaattacaaacttcagtaaaatgaagtttaatcctataatatctttgctaccaagtt

SEQ ID NO: 30613 - DNA, 1033 bp, Homo sapiens
agcatgatctcggctcattgcaacctccaactccctggttcaagcgattctcctgcctcagcctcctgagtagctgagattacaggcaggcaccaccatgcccagctaatttttgtatttttagtagaggcggggttttaccatgttggccaggatggtcttgatttcctgaccttgtgatctgcccgccctggcctcccaaagtgctgggattacaggcgtgagccaccgtgcccagcctaccttcctatttctaaggtacagtctttttactagttactttttctcttaattttacagtctagttactttttcccttaatgtctgatttcttagtaatgaaagttaagatttagtttcttttacgtactccttctccaagcatgcacacaaacttcccactttaactgctcattttttccagtataattacattgaaattttggtcacattagcattcaatatatacgttgtctctgttaatgctatttttttcatttaattttctgtatgcttatgactaattcaaccccaaattttagttgtttatatatcaatttcatgttttaaaaaaaatctcttgttgagccttcttaactgctccattctggactggttgctctctagacctgcctgaatcctaccaagttatgatgaaaatggaaattctaccatcttacggtgggagacccatttttatcatcctgtaattaactttttgtgttggagtctcagtattctagataccatatcatgctctttcttggtttacatcattgttttggtggaatgagaggaggcacaataacaattttttttgttttgtacttttagtgtctgaaaatgtgtttattctacctacttatttgatagtctggttattctaggttgaaaattattgtctctctgaattttgaaggaattttttcattgctttctttgacacctgttgataaatctggagccctctttgtatgtgacctggtttatgtccctggagttttgtagaatcttctctttgattccagaatta

SEQ ID NO: 30614 - DNA, 1050 bp, Homo sapiens
cagtgcccattggtcccagtttctccatatcctcaccagtgcttgttatttttcattttagaaaatgtttttgatttaaaataatcattggtttcttctccacttttctgtgtgtgggtgtgtgtatttttttctttttaaactggtcatttagactttgaacctcttgtactactattacagttttctgattacttccctcctttttataaatgtctttaaacaatgcacctttaaaaaagagtgttaaatggtgccatcattgagttagtagttttgttttattttaactcctcctcttccctccaaatctatagtttttgtgtgtgtagaattttccaggtaacgcagaacacttgctgactattattactcaggctatggagattcctaccagttagtggacacatattttcctccaatttcttagtcttcaagaatcctagctccatttgataactatgagtagtgctttttgaataacttcttttggagggatgagactgcagcaagctatagttttgttttgttttttagagactgttcctcttttgcccaggctgcagtgcagtggcacagtcatagctcactgcagccttgaacttctgggttcaagcaatcctcctacctcagcctcccaggtagctaggattataggtacatgccaccatgcctggataatttttaaattttttgtagagatgggatctcgctatgttgcccaggctggactcaaactcctgggctcaagcagtcttcctgcctcagccttccaaagtgttggggttacaggcattggctactctgcctggccctagttttgttcttaaaaaaaaaaaaacatttccaacagttcagatcattggtctgggcaaaggtaggtgagacctcaaaagcacagggaacgaaagcaaaaacagatgaatgggattacatcaagctaaaaagcttccgcacaagggaagagtcagtagagtgaagaaaatgaaatgggagaaaatatttgccaactatctttctgacaagggattaataactagaatatgtaag

SEQ ID NO: 30615 - DNA, 1076 bp, Homo sapiens
atttatcttattataggtctaatataaatgggcctgggacacccaggccacttaatcgaccaaaggtttctttgtcagcccccatgacaacaaatgggttgcctgagagcacagacagcaaagaggcaaatttgcagcaaaatgaggagaaaaatcacaggtttgtatgttttatatttaaaaacagtgtttttattaaaagttaaagttaacatttaatcagtacttatcacttactatttataagttctgagggacagaacaaggttttcatgcggtttataggagcactggcttctctttgcagctgtagcaaatgttgaaggtggacatagacaagacttaaaactgctaatttgtggagactgtttatgtagggtctaaaagtaacgtagatatgatgatccatttcatttgttgtttctgaaagttacttgaaaagaaatgatctttataaataagttgatttttgtgagtcgtttctcattgtagttcataaaaggacaccttttgtttatatcttcaaattttctgtatcacattaagggaaggaagactaaatgagggagaggacttaagagagtatgtccgtatggaagacttgcgggtttattgtaggagaatatttaacttactggagaattgcacagaaaggtcatatagcttttctgagtcctactgggaattattcatcaaacagtttagtttaccttgaaattattctcttgtgtttttctttgttcaggtgttataatttaactttgacactgaaatacaatttaaaacattatttaaccttaaaaatggggatgtagaagatggggaaaataatcttattaatgacactttaaaaaaacatttacagtgactcttcgacctctgaatcagaagtttcctcagtgagccctttgaaaaataaacatccagatgaagatgctgtggaagctgaggggcatgaggtaaaaagactcaggtttgacaaagaaggtgaagtcagagaaacagccagtcaaacgacttccagcgaaatttcttcagttatggtaggagaaacagaagcatcatcttcatctcag

SEQ ID NO: 30616 - DNA, 1034 bp, Homo sapiens
cagccctgtttcttacatggtgacaaagtgttccagcaggacttgacagttgtggttctttgccaggcaagtcatgctgattgtcaacaaaatccagatttaaataagtctccactggtataatttggcactagcttacatgtatatatttacaatatttgtgttaatcattttaaaggctgggcgcagtggctcacgcctgtaatcccagcacttgaggccaaggcaggtagatctcttgaggccagaagttcgagaccagcctggccaacatgatgaaaccccgtctctactaaaaataacaaaaattagccaggtgtggtggtgggcacctgtaatcccggctactcaggaggctgaggcaggagaattgcttgaacctgggaggcagaggttgcagtgagccgagatcacaccactgcactccagcctgggcgacagatcgagagtccgtctttaaaaataaaaaaaatcatttttgaaatcccaccttcaggcaactacatggtaagaagtgtagaattacctgaagtggagaggagggttctgttttcaactgtgggtctcctttcctatgcttctttttgtttttgtttttgggacggaatcttcctccgttgcccaggctggagtgcagtggtatgatctcggtctcggctcactggaacctctgcctcccgggttcaaacaattctcctgcctcagcctcctgagtagctaggactacaggcatgcaccaccatgcccgtctcatttttgtatatatatgtttttcgtagagatggggtttcacagtgttggccagggtggtcttgaactcctgacatcaggtgatctgcccgcctcagcctcccacagtgctgggattacagacatgagccaccatgactggccctctaggcatattatcgcacagtagctacagtagagggtaagatctgtggctctgaactaaggagagtactagtcggtgtgtttctaaccttaagaatgtcttagttttcagcttctcatatttgatctcttacccccac

SEQ ID NO: 30617 - DNA, 1046 bp, Homo sapiens
ccatgtttgcgtggaccgctctccgccaacaggtgtcttccacagacccctctcgctttagccctcagtctctttcaattctgtcttttctctcggtccataaaaacaaggaagtcgaccccagtggagcctagtctccccacgaggaggcggccccgggggtggagtcaaccctggaggccacgctctgtgggaaagcacggggcatgcaaactcgaaatgaaagcccgggaacgccggaacaagcacaggtgtaagatttcccttttaaaacgtggagaataagaaatcagcccgagtgtgtaatggcgtcaatagtggtgtggacgagacaaaggcaatgaggcaaggagcgaggctggggctctcaccgcgactttaatatggatgagagtgggacggtgacggcgggggcgaaagcaacggtaacgcttcttgacctttgggctaagatcaagtctagtaactgttcttatcagtttaatatctgatatgttctctatccgaggacaatatattaaatgggtttttggagcagggagatggaataggagcttgctctctccactccacacatcgacctggtattgcagtagctccacgaactgtgcacccctttagaagggaagaacactgcagagtagcttgcacacctagtatctgtgatatgctggttttcctattccttgaactaccttgaagttcctggtctgcggacataaggtggacttttcggcactcccattttcgctgtgtctacagcactttgggaagactagaacccaaaacgagactacccgtttctgtatctgcatgcagagagagcgtgttcaatgtttcttggaggtccttagatctcagcttggcagtcgagtggtggtgaccttttaaaggaacggggtccaccagtgtggcccagcctggacttgaacttcttcctcttttttttttttttcaagttctagatacatgtgcagaacgtgcaggtttgttacataggtatgcatgtgtcttggtggtttgctgcatctaccaaccagtcatct

SEQ ID NO: 30618 - DNA, 1129 bp, Homo sapiens
tgggtatatacctggattggggtgctggattatatgtacttatatttttaatcttttaaagaactgacgtactgctttctacagtggctgtatcattttacatcctcaccaacagtgcacaagtgttacagtttcccacattcttgccaacaattgttattttctgtttttttttaatagtaactatcatcatgtgtacgaggtgttatgttcttgtagttttgatttgcatttctctaatgattcattatgttgaggctccttttatgtacttattgaccatttctattaattctttggagaaatgtctttggagaaaagttctttgcccatttttgaatcaggctatttgttttattttgttgatgagttttaaaaattccctatctattctggatctcagtcccttgtcaaacatcatttgcaaatttttttttcattctctgggttgccgttttattctgatgatagtattttttggcagttttttaaaaaaagtttatcaagtacagtttttaatttttttctcttgttgcctgtgcctttgatgtcacatctcagaaatcattgccaactctaatgttgtgaagcttttgttctattatttcttctcagagttttatagtattttttgtattacatttaggtctttgattaattttgagtcaatttttctgcatagtgttatacgagggtccaacttcattattttatatgtgattcttctgttgtttcaccaccatcccaccatctttttttatttttatttttttttaagattgttctttcccacattcaatggtcttggacccatggtcaaaaatcatttcaccatacatgtgaagattcatttctgggatctcaattttacttcattggcctataagtctgtctttatgcctgtggcaccctgttttgattactgaaggtttgtaataaattttgaaaccagggagtgtgagttctgcagctttgttctttttcaagattgttttggctatttggtgtcccttgatttttcatatacattttagaatagattatttctttctataaaaattgttgaagttttgaaaggcatagtatttaatgttaagattgctttgggtagtattaacatcttaaaaat

SEQ ID NO: 30619 - DNA, 1044 bp, Homo sapiens
gggatccagtttcagctttctacatatggctagccagttttcccagcaacatttattaaataggaaatcctttccccatttcttgtatttgtcaggtttgtcaaagatcagatggttgtagatgtgtgatgttatttctgaggcctctgttctgttccattgttctatgtatctgttttggtaccagtaccatgctgttttggttactgtagccttatagtatagtttgaagtcaggtagcgtgatgcctccagctttgttgtttttgcttaggattgtcttggcaatacaggctcttttttggttccatatgaactttaaagtagttttttccaattctgtgaagaaagtcattggtagcttgatggggatggcactgaatctataaattaccttggggagtatggccattttcacaatattgattcttcctattcgtgagcatggaatgttcttccatttgtttgtgtcctcttttatttcgttgagcagtggtttatagttctctctgaagaggtccttcacatcccttgtgaattggattcttaggtattttattctcttcatagcagttgtgaatgggagttccctcatgatttggctctctgtttgttattggtgtataggagtgcttgtgatttttgcacattgattttgtatcctgagactttgctgaagttacttatcagcttaaggagattttgggctgagatgatggggttttctaaatataaatcatgtcatatgcaaacagggacaatttgaattcctcttttcctaattgaataccctttatttctttctcttgcctgattgccctggccagaacttccaacactatgttgaataggagtggtgagagaaggcatccctgtcttgtgccagttttcaaagggaatgcctacagtttttgcccagtcagtaagatattggctgtgggtttgtcataaatagctcttattattttgagataggtcccatcaataccgaatttattaagagtttttagcatgaagggctgttgaattttgtcaaaggcctttt

SEQ ID NO: 30620 - DNA, 1035 bp, Homo sapiens
cagtgaaaaattcaggggtttttaagatgattacactaccttggaaagattagatagaaaagttcacgagagcacaacaagtacagactaatcaaataccaaaaggatttcaaggtgctctgaaggtggataaaataaacagagatttgagagaagattctcattgccaatgacaagataactatttagaaattcctttgtcagctgagccagttccagattggattattattggggagtagcggaggaattgagatttgagtatatttgattacattttttcaatgtactctgctttctattatatataaaaagagaatcagcaattatgaccactgaaagtaaattacgccactaaattgcaactagtcttcaaacattctggaaatattatgatgtttaaccatcttctcaattttattttaaaacaaatagacatattttccaggcagacaaatatgtattttaagggtaatgacaccaacatactgattttcttttcagcaactgttgactttttggttgaatttctactttctggacaaatatatattgtggttatttcagtgtcatgattcacagcttgaaaagtcacacttgattgagaacacagataaaaaatctgaattggatgattgaaaatgccatattaaagatatccgaaaaactggcagataaagggaaatatttgtcctgtttttctatgtgaacagtgccattaacccaatagtaccgaagaagtgtccctttgtaaaaagatcacaggtaatacattaaaaataaatgtcaaaattagaatgttgctgttttgcaatccccaatgaactaataaaaaataggcctaaatattgatggcttcgatatcactaaaagaaagacaatttaacattatgtgcctactgatgaaagaacacaacgccaactatattctcagaaaagagactgaacctcaatctgatcctgttgatggatccaggttccaatctgccagatatgcagagaaccgtgagaatgcaaatcagcaaaatagactat

SEQ ID NO: 30621 - DNA, 1027 bp, Homo sapiens
tgacaccttgattttgaacttctaccctctagagttgtgagggaataaatttctgttgttttaagccactgagtttgtggtactttgctacggaagccctaagaaattaataaagggcctcaaacccccatgctatctaacctgttttgttttagattaccttttatgatttattttccttcaaactctattgcacctaaagtcctagcatgcatcagtctgttttggtgatagtggtttccttttctgcagtcaaggaccaagctttccatgttcacactcatatctccaactttctgcctagtatacaggcaatcatcaatgcattatttgctataaacatgaaataaagatacagtgttggagaagtcaaggaaaaggaatagctcagtaaaaagtgagggttatgaatgtcaaatgctgcaatggaatcataagcaaaaaaaggttattgtatcttgtaatccgtggaagcagttggtgacctttgagggatcagtttcaggcaagtggatatggtagaaaacacatcataggaataaacactgagtcagcagtgaagaaatgtgggaggcaggtgtaggttgctctttccagaaagttggcagtgaaatgaggatgtatagtaaaacaaagcctcaaattttctttgcatctctatctaactaaaatgggaaatgagtactcaaatatgaaggctatgtttctggtttattaattatagtagagacaagcagagattctagatttgaagagaaagtattcaacacaatgggaaaaaaaggtgtttttatgaattaagtgaagaatttaggagaaaccaaaatcattaatgaggataaagagtagatgcctttggaaagtttcttcctcaagaataaaaataaacccagataatgatagaaatacagaaagtatcatagacagcatcacatagtggcttctattttgctttttgtttctgtttgctttttcaaacatatgttccctattagattttaaacatttttcagatccaagattctct

SEQ ID NO: 30622 - DNA, 1104 bp, Homo sapiens
ctttaggttaagataaatattcttgctttctctagtcatttcttaggccctggcagccttttgatgtctcaacctcaataaaaatcaagcagttttcgtaaacaacctcaatcttaaaacatgtgtatttacttatcctgtaggaatctttacttatctagcaatatagaatagctatccttgagaagcttttaaaagagtgaatttctaaatttcttgtcacccaattcccatttagcattaataaggagaggcagcattatgacagagtttctgaaggatatgcagttcactttttcgtcaagaaatgctaaaatgaagaatgctgagatgtactcttggcttctgtatccctgaaacagttttttacaaggccatcgagcccgtgtttggggttatttttaaataagaaacagctctatgaaagttgattatgtttgttttgagaatgttgagaaaatttttcattttattacatggggtcttctctatgaaaatcttatgaagaggttcctttcttgtcttaggatcgttcttctgagcaactgctttactttaatcttatggaccctgaaattcgtaataactacttctcactttttgcactgacaattaaaaagcctagaaccaaataaatgaccctaccattctaattgcagtggcttcatttggttccaatttcatatccttatccttatttttccattactgtatgttttcacctttaaaaaatatagatgtataggtctctttgggtattttatttagatactttcaattatattcagaataagctagcgtacacatataggaaaatcatttaggattttttaccttggcaataaaaccaatccttaatgctattcctacttctggggtcagagattctattctgttgagaagcttgcctctttcacctttaattatcctaaggagattctggtctttccctgatgtttatggtatttttgatcgttcctttagagtacagagcactccagggagtgtgactcctataaaaaaaatctgagataaacttaatcatcttaaccttccaagggcatctcccattgtcttatttcagtgtatatttaatagatacaa

SEQ ID NO: 30623 - DNA, 1078 bp, Homo sapiens
ggcactattcacaatagcaaagacttggaaccaacccaaatgtccaacaatgatagactggattaagaaaatgtggcacatatacagcatggaatactatgcagccataaaaaatgatgagttcatgtcctttgtagggacatggatgaaattggaaatcatcattttcagtaaactatcgcaaggagaaaaaaccaaacactgcatgttctcactcataggtgggaattgaacaatgagaacacatggacacaggaaggggaacatcacactctggggactgttgtggggtggggggaggagggagggatagcattaggagatatacctaatgctaaatgacaagttaatgggtgcagcacaccagcatggcacatgtatacatatgtaactaacctgcacattgtgcacatataccctaaaacttaaagtataataataataaaagaaaagaaaaagaaaaaattcaagctgtatgtattagttacgatcttcccctggcaattttaccacctaaccttaccaattcaatacgtaccctcttccattttcacacactgttgcacctctaggcagtatacactaaactaatataaattatagtttttagtatattttaaactaaatatactagtagtatattctaaactaaatatactaatagtttagtatattctaaactaaatatactattaagtttagtatattctattggtttagtatattctattagtttagcatatgctattagtttagtatattctattagtttagcatattctattactttagtatattctgttagtttaatatattgcctagaggtgcaactgagtatgaagatggaagaaggtacatatttgatggtaagactgggtgcaaaacttaccatgtaggacaataatctattatcatcataattgactttgaagttaactaaattacacacaaataatacttgacatggttttgaacatacaactctgtagagtgttttgtttatataagcatgtagtatatacaataatattcagtccatattaggcacgcaagcataatataattttataacattgaa

SEQ ID NO: 30624 - DNA, 1050 bp, Homo sapiens
aagttagaggtggtgtttgcataatgtttttatagaaaataataggaatacaagcacctaaatccttttctctcacttcccatggcttgttcatttataacttgtttcagaattgccctgtgctgtttctctctgaccttctgttctacaataataaacacttggattaactatctgtgttctaaaatgccagctatttccagtttgagatgtttaaataagtgatttccttaatttgcagctatagttcttttttaacccaattttaaagtgagtttctttatataccttctcgccttcttcctccctgactttctactgctcagcaatctttaaaattaaacaaagcattcaggtgaaagggaaaaaatgaagtcatgttatttgtttctatattttgaagtctattttaactttatatttgttattttattctcaaatgtatatttcctttttttccccaactatcacaaaaagaaactggaatatagtacatctcctttcaaaacaaaactggatattggaacttatcattatttcttacacgcctgcaaggtattttttttttttgtactaataaaaggactcaggtatgttgaattcatccattcaaatgtgtacacattgcttttgctctctattgtgtacatttgcatataaagcctaagcatatctttgctcctttattaacaacagataaaaatatgtattgagcatttattctgtgtctggcactgtgttatttgttattaatacagtgggagaggaacagttattgtctttaatattgttgaactctagaaagaaaaccactgaatggataacccactctctgtcaaacgttcattcccttctcattctcagtgaacaaaatttgtccaactgtcacttatagaaaacctaaactgttttcaaaggaacatgtatggtctctcgattcttcacttatgtctcattttctcccagcttcacttacaagttttatatattggctgatgacatgtggtaccgagagcagcaaggcattagagaaagtgaaaagtcaaaaat

SEQ ID NO: 30625 - DNA, 1037 bp, Homo sapiens
ttctgcctttttgaatgaattcagttattccatctggaatgctataagcttcataacatgtgtgcttctctacctgtctagaattccatgtctagagaggaataacagtctctgtcagtaacattctcgtataagtggtcactggcacacttagcaatcagtttgtttttattttgttaaatatgaatttgcttgatagtttcctgtcaaaattaaatatacatatatattaaaggggcatatgcagcatgtcttacaaattgcaccgaaagtcttagtgcaggtaataattaacagttgtttacagaaagaaaagagaatttcaactggccttagacatcaatgatagtctgtcagcagtaaaataaaattgattgtataaaagccatggcttaataatacattgattatatgagtagatactaagttctgtgggttgtcttatctacttgaataccttactatatcctaatgatgacattactaaataaatagttcattggtctgaatgttaagcatgaagaagatagggcagatagaaattgctgtgtgtctatagcacaaataaagaacattttaaataatcccagagatatacagtttttggacttaagaagcagtatgtggataattgtgcattcgaagtaacataagtcagctaaaaagattttctttgtattaaacattatgctttaatgttcaattaataaatcataaccttaagacagccaagtggtgatcttatgtgtgaatatctttggatatcagttcttctcagaataaggcatcataaatttaattttatatgaaaatcaccttttttacctcatttctcacctagagtaaaaaaagcaatactcaatgaaacttttattttgcaaatttagtagatgtgtccctattggcctaacttattttgcttaattatattttctaatttaatttatatggaacattttaatagaaatatttaataattagatctggaccaacctactctagttaattgttattgtagttatgctactcaaatgcca

SEQ ID NO: 30626 - DNA, 1032 bp, Homo sapiens
ttgagtgcgttttaacatttacgttgtcatttgaacagcatggctcacacaatacttctcaggaaatataatttcaaagcatagatatgaaaattccagtcatttattctcataggttgctgttttgtaatttgaaaatcacatataatgtttccttgcttagcaacacaacattgagatatgggagaggagattctaaagtaatgctaacagtcatacaagatttatgagaatattaaaacataagtatataaatatttcatttagaaaatacatctttttgaaaaatatttaaaataatctataatcagtacataaacttttgtgcagatatttaaaggcctacccatacatatttgtatttttaaaataatttaaattactgctataatttaaatagtatagtaaatgctatactattttttaatctagaagccttaatttaagaacacttcagaagtctgttatggttgattcagaaactgattttacacagtattttttatgtagcatgtactgaaaacaagtgaataaactatggtttctgccctcaaggagttcacaaagatagattttatataatttgtgattaagatggtctatgaataagtgaccctaaaaacattacttcaacaaaaaaaagcttatttttatttttttcgaatacgtatccacaggtagaaatcttagtgagggccagccagcttctagctttctgctttgccatcactacgctgtggacttctttgtgggctaagataatttcagaacccacatttacatatcaagcagaaaaatgaagagcaaggacaaagggaggattctagccatattttaagaaagagtccccagaactaccacataaaacttctacttatgaacttggccagaacttcatgtcctagtgacacttagctataagtcatactagacaatatctttattttggaagaaagtgtacccatttcaatgaaaacaaagtcctatttactttggaagaaagggaaaacagattttgagggatcttaccat

SEQ ID NO: 30627 - DNA, 1080 bp, Homo sapiens
ggttcatagacggcatcctcacaaggtgaaaggcactaatcccatttagaagagctctgtctcatgacctaatcatcttccaaacgctccaccttcagtgacatcaccttcagggataagatttcaacatgtgaattttggggggatataaacgttctgaccacagctctggcctttggagagacttcaagcaagggttgtaagagaggcaggtgtttggatgcaatgacagacagggcctggaaattgagcttaaattaacacccaagtagagaaaaggctgttctttctcaccgatattggcagccctacacatttgtcggttcctcatctgaggagttaaccaactgcgaattaaaaataatttttaaaaactaacaaaaatataccaacaagaaatattacaaatcatgtggtatagcatctatttgcatatcatttacatagtattaggtattataagtaatcaagagatgatttaatatatacaggaagatgtgtagctatatgtaaatactatgccattttataaaatggacttgagcatccaattcaggggtcttgagaccagtctcctctggataccaaggaacgaatgtgcctctttctgagagccaggccgtttcctagtaatgcaactataaaggcaagcatcacattttttgtgtgtgattatctaacatttaagtctgaaccaagattttggaataaacgttacagtatctatatatggaaatgaaatgtaactattttttccataacatgaggtatatttgatataaaccattttatataaatctgcctgcctcattttctttcttcttgctttctttgcttattcaaattgaacaagtacattatacatatatatgtgtgtgtgtgcatataaacatacatatatttttttcttaacatgaggtatatttgatataaaccattttatataaatccacctacctcattttccttcttgctttctttacttattcatattgaatgagtatattatacatatatgtgtgtatccatgtttatatatacatatgtatacacatatgcatatatatgtatacacatatg

SEQ ID NO: 30628 - DNA, 1027 bp, Homo sapiens
ggctcaggtgattcttccacttcagcctcctgaagagctgggattacaggcatgtgccaccatatccggctaatttttttttttttgtatttttagtagagaaggggtttcgctatgttgcccaggctgctgttggcctcctggaatccggcaatcttcttgcgttggcctctcagagtgctgggatttacaagcgtgagccaccacacccagccgcaatatcttaatacaccaatgttgactgtagaatgtttctgccctttcttctcactcacctgaagaatcttgaagcagttggttttattttaatcattttccatcactgtacatcattcaatagtgcttgatattttaacatcagtaaacaaacaaacaaacgaacaaaaaacaggaaagtaatatattctgtcagagcagaattattcaattgcttaaagttttcatataaactttccatgtagcatgttgaatgtttgtttctataattaaaaatacctaagattattgactgggtatctgaaagggattttatacagcacagtacatagagtagcaataataaagatatattttttaccagcttttgcctttgtgagtattttgggtttgggacatggttgtacatatttcctgtttatatattctacacataatgtggtattacagaatgacgaattatagaaagatctggaatattattcttaactaaggaggcagtaagataattaaggagacattgaaagtagacttcagagttcttttcataaaataatagatttatttctcttgattaaggtttttatttggcctaagtctgacttaagatttttataaattagcttcatcattaaataccaatgtactattttttatggtatactaaattgttgctccatttgagaatattctaatagtattagggaaagttagtcttgttaattcatatcttttcctatatatgaataagaaagggcataaaatatgctttttttttttttttttttttttttttaagaaatagggtttt

SEQ ID NO: 30629 - DNA, 1047 bp, Homo sapiens
gttagcaacagtggacagttggaggcaggaagtgtgtgaaatggataatcatttagaagctattgcaaccgtgtgggtgagaaaccaggaagcctaaatcaggaaggtgactggaaaggagatacatttgtgagaatggtttaggtagcatttacaggattggccaagctgggatagtcatagatcaaggcaagcagggagagaggtgactccaagattttaaatcataacttagaagataaggagctgctatctgaacactgatcaaatcagcctgaatatttattaataatttgggaaatatctgccttggtacatgttgactttgatatattaatggaaatttcagataacgttttggaaacgtcattctgtaagtagggagaaaaatcagagacagaagtataattttggaagtatctagccaaaggaagttgaaaccatttgagtagatggaataatgaaagaatgaagtatggaagctgaggtggagaaagcctgaaaaattagtctgtggtaggacctccattaaatcagcaaatagcaggaacagaaagaatgagctgggtaagaagagctccaaaagattgagggagaactagaataaggaagaatcataaacaataaaaggaaagggaattctaagaagcaagagagggtcaaaattcatttacttcagagctaattgagaaaaaaaaggtgtttaattcatccaaaatctctaaagaaaaccttctgttggccattattacagataacctttaacaatgataaatgtacagtaactacttacatatgaatgagtcagtgaaaatactcggacggatttttccctttcggtgcattcagggtctgtgtggaagaattaatgctttcagaatatttgtttgtaaacacaccatctctaaagaaaattttagggtttctattgattttttgatcaggtgttcacatatgtttaaaattataatggaagtcaatagataaacgtgacttggtgtacaatatttacctatacatggcattctagaagcatatatcattaga

SEQ ID NO: 30630 - DNA, 1032 bp, Homo sapiens
gaattatgagtgagtggaaaaatatatgatccagaagtgatgcagacagaatgtgaagaggtcaaaggatcacttctgtttatgggaaccaaataatgacttctggaaagttggtgattgattttagcatgcctaaaacagaggatggggtttgggtttgcacatcagggagatagaagagagaaaatttcaggatggtgggacaatgtgagcaaaaggtaagaaaatatatgtattttcaatccttatctggatttaaagaaaacattgaaataagtttgcttaacattagttaatccttcagtgttagctttaagaaattataggaagtaaaaatacatctactgtttctgagtatgggtttcacatgaaaatgtgctgcgtcttttatgtatacaatgaattatgaagaaaagctttggataatatttcaggacctataattggacaagtaagactgagatgatataatgcttatttttgcatcctcagattctagcatcatagatggcatgtagtagcttacagaacttcttgatgaattcgttgtaatttcagcttgaaatagctaagtagccatagaaatagagtataatgcatggagcagatatctgaaaacagatttggcaaaatttgacaagtctctgggttcagcgctgccataaacagaattgtcaaatatgattttaaggcttgaagctgggatgagaggtagaatgatagttccatcaaaaatgaggacaggagtcagtttattgaaagataatgacttcatttggtgatctgctgttggaaatataggatagtggataggcatcttagattcagatatagataaagtggagaattatctctttggaatggttgttacagacagattactgaaggggaaagtatagagagtcaaaggtgatgctgaagagcaggtttttagtgaatgagtatttttgaaggagagaagaaacggaagcatagaaggaaagaaggcagtagtcagacaaatagaaggtacatcaaaacgtcagtaacaaa

SEQ ID NO: 30631 - DNA, 1051 bp, Homo sapiens
ccccaaaagttcagtcttttcaagaataaaaaagtgtattatgtttaaaatgaatgtatagaagtataattagtatatttgtattttctttcatcatagaccattgaaataagtagcagaaaatgactttgcttttttactttaaaactcagtaagggatgaaagttggtaggtaataaaacatattaaatgtaatcaagaatactgactgtctaaatgtacgctataaataaaattatttccaacctctctattaccataaactattagaatagtattttcaaagaaggtgaatgagtaagaccataatttttgtaacattaaacataagaagtcctagatctattatgtcttgcttatgtatcaattatctttgatattatgtggattcttcttctgaattatcagtgttactaaaaaaaagaaagagacagaaagatttgaaatgaagtaggcttatttacttatatattatttgctctgaagggtaaaagccaactaaatggacttacaaacatacggaaaaattaatgtataggatatttttccaaccaaaggattaaataatatgaaagagaaacactaatattagtcaaacagagctacctttaccctagagagttattaaagtctagatgtgttttatatgcaaaatggcctgtcaggattatggaaaaaaattctgacacctgcttctcatcagtgccccagaaacaaaggtgaagaaatgggtttctgagcatgggactgcattgcttcctgggtttgtcttaaaaatacatgtgtttttatgtggcattttcatacttatgtatgagtctttcattcgtttaaggcagaaaaagtgccagtaaaagtaaatgtctagtgctaaaacaaaatacacccttttcaggataaaactggcaacaagcattttattatgttgtaagagaacatttttactgttttctcatatactgttacatctctctacattctgtgttcaccaaaaatttaaaaatcactagtcctgaaattatgaaaatcggccactagaatatttgactaa

SEQ ID NO: 30632 - DNA, 1063 bp, Homo sapiens
taatgttctacacaggaaaccactatcttctaaaatattttatggaatcatgaaaaaatatttctgctgggtgggaaggcttccgtgtgatttctcttgaagaaagtcttcaatcccattttgaaatctcaattcctccaaattccaaagctgaaatttcacacctttcatgtttgcaagttttaatgagaattatatgtatacttaggtatcaactgcttctagtgttggatgagcttaggtggaaagcttcattaatgagcaatagacaacctcactgaatctacttcgcaatgaatattcagtctggagttcatcttaactgggtccatgaggcacactgccaaaaagcaacttgctattaagcatcaggtaggagcagaaaagagactgggtaaaataattacgttctttaaaaaacaagtttgattatggaatctatttaggtcctgttggttctagtgaagttgagtcagggctagtaagaaaatgtctggaaaaagaggaactgatttgaacactgctgacctttatgcttctgccatcagaaagggggtgagacttcaacagccaatgcaaaggaagctgagaaaaaatcaatttagctttctctgctagacagaataaaggtctctaaagatatccatgttctaattcccagaaaccgtgaactgttattttatggctcaaaagggattgtacagatttgatttaattagggccttgaaatgggaggttatctcaggttatctgggtgtggccagtctagttacatgcacctagaatgtggagaaccttccccttttgtattcaaagggagatgtaattatggaaggcaggtcagagagatacaacattgctctctttgaagatgggggtgagggggaatgagctaagtctatttgtgtatttgtactccaggccctagctagaatgccagcttcacaggggccagaattttgtcctattcacatttgtatcactggcacccagtacagtgcctgacacatagtaggtgcttcataaatatttgattgaataagtgaactagtgaacaaatgaa

SEQ ID NO: 30633 - DNA, 1043 bp, Homo sapiens
cattttaattagaatagtatcatgagactcatgtaagcatatgatattacacatcggtattttccctatagtctggaacattactggaatgaaaatttagagatgcatttttacttctccagcacatgcaagaaataatacaacatgaatccttttttattttaggaatgttatacccacaaaacattgaagtatgttttaagttaagcaaacaacaagttttgaccaagaaaattagaaaattaaggttttcttagaaaacaaacaaaattatggcaagaaattactgtcctagtaaaataagatgaccctatatggaccgttgtacgtgaatatttatgtccttttttttttcagtttcacgtatattctttaatgaacacgagaatacagttttagttttcatttgatggcagttttcttcactctccatttcttcaccacctcctcctattttcttccccttttttctgctattcctccactcttcattacacctacatggcttagagttgctggtagattttggtgcccatgctaaaatttgaacagaaggaacagtataaagatgagctgaagtaaatcttgaacacctactattttgccttcttatatcatctcaattgacaaagtcaagattgcagactgccttgacttatgatggggttatgtcctgataaactcaaggtaagctggaaatattgtaagtcaaaaaggcatttaatatacctaacctacccaacatcatagcttagtctatcttaaacatgctcagaacacttccattagcctgcagttgggcaaaatcatctcacacaaagcctacaataaagtgttaaatatctcataaaatttaccaaatactgtactggaaagtgaaaaccagaacggttgtacaggtgctcaaatacagttgctactgaatatgtattacttttgcaccattgtgaagtcaaaaaatcataagtcggtgactgtgctcggttaaaaagtagtggttgctgaccaacttcatttttctttaacagcttcaattgtgatgt

SEQ ID NO: 30634 - DNA, 1021 bp, Homo sapiens
gacaaaaagataggaaaacgtttagcatgcgcaaagtcaaagtcagggatccataaatatcattgggtgtgtaatgaattgttagtagttggatgggggatgctaaaatataaagtgagagatccttcatatattttcgtttcctacccttagttccagatattgatagagatattttagaaaatcccaacttaaggccaggcgcggtggctcatgcctgtaatcccagcagtttgggaggccgaggtgggaggatcacaaggtcaggagatcgagaccatcctggccaatatggtgaaaccccatctctactaaaatacagaaaattagccagatgtggtggtgcgcacctgcagtcccagctactcgggaggctgaggcaggggaatcgcttgaacctgggaggcggagcttgcagtgagccgagatcctgccattgcactccagcctgggtgacagagtgaaacttagtctcaaaaaaaaaaaaaagaaaaaaagaaagaaaagaaaagaaaatcccaactgaagtatatgtgaacaaatgaacagctttttttttttatcaaaaaagcaaaggtctttgaaataattttattcagattttgctcacaaatattatatttccatttttatttaaaattatgaggatgatggctaaaagtaaaatgaaccaagttttgtgcatgctgcattttaacaagttgggtgtctcattggaatgcactgccttcttgttccacatttatttttggaatttaataaggcgcctgtcatatctgcctcaaggctaaaaaacatcatgggggagaaatccaaagtactgtcatgtttgagtgacatggagccaattttattttatttccttttcatggggggtggctcaaattagccaggctcacttctgaaaacgcattgctacatcatctgttctaaaggccttgtgctggttaacgggtaatgacattgcccagtgacatttgttaggtagatttgactcagaaaaccaggggaggattttcat

SEQ ID NO: 30635 - DNA, 1026 bp, Homo sapiens
attcatgagggcggagtcttcatgacttaatctcttctgaaagatcctacttcccaacagtgttgtagtggagattaagtttctataacataaactttgggggtcattcaaacatttcacccctggctctccagggttgcagtctcatgtctgcagctttctcaggctgcagttgcaatctagtggccctgcagttccaggagctcaggggctgctccactctcaaggcttcactaggcattgccttagtagggaatctctgtgatgaacccacccctgtggcaagtctctgcctgggcccccaggctgtctgatacgtccttggaaatcttagtggagattgtggccattaaaccgtggccccacagctcttccattttagggacctgcagatttaatatgatgtggacatcgccaaggttttcagcttgtatcttctagagccatgggtcaagccacacacacctggactcgcttgaattacaagtgtggtggccaaagggtgctgttttggaattcagggagcagagttctagggcagtgcagggcagtgaatgctgtggtcttgcaggcacctctctcaaaacgttgctctcaacgccctagcttgcttagaagatctcagaattgcctgataagatacggtcattatctctttatcctgatgaagagaatctggctttcttctgtccatgttaattactttaggaaagggttgcttagccacacccttagtgatatggatttgttgcgtcccgacccgaatctcaccttgaattgtagctcccataattgttgttaggagggacctagggggagatgattgaatcacgggggcggtctcccccatactgttcttgtgttagtgaataagtctcacgagatctgatggttttacaaggggtttccactttcacttgactctctgtctgtctgccaccatgtaagatgtgctttcgccgtccaccctgattgtgcgggctccccagctgagtggaactgcgagtccgttaaacctttttcttt

SEQ ID NO: 30636 - DNA, 1040 bp, Homo sapiens
gagtgcacacacacactcgcactccaaaaatatatgccaaaaaaagcttcccagaaaaaaataatttaaaaaaatccctgaaagctactggaaagtcatacatatgttaaatttggtcatttagcatcataaattgaagttggaatatcatgaaataggcagatctgatcctcccacattccccagcatttacaggaagtctgagacagcagaggttggatggcgatgatggtgatgatggtgatgagtatgatgaatgtgatgatgaaggtgacagctaacctttattgagttttgctataaactaaatgccactctaaatactttaattcataaaattctcacaacagtttattttacatctgagaacactgagacacaatgcttagattgtctgagtaacacagtaactaaatgcaagattctgttttctacgttgtagtgaaataccatcgatctcagtggaacaagttgcaaagtaatttgtagaaccattaagtcaattagggaatttaaaattctgaactatggtggtagaaaaaaagccacatttcaaatagacatgacttcagagaggcaaagctaaaatttaagccatttacttgccagtttttatttttattttaatatttttaagttttattttaagttcagggaaaatgtgcaggtttgttacataggtaaacttgtgtcatgagagtttgttgtacagattatttcatcacccaaatattaggcctagtacccattagtaatttttcctgatcctcttcttcctcccaccgtccattatctgataggcctcagtgtgtgttcttcccctccatgtgtccatgggtccatatcatttagctcccacttaggagtgagaacatgtggtatttggttttctgttcctgtgttagtttgctaatgataagagcctccagctccatccatgtccctacaaaggatataatcgcgttcttttatggctgcatagtattccatggtgtatatgcaccccattttctttatctagtctatcactgatgggcatt

SEQ ID NO: 30637 - DNA, 1032 bp, Homo sapiens
cctgctgggtgtccccacagggttgcttgtatgtccttaaaatatggtgtctggctttttctgaagcaatccaagagaaggtagaaacatggcagacttggaaatcacacacccttaccacacatgattgtattggtcatagatgtcagccccattcaaggtgagaggggtctacatgaggacatgaataccaggagatggagataattggtggacatattgaaggctagctgccacagggagaaacagtatatttggtattaaacaaataatcttgacatcatgctcactgaattgatgccccctccccaaaataaatccctcattaatttgttgttttcaactcataactcacacaactatctttaaacctctgtatctatatttagtttgtagggtacacacttatataatgatgtctttcttctgattaggcacttaaattagctgtatttaatggaataatgatattaaataactttgtaaatcaaaaggtgaaaatatatgcctagaataaattatcaagactttgtccagtataatgagtggtgattattttccagtatactcttcaatttattactgtaataatcttttaaacccattaacagtcaatttgctctgtgatattaaaatgttagccacattatttgcctgttaatgtaggttaaatgttaattatgctgttgtatggcggctaagatggtacatccagaaattacacataatattggttggttctttggccgtcatacactaatgtgcttcattattattgtgctaattttagtaattttagtacaaactacataatactctgtgttactaaaacagaactacccatgatatattgcttgcaaccaaacattaggcaattttggccccatcatttaggagtagtttacatgactaaacaagtaatgattctgtaactctcaaacttgcatttagtgtatttagaatgaattgcttagtatattttaaatatttgtagatcaaaatgtaatcccttttaaaacaaatgtaagtcat

SEQ ID NO: 30638 - DNA, 1097 bp, Homo sapiens
tctctacccttagtacagaatattgcagaattttttctcctggtctcactgcagtttcatttcattgttcctttgttaattttcctttgccttgatgcacttgttgacttaattttatttcgcggcatgaatttgcatcatgaatttgcatctaaagtctggaaaaagagtgtaaacaaccaaattgcctttataatgtgagtgagaccaaggcacctctgggaaaccaaaggcctagtcttagatgaagaatttggggaaagattgtcaactgaaatgtccatattttcatgaagtctctcagtgtggaagttcagtagaattaaggtgttatctgaatcagaatccctggaaacaacacctgagcataggtatttttttgaattataacatgtaaaattaaaagatggcatttctggcatggaaaagagcaagttcaaatgacctgaaaagggaaaaagcttggcatggtttggaaagagtgaaaagtcacacatggctgggacagaacgagtgaaagggaaaggtttgggagataaagttgagaagtagacaggccagatgtcaggcagagccttacaaaccataataagacgttgcatcccatttcaaacacgctagaaataccgaaggtttctttgttaagtcaagtttgttgaagtagaattgatatacagtaaaatttacttttttagcataaagttctgtgggttttgataagcacatggagtcaggtaagcatctctacaaccaaaacacaaaacatttctctcactccaaagagttctatcacatacctttatgatcaacccttcctcccatccccataccctaggagctctatcacatacctttatgatcaacccttcctcccatccccttaccccaggagctctatcacatacctttatgatcaacccttcttcccatctgcataccctaggagtttggctctgctttctcttgtatagttttgccttttccagaatatcttataaattagatcatacaatctgtagccctctgagtctggcttcttgcacttagcaaaatgcatttgctattcattcatgctagtgtgtgtacaccaagagttt

SEQ ID NO: 30639 - DNA, 1033 bp, Homo sapiens
tagtaccattcatatctatcttcatattctaattatgattaagttttaaatagcagttatgtctttaaagtgaatgtgtgttatgttctgccctaaatataacttaacattgcaggtagaactctagtgtttgaaaatgtttagaagtcagaattgcaattactgagtgtgggataaatattagctataaatataattatgtataaatataatgaatataaatattagttataaaaagtataagcctcttccaactcttaatgtttataagtctactaaaaaattaaagatttctaatagtttaggagttgggagggaaaaaggaaaaaccacaaacaatgatgttggaatgcaagaaatataatttgatagtgcagaggtgagcaaaaaggtctgttgggccaaattcagcaaaattcaatgcagaaaatatttactatctgacccattgaagaaaatgtttgctgatccctgtatgtcatgaaaagataaacgtgaatttgatttgaatggcaaaaagtagaggtatgaagtaaaatgcatatagtccaaaatgtatatagtctccacagagccataaagatactccctgagactgcacaatttataaagaaaggaggtttaattgactcacagttctgcatggctgtggaggcctcaggaaacttacagtcatggcagaaggtgaagggaaagcaaggcacagccttacatggctgcaggcaagagaggaagcgaaggggaagagcttcttcaaaagcactttaaaagcatcagctctcctgagaactcactcactcactgtcatgagacgagcatgggggaaaccacccccataatccggtcacctcccagcatgtcccttccttgatatatgggattataattcgagatgagatttgggtggggacacagagtcaaaccatatcatagggatttctccagaatatttgtgttgtgatgctatcttacgtacttatttttaccttttaaataaaaattggagtgaaaatggcagagtcagaaattaatg

SEQ ID NO: 30640 - DNA, 1046 bp, Homo sapiens
caaaagatgaattcaactaaaatgaaaatgattttggagtagttcataatattagtatatcattgatgtgacctcctatttttggacaagatttcgaaataccatataataggattttttatctattgaatgatattctactgcactatacaagaaagttaatatgggaaattaatatttaatttccaaaaaaccatataatctttgatattgctaattcttttatggtataaattttaatatgtatttgagatatatcagctaaactgacaatctataatgtcagtatcatatagcacaaatggaaagaaacaccctttactggacaaaaatatatacctattgtaatgacttatgaatgaaattttcctggcccaaagatccttacctgtaaaatgaggaggttgtagtagacacactctaactttcaaccatgacatatacattgtatggctgatgactttgtgcatttctaatttattccatgaccccacttgtttaatttgtttggattaactatatgctatttgtttgtactgagattttgttttatttttttaattacaggttatttgtaaaagactatagtgtattatggcatgtcacaggctaccaagcatcaaagccataaagagttaaactttttacatcattagggtaacattttctaaattacttttcctcaggagatggaaccctttcagtctgaaaatgttaatgctccctcttcccttcaaaatgggtcatttgctcttcttgcctattggtagaattagctatattatagaatccagaaaattttaaacatctgttatgaatttaaacaggtttaataatataggagaactttttgaataaccttatatgtcatttagactgccatttatttataataagtctcacaattgttctgaataattaaaaagtaatttatcctgggcttcctttttatttcattaaagatatgcaaagtcacatgcagtatgtaaaaataaatctatatactataatccatggattacttaagacttttaaaaatctttctt

SEQ ID NO: 30641 - DNA, 1020 bp, Homo sapiens
cgtcctccagcccccagaatgttagatccactgacagcttgcactgtgctgctggaaaagccacagacactcaatgccagctagtgaaagcagccaggaggggggctatatcctgcaaagccataggcagagctgtccaagaccatgacaacccacctcttgcatcagcatgacctggatgtgggacattgagtcaaaggaaatcactttggagcttaaatatttggctgccccactggattttggacttgcatgtggcctgcagccccttcattttggccaatgtcttccatttggaacggctgtatttacctaatgcctgtacccccattgtatctaggaagcaactaacttgcttttgattttacaaccccaaaggtggaaggtacttgctttgtctgataagacttcagactatggacttttgaattaatggtgaaatgagttaagattttgggggactgtttgaaaggcatgattggttttgaacgtgaggacatgagatttgagaggggctggtggtggaatgatattgtttggctgtgtccccacccaaatctcatcttgacttcccacatgttgtgggaggggccaggtgagaggtaagtcaatcatgggggcaggtctttcctgtgctgttctcatgatagtaagtctcaagagatctgatggttattataagggggaatttccccgcacaatctcttttctcttgtctgccaccatgtgagatatgtctttcaccttctgccataattgtgaggccactgcagacacatggaactgtaagtccaataaacctctttcttttttaaattgcccagtctcaggtatgtctttatcagcagcgtgaaaatggactaatacagttgagtatggtgaaatagctcatcccttgtatcacctaataatggagactcagacagctaagacccactctgtaacttgggaaccagaggctaaaagggccttttaccctttaaaacaagccttgcttgtggcacctgctcttagtctttt

SEQ ID NO: 30642 - DNA, 1670 bp, Homo sapiens
gtactgtgaaaataagtgtgcatatataatgtcataacaaaacatgtacaggttgttaatatgtatttctacaactagagtttattgacatcaaccagtatgttttggttactctaaagttgaaatattataaatactcttcccagtgatttgatgtgtgtatgttaatgtttttaatatctggaagctattattggaatgctttatatatgtatatgctgtatatatgtatataactcattttgaatgctttccatgaatcagggattgtgataagttgtttacctgttttagctcatttaatccactaccctacaagctatgtgccattattctcatttttataggtcaggaaactaagaccagaagagatggcttgaccaagtcctgtacctagtatgtgataatcagactgtaacctagccagtttgacagccaaaagccagcccgtgcacttagcctctgcagtgcaatacaatacattgtattgtatctaggaataagcatttggtatctattgtaccatctatgcatatatatttgatatatactgtagcttactaaagcagttttgattgagtggaagcagtggaatggacactgttaaaaagactcaaggcagcagaaactaaagatgttcataaatgtgaaacagaagaaaaaaatcaaattcaatctagcagaagttccccatcagaagtgattctcaggccaggcgccgtggcttacacctgtaatcccagtactttgggaggccgaggcaggtagattacctgagtccaggagctcaagaccagcctggccaacatggtgaaaccccatctctactaaaaatacaaaaattagtcgggcatggtggtgcatgcctgtattcccagttacttgggaggctgaggcaggagaatcacttgaactctggaggcggaggttgcagtgagtctagatggcgccgctgcacttcagcctgggtgacaaagtgagactctgtttcaaaaaaaaagaaagtgattctcaactcttagtccaccccccaacccacttgaatgggatatgcttagatgagatagtaacaatggctcagttataacttttcttcatagcacttatcgaagttataactacacaaaacaggacaatgtttgcttaccacactatatccccagtgccttatataattggcaagcttcaacattcacatcaggacttttctgctacttagatggagagtctttcagttatttttgtattcaccactgctttggaaagttgacattatagagtgttaatgtactggacttcagtatctcgtgtaatatattacacaaattatagcagttctcaaaataccaaagttatggtgactgcaaaccagtagaagttattttatgtttattatcttgtgttttgaaagcaggagagtatgggatgtgttttaaatgtttatcctaaatgattaaagtttgtcagtctctccatatttagatttaaccttgaatatctggaaatcctaccagtcccaaatacaatggatgtgtttttttggcctttatctgtcgtactgtcatttgacaaatctctcaaattatagaatttatttttaaagtctaaaatttacatatattccatgctcatgagagtatgaagatctctttttcagctgatgggagtac

SEQ ID NO: 30643 - DNA, 1133 bp, Homo sapiens
gtgtttatatttctacatgagtgtgtagtcatgtcataggtctttacattcattcaccattcactcactgacacacctataacaacatcattcttgcaagctccattcatggtaagtgccctgtacacataaacagcttttatcttttacaccaggggtgtccaatcttatggcttccctggccacattggaagaatagggattgtcttggcccatacataaaatacagtaacactgacgacatctgataagctaagaaaaaaaaattgcaaaaagattacgtaatgttttaagaaagtttacgaatttgtgttgggcctcattcaaagccatcttgggctgcatgcaggctgcgagttggacaagcttgttttatgctatatttttacttacttttgtctgtttagatacacaaatactattgttacagttgcctatggtattcagtacagtagcatgctatacaggtttgtagcccaggtgtgtagtagactataccatttagctttgtgtatgtacattaagtgatgttcacacaaggacaaaatcacctaatgatgcatttctcagaacatatccctgtcgttaagcaacataatgactgtactatgttagctgccccatcagaaccacagaagtgttggagagaggagcaatttccttaaagaactggctacgtagacaaaaataataaaaaataataaataatcacactacaaggaaaatgtttacattattttgcagattaccaaaactgtttcagttattctctactgatttttgaggaaaatatgtattaaaataaattattcgtaaggaagaagtattgctgtttcagtgcctattggaattttttccctctttcatctatataatctttgttaactttagtgttatgtgaaaattcttatacaactttcaaaagttctttggtttaaaatgtcatttattgacttctcttgcattgcctgctagctgatatggtttcactgtgtccccacccaaatctcatcttgaattgtagcttccataatctccacgtgtcatggaagggacccaatgggaggtaattgaatcatggggtcgggtttttcctgtgctgttctcatgatagtgaataagtctcatgagat

SEQ ID NO: 30644 - DNA, 1028 bp, Homo sapiens
gcactggcaaagactaaatggtgtattggcaagctgtctaagagaaaagaccaaagggtcttgtcttcatggagctaagtgggtataatcagtctcttattttgagtggctagatattcttggactagactacacatgtaatgttagatcactgatcctttctgattatgttgctaaattgtactgtatttcatacagcatttatgcctagcctaacttcagtctctactctataatcaagttttacttgattgcatttataatttaagtctaggctttcaactaatttaggaaatgacttggaaataaaggaagaaaggctaattataaaggtacatttgttttttgcgggggctgggccccacaaaaggtgtttgtattgtaggtcccaatgagtattgcccatctccacagcatctagtactcttactcctgactctttatattgacgaacaattattcaacaccttaaccaattttgtatctattgtctttactaatcatttgtgacatgtgaacttagtcatttgagagaaaaatctaggtcgtctagcgttctatttctttgtcttctctgaggaagagataatattcttttttttttttgaggcagttggtggtcttaattcttttctcttactaaacttcatgagatggttttgttcttccctattacactagagtattttgtttataggatttgttgtagctaaagtcaatattaaaaaactcttagtgcatttgtttgtattggccatcgttagaaacttagtattgcatttggtcttagttgtgactagcatcttttccccggtaattttggtctttattgctccttttattgattttggagtaaagtggttgggactatagttgttttatgagcaaagagatagattactaattggtatatttctgttggtagggatggaaagtgatcaggggaaaagaaataccctgttcccacctacattagtatttatatcagaatctagagggctgtagatgtgtagttttggaaaatggta

SEQ ID NO: 30645 - DNA, 1057 bp, Homo sapiens
ccatagggagacataaaaaatgagacactgtcacctgtaatttaggaattcacagttggggggtgaggacatacacatacacagatatttataaaacaaaattgaaatgtttttaaagataagttattcttggtggaaagaatggggaattttaactgtacctcagggcagagaccaggataagtggggagaaaaaccttcagattagaactgattctcaaagaatgaataggaggatcagtaggaatttactagctggataaagtgaaaatcggatgtgccaagttaaagtctgcctgtgggaactgtaagtagttcttcagggttacacagcatgtaaaggactaagaaaacgtgaggctggcaaggtagtattcctccctgtaatctatactataccatatgtaggcagtatgatatatatacatatatatgatgttaaagacattattatggtgtctcctccaatcaaaataagcctttagattattccaaaccactagagacactattataactaagatgggtcgacaatagattcccaagtaaaagctgatgcaattatccttgagtcatcagtgaatgtttcaaagcttgagtactgttcagataacttccagggggctcattattctgaggcttatataccttattagatttggaaagattataactgccttctttatgtgtgccacatttccccccttatttggataaataacattacttaataagcaaaataagtaatattttttcatatagcactataataaaagttcccataagcagtttttttaagcctagtttatttcttgatgtggaaaattgataaatctgttaaaatacacataattttgacccttctctcaaagaatatgagatttgtacctacaataataaatgggggtctagaagaaatcttaatcaccataagtttatgaatcaccataagtccattttgtattatggatagtgggcttgtcaaatgtgaaaattaaataaattagaagctaaaatgctatctattccagattattttcaagtttaagaaaaagag

SEQ ID NO: 30646 - DNA, 1026 bp, Homo sapiens
ttgtcaaaggcaatttgaagattctcaacattttatagaccaccttaatagacatagctatccaaatgtgtatttttgtttgcattttaattgcaacgagtcgtttaagctgccgttccagcttgcccagcacacaaaaagtcacaggatatttcaggctcagtgtagttttccagaatgccatgagctttttgaagatcttcctctgctgtatgaacatgaagctcaacactatttaagtaaaacaccagagtcatctgcacaaccaagtgaaacaattctttgggatgttcagacagactcaaatcctaatcaggaaaaagactcatctagtaatgagaaacaaactattagtctgccagtttctactagcaaatcaaggaaagagtctacagaaccaaagacatgtatagaaagtatggaaaagaaaacagacagtttagttcagaatggaaacgaacgttctgatgacactgtttcaaatataagcttgatagaccaaaagatgcctgacatagagccaaattctgaaaataattgtagtagtagtgatatagtcaatggacacagtgaaatagagcaaacacctttagtttcatcagatcctgctttgaaaattgatacaaacagaatcaggacagaaaatggttccattttgcccagtgttgtaccacaagaacacaacaccttgccagtatctcaggcaccttccaaaccaaatctgacaagtgaacatacttcatatggcttaattttaacaaaaccatacgtcagaccattgcctcccagttaccttgatgaacggtatcttagtatgccaaaacgcagaaaatttctgactgatagagtagatgcctgttctgatcaagataacgtgtataaaaaatcagtgaaaagattaagatgtggcaaatgcctgaccacctactgtaatgcagaagcacttgaggctcatcttgcacaaaagaaatgtcagacactctttggatttgattcagatgatgaaagtaagtcttctgtcttctt

SEQ ID NO: 30647 - DNA, 1108 bp, Homo sapiens
tgtattcaaagctttatatattcctagacctttgcttatctgttaaaaacaagacctagcatataacatatattagatgctcagtaaatatgtttaatgaataaaaccaaagttatcttctggaatcataatacatgagttctaatacaccctggtagatagaattatctagttcttatacttttatttgttgttgagatggagtttcactcttgttgcccaggctggagtgcagtgacacgacctcagctcactcctgggttcaagtgattctcctgcctcagcctcccgagtagctgggattacaggcgcccaccacaacgcccggctaattttttgtatttttagtagagatggggtttcaacatattggccaggctggtcttgaactcctgatctcaggtgtttcacccgcctcggcctcccaaagtgctgggatcacaggcgtgagccaccacgcctgtcctagttcttatactttttttttttttttttgagaccaagtcacgctctgtcacccaggctggagtgcagtagtgtgatctcggctcactgcaagctctgcctcccaggtccgcgccattctcctgcctcagccttccgagtagctgggactacaggcgcctgccaccatgcccggctaattttttctattttttagtagagatggggtttcgccatcttagccaggatggtctcgatctcctgacctcgtgatctgcccgctcagcttcccaaagtgctaggatcacaggcctgagccaccacgcctggcccctagttcttatacttttatgaaagacaaagaaggtgaagtgctcccctgaccccccaaccccgaaaaaagcttagtaacatgctgaaggtcacatagttttgttgtggtgacctggcctgttttgtttttaacagcaaagcccatgtgtttttcttgcactttgtttaccgtctgactactgccatttccttaatttcaaagattttcaacttgaatcctcaatttcttcacatgaaaaaatggaccatctagattagatggtttctaaggtctgctgtgattttaaagttatgtagcattgtggctgtatgtcttcacagcagttcaaga

SEQ ID NO: 30648 - DNA, 1032 bp, Homo sapiens
gtagttcatctcaacctctaaatacagcactgtgtataattcatgattaatataactgttgatatttttaaaatattggattttacaataaacacacaggaagagaaaagacgcgtttccctggcaacttgggaaatctattcctggaaatttgtcataggaatttatttccaagtcatcaaatttatctcatgtattcttggaatttagtttgaaccacatgtagtatcttcaatatttacaaatacttgtacagtatttatatatctggaatccattgctcatgataaaagagatgatactaaaacccaaaaactaaataaacaatgaattaagtgataggaaaatgggaatacagaattggaaagtccctgtcatgcagttactagaatataaggttgtctgggaaatgactattaactgttcctagagtgttactaggatcagactgtgatgaattttgtgtgccaccctaaaatgctcacatcaatcaaagacaacattttaagcaggtgatcagggaggatagtgtaattgaagaacaaataggaatcagaaagggcactgtaaaagttcccattataggttaatgggacctagaatgagccttttattctttggttatatatcttgaggatttagcatcaagtagaacttttattattttgttaagactccaggaagggctattcttaaaaatcaaatcttcattattttcttttcttttatgttaatcagattatagtatttattataaaggcacaaaacaaagagaagtcatatgtggaaaactgagtaacttgtaggacctatagaggactcagtgaacatgaaaattatctagtaaactaaggaaagcaaaagaaacaaacaaaagagtgtgtgttgggggacagaaaagtactctcgcagtagaagttattatatttcccttctgtataacagtcaatattcttttgggcctaaggttaagaataagctaattttttaaaaaatgtaaatggctacctcccttctcaatgtaaagtgaca

SEQ ID NO: 30649 - DNA, 1022 bp, Homo sapiens
ctgagaggggcttttagaaagatcttgaattgggctgagattgcaaggcctttttattcctgcaaaatcactggatgtgccacccttgggaaggacctgaactctaggacggccactccatgcagcaaagacaatatctgaaagggttgaaagctgcagggtgtctgctgacagcatcccagcagccggggctgcagtccttcaatgaagaggtattcaggtggcaaattgcagtgtcagcctcttgtatcaacatagtcgcacaacaaacatgattcatactaagatataaatgattaaagtttatatttaccaggatatttcattttagcatgagcaaaataaatgagccaaattacaggagtgattatagctttaggatcattcacacctaaacttgaaccctgccattgcctcttattcactgtaagcttcagtttcttcttctataatatagggatgatgatacctattttggaggatagtgtacagattagaggttatattttaagtaaaggacttaagcgcctagtacatagtgagcatttagcaatgatgacttatttttaatgagtaatcataaaattgatattaacttgattaacttttagtttgatactaaatactttgctatgattttgaggggtcgggggagaagggaacaataaggaaataagaaagctttcccagaacatctcatttatgttgctgctgatgctttatactaacctttttatcatattttttaatattattgattttattacattataatagcaatacctcatattcatatgatataaaaataatgtgtagatgttttgtgagttcccttaatatccaatgtatacttctattgaaatgtgggaatgaaactttgtaaataaactaaatgaatactagttgtgagtatcttaactacacacctgggaaatcgaggactcttgtccgatttcccaatcagacaagattgtgagctgtgggtctctgctgtagctgggtggcaggtataaatggaacac

SEQ ID NO: 30650 - DNA, 1022 bp, Homo sapiens
tccttgtcctactcctaaaatatttctctcattcaaaaattagttcatttatttgcttattcaatgagtggattatgtggaactgtcctgggtgttgggtatcagtaatgagcaaaatgaacaagtcctcattacctgtcccttagataaccacagtaactctcagatccatctgcctccattcctcatctagcccatcctaaacactcttgccaaagcaatgtacttaaatctaattgttgcttaaatctcacgagtgatgagaaaaacttccattatattccaaaccatctacatggtcattccccactgttctaattttctactattgtctttatagcacccagagtgattctaggaaaaagtaaaacttgtcagtcttctgctcagatcccaggattgggctaaactcttcaacccttccccttcctccttctcccagtcattctctttacctctctcctctgaggacatacaagatactgtctaccttgggattctttactgctgtttcctttgccttgaatgatgtttcctgatgtatccatattcttttattcaaatagttcaccatgaagtcttcctctgacttgtctcatcctttgaggttttatttaagtatcacattttcagtgaagacttcccaggccattcattttgaaatcttcccctcctctcaacatacacaactgtgtcctctctctggcttccgtcattgcttctcctgaaaacataacactatgtaagaaaacacattttaacacttaattttgttttgttgtatatctctcccactggtatggaagctccctgaggagagatttcaagtcatagatttcaagtcatcattttcactgctgtaatagcaccttatagagtcactagtgcataacaggtgtttgataaatatgtgttgagttagtcaatgaaagatcaacttcatctctcactgcagctgcccagtgatgtccaaactcagttggaattttgggggttttatgcctttttccatatcatttcac

SEQ ID NO: 30651 - DNA, 1050 bp, Homo sapiens
gaccaatcacggacatttacttctgactccaagggtgggagtgattgtgttccttaagctattcacttgtttttgctttttggatattgattcacgtaatggtcatcgtatcttgtttgcattccctatagaagagcagaaaattacgtgtcttcctgtatctgaaaaacatacatagatacgctctcttaacatgccttctaaatagtaaactcactgttttatttattctctttatgtaccctttttggtctactcttcaccttctaaaatgtattttattgtaatctattccatcttgaattgtgggaatgctttctcaaatacgaaaagccatacatacatttaaattactatttattgattgcctactatgtacccagtgaggaatataccatttgatcctcaccaaagccttacgaggtaaatcttattatcgttattttatcagaacaggtctaagaaaatttactaatttgaccagtgtcacaatgccagaatgtaaattcaggtctggctgactctgaaacctgatgcttttcataatataatatgtcaataattttcatctgaaatgcttctgcaagtcaccataatgagaaaatttgcaagttcctgctgccaaggggatggttggagaaattggttataagagttgagaaaaaaaagattggcaatggtggtataaaaaggcaaaaacctcatattaattagcataacatctctttctttaacataggattaggtaagcctctaacacgcaaatcttttcacagggcatctctggcctttattttctaggcatgtggaactgagccacacctctaattgcttctgcttctgtttccattgctcctgctgttgctgaggacatgattgataggagatgatggctagtggagaaccagggctcagaaagacacttgctatgtgcccaatgtgtatgcttgcacaatatgcttcattattagcttgacagatctccaagtggcagattgggaatgaattttggacctggctagcatttctgttacagacattgggttttta

SEQ ID NO: 30652 - DNA, 1166 bp, Homo sapiens
agacacggtggctcatacctgtaatctcagcactttgggaggccaaggcaggcacatcacttgaggtcaggagttcgggactagcctggcaatcatggtgaaacactatctctactaaaaatacaaaaattagctgggagtggtgtcatgcatctgtaatcccagctactcgggaggctgaggcaggaaaattgcttgaatcctggaggcggaggttgcagtgagacaagatcatgtcgctgcactccagcctggtcaacagagcaagactctgtctcaaaataataataataataatgataataaataataataaaaaaataaaaagcatacactttctaaatactctttgatgctgaaaaatatagacgggaaaggttaaagagtggctgtgattagtgagattagctttccagtttaaataaaaatttagcaatcaaattcagttaaaaagaaatggattactttaaggatgtaaaaatgtgaaagttatttggaaattatcaagttatttacaagtgaaattatccatcttggaatagctatgttaagatctaaagacgtgaaggtagtaatttgtaatcacattttatttgctattatttattcactggtcagtcatggctatgattatgtgctactgcttcgatgcctgtaatgatcagaaaaaaaatgcctttataatccagtggattctatgactggaaaagtcagtgaaaatattctatgaatcctcggaaaatactctttacttactccaaaagattttggtgtgttcgaaacaattttctaaaattacactagatacgaaagtaaaccttgtggaacctttacattttcaaccaactgtaccatgttatacatctcagcctgttgcatattgctacatttctcttagcttaatagctattgtgttctctaagatggtgccagtttataaagtttggtcatagtagcctaatgtattttcaaagaaagttgcattttttccccaaataattttacagaaaacgtctttggtaaaattgctaagtgaggaacacaggcttacaaatacatcccctaggtatgccataagttcatagtgaagttctttacactttcaggaacactgaggctgcagtcagagcctaccctattttaggtacatagttttaatatgctga

SEQ ID NO: 30653 - DNA, 1048 bp, Homo sapiens
atgaataaaaggtggtatgttaatacaatgaattactacactacaatcaagattaataacaaatgacattaaaactgtgtacgaaatttagcaatatagtattaagtaaaacaatcaagattaataacaaatgacattaaaactgtgtacgaaatttagcaatatagtattaagtaaagagtaagtccttatgagaacacatggacacaggaaggggaacatcacactctggggactgttgtggggtggggggaggggggagggatagcattgggagatatacctaatgctagaggacgagttagtgggtgcagcgcaccagcatggcacatgtatacatatgtaactaacctgcgcattgtgcacatgtaccctaaaacttaaagtataattgaaaaaaaagagtaagtccttaaattcacatctataatagtaatttttttaaataaaattaaagaaagctacatttttttatatctaaaagcaaaattaccatgtaaacgtgacttagaatatcaatagcccagtgtgtagggagacagggatgaagtgaggaagacaatatgattagatgcatgtagttgttatcaagtgtacattctgcatgatagatttacagatacttattgcagtactgaatgaatgtaattatgaatcaatgaatcaatgcatggatcgaatggataaatgaatgcatggattgataattgaacaaatatgtaaacaaatacataaatataagccagacatggtgactcatgcctgtaatcccagcactttgggaggccaaggcggttggatcacttgaggccacgagttcaagaccagcctggccaacaggccaacagggcaaaaccctgtctctactaaaaatacacaaaaatcaacctggtgtgatggtgcgtgcctgtaatcccaggtgctcaggaggctgaggcatgagaatcgctcgaaccaagaggcagaggctgcaatgagccgagatggtgccactgcacctcagcctgggtgacaaagcgagattctgactcaaaacaaaacaaaacat

SEQ ID NO: 30654 - DNA, 1030 bp, Homo sapiens
ttcttctgaacagagagaataaggaagtcttgttcttacatgaaattaagtactttttaatcctatgtgtcagtcctcatgtggcagagattttaatctgcaccaaaaatctatttgcaatctccttttcccagtatcccttgcagttatatttgggtccagagggtagttcttaccaatgagctgtgagtaaaagtgactaatgccacttttgggtggaagaagttaagaattgtgttgcttcttcatttgcctattgcctttgccatggagagcttttgttcttgaaacaatcttcctcattcattaattcttcaaaggccctggttttgtctccttcctcattattttataagagcacatgggatatgagtggtcctggcattgagaagctttgacatctcacttcctcttgtttcctgtttgggctttaatttctttacatattgaacggcggtgacattttaatttttgctaaattcatggtttctttgttagtacagtttcattcatcgttattagcttctgatcaagcagttgtttagatttattttttattttttattagtattagtagtgattttgagacagggtctggctctggcacccaggcttgaatgcagtggcacaatctctgctcactgcaacctccacctcctgggctcgagcaattcccccgcctcagcctccctagtagctgggactacagtcgtatgccaccatgccctgctaatttttgtattttttgtagagacgaggtttcaccacattgccctcactggcctcaaactcctgagtacaagcaatctgcctgcctcagcctcccgaagttctgggattacaggcagttgtagcctttaaactaagcatttcttatagtgataagtttttgctgtttctatatctcaggataataacatctgttttgacataattcaaataaaaaataattgtttcctggccaacatgttgccatttcttactataacaaccacaagattcacccaacattcactctaatgctacaatt

SEQ ID NO: 30655 - DNA, 1061 bp, Homo sapiens
gtattttttcttcattttataggtagcggtgcttgtgtatgatatagatggtttgggatgggatggtttagcagaaatgcttcttgatttttgtgtagaaaagtgacacaatcaggcctatgacttagaaaaataaatgaagatgcaaggaaaacaaaccagttgacacactaatgatagcccaaatgagagattataaaggtctgaaataaacctggggaaatgagggagatgacctttcagagattaaaaccagaataattaaaaccatgaccagttctgtgtcatgcatttgggaaaaaaacagaaccaatacattcatcagtttaagggaatatttacacatattgagttccttttggttccagaaccaactcagcatcaacaataccaacaggcagaggggaatagaggataaattgaccagaattgaataaaggagcaaggggggagttgtagctcactcaaacatgagaataatttaaacacatgtggaagaaaggatgataataccattgatcaagatcaaaaacatgaacgcataataagataatatacagcattttagaattgatgaaattaaggcaaaaaacaggtattctatgcgggtggttgtacaaagtaagcaattgaccactaagatctgattcttgagaaagatcttaaatataatttgtatatttgaaagccatgaaagttgaagagaaaaagtgtagataatagagcatggaatttaattttaaaatagcatcaaggaaaagatcttgagaacagcaatggatacctgctgagtatagacggagtcagctttggaatcaaagcccagactttaactgggaaacagttatctacaaagtcatttatgaaatcttactctgtttttgccctctcacttagtcctcctcaaggaatataagcctaatgagggtggggaattgttgttcactttgttcattagtatgtattttgttcattttgttcattagatgtgtttcctcagcaactaaaatgtattggatatttttaaaaattctatcaaatgaagatgtagccagttagca

SEQ ID NO: 30656 - DNA, 1047 bp, Homo sapiens
aatttcaactatttcccttctttacctgttcatttctcatctctcaaaagtcagttcttgagtcacttcctgcaggatgtttcccatttcttcactagagtgagctggcctcccgtgtacccacataggaatcagtttctagctctgtcactgctcttataggtgaagtgactcctcaaaggcagggacctagctttatccatgtttgctgaactcttgataaaatcattgtcagattaatcacattagcatatagtttcaatcacataacttagctcctttaaatagtggcttccattacagaggagaaaaaaacaaaaacaaaaaaaaacttcttagcctcgaaattaagattcctcttatgtggcatcacacaaatttccaatcataatttcctttactccttgttacaaagatagatatatctccttcctattctccaggatattttgaaaatttggtaaccttcacctaaaatacaattattctatatgcatgtgtttaaaattttttaattctgcaagactcagactaagtgccagcactttgttaatttttctctaattcttctcagctggaaatagttgtccttttatcacaactcccatagggctacagaatcgtttatctgtatttctcttatggtgctcctctgttctaatttgtattagaatgctacttcatatgcatttaatctttcttactgcactctaggttccttgagggcgtgaccaaggcatggctcacatttgtctccttcatagtggctaacttgggccttatccaataggcatttttatatacattttaagtgagagagctgtaagaagaagaagagctgagcagaagatttcagtcctagtggtttcatataattagatcagaatactaaagtgtgtgctgttggtagttgtggaggtatggggttttttaaaaaaattattattttaagagaaaactgagtgaaatttgggggcagaatttagatcataagtgttagagtacattatttaaagcaatcttcattaattaaaaaaagacaaagca

SEQ ID NO: 30657 - DNA, 1032 bp, Homo sapiens
ataatactacagagagcaagaaaactgctctctgtagtgaatgtgtattgtttatggagaacatagtttcatgtgagttaatactccttatcttcagctttataatctattcagtttttcataagcttatgatttgaaataatggttcgggtttactatttttatttgttgcaattgatatgacaggcactactgctactacttttactagtgtagaacataaagagtttgaaactacaatgaagaatttaaagagtttatgagaatgtatgtatctatcttttcttaaattccataataattttgctcgtttgaaatttcacctgtagtttgatttttttttttacttcaaattaaatgtgtacaatgttggtttattattcttttatttttaaagccagagcaatttgatattatttgcttgccatagaataagataatttttaaaaatttctttttatctgatttagtattaattgctaaatttgaattgtactttgtagttaacagtgagctttcccttgtagcatcttttaataaatttgttatattgacagtaaatgtaacaattaaagggaattgaaaggaaggaacaggcataacatttattgaatgctctattaaggagcagacactttttaaatggctttatatatattataaattcatgacaaatgacaaaattttctaaataataatatataattctcaatcatctttattctcttcctgtttccctcaatgatggatggcatcatttacaatatggttagatagaaaagagataagagtcttgaatctgtgattatttcattattggagctaaactaatccgtctaataagctacctattagcagataatggaaattctctaatgaaaaggctaaatgtttcatgaatattgaatacattctgggctaaacagctaactcttggccaggtgcgatggctcacacctgtgtaacaccagcactttggtaggtggaggtgggaaaatgacttgaggccaagagttagagactagcctgacc

SEQ ID NO: 30658 - DNA, 1044 bp, Homo sapiens
tctctcaaatctgttatcccaatcattgttgcctctccgtttattataaactgtatgctcacaacttagtgtaatataccagcttgtatgcaatggattttcaaccagataacatacctttcctgctctggtgcttagagactatcaactccctcctttagtgaaggagccgtgttagagcttccgagaatagctccactggagagaagtggaatcctatatagaatgctgcactaattgacaacacagcctataggccaatgcatgagtaaaaaaaaaaacaattactggctcactggctttgaaaagtcacttactattgttgctgaaacttgctgagctgtttatagagaatgatgataacagaacttttcctctgtatcactggtgtttaggtgaattaattaaacattgtgatcattagtaccaggtattattatctttaagagtcttccacttcaatgcacatggtgcagttttggtgtgtaacttagaaggattgaacttctttgaatttactggacataacattttcagaatagttggtcatctagcaaccgcctcaaaatgtgtaagcaggagagaaatttctcatcacagggatttagacttactattacataaaggctaactatgagcttgctcattaattttgaaaagatgtacctggtggatatctagctagtaatatattctgaagcaacattttagctctattgatactctttctaatgctgatatgatcttgagtataagaaatgcatatgtcactagaatggataaaataatgctgcaaacttaatgttcttatgcaaaatggaacgctaatgaaacacagcttacaatcgcaaatcaaaactcacaagtgctcatctgttgtagatttagtgtaataagacttagattgtgctccttcggatatgattgtttctcaaatcttggcaatattccttagtcaaatcaggctactagaattctgtattggatatataagagcatgaaatttttaaaaatacacttgtgattataaaattaatcacaaat

SEQ ID NO: 30659 - DNA, 1033 bp, Homo sapiens
gagtgttcaatttaattcatcattcttagtctttccttttcttagcagcttttgtatatatactctctggaatgatttgtttaaagagaagagttcagagaaaggagaatgtattgatttccaagtagaacagataattgaattttcttaataaagcattattaaaatttagctgcataacccagagtgtattttcttctttaataagcaccatctagatttgtcctgtccagtagggtaacaacgagctacacgtggctgttgagcacttgaaatgtggctagtctgaattaagatgctgtaagtgtatgtttaatacatagtgggctttgaaaaaagatttattatgcaaaaaagtcagcatcttatcagtcttttaaaagtatgattacatgttgaaatgataacttttgcatatgctaggttaaataatatattagaattaacttttttttactttttaaaaaatgagattactagagaatttcaatgtatatgttgcttatgttaacatttctgttggatcttactgctctggatcatagcctaatataaaggacataggtaaacatctcaatttggataactgtcaaagaatttgaacacaagttggattacccctgtcttctaagtccccttgttcaatgcctgatttataatagtggctgaataaatatttgccaaatattgtatgtagttcgatttttcttagtaataatcatcctgaagtaaataacattagcaagtagttccatttattttactggaataaatgagaggtgagcaagctaattttaaaaacaaaattttgtgcttttatggtgttctctattttttcaacagaaattgcctgtttgattattatgtatatatttgttttctgtagaatttcttattaagattcctcttcatgtttatattttatgaagatgaaatgtgaggagtgaatttgtaaaagagatgatgatggttattaatatactatatttgagattactttgcagatttgtttaatacattctgtaccccagta

SEQ ID NO: 30660 - DNA, 1034 bp, Homo sapiens
tctgaactctattaaattattctgaattatttattttgttaagttgctttattccttattaatttggtacagatactgtgcactgcattactttatattcttagtatatttgtgactcttgtggcgaataggctctgtcttaatgggaccagactattatgtttcagatttgaatacatgcagagatgcagaggctccttgatgcctttgatctgctaagagggaatagtatctgtattctagacaataggaaggaaaatttaaaaagatgagctgcccctgcttttaagaatacccatcttctacttacattttcctggccagaagttagtcacatgcctatgcttagatgaaagagaggtatagttagccagcatagttctctttgaatctcttgatgctttttttcaatataagtaatttttataattaaatctatatcattaaacggctttatatcatacgtactgcatctcattgaatattgaatatatatcatacatattacatctcattgagtgtatctcattgaatgctggctagtcttctttttttttttttaatttttaatttattaggtctttttttggtagagatggggtctccctatgttgcccaagctggtctggaatgcctagcctcaagctattcttctgccttggcctccaagagtgctgggattacaggcatgagccaccacgcccagcccggccaggtaatcttaatttaatgctttgtgctacaatatagcagtatctatgctagtgactttgttgggcacctagaatgtatcaccagtcaggcatctaaagtgagtccccaaccccggggccgtggaccaatatctgtctgtgggctggttcttaggaaccagcccacaaagcaggaggtaagcagcaggccagtgaacgaagcttcatctgtatttacatcctctccccattactcacattactgcctgaacattgccccctgtcagatcagtggtggcattagattcttaggaccatgaaccctatgtgaactgcacatgc

SEQ ID NO: 30661 - DNA, 1047 bp, Homo sapiens
aaatatttaacaacacatcactggctagcctcccctcatggccaccccttgctgccgtagtagttggggattatggtctgttgtaagcagtcatgagcctaggtaaaaaaaaatctaggattctcttgactatcagatagtgtttcctaatagggaactattgttatttttggtgcgaaaattctttgcgtggactggtccctagcattgttgggtattaacatgtcttcattatattgtagttatttgtgatttgtgaagaggaaaaaaaaaacaaaaaaattatagttactcatatatatatttatgtttcatatgtagttatttgtgtatgtgtgtgtgtgtgtgtgtatatgtatatatatatatttccccaatagactaagagctctatgggatcagaagatggattttattaatctttgtatttctagaaccatgcatagtacttagcttataagaaatgctcaaaaatttattgattgtatatttgcattttatcttggactttctagagatgatgtcttaccacatatactctactgaaattctcaattggagaccatgtatctttgtattcctggttcttgtatgatttatcatctataatgggccctaaatacatgtacgaggatagatggataaatacatgaaaggaaaaaagaaagggtggatgtatgggacaggagcttcagttatctcagtggtttggtggtgtagtattgagccctatatactttgtgctgaatgctaaggatacaaagacatagtcccatgtgttgggaaggtataggctattgtgaagatcagtagaggacagaatattatgatagaggtaaaggtgatagtagaagtaggaggaatcatcaaaaaaggatttatggggaaagttgtacctgaacatttagtcttaagttgtgaaacacaaatgctgaataggaaccagaggaaagaatagaaggtgttccatatatcaaaagaaacaggctttggaagtcctgaagacctctgtttgaggcctgtctctgcctgctatataaccttgaa

SEQ ID NO: 30662 - DNA, 1124 bp, Homo sapiens
aaaatatagttctcccttctctgttacaattatgtagcttttatgtgttcactcacaatgaagtcttcatttcaagattttatttcttctctgaaagcctttctagaccataacttgcccctccctttttcaccttccttcccttgaattcctacacactatcgtctctagcttattttttttaaagaacatacaaattctgtgttattcctattaatattccacttctctatattacattgtactttgaggacagcaatcatatcttactcatctttgcacccttgatgcctaacaaagtcctggtaccaaggaggtgtttgatacatgttagttcccttattcctacttcagcatagttgatttgttttcactgatgattgcctggggttcctctctattcatactgaaagacagctgcctattttatccacacaaactacttctggttaagcttagatcacatttttaaatgcctagtataatcctatttctggaaaatcattctgcttatatgtctaactttacctttttctttttctaggtaatgaaagtattagcaaaagtatgacttgtagtggctcttaactttctcaggtgctgtgtaaacttcactaaggtgcttaccaagagattggtgtgttgcaagtctgtttctcagtcacacctaagtttagtgaatgcctttcaaattaatctttgtaatagcaaatgttttgctaaatgtggaaataagaccctctaaacaccggtgttgttcagtagaactttctgcaatgatggaaatgttctatattggctctgtccagtagggtggaccactagccacatgtgacttttttttttaaactctagatgttacccagactagtctcaaattcctggcctcaggtgatccttccgcctcagcctaccaaagtgctgagatttcaggcctgagccactgtacccagccaccacatatggcttttgaacacttgaaatgtaactgatgcaactgagaactgaattttaaattttattttagtttatttaaatttaaaaagcctcgtgtggcttgtggcttttgttttgaccatgcagctctgaacaatgttttctgtgggataatatttatagtggat

SEQ ID NO: 30663 - DNA, 1033 bp, Homo sapiens
ttcatatcccaattcactatgtgcagtttctgtgacctggaacaggttagttaattttgttgcacctcagtgttcatattggtaaaattgtaaaaatagtgtctacttcatactttatctactctgaaataattggaacaatgagtaggacattgcgaatactttattcctctttgatattactgttgttgctgccaccatcaccacctcctcttccatcctagtccaagccaccatcatttcttcctactgcattaactttctaattgttttctatacctatgtgcttgtcttctactcacctctcccaaatccattctaacccattcttcatatggtagatagaatgatctttttcaagtgtaaattatataatattactattaggtctagaaaaatctgagatccttgtgttgattacacttgtgtgaacttcagacttctttccatggcttacaaaaccttacatctagcccttgctgacctttcttaacctcatctcatatctcactgctcttttctgactatgccccagctggattgttatttttctttgcacagagttagtcagaccctcctcagggtctttgtactatttgtttcctatgcctggaattataccctcccttgtactcattcagatcttcaagtaaatttcacctttcagaaaggtcttcgctgactacccaatctaaagaagcaccccttgacagtctctgtctcatttcattgcccttttaagtctctgcccagaacttaacattatctaatatttgtatttatctgctttctccattagaatgtgagttgcaaaactctattcccgtgttgtgtgaatttagactgtatctctagcttatagtatagtatagcattatcttaaagtcatggcaaaatattcaagaatacagttgcctttaatttgactttatctgccagtctgtaatacattgccctgtatggacccaagttcaagaaagcaataccttaactcatcttcttattccttaagctagattcagctcccagttac

SEQ ID NO: 30664 - DNA, 2086 bp, Homo sapiens
tgaatgatactaaacctggaacaattatgaaaggaagattagtcaggaggaatattagacgatactatagaaagaattgccagttttaggtgttaaaaagttgtttttgtctttcgtgtttaatattattatatatatatatatataattttttttttgagacagggtctcgctctgttacccaggctggagtgcagtgtcatgatctcagctcactgcaatctccacctcctgggttcgaagcgattctcctgcgtcagcctcccgagttcctgagactacaggtgcccatcaccatgcccagataatttttgtatttctggtagagacaaggtttcaccatgttggccaggctcatcttgaactcctgacctcaagtgatctgcccgcctcagcctcccaaagtgctgggattacaggtacaaaccaccatgcctggccaaatattgtataaaatatttgatgcttatccaggtatagatacttaaagacatgtaaaactattgggaagtaatgtggaaactttttaccatgtggcaactttgtgaaagcagaattatcacccatgttttattatatacatctgataagaactagtcttcttttcagtatagagaaaatttgatgttaaagtaggttggcttagtaatttatcttgtatagcttcctagtgttcattttgtggtttagtggtatttatgactccctaatctataagctctttctagtattactatattgatgctgaaaataaattattccccaaagtgttgaagataccatgtcgcatttaatatagccataagctttttaaataagctttttaaaaatgttattttttccctcaaattaataatgcatgtacacaggttaacaagtcaagtcatgtcaaggcttctaaagatatatatctgacccttacctgccgtaccacatcccctttccaattctccattccttaaagacagtcataaaggcagtcattttcagctccttagctatatgttgcatctaaactcctgtttctaggtaatttgcatgtgtaggtatttttgcttcttcagttttattttattttattttttttgagacagagtttcgctgttgtcacccaggctggagtgcaatggtgtgatctcagttcactgcaacctcctcctccctggttcaagtgatttctccttgcctcagcctcctgagtagctggaattacaggcgcctgccaccacgcacagctaatttttgtatttttaatagagatggggttttaccatgttggccaggctggtcttgaactcctaacctcaagtgatccacccgcctcagcctcccaaagtgctgggattacaggtgtgagccaccgcacccggctgcttttttggttttagttattttattgaatttcttctatggaagatgtggatttaatcttctctcacacccccattcttccctcaccttcccccttttaatacagttatatcacaaattttggttaatcaatattttgtgtttacattattgtgactacccaaatattatttatatgtgagtcacctaaggtactgtagctgtatttcctttctcaaataattttttaaattatttctaagttttttcaatggatagagatagaaaatgaatatatttaagaaaacttcttattgacatatttatatatacagaaagtcccccagaacataaatgtatattatggtgatttttcacaaagtaaatacatccatgtaactaccacatagatcaagaaacatataacatttaattttaagaaaatattaattaccaaagtttttcacctgcttaattttgtacatacatcactaattcattctaaaactgaagtgaattgaacatatcctcttgacatatttaaatatagaatatatatatttttatttcattttattcatcttttgaggctcctttcctggaaactctaatgtaacctgattgtgttagaattttcttcctcttttatattctctatttttgatttccaattcctcacctttcttggtttatctccttgatttgggagtgtaccatagctccttttcaaaacata

SEQ ID NO: 30665 - DNA, 1093 bp, Homo sapiens
gcacacttaagtttgcgaacctctttcttaaggaaagaggttgtcatcctccaaaatagctgaaacagatacgccaggctcctgtgactcaccatccatagtaagaggcagtgaaaggagaaagcagtttcacgtattagccctaaattgaaattcacatggcacgcttccagtcgcaggtgttacatttcaatccacccattcctcacataggcaactccagggtgtgtagcagctggaatttatttaattgaccatagttaatgaggctcccaaataactcagctagaaaggtcggctagtaaataaattaaatatttcctgctggatcacctgtcagttgatatgagtttgtgattgttaagagatggaactcttggaccgaatgcaaatttaacagggtaaagctgctgggggaaagcctgcaccatcaatccataagtggtttttaaatcatccttggttttttatcatctgagccactcatcgcctcattaactccattactgtagagttcactgtagttagttttccataccttttatcttcatcagaagaaaacactcattccctctaacacccttttatgataatacttttccctctaatattaatagtctctaggaaattgaatattgtctctaagaaaaacacttccttgtgcaaagagtgatgggttcattttgacagacttagaggtatttaaaggcaggctgcctttttttttttttttttccaagatgtactgcagggagggactaagctgagtgtaagctgaggcatacctctctggtgcagaatttaagcctcaaaaacctcagtaatcataatgttaacagtagagggtcttgactgcaagttgtccaggttcttggagttttgaacaaagaatctgataaaacacacagcaaagcaaggaaagaatgccacaacagaagagatttattgaaactgaaagtacactccacagtgtgagaatggccacaagggccccagatacagaatattcttgggtccgaacacccattagaggttttccattggccacttggtgcttacctcatgtaaatgatgtggtggcccgcaatcagtc

SEQ ID NO: 30666 - DNA, 1042 bp, Homo sapiens
tggttttgagattaacccaatttgttttaaaaaggctttgtgttaccacatacaattttctcatttagaaattaatgtgggcagttaagttatacctgcctaattttagaaagataaattatgaatgtcgaaatgaaaggtaagcagaagaatcagccaacattggcaacattatagaaattaatttaaatttgcattaagccaggaacatattgtttgtaaattatgaggcttctatgtacttttgtacagctttaatgaaaaagaatcatacttacttgattaagcattggctttgctaattgtggaactaagaccaaaatagtcattttcatgggaggttggaagtatctgaattcaaatattgcctatatccacaataatctaacatttttattgtgtatttctctatttttaattgtttaaaaatacataacataaaatttgctatcttaaccatttttaagtgtacagttcaatagtgttaagtacattcacattgttgtactaccaatctccagaactcttttcatctttcaaaactgaaagtcgatatccattaagcactaactcttcattcccttcacttcttagcccctggcaaccaccattctactttctgtctctatgaatttgactattctagatgcctcatataagtggaatcatgtgatatttcttttttgtgactggcttatttcacttagcataatgttctcagggttaatccatgttatagcatctgtcagagttttcttccttcttgatgctgaataatatttcatcatatctatgtatctgtctacacattttgcttggcagttcatccactgatggacacttgggttgcttctatcttttggccattgtgaataatgctactatgaacatgggtacaaatatctctttaagaccctgctttcaattgtttggggaatatgaccagaagtggaattgctggagcacataataacttgatttttaagtttctgaggagccgtcatattgttttccatagtggctataccattttaataatcta

SEQ ID NO: 30667 - DNA, 1050 bp, Homo sapiens
ttttctggtagaaaattcaaaataaaaggtaaagataaattgctaaagactgcttcagcttgagttgtacctgtttcttcatgtatagatattcaacacaagtgtgggtatgtgtgagtgtcaaaatttgtcaagaagcatatatagtgtcatatttcttatttaagatattttaattagttatcacaataatccttcaaggaaggtattttaacaataagtaaatctcaaaaccttttttgatgttcttctttatgaaatggccttttaagttacattactacgttagccttatactgaaatttaagtatagaccacctcagatttaaagagtaagttgaaaacaaataaacaaataaaaaggatctttcggcagacgccattatcctctgtttctctgctgcaccgacctcgacgccttgcctgtggcccacttgttcactgactataggctactgcagcactggggtgtcagttgttggtcccacccagaacgcttcagttctgctctgcaaggatatataataactgattggtgtgcccatttaataaaagaatatgtaaactgaacagccggaagaaaccttcccgaacactgaaaccaatggtgaatttggtaaacaccctgcagaagatatggaagagtaacaagcatttaaaagatctagaaacactgatgagatggttgaattacgcattctgcttcagaccaagaatgctggggcagtgattggaaaaggaggcaagaatatcaaggctctccgtacagactacaatgccagtgtttcagtcccagacagcagtggccccgagcacatattgagtatcagtgctggtattgacacaattggagaaattctgaagaaaatcatccctaccttggaagagggcctgcagtttccatcacccactgcaaccagccagctgccgctcgaatctgttgctgtggaatgcttaagttaccaacactataaaggaagtgactttgactgcgagttgaggctgttgattcatcagagtctagcaggaggaattattggggtcgaaggt

SEQ ID NO: 30668 - DNA, 1055 bp, Homo sapiens
tgcctccatctagaagagattatgatgatatgagccctcgtcaaggaccacctccacctcctccaggacaaggtggtgagggtggtagcagagctcggaatcttcctcttcctcctccaccaccacctagagggggagacctcatggcctatgacagaagagggagacctggagactgttaccatggcatggttggtttcagtgctgatgaaacttgggactctgcaatagatacatggagcccatcagaatggcagatggcttatgaaccacagggtggctccagatatgattattcctatgcagggggtcgtggctcatatggtaatcttggtggacttattattactacacaagtaacgattcccaaagatttggctggatctattattggcaaaggtggtctgcagattaaacaaatccgtcatgagtcgggagcttcgatcaaaattgatgagcctttagaaggattggaagattggatcattaccattagagaaacacaggaccagatacagaatgcacagtatttgctgcagaacagtgtgaagcagtgtgcagatgttgaaggagtataatgcaagatatttttttcttttttatagtgtgacgcagtattctggaaagtttttctaagactagtgaagaactacgtcttttttttttttgttatctgcttctgtttaaaaagccaacacgcctctgcttcacaggtgttctgcatttgaggtgtagtgaaatctttgctgttcaccagatgtaatgttttagttccttacaaacagggttgggccagggaagggtgtgcaaaaactaacactgaaattttgaaacagcagcagagtgagtggattttattttttgttattgttggtggtttaaaaaaattccccccatgtaattattgtgaacaccttgctttgtggtcactgtaacacttgggggtgggacagggaggaaaagtaacaatagtccacatgtccctggtatctgttcagagcagtgtgcagaatgtaatgctcttttgtaagaaacgttttatgatttttaaaata

SEQ ID NO: 30669 - DNA, 1436 bp, Homo sapiens
tttattatacatttacaatataaaataagtaattgtataattagtcattattgattagcatccaaagtacaaagataaaatgtttttatgcagttccagcagtgatcatctaattgttgtttgttctggtcttgggataatactatatctaaaagaaaatttcttgcacaaaaattatacataatccttaaggaactcttcttcaaacaaaaaataacttaaatgaatatagttgaagttaatttagtattcatgactatagcacttttatatgaatttcctaagggaaaagtatatatctattggtacaggggaaattaatgattaaattacatccttttacttttttgttacttttacatcacaaaataagtattaaaaaatattagagtagaaagccttttgcttctttgtttcttcactaatcattgttagtataaatgacttaagtacaaaagatataaatttccctctaccaaccctttttccctatcacaatttcagtaactctctctctttctctctcccacctcacatacacaaatgcttctgactgcatgctccatttgttctaaatggtgaaagaatagatcccacttcacactgttcatcaaccaaatcccaacagtaatagaaattttttcattgtacccttgactcaccattttgggtttacaaacatgctggaaatcaatatatatagttaggtgatcaaaatagtttgactttgtccaacatacattgtaatcaaactaatttaatacaggatcaaattgcgtatctctacagtgttctgttcaacttgtaatttaatcagactgacatttaaacaaactgaagatacattctgttcttgcattattttattgagtattgtgttttgtaaactaaaatttggattatggatttaaaaagaaagataaggcatgtgaactcatgatatttgggtaagtaaataaaacaataaagattgtaaaaattatatatggatgaagcaacaaagacactgagaaagtaacaggagagatgtgctatttgaaatgggacagttggaaagacttgtctttgaaggtgacattgaaacctcattctcagggaagagaaagagctcattctgcagagtgggaagaagtgcgtaacatatagtggaaactgactgagcaagggtctcgaagagaaatgagcttgacacatttgaaaaactgagtccagggtggactggaacttactttgcaaggaagagagttgcagaaagtgaagtctgaaagatagtcgggaaccagagtcctcagagtagaataagattcatgttaagaaactgaatttttatattatcctagataaagcatgaatctatagggaggttttgaccagttgagtaaaataaaccaatttacattttagtagcaccatgactagtgagcaaaaacttaatt

SEQ ID NO: 30670 - DNA, 1065 bp, Homo sapiens
tcagtaaggtacttgatttgtgtctccttatatttttctttaattttttactcattcaaagctgcataatcaaataggtctggaactgaatatcagttccatcccttattaacaatgaatttattggaaaatggcgtaatatctaggctttcctttaattatctatcgaatagcaaaaaagacactatttttgttttgaagatttatagatggggtttatgagcaggtgtccggccatacaacaattataataataatggtgtaatacccaaccttaatcaaattattaccatgttttaagcaatttagtctttatttcattcagtcatcacatctgaactaagaaatagttcatgttaattcaacaacacttcaaaaactgacataatgagtttgagtaatttgctcaaggtcaaaagatagtaagttgtagatttggaaatcaaacctagttccctacctttggaattcacgaacacaatcagcatttattaaatatataactattggccctgcattggagatacaaatatgagtaaatttagtcttagtcgtctgtgaatttactgtttaatacaaagagacagttgaatgtgtagagaaaagtgttatagatgtggtgatgaaagtatgtacagcttatcaaaggcttcaaaggaagtggtggtcacatctactttcaagtttcaagaaagactttgtataggacgtgaagcttgagatacaggttgaaacatgagtgggtgctcatcagataattagtagtacaaatcattccaggcagagggagtatcaagtgcaaggggatggaaaattcatatggggcagggtgagaggtgactggcaaatagttgggaatagataaagactgtgaggggtaatgaggcaaataatgaaggaaaatacacatgcatcgttgaggataagaagagccttgaatgctatgctaagtggtttttgctttatcaagaagccaaaagttcttgaccccggctgcatatcaaaatcattatagggatttttgaaaaaacacccatatttgagtcccacccagatttatctctg

SEQ ID NO: 30671 - DNA, 1096 bp, Homo sapiens
tgcttgatacaacaactgtactgggagagctaggatggaaaacatatccattaaatggggtaagtttaaatatctgaaaaattgctgtcttttttagatttttaagatctcctaatagttgatggaacagtgaattttgggccctacttgttatgaattttgacatataacttacatcccatagaaaaggttaaaatacaattagaactggtaatcagtgggaatgatatgtaaagctccttcctctctcctaaattagtaattattctttaatactgtgtttatacatagtgacattagaatatctcccatataaatattttccttaaatataaatttctgtgtgtaagtttatatatgttacatttatgttaaatttgataacctcgatgagtatttgtgcataaataaactttaaactactgtagtataaatggattgtgcaaatattaacaatttggtttttaatacagaatacaagtctactaaaatattatgcatttttgaacttggtgaaaatatacaaggtgattaggtttttgttaactgaaatagttgtatttaaaggcttgttaaggatgtgtaatttgcaaaatatagtttttcatggaccaacattttagctatggttgtacttgactttttatatatttttatatattttgcatcattttcatattacaatatatgtctacttctcattttcacactgagctaaaataaaagggtggtttctaaagcattttgctttgatttttgtctagttaatcaaaatattgaataatagaggcagtcacatgttttcagatacacttgggttagctttcctttttttccttagaaatggtaattttcttattaatcacattcttagttgacattttcacattgcttcttctattatatcttcaaatttaaacctcaaaggagaaattgatccaaatatgttttattcttttagaatctttcacatattgctgtttgaatttgacattttacaacaacagttattcactaagtgtgtattttcaactaaaatatcctatgaagagtgaaatcttcctctctttaacagcccatttgcttctttaaattt

SEQ ID NO: 30672 - DNA, 1071 bp, Homo sapiens
gaataaaagttgaatggtgaaaaacatataaagtgaatattcacaaatattgtctatacttttactgatttatcctcaatatttaacattagttgatagcactaagtttgccatcaataaatatcacttaagtgaaaactgaataaattgattattattttgagtattagaattattgtagaaagatatatttcacgcaatatacagaacacttaatatggtgtccacattctgcctaatttaattgaaatattgtctattattaggtttaagactttgtaggattatgttttcattatttcactgaaaatcttaaaagaagataaaacacttcagagggaaactatgaatgttactgtatttctttatttcactaaagatccatttctagcattttgcctttgtttataaacgtaatttggataacatttatgaacataatgctggatacaagatcaatatatgaattcaaatttatttctatctaccataaacaaacaaaaaataaaaatgtataacatatcattttcaacacatcaaaaacacacacttttactgcatgaactcatgtgcagagtctagagaatttgatctcatagaattagtgagtagaatagcagttagtgggggatagggaaggtacaggggagggaaaaagagacattggtcaatgtggacaaagttagagttaggaggaaagagttttggtgtcctattacacagtggagtgactatggttacaataatattgcatatttcaaaagaactagaattgcttttggcagtatgattatttttatgatactggttcttcccatccatgagcatggaatgatttccgtttgtgtcatctgtgatttctttcatcagcatttcgtagttcttctcgtagaggtctttcacctcctttgttaagtatattcctaggaattttgtttcattgttgtagctattataaaagggattgggttcttgatttgattctcagcttggtcattgttggtgcatagagtgctaccaatttgtgtactcgattttgtaacctgagactttactgaattcatttatcaa

SEQ ID NO: 30673 - DNA, 1266 bp, Homo sapiens
tcccttccgcactttaagatttgactgccctgctggattcccttccacactgccttagcagaggttctccatgagagccctgcccctgcagcaaacttctgcctggacatccaggtgtttccatacatcttctgaaatctaggcagaggttcctaagtcctaattctgttttttattttatttttccgtaagttattggggtacaggtggtatttggttacatgcatgagtaagttctttagtggtgatttgtgagattttggtgcacctatcacctgagcagtatacactacaccatatttgtagtcttttatccctttcccacctctcaccactcccaccattccccccaagtccccaaaatccattgtgtcattcttatgcctttgtgtcctcatagctttgctcccatgtatcagtgagaacatacgatgtttggtttcccattcctgcattacttcacttagaataatagtctccagtctcatccaggtcactgataatgctgttaattcattcctttttaaggattcgtagtattccattgtgtgtctgtgtgtgtgtgtgtgtgtgtgtgtgtgtgtgtgtgtgtatagtcaatcatcaatctatgtgatatatatctcacagtttctttatccactcattgattgatgggtatttgggttggttctatgagtttgcagctgtgaattgtgctgctataaacatgcgtgtgcgagtatgttttttgaataatgacttattttcctctgggtagatacccagtagtgggattgctggatcaaatgatagttctacttttagttcttaaagaatctccacactgttttccatagcaattgtactagtttgtattcccaccagcagtgtagaagtgttccctgttcactgcatccatggcaacatctattgttttttgattttttgattatgaccatacttgcaggagtaaggtggtatcacattgtggttttggtttaaatttccctgatcattagtaattttgagcattttttcatatgtttgttggccatttgtatatcttcttttgagaattgtctattcatgtccttagcccactttttgatgggattgtttatcttacagatttaagtttgttgtagattctggatattagtcctttgttagatgtatagattgtgaagattttcttccagtctgtaggttgtttactctgctgactgttcccttttccatacaaaagctctttagtttaattaggtcccagctatttatctttgt

SEQ ID NO: 30674 - DNA, 1043 bp, Homo sapiens
gcatagatgaacaagaaacaaaagcaaaggaaagtgcaggaaaagaaaaaggagaacccccagaaaattcacaagtgtttagtagaagcttttgcagacctcaacaagcttcctaaaaatttggaaacatggacccccaacaccaaaaggttttcattaatagagaagaatgttcatggtgtattatctacttacaagcaaatctgtgatgaatagaagaaacaaaccaagcaaaccaccatggacaatttctgaaaagtgtgacacctcctctggaagagcctcaggcaggttcttcagaaagtattccagaaggcattgccatcatacgaaatggcagtttcatgcctgcttttgcccctgaagacctttcagtgggacaggataaggaggtggaagacagtgatattgatgatcttgaatctgtgcagacttaagctaatcttgtttttttttcttagtttttcacaaaaaattaaaaaaataaaaaataataaaggttgtagaataaagatgtaaagaaaaaagtatttttgaacagctatcccatgtttgtattttaagtaatatttttataaaagggccaacatttaaaaaattaaaagtctgtaaatcaaaaaatgttacagtaagctaaagttaatttattattggagaaagaaaaaaattaaaataaatttagtgtagcctaagtgtacagagtttataaagtctatagtaccttacaggaatgtcttaggccttcacattcactcaccacgcagtcactgactcactcagagcaacttgcagctctgcaagctcccttcatggtaattgacctatacaggtgtgctactttttatcttttatactgttttttgttgttgttgttgtaccatttctatgtttaggcacaaaaatatttactgttgtgttacaatagcccagagtattaaagcttctagtgtttgcctgtaatcctgggcatcccctggtttataggtgcatcgctctactttgatctgccatctttacatgtccatctttcctccgtgtatatc

SEQ ID NO: 30675 - DNA, 1064 bp, Homo sapiens
ctaggaccctccgagctaggtgtgggatataatctcctgctgtgctgttattttaagcccgttggaaaagcgcagtattagggtgggagtgacccgattttccaggtgccgtctgtcacccctttctttgactaggaaagggaactccctgactccttgcgcttcccgagtgaggcaatgccttgccctgcttaggctagcacacggtgcgctgcacccactgtcctgcgcccactgtctggcactccctagtgagatgaacccggtaccttagatggaaatgcagaaatcaccggtcttctgctttgctcatgctgggagctgtagaccggagctgttcctattcggccatcttggctcccgctgctcttggttttaagttcaagtttaaaagtaataagtattcatatgttcatttcctaagcctaggagaactctgggatacaaaccagggtattccaaaatgaccttgaagggactttttttttttaactgaaactaatttcgagacctaaatttcatagtcaacttactgtgcaattgcacaccagaacttattcctcctatctaactctaactttgtatccattgaccagtctctcattatccaccaccagcctctggtaactactattctcttttctacttttataagatcaactcttttagatgccacatatgtgtgagatcatgcaatatttgtctttctgttcctcacttatttcacgtcctccaggttcatccgtgttgcagcaaatgacaggatttcattctttttatgtctgaataatattcttttttgtatatatatatttttttctttatccattcatctgctacctattgtattctatatttcaaaatatctagaagggaggattttgtatgttctcaccaaaaagaaatgataaatttttgaagtaatgtatatgctaaatactctgatttgattattatacagtgtatacatatatcaaaacattatactgtgccccaaaatatatacaattatgtgtcaattaaaaacaaacaaaaacacaaagatttttaatatcctgaatttc

SEQ ID NO: 30676 - DNA, 1086 bp, Homo sapiens
tccaggaaggaagaaagataggagttaaggagttgacttactgtttctcagcaacctaggaaactatggtgtacttggtttgatataaggacagactaggtgggtatacttaatcttgacagtcaaggttcttggaaaatttaattatttctcatcactcagcctgggtacttgtcctcttgttctccattgtactaggaagagaccatcatcattcagcattcctcactacacccatccagacaagaaggtgagctacttgtggtctgacgcgtgttaaatagcttgataagcactgcctagtacagtgcctagcaccgaatagctgttttctaaacttactttctgctatagtttggatgtgtcttgttcccactgaaactcatgttgcaatgtaattgccaatgtaatggtattgtgaggtggtagggcctttaagaggtgtttggatcgtgaaggctttaccctcatgaagggtttagtgcagttctcacagggctaggttagttcttgtggtgctgagttagttcttgtgagagtaggttattataaagaggtttggccctcttcgtttctcttttgcttgtgcttcttgcctttctgccatgttataactcagtatgaaagattttaccagatgttgcttccatgctccaaaattgtgagcaaaataaagttattttcttataaattatcctgtctcaatattgttatagcaactgaaaatggactttctgttacccagtgttaacattatttgacctttgccagatgcatagtttgcaaaagttttctcccattttgtaggttgtctatttactcggttgatagtttcttttgacgggaaatcaaatactgcatgttgtcacttacaattgggagcaaaatgataagaacacatggacacatagaggggaacaacactgtagtatgccacagtgtctgtctgtggagggtgggaggagggagaggattaggaaaaacaactaaagggtattaggcttaatacctgggtgatgaaataatctgttcaacaaacccccgtgacacgagtttacctgtgtaacaaacctgcacaagtacccc

SEQ ID NO: 30677 - DNA, 1049 bp, Homo sapiens
aggcttaacaggaagcactactggaacacctcaggaaacttacaatcatggcagaaggcgaaggggaagcatgtatgccttaccctggcagcagaggagagagagagtgaaaggggaaagtgccacacactttcaaacaaccagatctcatgagaactcactatcatgagaacagcaaaaaggaagtccacccccatgattcaatcacttcccaccaggcccctcctccagaatttcaagatgagatttgggtggggacatagacacaccatatcagtgcactaaagaaaaatttatacatatgaataattatccagttaagtggagaagacaataagatctaaggataaaatgtattacacagagtaaccatgtagtgtttttggtacagacatgtaatatgtgtaataatcacatcagttttaccatattttaaattaggtagaaagccattacttggtaaaaaaaatacagttttttaaatatttgaagaattatttaatctaagaatttatgtgatttgctattactaaatatttgtatttctttatggcatttaccacagaattaaagtaaccaaccgtgatgtctagatttttttttacttaatatgcttgctgtgaaattttattcttatttatatgcctgcaaatttcttctatgatttggcaaagatagttttggacaaatgataagcagcatctgtttatctagagcttctacttgtgtgtttttatggcttgttatctttattatcctttatctgattgcagaaacatgagggagtcagtacagaacaattgttcatcaccttgtagtggatggcagaaattggaagatttaagtttgaattctatatctatggcttacaaacctcaaaatcaggtgttttttttaaatttataaagtagtggttataatcacctaaagatgaaatacatgtaaaactattaacaacaagcaaacatgcctgattctaattaaatataatgaattgctatttataaacaaaagaaatgtcagagtggatgtggagactacattatttt

SEQ ID NO: 30678 - DNA, 1045 bp, Homo sapiens
gatagtctcaatctcctgacctcctgatctgcctgcctcggcctcccaaactgctgggattacaggcatgagccactgctcctggcccccactattctttctcactctttcatttcctcattccagacatctatgccctcactttgaaatgcttcaatgtttgctgcctgccagacccaaagcacaggagccctaagtttctcattattaattaggcctgctctgccttctatttctcttcaggagtctaatgtggacactgctggagcaagatttaagcatcacttttgaaattcatgctgctgaggatgatgaaaatatatatagatatggattcatctggaactttgcttttagagatgataaacaggaaaaattacagtgaggctttagggatttttgtaatttgcttgaatgaatttgagacctcttggtcagctatgcaactaagacacaataagctgatttaaaatagaataaatctgtatctagtcatactccatatctactgaatgatgtatatttaaattgatgtatatttaaattgcatttaaataacttgttatgatattttatccaaaaagtcgtactactgaatgtttgaatttgtgattcctttttgcataatattgttaaggcttacctgtatccaaattctagaagcacaaaagagggcagtagacttttactcttgctgtatgaaccaggcttaaatagatagaaagattatattaagcatgtttgctaaaatttaaaagcaaacacgaataatttgggttgctttattatacatagtaagcagtattttagtcctctttcaaatctcagctgatatttcataacttttaattttatttcatagattcataattaagactgtcatattggacatgttgatgttacagatttaacattgttttaatttattctacttaatgtcagacttttctaaggttttgaatttaaaaataacattgatttgcaaagtattatgctaatttacatcaaatggtctttcagtttatatgtctaggactattttagc

SEQ ID NO: 30679 - DNA, 1049 bp, Homo sapiens
aattattttacacatatttaataccaagtttagtccatattttattctgttaactttaagactatattgaagtcatattcctgtagggctatagggctgtccttaatttaaaaagtcaaatttatgtaaataaatttacacacatttctatgggagcataaatttattcactatctctgtactctttccagacatgacttaccatgttacccatgtcacccactgaaatggctccttttcatgtgaattctgcctagaattttagttctaccttttaaacaagtgaaattaatatgtatatatatgcaatagttggaaacatcaatatatagtaacagtttttgtacctttcattttgtctatcattatctcctttcttttgggttcaaaagtatgtcttttggtagttcttttgataaagttctatgagcagttaagatttttatttaatggatatttaagaatagctttattttttctctccctcttcaatgattgtttatttagatgtagaatacaagatgatgatgatttttcttcaacattctgaaaatgttatttccccgtctatgagaatctattattgctaatgatctgccgacaatttaattgtcatttcttgggagattatgtataggttctgtatttttggtttttagttatatctgatgtgtctgggtgtggatttatttttttcctgcttttcattctgtgtttttaacctgagaaagagagagacagagaaagagagagagagaaagattgctttcttttattctgtatttctagaatttttattaaatatgtttgttggaaactttcaatttatcctgtctttgaaataatttaaatctcagcaataatttccaggtttagaattttcactttgactatgcctagttaagagtttacctcatctgttgagatatctttatcttcactagttttagttgttaactttttcgttcttactttttgtttcatttctgcctactttgttacataattctcttcctcttttatggttattttattctggatatatttta

SEQ ID NO: 30680 - DNA, 1790 bp, Homo sapiens
caggtatgagccaccacactggacttactatttttttgactttttaataatagcccttctgactgatttcaaatggtatctcgttattgtttttatttacatttctctcacgattagtgatgtggaacacttttcatatgtttcttggctacttgtcttttgagaagtatctgttagtatatttgcccactttactgggcttgtttatttatttatttacacttgttgaattgttttagttctttacagattctgaatattagacctttttcagatgcatagtttgcaaatatactctcccattctgtaggttgtctgtttaccctgttgataatttcttttgctgtgtagaagctctttaacttaattaggcctcacttgtcaatttttgtttttgttacaattgcttttgaggacttagtcataaattctttctcaagtccagtattcagaatggtatttcttagattttcttctacgattgttgtagtgtgaggtcttatataaatgtgcttgtttaaaaaagtgtgagttaatgatttatattctttgtgtaaaagtatacacagcatcagattataaataaaatttaaattatattttacttagaaatgataaaaaaaaagattttctgtgaaccatagactaaatttccagtaggttctcatgtttttctccctacatctatattatattctgcttttagcaatcctagatatatgtttattaaggtgtgatggaggcctaatatttactgtgtacccactacgtcctgaaaaaccatgaattgccattaattatcacagtctgtgtcaaacaatacataaatccttggaacacagtactatttataattgtgctgttgcttatatgaagggatgtacactcacatggaggccataaatgtatatacactttgtatacttagcttattatgttatgaaatatgtttaaaatggatgttctttgaaattttcccaaaattgataatcttgaataaaaactttttatgaagatatttctaaaataagtaatatatcttatctgcttaagatataaacaagaacctttgttttcaaccaaaataatagttatattcaaattatgaagcatgtttttgcataggagttttatgtttttgtttttggcatgggtcttcagtaatgcctcctgcaaacttatcattattgtatattgtcattatcttatttttgtacttctctttctctctgccctctccaccacccaatctgtcttatttttgccctttaaagaactgaatttatgctgaatggtgaatattttatcattatatttatttatatttgaactttcttatactgtgtacttgattaaactttcctgtaaaatgtgactatattttcccattttatacctcttgtcttttaagatagagataaacagatagagaaagagataaaaagagcgatagataggtcaatagatatccaactcattcattctaattcatcaaaagtaaggatttggaaaaattatttaccattaaatattaaaatgatttttcagaattttacttccttccttcctttccgtcctttctcctgccttccctccttccctcccttcctccctacctctctccctccctcccttccttcatttctccctttttctttcctctctcccttcacctccttccttctttccctcccaccttccttcttcctttcctttcctttccttctttccttcctttctgttatggcataaatatgcaaaacttatttggaggaaatggagaaaattat

SEQ ID NO: 30681 - DNA, 1026 bp, Homo sapiens
atgtgtcttaccaaagcagcttgctgtaggtatgggctgcattttttgtttgatactttgtatattcagatagttatttatatagaagttaaattccacaagtttctggtaatgactttaaacaattaatgtatcttccaacaataaaatcaacacttctgaatttgaatgaaaaaaatctgaatttttggcaatgattcaaagctttttctctgaatttcaaaagttttgacagaatctccactttaaattccctcccactctgttaaatttaactataataatgtgaacattccaatttcagaaaaaaagtaaattaaatataaaaagttctaataataaatagttatttacattataaattatgtatttactttaaaatgcatacaattcagttaaaatcaagagaccaaatgagacttatttataatagctctattaagtaataatgacataaaataaactgtattttaaagtgtgcagtttggtaagttttgacgtatgtctagagccgtgaacccatcatcacaactaagacaataagcatatctttcattcccaaatttttccttacgcacctatgtaattcctctctcctttcccttagtacagccaataactatggctctatacacttgtctctttatgttggttaacgtgttctagaattatcacaggcatctgcagtatccactcttttgcctgctctttaattcaatatgattattttgccatttgttcatgtaactggatgtatcagtactcagtattaaaagttcattacttttaatgctgagtagtagagcattgtttggatataccactagttgtttatccattcatttgctgatggacattttggtagtatcttgtttgtggctgttacaaacaaatttgttaagaacatttatagagggacagagcaagatggccaaatagaagcctccaatcatcccactaccacaaggacaccaatttaacaactatctacccaaaataagcaccttcataagaaccaaaaatcag

SEQ ID NO: 30682 - DNA, 1007 bp, Homo sapiens
ggtggggatgctcttccttacttgcagaagcccacattcttgctgtgtcatcacatggtttttcctctgtgcttgtgcacttgtctcttcttcttatcaggacaacaatcctattggtttcaggcctgagccttataaccctatttaatgttaataacctttgtaaaagccctatctcatatcacattgggggttagagtttcaacctatgcattttggggacacaatgtagtctatatcaccttgccttatcctttgccacttagatcatcacatggtcgatgccttttcattactcaggtgttatttctaatatcatttccttggagagttctccctcaactattgcttaatcacagtgtattgtaactctacaggacatgtctgaccctgttcactcatcactaaaattactatatacaaccagaattgtgcttgacacatataatgaagcattgagaaaacatttgttgaataaatgttttcttctaatactggtttatgggcataactatttctgaatgtgtcctttctcaaaggtagacacctgagctttatgatccatggtgttatcctaaaaaacagaacacaatattattatattaagtataccactgaatatagcaattggtgtcttgaggagttacaacatgtcattatttaaataggttatcatattttttccagtaatcaccccagctatattaaaatgaaacttctcccctttttctctctaggtagcatcttccttgactctttcttagacagatgctataacttttcagctacttgagttattagtttatttcattatttattgattttaaaatgccaatctcaaattatactcaaaggtttttctacatttcccatctgtgatgacagctcttatagctttaagagtactaggttgtgggtgggcttcaagacatctcttttcactcccacttctagatgccagctccatctgtgatatgacaagagcgggtaaatatcttcttacttga

SEQ ID NO: 30683 - DNA, 1013 bp, Homo sapiens
aaactgtacctgtaaccctaaaattaaaatgttaaaaaaagagtagccactagaagataagccacctccaaggaaaaaaacacctccaagggaaaaaaaggaaacagatgtactttttacaatagaatgtgttgattcttcttgaagaatactagtgtcagtaggattttagctatttttagtctgctaagaattggcatgaatagacattaacaggttaatgaagtatctgaaaataagtgaatccagttgctgtttaatgtcccaaactcaaacttttaatgctttataacagtctcagttccttttataactgcgaggaaatagtttctttcccaggggcatactgccttttaaaaaaatgtctatttttattaacatccctttgtggccgtaactactattaggaagttggagtaaattatcttactgatgacctatttctgtttctaatagttcttaatcaagaatgatatgcaattgggacacaaattttcttccttcagacttactccaaattcccgtatcctggtccccaaggtggaattgcgtgtctagaattccctttaaaactgtcaatagccgaattttcttttattactctctggcactttaaacaactttggcatcatttaagaattttgatgttttattttgaagttccaaaagtgggaaataaaagcatgcggagggtaggattaacaatacttgactggaccatctagaagtgactgaagaaactggttttgtttatatagagaggagaaacccaaagactgatttagtaactagctatatagagggcagaactaaattactgctttaatttccctggtgaatttgtagaatttaaccactttaaataacagtatccccatttgcaagatgaagataatatttctgctttatgactgtttggggaggattaaatgagacaatatagattaaatattgaatatagtagctgtaataataggagctcaataaaagtgtcttcctttcttttgtcttct

SEQ ID NO: 30684 - DNA, 1040 bp, Homo sapiens
gtgtaccactttattgaaattgcatttttaatcacaatgattgtagttaaagcattctaagtgtgtactgatagtaatcaaattattctaagttgtaaaaaacttgtagaaaataatgtagacaaaatttaacctaggaaaatttccaaactaattttagtggtataggtgagaagctggtcagtcggtcagcacgagtaaagaatgaagtaacactctgaatttatccacatatatcatggatctttaagaaaattcacatagagatattcaaaacaaattatttaaagatcactagtgagcaaacaaatgaaaacattctggttttactcataaaaagtggtagctgtatgatagtgtttggctgataagagtattagaatgctgaacatcctctatagaaaattgcacatattcttaacctagtaacaataaaagatgatgaggaatgtcaactcagatttaaaaacgaatccttacttccaaaagtgagagacaaataataaattaatgttcattctatggaaatgaaattgagattcaagtagaccatgtatttgataagagccccaaattaaagctgtatagttcaagactataaaatgctgttatgtctaatcaccccccaaattataatacctcttttgtcaagtaatgaaaacttgatatagaaaaggatacatcaggccgttgtggttttagaaatcaaacaatattttctgagaattgttctgagctaaaacaataacaaaacctcagactttggatttgaaagggtttaccttagtagtctgtttaatttattttttaaacttattgctgaccacaatctgcccatctgtgtcacattataaaatatattctaagtctacagtctaattgggaatataactttaggaacatgggaactttagggaaaaagaaactttcttgacaaggttgtatttaagcattctttactcaactgacataatcaaattattctgataaaaatgaaaatatagtaatttttggattatagtttcatgtttctatgaaaa

SEQ ID NO: 30685 - DNA, 1021 bp, Homo sapiens
cataaaagaggctccagaatgcttccttgtcccatctgccttgtgaggatacaagaaggtagccatttatgaacaaggaagcaggccctcaccaaataccgaatatgccagtgcctcgatcttgtgcttctcagcctcccgaactgtgaaatacacatttttgttgtttataagccacccagcctatgatatttttattatagctaaaacagactaccataaagggtgatttgaaagataaagtgtgaattatgtctttgattctttaaatcagtttctgtcttgttctatttttggtcaattcctattttatagaaatagtattaggccaaagagaggactaaatatgaaaatgctttcaaagatttcaaagaaaggcatataataaacaccaaatagtataataactattagtatccccattattaatgttgttattttcttcatgatgagcagagcaaaatcattattaaaaactgagctgtgagtgttttttgcattttaatctttctggcaattttcttacctagcttaaaaagatgaccctgacagctaagtcaattgtttttttctcccaacttggacgttcttctatttgagtccctttgtatacacaaagaaggattcagttcaaaggagaagagtcctagttttcaagtgacattcttgagctctattctaggcagtaccctttgctggagttttcccttgaactaatcacttaacattttacatttactttcatcaccataaaatatggttaataatcttcctagatgattgtgacaatcattaaatgaaaaggtatatgtaatgggcactttagatcctcttcctgtatttcagtactgagcaattgtacccatccctcagtgctgattgttggctgctgatagctcacagctgctcccttctctaaaagttgccattgactgggagctactaggtcagttatgtgactcgccgacccctggagaattccatggccattgatggactaatatgagaggttcaaaaggtc

SEQ ID NO: 30686 - DNA, 1050 bp, Homo sapiens
tgtgcaggggattgaagccaacttgctttcttgctgccattttgaaactggaaaatgtctgcagtgagacatttaaaggagttgtacctaacagcctaaatgggctggaaatgtttatcttattatcaacaacatagacaaaatatggcaatggatgtgctcagttagggagggcaggaaaacaagaaggcctaagactcaacatataagttggcaaactgtaaacatttaggaagaaggagactagaaagaggaagttaataaaggagagaaaatgatagtgtaggaagtatgaagggagaaaaacagtttaaacatgttcagctacatagaatgctgcaaaaaatgtgagttaaaatgaaatttgagagtggttcatcggaatttcaatttatagaattcagatgactttaaaatataatttggagagtggtagacacaagcctgttggagtagattgaagaatgaatgggaaatgaagaagtaaattagcatccatagaaaaattatgtagaagagatatagttagttggaatagattatgagagtcatggaacttttttttttaattgggagaaagtggaatattatgagtatatgtagttttgttttatttttaaaatatcttaatttggggcattttacttttagcttgtaatttcaaatattctggagaaataagatggtttttcaatgaatgtttatgtaaaatttacatgtattcggcagtaaagagtttgaaaactgacaattgtttgccacaagtttacagcttttaatcctgatgttttgttacagcaaggggacacttcgaagtaagttgttaggcagtaagtccttgtaatataattggacactgagcaaattgcagtctcaaagccagccctcgtaacctttatactactaagttcaataaaagtgcagaagacaatgaagaagaaacatgactcagaactgagaaaaataactgaacaacttaaaactggacctatcatcctgttgtttgagacatactattgactccagtaagaaaactggtagttaaattga

SEQ ID NO: 30687 - DNA, 1052 bp, Homo sapiens
aggggaaaatcctccccagtgatctaatcacctccccttaggcccctcctccaacactacaaattacaattcaacataagatttgggtagggacacaaatccaaaccatgtcagtacctgatacctcagtgagacaaaccttaatggccttggtcctagagatatgtcatagttgtccagggtataatatcaaagatctggatcccattcctgaggtagtgtgtgataatgtttgcatatttgtctccgcccaaatcttatgttgaattgtaatcctcagtgctagaactggggcctggtaggaggtgattgggtcctgggggtggatcccttattaatggcttaatgccgacttcatgatagttcttaggagatctggtcgtttaaaagtatgtggcaccctctcccactcgtgctctctccctttttcctgcttttgctgttacgtgcctgcttcccctgcaccttccactatgattttaagcttccagaggcctcatcagaagctgagcagatgcccaggctcatgcttcctgtacagcctgcagaactgttagccaattaaatttattttctttataaattacccagtctcaggtatttctttctagcaatgcaaaaatgccctcatacagtgtggttcttatctcagcccaaattattgaaattttgagcacctaactctttgaaaaggattgtacctattgctaatatttgttacacatctctatgtctcaggactctcttaggactcaatgctcggtgctcgcctccctgtagatctagccgtggttccaaccattagagaactcccctgctttcgctatagcaggcaaggttactcagcaggaggggctgtggactttttgaatctctcactaggctatgagtagaagagcatacacttagctccatccatatcagagcaagaagatcagacatactgccccatgtataaacagttcaaaataaaatcttgaccaccacctaaccactcacattctctgcagcaggcagtctagaacctgttgtggtgacttggcccagcactg

SEQ ID NO: 30688 - DNA, 1312 bp, Homo sapiens
caatctatgaaacaattaataagctatccatcactcatttgtttaacactaaatagtctcagtagtttcatctgctgacaaaacatcttgtaaacaaccactgggacatttaggatttggaaaatgtcactggagaactgcctttttctctaataaatggagcaaagaaatacttattaaatctcctccgtaaggagatatagtatgtatgtttatgtgtggcccagaatttgtggtgcttaagacttgacccctgctgtctaggaaatggctgttttgtagagaaggtaaaaatataaaaaataattacaaaaccaggcactatatgctctgtgccatatgatattcagtgttatgcagagtctcatagtcatgtcacctacatagaataacctggaatactttttaaaaatatctcttgacttgattcagtccacatccatggaaccaaaaactgtgtggaaattaggaatgtgtatttttaaaactcatttgatgttagatatgtacccccaaagttacatgataagtgttgcagtagttttcaggaggaagattgcttctagttaattctgtggttctcaatcttggcttcacacaggaattagttggaaggcttcactgatgtttaggtctcaccctcagagattctgatataattgttccagattgcagcctggacactgattattcacaaccaaacatagtagatgttatattccaaatgttatagtctgtgtataagaccattcatgatatcatacatctaatactcgatccgctagccatattgaactacttgaagactccaaagtcgtgataatgatgacaattaaaataatagtaatgtttaatatgtatttcgttatcattatgtgccaactataaatttgtttatcttcatgaaactcctttgatatgaatgctattattattaccattttatagatgaggaacagagacaaagtgacttggctatgtctacatggttaataggtgaccaaactgggatttgaacccaagcattctggctctacagtgcacactgttacattatgccactcacgcatatactctatttcccccatgcctgcctcatatgattgaactctgtcatatgtgtttatattgccttgagatatcttcctctaacctcctgtatgatgactgtttacccattttcagttcatagtttaatgtgacttccctacaggaatttttccctacttcctactctgaggagtgatgcttctgttgcagttagttgccaaagactttaatttttttttctttgtctgtccacattactgtg

SEQ ID NO: 30689 - DNA, 1306 bp, Homo sapiens
atttcattttcagatagtaggggattattgaggattttaagtaagggagtcagataatataccctgtttctaccaataacacttgataaactcaggggaccagctaggaaatcctgtgaacaagccttaaacatcccaagccatcttggatacaatgccatctctatcaggggaggcctacctccatctaactaaatacacattgtcaactatggtggtggacagaaatgagcaaaatgtgagggatgaaggagtggtgctaagcccagttccaagaggtgaggtatatataaaattagttgcaaatggcctgcaaagcatagcatattatctggccctttacagaagtgtgactgactggaagtgttaaaagcatagggattaattaagcgacttatataggatattacaatctatatgaagtaatgaaggtatgaatgaggtaataaaggtattttatcatggagccttttaaaattgaatctatcaaagttaatgccatctcggaataaacgactaggagtatagagcataaagggtgaagggttatagtaagtaagggtagaggttctgtagagagtactcacagggttagtctggtctagagaaggactagtaagttcaattcgagcagagctgtgagatcagatgtagtacatgggaacatgtgctggtactgagatagaaccaatagatgacccagaattggaaagaattaaaggaaagtataggaattcctcttctgaccacagtagacacttaaaaatgattactaaattaactagactggaactgacagaagaatcaagcgatctttaaatccaggtaaactatagagagtaaggtcctaagaaccaagaaatgttatgcaagaatgggcacatctcaaacagcctaggttcaggggagtaacctcagtcagccttaatatgagccactgagtcctatacaacttgcatttgtaagacactaaatgcactttcacatgatattttatttatatttcttacagaaatctgataatgtagtttaagcagacattatgccttccattttacatttatccgaatgagggatcatgagtatcttctcagaggcaaatttaccttatagctgaaaaagcttaaccttcagagtacctcattttcatgtgtctctttcaaagccctgtatctctatcttagagaaacgctcaaattatataatttcaggacaaacacaatcttgatcttcccttgtgtttcacctaacctagatggcattgggtgggtctgtaacatcagaaccagggttctttctgttataa

SEQ ID NO: 30690 - DNA, 1058 bp, Homo sapiens
tttcctctttaaaagactttaataagtgcatcattacagaatggcataaaatatgacaaaaaaatcactaaactgtgtaactgcttaaataaggagaggaataaatgtccactttctaagtcattatgtcattatacactgaaatgagaagaaaatctttgcatttagttttgaaaaacatcttgaatataacaatcaataataagaaagaaatatttcttataattattgcttcaaaaaggtatgctcagaaaaatgaaatccttttctaatttttacctgatactaaattttatttagcctgttttatatgtcaattatgtatttctgtatgtatttaaagattctaggtttcattgtaatggagtgattatcatgggtactttttttttctttataaacctttccaagggtaatgataccttcactttcttccattgccctctctaccatttaaaatttttgttactttcttaaaaatttcccccctttgggaaataatgaagatgattctgcttagctgtgtagactcctgattcgtagtagtggaatgggaactgggccaacacatttaatttgcatttctcctagaaaatgttgcagactaactctttaaaaagcaccaaatcagagatatattctaggcaacttgcatcagaatggcctgggttgcctattaaatatgaaagttactgtgttctagccaaaaacctattgaacctgaccctctgaggatgtagattagggacatctatttttaacaaacaaacttcccaagtgattcttattcacattaaagtctgagaacacaagcttatatatagcctacctcatttaagtcctaggagtgttgcaaatgtattatgatacagttgcaaagaataaaagaatgcccctcatccatagggggaacttgggaaatcttagcttaaaaacctctaccaattaagattcatgagtagaaatggtttgtttatagaaagattttgcctgggtcattaatttttaggaaggcttataatcttttaggagttagattcatatggaaatacacaagg

SEQ ID NO: 30691 - DNA, 1001 bp, Homo sapiens
gctagtatcatctaagagtaaggagttttttttttgttgttgttgttgttgttgagacaagttttgctgttgttacccaggctgaagtacaacggcgtgatctcagcccactgcaacctctgcctcccaggttcaagagattctcctgcctcagactctcaagtatctgggactacaggcaggcaccaccctccggccccagctaatttttgtatttttggtggagacggggtttcaccatgttggccaggctggtcttcaactcctgacctcaggtgatccacccaccttggcctcccaaagtgctgggattacaggtgtgagccaccatgcccggcctggagtaaggagtttttaatcaagttcttttattgttactttcaatataggtattcaaatgattttaattactcaggagcttaaattctcttattaaagtgaatttctccttaatcactttttgcctacaactggactttgaaaaatatataaagatccgtgaatcaattccactgatttaaagggtgttctaatagaggtagcttgaacaagacttcttagtgatttatcttatgtcagtaagattgtttttatattttatatgcaaagtgatttatcaaaaacacaaaagactcagacaaatcctggagggaaaatgtctttctgatctcaggttaacctcaagagcttgggttattcattctacaactggggcagcatggaggagtggggggacgcagattatctctgcctgaacagcggagtctttagatcaaacaccaaaaataggagatgaggaaaaagacaagccttaagtaaaatatacaaaagcaaagcagctggagaataagaaaactattgttttcttggatgtaggagcaaagagagggaccccagaagagaggaaagcaaatatatgcctcttagtatctgattttcagagtcattgaactaggtctctgagaatcaaatttttcttctcaaatgatttttctttgtaa

SEQ ID NO: 30692 - DNA, 1910 bp, Homo sapiens
taaaaatagatatctacttgctaaatttttgcatacactcagactgcacagctaaatctaaggaagaaaacttgtgtactgaatttgtcatggagttagctcagtttttctttaattctcagttcatatagaatcctcaatttatttgaaccatgtgtgacaatatgaatatcaagttttatcattatttgaggtaaataatataaagtgatcaatgattacacgtgtgctcctgtcagattttcagagaggctcaccctcacccaaaaatcctagcaagattatattcttccagaatgctctaaagagccaacttctctttcttcctaatatttacttcaattcataataacatattaatgcacagtgtttgataaagtctgtattcctcactaaactgcaagcttcaagagatcagagactatttttgttctctgtaattttctgaatatctggtccagtgcctgacacatagtagtatgtcaataatatccatttctttaatgaataactgaacaaatcatttaggttttgctgagatgatcttgataacccagaaaaacctgtcttttcttattagtgccgtttagaggtaatgacatttacattaatgtcctttaagtcgggagtacttctgataccaagtgatactggtcagtgcttttcctatttatatgtgttaattacatatgagggtccactcccctttttctcacaattgctgcctctggagaaagctcctgtacttcacaaaccacatttgcttcatcgtgactgctgcttcaggattcttccttttgactgttctcagaaagcaaataaatggaaaggagaaaagacttgattaaattctcaatttttttcatggttgtttactgctctaacctatttaaaatgtatatactcaatttaggtgaagtatatttgggttttgaaaaatttgctgccgatagaaaatatatatctgctatgaaaattaataccttaagctgtgactgtcaaaattctttgaactaatgggcctttacagagagtgcattatttagaatcgtttaaaagatgcaaacaatgcacgaggagattcataaagctataaaattattctaagccagaacagaatttccctgatctttaaagggatttagctattaatttttaaatgctgaacatagttgacatttcaaattgaattgttactgaggtaatcacattgaatctcttggttaaatgttcaaagtagagtccatgaaatatgcatgttaccaaatcaaggcaaagagtctttcttcagaatacatgatttttatttagataaaatattagatgccttttattttaaaataaaactatctcttaataggaagatgcacttactcttcaaagaaaacctgtgtgtagaactcaaggggtttgtgcaatgtttactctacaattcaactcattgcatatccattgtttgtgaaaaagtgaactgaaaacttgtaagactcgatttctgatatcaagatacttagactctgatagtatttggaaaacacactatttctaggaagtattacatatcacaaatattttccaagatcaaacttcccaaagtgtagtattgataattttgttgtcacattaaatgagtttatgtcatacatgagccaacatgttataattttaattcatttttaattttgtattaactgtcttccagtgtgttcagatcatatgatactatttatttttagtaactctctaaagtttaatttttaaagaaatatttgtaaaagcaacttgatttttttaaaaaaatcctagtaaataataatacatatggcatgcagatgctcacaactataaaatgattaatgaatggtaattgagaaacaactctaaaaactctttttaatacaagtttacta

SEQ ID NO: 30693 - DNA, 1057 bp, Homo sapiens
aatggtaaatttccaaagtgttcataatttagtttttgttgcctgccagtgtccatctgccttaggcaaaaatttaaattgcatactttacatcataaattcacatcctataatctcttgaatattaaatttgtttaatagatgtttaccatggactggataatactgtgttatatcagtagtacacaggtgagtaaaagacaatctgtgttctaggatcttcaaatttaggagagggaaactagtattttcaaacttctatattttagttttgaaatgagagatatataaagattgtaattgaaacgtgaaagctagacatttggatctgatgctgaaaagagaagagtgaagtaagtagaatctaggctattatggaagaaatgattgagactgaaattatcaggaaaatatatatatatatatataccaaagagaagcaatagtaggataaaatagggagccaaggagggaatggaagagaacccaagccaagtggcataagcaaactcagagaagatggcatgtagtaacattaaagaggagcaattttcaagaagcagaggggtagaatgaggaacaagaataagacactgacaacttgacctgattaacatttgagacaaccatttctatagtaaggggaatgggttgtgggaagaaggcaggctgattactgacgtgtcaagaagagagaggtaagtagcactagttcaataaagactcagggataggccaggcatggtggctcattcctgtaatcccaacactttgggaggctgaggcaggtgaggatctcttgaggccaggagttcgagaccagcctagccaacatgacaaaactccatctctaataaaaatacaaaaattagctgggcaccatggcacatggttactcagtggctgtaatcccagttactcaggtggctgaggcagagaattgcttgaacctgggaggtggaggcttcagtgagcagagttcatgacactgcactccagcctgagtgacagagcaagactccatctcaaaaaaaaaagaaaaaaaaaaaaaaaagag

SEQ ID NO: 30694 - DNA, 1145 bp, Homo sapiens
aggatattttttgttctgacaccattaagaaacagagattaatattattgctaagtcaacaaataatggaaacaataaagcagagttgcaaaattttagaaattattcttttcacaactctcagcattgttctctgaactctggatatctaaaaacagttactcatatcaaatgaaacttccaattaccatttagtaaatggaaacagaacagagttatgctttctcatacatgtctccatgatggactagagagtaaaactgataactttggaaaagttctcaatggtaccgtgttatcagaactagtttcatgatgtagaatagtgtctgcttttctaccattgtagggagaaaaattgattttctggtacttttttttaccagcaattaggactacttgcagcttcttgcaaaacaatggaattatattagttagtagaggaaaaaagggaatgaaagaaattctgagaggcttaggttatacagagtagaaaagagatgagcaaaggtgaattttaagacatgtagaatgacatatagaatatttcatatctagattgtttttgtcaatttgaattttttactcattcaaaaataaagataatgttcatatcaattaatatattaggcaaactggataactagatgtcgcatgttccagaatttttccaattttgtgtttaaactttgacttttgtcaaatttttactactgaaataatttgatttgttctggggcgtctgggtgtggtgccatacttttataggcaataatgatatgtttagcttctagaaaacctaaagcactgtaacttaaatttttctatttcagagtaaatactaaagatttttcagcttgatatgtatcattatgagaaacatagtttacatgacaccatgtatagaggatacatgtataatggaaacatgctggacatgtctcccctttttattgcaacaagtatattaattatagacatatctcatttcattgtgctcacttaattgtgctgctcggatactgcattttttttttttttacaaattgaaggttgtggcaatcttgcatagagccagtgcgttggctcaatttttcaatagaatgtatttacttggtgtaattcttgtagtgtttaaaaaattt

SEQ ID NO: 30695 - DNA, 1066 bp, Homo sapiens
tgtagatgtgtggtgttatttctgaggcctctgttctgctccattggtctatatctcaaacagatgcaatcttgtgataaaacttgaatggatgaggagttcttcttatggatgagcaaagaaaattgtttcttgagatgtaatctactactggtgaggatgctgtgatcattgttgaaatgacaacaaggagtttagaatgttgcatcaacttagttgatatagcagcagccattgtgaagacagtgtggcgattcctcaaagacttaaagacaggaacaccattggaaccagcagtcccattactgggtatatacccaaaggaatataaatcattctattacaaagacacatgcatgtatatgttcattgcaacactgtttacaatagcaaaggcatggaatcaacctaaatgcccatcaatgttagactgatgagcatacatgcatgcatatgttcattgcaacactgtttacaatagcaaagacatggaatcaacctaaatgcccatcaatgttaggatgaagacaatgtggtagatatacaccatgggatactgtacagccataaaaaagaatgagatcatgtctttttcagggacatggatggagagggagaccattatccttagcaaactaacacaggaacagaaaaccaaataccacatgttctctcttaaaagtgggaactaaatgatgagaacacacagacacattgaggggaacaaaacacactgggcctatcagagggtggaaggtgggaggagggagaggatcaggaaaaacaactaatcagtactagccttaatacctgggtgatgaactaatatgtacaacagacccctatgacacaagtttacctgtttaacaatcgtgcacatgtacccctgaatttaaattaaaagtaaaaaaaaaaaaaaaaagcaaccacagggtttgagagggttgactccagttttggaaaaagttatactgtgggtaaaatgctgtcaaataacattgaatactacaaagaaatttttcatgaaaggaagagtccattgatgcagcaaactttattgtcttat

SEQ ID NO: 30696 - DNA, 1048 bp, Homo sapiens
ctttattgtgaaatgcagtttattggggtggtttgttactgaacccacaatatctccatggtgtgcctgtaatttaccaatgcttcttatatactacattttaaaagataataacaatgttccaatgaatatctgtattagcactgcacttaccgaaataatgtaaccttcccagacctggttataaaatggattgcaaagtactatggtactggaaataactttcaaatcgagctgcaacaactcagtttggaagtgtgggggagggagttaatggcaggatattgcagccatttcatatactgtttttttctttgtaatgaaactattttccaaacaaaacttacctcagaaataagtagtttttctcatcaaaagctggagaactctccaaaagtgcttatatcacataattagcattttctataactatttttgcaggaggcatctggaagagaatattcaaagagtatgtaatgaacctaaactcaggaatgtataaaatgtgtaacacttataagaacagaaattactgtatatgaagaaatatagttgatgacttcacaaattaaactacaaaaaaagcagcttacagtgagaaatgaatattctcccaaactgtcaatttaagaacatagtgcttatatataaagtatacatgtttatgacacatacaatgtttcatatgtatgtggttttttgcttgtttgaatttcctgttcctttaaaaataaagataacatacatattgatatgaatgttagcaaaactgagtaattatacatcacatatttcaatttttttggaatatataggcttgatttgagcatttgagacaaagcacatagacatatgcttatatactttaatagttgtatttacaccataaggtgagaaacagactttaaaaagtaatgactcactcttttacaaaaactagaagtgcttttgtatagttttgcacctactgattttatgaaatgtggaggtgacttgctatagttttgtttagttttgtattcctcaacataatgccatattcatatat

SEQ ID NO: 30697 - DNA, 1052 bp, Homo sapiens
tgtggcagagtggtcactcaggacgtttggaaaccaggttttaccaattgatagaaaagtatttcatactttaacaatttgtgaagctgtaccagtgagaactggctgaatataaggtataactcttacatgtctgaaaaacagacaaaaactaaataaattactatggaaaaatagttaactaatatcaaacttgttgataagatgctgaatattacatgaccttttcacagtttgcttttttaacatttgatgacataatttttagaaattaaaatcatacttgagtcaaaagtctataggcttatttttctttactcattttttctgatggtgtatctttctgtattctttctgtaatctttctgatggtggtatatcaacaatctgaaattaatgcaaattatctttccccttgatgttgccctcaaaatgtggagaattccaaagtctcagaaatctgtcattttccaattccacacattgttttcaaaaggagctactcaaacaaatagaaatcaaaacgatctatgcctgttctcctctggatttgtgtatcagtagcttcaaatcctattatatgtaaatgataataaaatcttacattgctattcacgtggcttcacagcagagccagctttcaccctaggagtctctagaagtaggaagtgacttccctagagcatttggtaagcccatcaaactctaaccattttgaaagttgagtgagtcattagttttatgacctatctagctttaaaaacatggaaaactgatgtgatgctggtttaattgaaaacaaacagggagattattttcaccacttcctgaataagggataaagcaatataaatcatattgaaattttgtctgtatttaattactgagtagtgtgctgcaatttatactttaagtactaattattcttaatgtaattatatttaattattataattgctattcatatcttatgttctaatagagacatatcatatcgagggcctttttcacaaaattactatattcccttcatgctagaaaacagaatagaa

SEQ ID NO: 30698 - DNA, 1033 bp, Homo sapiens
actgagattcatccctaggcccagcctctttcagagataatacactgttcattgtgtgagcagagaatggagttagtaagttaagtaggaacaagacaggataactgggataactgaaggtacgtgttccaaatatttttcctttattttaaaaagttgaaatacatttcagttactctgaacattatcaaagtgatataccaagtgtttcctattatttcccattttcacttgtttgggctaaaatgtctgtatatttttgacattattgttgtaattttttctacatattctatcctaatattaaccactccctgaatattgtgctggagaaggtagtgagattttaaaataatcataaatgagaataagataaatgattaaaacagcatctctattacagaatgaaataaagattatcaataaagtctataattatttgataatggagtttagtatctgtgaatgtaaaacgactttataatgtattatgattcagattttcaacttaaggcacattgtctctgatctgtcattttttactgtggtgagtaaattatcataactatatttttggtcaattcaagcttttacagtaaattttgaacatataaattatttaatacaggaatagggaaaatgaatccaatactcagaaataaaaatgaattaattagaacatattagaagtgagctttgcagatatctattctaaccacttcattttacaaaggaagattcagagacattgagtggcttttctaaaatgtcactgataggatgaactcaactacaaaatctagttcctttgtccccatgatatgcccgctctctccaatttgttgtttgtgtgtctgtgtggccactgcataccttttgagtgactttatttaatttccaaataagttataatggatatttgactgggtgtcatgttgttcatgtgggaataacccaaaaggcccagtgtgtctcctctaaatgcccatttggagttcctgttcatccctgattcatttaagcaagtttttct

SEQ ID NO: 30699 - DNA, 1059 bp, Homo sapiens
ccatgctgttttgattactttatctttgaatcaagattgtgatcttagctgtatttgtttgcaagcaactgtgcatctaaatctcacaagatttcttacactagaaatgaatttggtcataagaagaaaccaagtatgaatggtgcagcataattattttattcttaaaaaacaaatcaaaatatatttcttatatgtggtagttcatatacaaagaactctgtatcattttttgctatattcagttcctttagtgtttggcacagtgtaatagtgcaatgaatatctctttaaaatcatccactgaaaagagaattatattttgtaaacttctttttgatcttcaaatactatttgaaataactagcttactaagagttgaaattcattaatttgaataaaatcattaaatgattatatttcattaagatttaatttttactgaagccagagcaactttatatacaaaagattatttcaaagtctcctggtgctttggaccttatttcagagaatctgtcaacttctgattcagaatgctatataatctgtgtgcatgttaccaggacacgtgattgaatattatttgtcttttttttttcatacttttgctctctggttcagttttggagactttcactcataaatattctataatcagaatttattttatttggaaaacaccttaaaaactacctatctcatcagctgtctaatgtgtacagtatgtttgacaaatgttccttcaatctgtacttaaacttttggagactgataattccctctttttttgaaatatctcaatataaagatcttacctaacatacatcttctcttgcctagtcttaacacattagttccttttctgttttttgctaagtggtttccagtttcctcaccatattcatttcagtttgaggacctactaggatccatttgtatagggtagaacttgtatatttaagaatcacacaaatatggctaaagtcctatttccagtctatagtacccatgatcttgggaaaattacttaacttccctaatattcaatttttgcat

SEQ ID NO: 30700 - DNA, 1057 bp, Homo sapiens
cagtttgggctgtgtaatactaggattattggcatcgacatctgtctttcccttaaatttagggaatttaagccaataagctactcccgtagaaatttgaaattaggagcatagaaactttggcaatacatgtgtgggtcctggaaatgttaaatcatgtagaggtggagctggaacagccattttcatgaaagcatgtaaatgttaagttaatagagaaaatagtcatcaaagagaatcaaaaggatagtttgaattcatagagagaaagggtcaatagaccgttgtggattagagaaacaatcgtactgaaatcagtttgtttcacttcacagaaaccaattgctaaattttcaggaagttttgcatctggggtggcttcaagtggacaagtgatttgaaatcagccatagtgatgtacttctgccatagaacttatgctccaaatcagggcttcctgttcctgagagttgttaaacgtttagctgcatacattgtcacagagagggagagacagagagagagagagagagagatctcctgagtagtttatctgatccttgatagcttcccagttcccagctctaaatccatgagaaccagcaatgctttatttctatggaatgcatttgtatcctgttaataaaccaacatttatgttctgctcatttagttcccataaaaaattaattgctacatttctaatcaatataattggaagcaaggaaacaggatggtaacttatattcatgtgaaatgccttatatgtatatgctgaagtctgtttcttttttgaccccatatagtttagaatcaatcccaaataacatttaatgccaactatgttgactccatagcaagacatctttttccagatgcgtttcagtattaatctgatcatcaccgagaggaaacttagggaggaataaagacaataaattcagtatcttaaaagatatttgagtattttattaaggattttgcatttttaaatatagagttgtgatcaattttggccatcacaggcatacagaaaagtttgccctgaatgattaga

SEQ ID NO: 30701 - DNA, 1031 bp, Homo sapiens
ttttatttgaaactaaatgactaccatattatttgattgctccttttaaattatacaatattgccatcctatgaaaaattattttagaataaagtactaattttaactgacttctctgtagctttagtagtgttggtctttctctcattttataacctctgtccttgaatattgaagcctgcatcctagtttccatgacaaagttttcttgattttattctatccttccttgacattctttcttagtgtagttttctctgtagtttacctgcactcattaattaaatgtgaatgtttctgagagttccaaaaacagcctctcattctctttgctgctggagaatatcacttagttctattatttccaatactctctgtatgataatgtctcccaaaccatatccctagcatctctctccttaactcttgtttccaataatcataagactattgggcatctctacattatttcctcagactcaggcatctcaacccaaactcttcaaaactgaaagattttcacagcttccaaccttcttaatccatgactcttgtactctctatattaggtaactcacaccaatagctaccttatcaactaagcagaaattttaaaatgatgcctcctcttctttttaaaaaatttttcatgttcaattttatgcatgtcctttagattctacctttctttgaaaactcttctttatctttagttgataatcttgttattttgtcttgattatactaacagctttctaattgtttcccacttctaattccttttacctccagttcattctctgcactactgccagaatactctctaaaatgcaaagatgtttaaaaagaaatgaaaagaaaaataattacaatgtgtggagtgatgtaaattgctcttttaattaaaaaaataaattttaaaatgcaaatcttatttgtcatgctcttccttgaaatcagtagggaaaataatcctcttttaacttcccatcctcaactcaaaaattgaaaagatgttggcaaagcacgct

SEQ ID NO: 30702 - DNA, 1798 bp, Homo sapiens
tcctgagtagctgggactacaggcatacacccccacgcccagctaattttcatatttttagtagagatggggtttcaccatgttggccaggctggtctcgaactcctgacctcaggtgatccacctgccttggcctcccagagtgctgggattacaagcatgagccaccgcccctggccgaaactattttttatgaagagttacagcttgcaaggtggccatcctgcaggctgggaaatatagcctctgaccaagacatgcactttgagggtggtaagaatgacagggatttacgctgagtgaggtggtcaaagacacatattaaataacgctataggagtcatgaaatttatgaaagcagaaacatgcacatgggcaattgagcttcatgcctcagcatgggacccatgtacaaaaaaatggccatgttagcacaacccaagggtggagttttcagccctctgatgtcaaaaggtgaagcagaggacgtagaaaccctcactgagcatactctggactggccagaactactccgtggttggtggtctcttatcaggaaggaagctggttagttgttatgtctaaaccacagaaagggaggggcagcatcagatagttgatatcagcggtggagtgggtctttaaaaagggctggcttctctttaacccttgaagaaggaagcttaatggtagtaaaggagggaggtgtgtccagcctctcatctcatcatcatagtcgggatcccagttttaaggtttctctggggtaagcttggccatgagggggtctgttcaataggttgtggaattcggattttatttaatttttatttttataacaatagtttttggggaacaggtggtgtttggttgcatgggggaagttcttttgtggtgatttctgagattttggtgcacccatcactcgagcagtgtacactgtactcaatgtgtagtcttttatcactcactaccctcccatccttccccactgagttcccaaattccattatatcattcttatgttgttgctcctcataccttagccaccagttatgtgagaacatatgatgtttggtttgccattcctgaattacttcacttagaataatggtctccaactccaggttgctgcaaataccattattttgttcctttttattgctgagtagcattctatggtgtgtgtgtgtgtgtgtatatatatatatatataatgtaaatgtcatataaatgttatatatatatatatgtcacattttctttatccacttattagctgatgggcatttggactggttcaacatttttttgcaattgcaaattgtgctcctataaacatgcatgcgcaagtgtcaaataatgacatcttttcctctgggtagatagatacctagtaggggggattgctggatcaaatgatagttctccttttagttctttaaggaatctccataccgttatccgtggtagttgtactggtttacattcccaccagcagtgtaagtgtttgcttttcaccacatccacatcaacatttatgattgtttgatttcttaattatggccattcttgcaggagtaaggtggtatcgcattgtggttttgatttgcatttccttgataattagtgatgttgagcattttttcatatgtctgttggcagtttgtgtatcttcttttgagaattgtctatccatgtcctttgccaactttttgatgggattatttggttttttttcttgctgatttgtttgagttccttgcagattgagttcctttgttggatgcatagtttg

SEQ ID NO: 30703 - DNA, 1034 bp, Homo sapiens
cttcaaataattttcatgtaatatagatctgttcttagtagcactaggctcttaaaaaattataaccttgaattatctgctttacaatacttgtcaaaatttgtactatgtgcaatataattcttagagaattgcacaaaactatgcattgcattcatttctttagttaaaacatgttacctttggttcaagctagattagcagacttgtgcctatgaaaaaaattacttcagtgtaatatgtgcattatttgctaagtgtcaatcatctcttctataaaatggggatattaataaccattttacagggttattgtgatgattgagtgaaacaaattatgtgaaatattaagtacaccccttacagttagctatatttttttcaatacatgcttaccaggtataaaagtgatcagttctgacagacgatagcaaggagttgtcacaaaggaggtaacaactaaatcagaatatgaagggtgagtaggaatttttcagagagcaaaaggcggtaaaggcaattcaggaacagtaggtacaaaggcaaaagggagctagaggctaaagaatggacgggggcctggtatgaagacacttgtagacaaagctgagaagtttaggttttattctggaaatgaatggtatttggtctattcgattttttgtttgcctgttttaactattaactttaaaaataaaataacttctaaaagttaactaaatcctgattgatgggactatgaaaacattaatgcataacaagttttgttttaggcatcaatttaattactaaaagtaggtgcaagcatatcaaagataatcagaagcaatccgttttgccatatggaatgcaaaagatttgaagtgtgcatactcctgaattttgagtaatatttactttgaaaacttaagtttcagttgctcttctgtatataaaattatttaaaccctctaatagcattatttaagggagtctcctataggaaggcaataatcagttactaatttgtatgttttgaaaatgtgtatttgaca

SEQ ID NO: 30704 - DNA, 1034 bp, Homo sapiens
cttgagcagatcacgaattgaagagaaaatcttgtaactatataaaagaagactattacaggcaatggatataaaaaggtcaaagccttaaattcaagcaggaatacgtctggaaagtaacaagaaagtattaatggcatatttattctttagcatatactaaatttcatgttcactaaatcctctggtgctatacctacattttcaacaatggattttaatcaacactaaaccatcctttaatagcaatttttctccgtgatcatacattgctaaagaaatgtgtttaatcctaaacttgattttgagcagttggcttttagagtcgtcagctgtgttctctgaggaattctcatttgcacattttgcaggaaaggtgactaagtattttatatagcataaaataataagaccttattgctgttttggtgcctctattactatatcaacaattttaatggcatttatctgtacgaattaaaaaatagtcatacgattctttagtaaaatgctttaaatcctgtaaaattaaaccagattagcagatgtttaactaaattgaaattaagtgtgtgcatgatcacatcctacataatctatagctatcatatgatataaggctctactttatggttaggcaaatgtctaacaaactggcacattttcaatatagttctttgtttgaaaatggatgccaatttgatttcattaactgaactctgcctacaaaatgaatgagatgatttggataactgattcattatgtatgttgttaatatttaacactgggtttatttgtgatatttgatattttctttttttttttctctttttttagacagagtctcactttgtccccagggtggagtgcagtgtcatggtcttggctcactgcaacctctgcctcctgggttcagacaattctctgcctcagcctcccaagtagctgggattacaggtgcccaccaccatgcctagctaatttttttgtgtttttagtagagacagggtttcaccatgttggccaggctgat

SEQ ID NO: 30705 - DNA, 1060 bp, Homo sapiens
tcaaaaaaaaaataaataaaacaaaattactttcaaagtggatggattattctgatcatcattaaaaatgtgaatttcttcatacttaaaaatatttcaattgcaaagattgaaaaactaattgccgaccttttaatcaggcagaaattccacagaccatcattagatgagtgttttttcttccatgtattcctctgcacttttctatttcgtttagattctaaaacagtcagtcgtctacataaataatttatgatgtccagtgaaaaataaaaatgcgggaccctttgttcaaaaagtaggaaaagagagccataaaaggtactaaaatacagtgctctttctttcagtgatttttctctctcaacttggcacaatgttttttgtttgccatttaatgtccctctaagtaaagaaaaagtaaaatttcaaattatttgcattaaaatttaacattcatctttatattgttcagtgaccattttaaatgcaaatacaagaacatttaacataagtgaaagcatcaaaatatacaagtcttttttctgtagttgaccccacatgcacctcctgttcccaagtgtgtctcaagtaggccagaacagaaaaatatcagccagactcaggaaggttgggaagtaaaagagagggtcccttaaaacacggtgcctgtccagagagcactccctctgtaccagggatacttgagcagaaaaatgatgacactcccaggttcccagggccctgcctcaggactccagctgcctttgtaacccacaatgggagaccaccagtggtcttcaaatctcctccctggtaggtgagagacctgcttgcgttaagacatgaaatctgcaaagcagaaacagctacacacacacactcacacacatacacacacacacgcgcgcgcacgcacaggcacacccacacgatgctccagggttagcatatccaacctagatcctttccatgatgtccagatccctcactggggaaaatgaacaggcaacccaggaatgtggtcctacctgcactgaggtcaatatattcacctaac

SEQ ID NO: 30706 - DNA, 1031 bp, Homo sapiens
tgtgcttaaagcatgttagcagccttgccaaaaattaatgatatgtgtaatcttagcttgctatagggtatgttattgcatttgtaatttttttatgctagaagataatatgcttcctcttattaagcaagtcggatttgcctaaaacaatacaatcttctgagcaactccattctgcctttttgacagataaggtttcaaagcttcatagcataactgaattaggccatcttgccacagtcataaccagtcagaagtgcatcaagactgactgcttttattcagtttcttaactatttatactcagtaacaaggttgcccagtttagaggatcttcatgatatcctccagcacagtaactacaaaagatgtctccagtgcaaactcagaataatttttccttttttaagcttcactcatagacaagaagcacaatattatgaacagtagttatcattgtacaacagaaagcctagaagtaactccctgaattcccagtcataaagtagtctgtggcttatggtttcagttgcccaaactctgctgttgcctaactataggggccattgaggaaaagaagtatatagcccttccagagtatatctcatatttgggaatccaggcactcattaaccccttcacctgtgacaattagagggtaatgagtgatcaaggactaaattgactaatataatttatatccaaacagacatttctgaaataaaaggggatgctgtaattacaccagtacaccaggtgttaacctggattgtcctatgcaaacttacttataattagcctgatacacaggtgaaatgaatgagcttctgaatttacacatttctgaatatgcacccatactcactaaatccatgagttctctcctcactttactgaaacaaataattattaaatggtattttactgtccttttgtgtgccttctctcttcaaattcctttaatttttgagacggagtctcgctctgtcacccaggctggagtgcagtggcacaatctcggctcactgcaa

SEQ ID NO: 30707 - DNA, 1022 bp, Homo sapiens
cataaatctatagagggatcacaggctgtaactgaaacacaattaagccatcatgaaacattttaacgttaaagtccagaatcattttaaaactgaaaacgtaaagatgacaactataggaggacatgtgacctggaattggaagactcctaaaaaacctaaccagaaatcttcactgatgaagaatttgaagtttagatcatttaaagaacttgcttaaaatcatctagcaatgtaaaagcagagatccagctaaatattctcctaatgtctcagttgttctagttggaacttagcctctggtgcccacctatcgaactctgtgtttcttttcacacttggtgttcttgaacaagtagattttaatcactgttaccagttcttgaagatattctggcttctcatcttctcaggcaactgaaactcttcttgttaaggtctcctattaccactcttttgctaatttaatatatatttttcagttactaccttatttgaccatgctgcatgaaacaaaaatctaatttaaaaggaatgatgtgcacagcagagtctggatttctcacatcctccttaattctctgaactcactatttctttattaaagaataaagaaatattctttatgataacatgagctgtccatggtattatataaatattataactaacagatggctttaaagttaaccagcaaaattgagtaactataatcctttgataaaatatcacagttttgataacttcagtggtttctttcaagtgaacatttattgagattccttctatttattgttatttatgcaagttatttatgtaaaaaaaaatgaacaacattccaatagtagaatttgtttctcaagaataataaatagaaaagggaagtgacttcagtaagttgtatgatttcaaacttgacaaaattaaatgatccaaggttgatgtcaatctgttcctttatattgagagttcttagagaaattctcttacgacatcacttgtacttttatcatgagagacac

SEQ ID NO: 30708 - DNA, 1039 bp, Homo sapiens
gctaccctttattcttcttttcggcatactggattaaacaatataaatcttatgtttttattctgaataactagcttagtagtgattaagcaagggggaaaatgacttaatcatgaaaataacctaagcaggaagagaaaatcactccatcttcagagatttaactacccatagtccattcttaaggaaaattgaattaatgacatttccttagaaaacatttggaacttaaggagcttaaacttttataacttgaagcagaaatatgtgctttttacagaagtttcagcgttttaggtttcagtcaagcaaatggtcttggtagaaattggatgcacacatcatgaaacagtaaaaaccttccccactgcaaagaacaaaatgattctaaacaaaatactgaactgctggaatagtagaaggcatgggaaatctgatgagatttctaagaagtatgatttgcctcattgcagatcctctgaaattaaatgtgaacgtcttaatttgcatgaaaactgcctaaccaatccactgatgctcctgagcacaatattgtgtagcaaaactttatgaattccaaaaggagcttatatcagtgattttcccattatacagtagcttctcactggtaactgtagagttcagtcttacaaatactgtgaacaaatcttttgccaatgaaaccacaagtctgttttatgagggaggttaagcctgaaaccggtaacctttaaaccttgtcatgtttaaattcagctctattttgaattaaacaggaatgtttactgctgaaagtgataaacagtaaattacattatgaaatataaaagtactttataatgcaagcaaccatctcttatatatttactaatctatgccatatattgttttcatgagtgcaattcttatttttaattgacatttttattgaaatgattgtagattcacatgcaaatataagaaataatacagagatcccttgtgtactttgtcctccagttttccactcaatagtaacatcttgcaaaactgtagtgaa

SEQ ID NO: 30709 - DNA, 1075 bp, Homo sapiens
tttttacaaaagtgaacaagtaaaaagtctttgtactttcatgagtttcacttttgtaatgaaaatctatcaagcagtttttataactgctctatcacacacaagcataggaaaatatacaaaattaacatcagggttaacaaaaggcaaataagtaaagacaaaaatgataagacattagatttttggaacaataagaaaaaagcaagtagtcaaatagtgaaaaataggaagaggaatttacagaagaggaaatacaaatgacaataaatatatgaaaactgttcaaacctgctagtaatcagaaaaatgcaaactaaaacaaaactgtgttttcaatcatcaaactggcagaaattaaaaagatttataatatccagagctggcagggataaatggaaataagcactttcatacactgttggtaagaatataaattgataaacctgttttgaagaacacctggcagtatctcaaattttcaatttgcaacttttagccaacaaggactctcttctacagaaatactttcacatgagaataaagacttatgtaccagatattgatagaagcattatttatgatagagaaaaatcgaaaggaaattaaatatcttcctatcaggaatattaaattcattattatacattcatagcatggatactatgcagccattaaggacagtgcaggcttcagtgggatgactttaaaagatctcccaaacatattatttaatgaaaaaattaaaagcatattggaaattaaaaatttgagaataataccacttatataaatgtatgtatgtttattgaataaacgaatctgtgacttagaaaggctctttaagctaccaaaatatgtggtgcattgatccttttttaataaaatacttcattataaatgaagaaatggtaccttaaaaaggcagcattacatatcctgaagcatgatatgctgaagctggcatgatactcactaaactcaacagttcctactgattgggagagggatgaaggggagctaacatgttttactctacttagttctgtataatctgaatctgttaacaaaaata

SEQ ID NO: 30710 - DNA, 1089 bp, Homo sapiens
taatgatgagcatttttttcatatgcctgttggccatttgtctatattcttttgagaaatgtctattcagatcttttacccatttttttagtcagattttttgtgttttgtttttccttgctactgaattgagttccttctgtattctggttattaatcctttgttgagtggatattatgtaaatattttctgtaattctgtagattatctcttcactttgttgattgtttcctttgctgtgtagaagctttgtagcttgatatagtccaatttgtctatttttgcttttgttacatgtgcttctgaggtcttactgcccaaatcagtgtcctgaagcattttccctgtgttttctcctagtactttgatagttttgggtcttagatttaagtctttaatccatttttagttgacttttgtatatggtgggagataggggtctagtttcagtcttctacatgtgtttatccagtgttccagcatcataagactatccttttcccaatgtatgttcttggatgtctttttggaaaatgagttggatgtaaatacatggatttatttctggcttctctgttctcttctgttggtctgtgtgtgtgtgtttatgccaaaactatgctgttttggttatcatggctttgtagtatagtttgaagtcagatagtgtggtacctccaactttgtactttttgttcaggattattttggctatttggggtcttttatggtttcatataaattttaggattctttttatatttctgtgaatgttattggtattttgatagggattgcattgactctgttaatctcttcgggtggtatagatattttaactgtgataattcttttaatccatgagcatagatagaatagcttttcatgtttttgtgtcctcttcaatttcttttatcaatattttatagttttaattgtagagatctttggttggatttattcttaagtattttatattttttatagctattatatatgggattactttcttgatttcattttcagattgtttgttcttggtgtatataaatgctactgatttttatatgtggacttttgtatcctga

SEQ ID NO: 30711 - DNA, 1032 bp, Homo sapiens
agtgtatttttcctgctacttttttgtttctaaattcagaaactttttgttgttgaaggtgttttaattacgaatacgcatttctcgtaagattatgagggaaaaattaagcaactaaaacatttaagggaactaaaaaatactctttagtaaacttatagggattccggaatagcaaagaagcagacagttaaggggaaggagaaacaagttttttttttaaaaaattatttactactttaaaaaggttaaatgtaaagtctttcattagtttcacaaaatgtatcttcctcatttggaaagcaacctgttatgctttgaaaagaatgagcaagtaaaaataatagggagataaatacatttttgacaaaaattactgttttgagattttaatgatgttaaaagtggtaatcttgttcattttcttcttttaaatcattgcccagattatataagactcttttgcaaatttttaaagcattttaaggatatttatgatattttaatgagcagcctgtagttcgctttcttcaagtggcgacataggatgagcagccacttcatactacttatagaaaagaattaattactgttcttttcatgttccagtgttctttttgacctggggagaaatattgtggctaaaagttacaataaaccaaattgttaacaaaaaatgtatatctttcatataaatgaccattttcaaaatgtcaattagcatatcttctactgccaaactgagaggttgtttatgctgtttatatgaggagagggcacaggtgacttatagtgccagctctcagaatgagcagaaggttggacgggtgaggtggagacaactggaatcaaattgtagttgaaactagtgaaaggtgagatgtgcagtgtctctagaatctggctggtgacattctaaatgtagaggctcacaagatgtattaaatcctaacacatcaaacaatgccatgtgcttactcagaaatcccctttgacacctgtgggaacaaatttaaaagtattgtttgcttg

SEQ ID NO: 30712 - DNA, 1029 bp, Homo sapiens
aaccagaggtagatgccttaggctctcctcctgctcttcttaaaagtaatatatcttggattttaccacctattcatgatgaaaaaatcagtaggcaaatggcgcagaattgtgaagctcacacttgtgtgtttcatcaatctttggatatttgtgggactaaaaagatttctggtcactcagaaatggcggaactcagcttaactaatatttcccctaaattccaagaaactggcagcatgaaagtaaattcaccttttctggattctgattccagtttggaaaaaaattcttctgcatctgaggactcaagcttccttaaagtaccttctgtgctgaaattggaaaagaaatcctcatcttacagaaagaaagagaacatccattttttaaatggtggtattgatagtgtgtcatcttcctctagttaccctgaagaagttagcatgatagtaaattcacataagccccaaaataatttggattctatacaagttaccaaagatctcacacatgaaggtacctctgtaactaacctgttgtaccctactacctcttatttggaatttgaaacgtctgtctcaattgggacagaagtaaccccatttcaggaacattttgggatttatactgggaagatatccattgatttcccaactgctgcccaatttgacaatctcgtggaagcagagactggagcagttgctgggcctgcagcgtcagttaacagctcaggccaacagtgttctgaagcctctgctgagcacatagaagccaggagaagagcacatgaccaacttttggacctcaaaagtagtttactcaaaaaggccgatacattgattggtgagatttttaattctgtcagggaagaactaaaattcaaacacacagtgagtacctgccaggagcatatagccatagaaggtataatgaatctgggtaccctgaaagaagacatctctgagaaaaacccatcagaagtgacactaacagaaatacaacagacagagggtttggaagagcaag

SEQ ID NO: 30713 - DNA, 1027 bp, Homo sapiens
aacaagaaaattcttcctttactatattatacgaagagccccttcaagaggaggacaagtatgcttccgcagaagcaagacaaacacagtctgtcttgtttcatgatacgtccgctgacagcatgcctgttctggcatgtgaaaggtctgagagtagaactgaccttgtccatcactttgaaaaaggtactaaattaggtgagacatttgatagtgatagttcagaaatgttcttatcagtggaggccaaaaggtacaaaatttatcctttagcattgtctcccatttatgaggatgacagctcacaggaggacattctatctagtgaggtttcacctggtcaccatggccccaggaaatcaagagacagtgaaaaccagtcctcttctgttttatcccttctccagtcagtgtcagaacgtttaaagatgaattttgatgaagatgacagagaggcagctgatgaggaagaagaggaggaggaggcagcagtattgcataaaggagatctgagagctggaagtggggagcgtgttaccttccagttgccagatccttccatcacattttaccctgatgaccaggagagcgttggaatttctaagaattcatatgtgatgccaaatgaacctactacctccaatctgcaagttggtctgtggccagaaaagacctcgtttctccagaaatctgaccttacttctaaactacattcttctttaaagagtgcttatcatcagtatctgcagacttcccaaagtcattcctcagaaaaaggagccagatttggtggaatttttcaggaaccagtgtcaaaatatttccgtgttcaagacagcccaggcagattgagcccatttatagaggtaagttattttgtttattgtattaataatagttattaaagctttgggtcacgaaattatctaaaggcttattaagaaaagtcaatgttttggccaagcatggtggctcatgcctgtaatcctggcactttgggaggccgaggcaggtggatcacgaggtc

SEQ ID NO: 30714 - DNA, 1050 bp, Homo sapiens
cttaggcagccaatagaactgatattgattctgaaaacgtggctcaaaatgtaaaacaccttgtggaatccctacctctgattgttccagtttaaaaaagaatggaatatagtgaaattgtttttgattttctaattatttcccacttgaattaaaggtgccacgtgttttaggtatcagaaaaataaaagtaatgcctaatgattggaaaatgtatcagacttattataggacagatagcttattataggatggataatgtgtgaatgtaaataacatggtaactattatcgttatataatgtctggctctcactttgagtgtgttttactagtgtaattctgtgatggaggattttgtttttttattttggtagccctttttacttacagaaccagactaaagcagtactattatactttaactaactatctatttttatatagttggcttgcctacccagatattaattttaagggacaagctacagttctggaggaagaccatgggctctttgagatttctacagcagaaatgaaatcattacatccgcttcaaatggtaagcaaatttaaaaagaagcattccttttcccaagtacccatgaatccaaaattaaataaccatgatgtttgctcatgcatctcaatctcaagtgaatatgtgtactactgaattggcaaactattgtactgtagtgccttcagtatttacagtatttcttttttgttacaaacatttacttgagtggcagactgttcaattaaacattggctatgtgataaaccatttttggttagtccatgccccttaaaaacatagccactaggacaaactaaaacattttaagaaatatcacaacgtggagtagcacttgaaacaaaaaaaactacagaattggggtttttgtaaggaaagagttgctttttatgctgtacaactttgaggtcacaaagacagtgcatgtgagaaaaagtgttggtagaacttggaaaggttagtgtggttagctcagtgctctaatttaaaaagcccaaataattgtaggga

SEQ ID NO: 30715 - DNA, 1044 bp, Homo sapiens
tcacaaagaaggaataatctccttgtatgcaaattcatgaagttgtagaagagtgtggccagtttggataataaaccctgtagaacaataagagtgcccatgagataatgttcagaaattcacactccttctttgtaatgggcactaggccatatttttcttccacctacaatattacttaatatgaattagttataaataccaaaattattataagagaattcagtaggttatttgagatccatagccagttcaaagagtctcataaataggtcaaaccatgaaaaaaatttttcaagctgggtgcagtggcacaggggtgcaatcctagcactttgggaggccaaggtaaaacatccctaaagcctagtagttcgacaccagcctgagcaacacagtgagacctcgtctttacaaaattaagcaaaattaactgggcatggtggcacatgactgtagtcccagctacttgggaggctgagttgggaggatcgcttgagccctgaagatcaagggtgcagtgagctgagactgtgccactgtaccccagcctggataacagaggaatactctgtctcaaaaaagaaaagaaaaaaaaatttttttcaaagggtattttcaaaactttcaaaaagacagattatgtgattacaattttgaaaatgttttaatatgtttttcaggaaccacttgggataaatgaacctccgcatttggtatgtttaaaaatattcttgtaattgttaaattgtttactaaaagcatttataccctttctctcaaatctttctcttttctgcagataacttttatgtgtctctctggcagagcagattacaattgcatttggtacctatgagcagaagaattcacatctttgtcagtggttgtattagactgggtttgtcacacttccttttgttttctcctgacagagcggtagctctgaccactttagggtcattttgaacttctggcactctttctttcccatcgtccattatttcttcagtgtcacattcttcatagaatattatatttatt

SEQ ID NO: 30716 - DNA, 1050 bp, Homo sapiens
agtctgcctcagaatatggtccccagttctctttcaaaattcatttagaattctaaaatcatcaggtaatttaatatagggaaatttaatttaatcatactaagacagctctatgtaagcatctgggaaaaataataacaaattaggtggcctagaattaggaaagtgaactaaaacccagggttttcatcaggctcttctcagagatatatatctggaaaaattacatgactaataataggcctaaatatctatctcaaaacatggtgaatgggtttctattgtcttctctttaagtttttcagtagccttggtttggtaatggcttgattgcttaacagtgattacaagaagaccttttaagatgaaaaagattgaatatcatgcctaaggaagtttaagtgttttgtgggggctgaaaccaaagccttctatatttaggagtaatcatactgggtggaaaagggcaataaaatgattaaaaaaaaaaaaaaaaaggcttaggatgatgcttggggcgttggtgtagagttccatgaatgaaaaacacatctgattagtaattttgtagaagaaagtttaaaggtactccattttgctttgatcaaagaaaaatatttaaggtggctgaattctttctcccatctcagcctccgaagtagctgggactacaggtgtgcaccaccatgtctggctagtttttgtgtgtttttttggttgagatggggtttcaccgtgttgcccaggctggtctcaaactcctgggctcaagggatccacctgcctcagcctcccaaagtgctgggattacaggtacaaaccactgcaccgtccagctgaattctttatataaatatcacaaatgctgcacaataacaccattgctgaagatgcattttatatttattcaatctaaagtattgaacacctgctctttactaaatactgtgctaagtactgaatatgaattaaaaaagaattagatggcataacaaactcatcaaatctaagtgttatcttactcttggtctctcaagtgtagatgtttct

SEQ ID NO: 30717 - DNA, 1023 bp, Homo sapiens
actattactattataactctgtttttatagctattatgacaattctattcttcctcaattagttaaaaattgactttccccagaaaccctttctgattgttcttatatacctctaattttttctcagatctgtttcctcttagcacctggcttccctttggactatgttaatctacctatgttattatatttctttcatcattcttcagcgaacagcaacaaatactttgcatctatcatatgccaagtactctgctattataaagggatccatgggcatatagtagagggattcagtgtgtgtgtgtgtgtgtgtgtgtgtgtgtgtgcatgcatgtatgtacatatgctttcaagtggagttagggagagaaaatctgtaggttgaatagagctatgaatttttcagaataaactaggcttaaggagcaaaaaccgttctctccgaatgttcttgaaatctgagattttttttttttatggttcaaaacatagaaacactgtagttatctctgatcttgaaacagctttacatatgctttcttggactcctatgtcatcatccagatgcagggtagagatagaaagggaagtcctccttgaagaacagaatcctaacagattattccaatttatattggggagtgggaatgttgtgggaggggaattggggggcagggtgagaggagagggagaacattccgggcagcaggaacagtatgaccaaaggcgctgagacatgaaactgccaagaaggattgagaagtgcacaaagtttggtgttactagagtcaagcatttcaggagatgagtcaagagtcaagcatttcaggagataaggcaggacaggccgtaggagccagctggatcagacttagaggcctatggcttatatatttatatctctctataaggcacttagggaggtaggtctatataaacaatttataacaggtaaattctacatgttgcttctaaatttggacttggggcttacaatatggcatgtaatacattccttcc

SEQ ID NO: 30718 - DNA, 1024 bp, Homo sapiens
gacctcaggtgatctgcccgactcagcctcccaaagtgctgggattacaggcataagccaccatgccaggctcttttttttttttttttttttttttctgagacaaggtcttgctctgtcgcccaggctggaatatcgtggtgcaatcttggctcactgcaacctctgcttcccagctcaagcgatcctccagccttagcctctggagtagctaggaacacagatgtgagccactatgcctggctcatttttgtgtgtgtgtgtgtatttttcctggagatggggtttcaccatgttgcccaggctgttctccaactcctgagctcagagcgatccatcaaccttggcctcgcaaagtgctaggattacaggcgtgagccactgtgcctggcccaattttttttttttatttaaatgaattacttcagcatttccagttataaagcagcctcttaagaattctgcttctcaggtgaacagacaactcaagtgtctgaacccgcagggctgagctgccaactcctggctgtgtaactcctcccagataatgcccctccctgaggtcctagctgggcttccaagacccctatttcttggatagctccatcttctctaatgttttgtaaagtttttatggaaatatatcagacatacagaggagtgcacaaagcatataagtatagttcaataaatttccttacagtgaatgcacccaggcaagctgcctccagatgaagaaataggacaatacaggccctccagaagggtaccatgtgttcccacccagtcactattactactcacatgtaaccactactctgacttttgccaccatagattaattctttcctgtttctctttcacattaattagcgcctggtattctgaatgacctaggatattaggatccgtctggctgagggtgagccttgggcaccccaacgagggtgtaattggttcagttgtgcccccctcccccccccgctccaagagatatttagaagtcctaatccccagtacctca

SEQ ID NO: 30719 - DNA, 1035 bp, Homo sapiens
aacctaatttctactccaaggaatgtacaaatttgtgatgtatttgtttgatagaatagagcatttaaaaagaatgaaccagatctttaggcaccatatggatagacctaaaaattaaaaatatagagtgataaacacaaatttcagaatattatgtatttgctattcaaatgttaacactgaaaacaatatcatatactctataatgtttatgaatatgtatgtgtgggtatgtgtttttgtgtgtatatataaaaaggggactgactatgtatcaaatccatgatactgggaggagaggaatgggggtagggaagggaccataaatctagtttaaaaatatctttcagaagagatggttatttttggtaatgagctcatgggcatttattaaattaacatttggacctctattaatgtttttgtgataaatatgcataatatttcctaatgaaatagatcacaactaggagccatacatttatcaagattctgggaatgagactgaagctattgttaggcacacctaatatttcatgatgtcattctgtgcaaattgaaaattaacagaatgaattttgaacatgaggaaagcttcaagttgatctcactcttgggaagcttacaggttgggaataaggaccctggcagcaaactgcctaagagcaaaccagccttgataccttttagcttaagaccttgggcaagtcatttaacttctctaggtctcagtctccttttctgtagagtcagaatagtagtgcacatctccatctcagtgctattgtggggattatatgagtttgtgcctgtgaaacctggaatgtagtaagtgtgcaaaaaagattagctattattttcttttcttatttgtatttatttatttttttgagacagagtcttgctctttctcccacgctggagtgcagtggtgagatctcagctcactgcaacctccgcctccgggtttaagcgtttctcttgcctcagcctccctagtagctggaattacaggcgcctgccaccatgcctggc

SEQ ID NO: 30720 - DNA, 1027 bp, Homo sapiens
cccttcagcatatcccacagttgagctatgagagtcttaaatattatttttattctcagttgaatgggccttctttgggactcttcttaaccaatacataagtgaggagtaagaaaactcttaaaattagaacattatatgcatcacaaatattatagaaattctactgttaaccagctttatattgggcaagagggtttccctctttgggccttgttttctcaatagaattaattccagttctctgtctttaagtgcaacaattaatgatagtttcattaaagtaccttctaattttttaggctgatttttcttactttttttggaatcctatgcacagatttcagacatcaatgtataactttattctgaaaaaagatctagagttcagatgtctaccaggaatgaactacatgttttacccatgaatatatgcaggcactcaatgatttattaaggttcatcagagaatgattattctagcaaatttgtttggagatctttttgggaaagacacttattgactgataacattatgctttagtagtgctggccaatatggacactcataatggtcttgtgatttagtcctagggaacctcttaagctcttgcttgttcctattgagattgctcatgagggtttcaaagtccttccccagcgtggtccttagccactggacttgcagaactcttgaggacctgaatcaaggctggaggtagggctggatcctcaggttttactgccagcaacacctcaatttagtggaatctggactgtaatcatcttggtgatttgtaaagctgtttttcttgtcaatctttaccatttctggcatcaaaaagatggaagtattttgagagtctttgtgatgctcctggactctagtacgtgcttgggttcaagtcccagctctgtcacttttgatttgggtatcccgggggaagttataacttctctgtgctttggtgtctttatctgtatgatagggatgacgataaagcctttcgtaaaggttggttttgag

SEQ ID NO: 30721 - DNA, 1040 bp, Homo sapiens
cagtggatgagatgaccaggatcactactggatccacaggaacctgacccaactgttaagctgctagtcgagggctcctcagactctctttctgtgggtcagaatcagtcccagtgcctggggtggctgggcttgcagatgggcattaggaagcacctgcttccagactgaaacagaactggggatggaggagacagggaggtgaggtttgtgtgtgctcagcatccggaatagagaacgccaagggtctttcttccttggtgttgcatattgactgagatacccaccgggtttttctattaggttggttttaaatgacaaaaaccacaattacttttgcactaacctaatgcttgataagtagaacaatgtttctagaattattgctgaacatgcttttttctagctggttggaaaagcaagctccctttggtttgagaaagcattaggggagtctaaaaaaaaacctgacatttttttcaagtgtttctccgtagagtttgtttttataaacaatgctagcatggttgggaggagcagaactgggaacagggttgggagtaacaggcttttatttcagctgagtttgaatcaaaagtattataagctttacctccatttcatcaattactagaattgatattgcttaaggagcttgcaggattgcttaagttggagaaatgttcagtaatgtttagtctggtagcaaaaggaggggcctgtgctcacttgtgaaagctcacatctagggggaggtagtataacgcatggcctgtggcctgatagagacagatttgagtcctcgttctgctacttgtcagctcaacaaagtcgttgcttctcccagagttttggtttcctcctctacaaaataggaattgtaagtctaccacttcttttgcaaggtggttgtcaggatgtcatgaggtaatacaccaaaagcaattatcacatgccttggcacaggctaagcactcatacatcttaatgcttctaatcagttgttattcattgagcatttaccacgtgctaggcattta

SEQ ID NO: 30722 - DNA, 1024 bp, Homo sapiens
tgcctgaatgctgcctctgagtcaacttagttcctcaagtgaccttatgtagttctcatttctcttctcagcctgggaataaagctctagaagaaagatgtctgagaacagtctttctttctcaggcagagaatttagactgcctttggcaggagagtcctccctgagcccctggcttgtgaatttgtgagctgggcccacacgtccaaggaggaaggtattgatatttaggctggcttgtccttcatcatgggtctgtaggtcagagaggaggagctgaggtagaagggattactttcaagttactttcctcctttttctgctttctttactgatatttatataattgctggccttgctctctgctcattttttcctacctgtgctctagaaggtgctcgacgtagtttgagttataacagctaagcacattattttccttgctttttattctccttccatcctctttgtcccttctagaaagggtcagatgttgttggtgctgttgtttcaaatctgaatcctttaagattctaccagatataagttgtagttttgtcagatatctcgtccagcatgtatgatgccctcagttgggatagattccactgtgaatgggaaaactcaaaatatcagttgtgattgtaagaaggaagttctccatttgtccagttttcatgtaaatgaactctgcaggtaaacttgccagggctggttctgtgagcatcagggaccaaggctgcttctctatcttgacgccaccattcctaaatatacaacttgttccttctggtctggtatgatggctggagttccaccgatcacgcctacctccctgccagccaggaggaggaaagggcgaagggcataccccaaccctttaagacatgccttcttcttaagggcatctcccagaaatcccatataacacttccttacctccaatgatgtgctggaaccagttggtaccaacttgtgagagctgtatctctttgtattcagctccatatttagtgccatcaag

SEQ ID NO: 30723 - DNA, 1190 bp, Homo sapiens
attgaaagagttcttgaaacttcaaaatgaaatctcattgactttcactcctgtttgccttctttccctagaaaacaatactctagacccatacagtggcagagatattttttactggaagcttgagtaactgtataacatgacaccttggttgaaatgagtttttcacccctttttaaagtagggaaaaatccaaagaaataaatatacatcatgtattttcatgatgtatatttagcatgataagaattgtgattaagaaattcaaaagtgttatatgctgaaaacaaatgttagtgttgcacactgaaataaaggaatattaaaaatcaaaaaggaagtcaccagtctattctcttccctctacaacccatgtaacctctcaagcttttctaccttttatgtgcttccagactatttgctatgcattcataaacacataatctttttgtttgttcagtataattatgattataccataggtattgttgttattttcttttttctctttatttaactcttcccctatttatagacactcagatatatccaacattttcttctctttaaataatatagcagtacatgtgtttataggggttttctgcccatttgtcggatttctgtaggatggacttctggaagtggaatgctcaagtcaaaaagcatacatgttttaaatttaaacctgacttcctagtaattttgagggtaaaggacagcttctgaatgtgtgttttgtgagttttcacttcctatattcctaagtgaagtatgatcaggtatatctcttgcttcttcattttaggtaatatctttaattccaaaagcacaggaagaccctgagcatacttagtgatgacattagaactagctgtagctacatcaaagtcccagtaggacatggtgtcccagaaatcaaatgctgtatttcaagagaagtcagccatgtcagatgctgtccagaggttgaatgtaaataataaaccctggttttagaaacgtggaggtcatattggtgatatatattaacaagaaagaaggaaaaagcctgcttgaattgggttgaagagaacctgggacatgagcaagcagcaacaaatctttagtggactttttgctagaacaaggatcgtagaaatgaagcaatagttggaagatgatataggatcgaagaagcgtgttttatt

SEQ ID NO: 30724 - DNA, 1845 bp, Homo sapiens
atagaacagtaatttttaacacatcttaaactgaaccaggcattataatagtttatctccaggctgattttgtttgtttttaaactgatttctaggggcttcttccattaaagtgaacaactcaaaattttggtctccagatttgtattgtaccatgattcggtctaccagggtttgatatgaaggagtcttacttatgtgagagttgaaatggaaagagtgggctgtagggaaagcttttgcacaagaaccagcaaggaaagtaatttaaaaggctatcaaaagttaaaagtacatgcaactcgttacttaacattcgagttctttattcggatttttttagatataaagtactccattggtgctgctaatactttgagattgggaaagaatgatggtaattgtatttttcttctttagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacagtgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatg

SEQ ID NO: 30725 - DNA, 1123 bp, Homo sapiens
catggtgaattccttctggaaatggagtaggggagcaccttggatcttttctttaaacccaagtacccaggtttttttgttctgtgttttttctattttcacaccaaagttaaacctttacagtattagttttacatatagacagtcttgcattgtagatgttgtaaggcattgtctctacatataaaattcagacttggaatatttgtaggagatgttaataacacacaacagaggatcgacttctgggcatgttgttttcataatcattcgtcaagctctcatgcttagccttgttttagacactgtaccagaattagagggaaaaaacataatcagcttacattacaggatttacacattgatgtggttcagtcaaaatgcaaatagtattgacagatattcaggggcaaaacacaggggcaggatgaatttaaaaagcaaggggaaggaaagaagaaagaggagggagaaaaatgactatgttattagtcattgctctacacttgaaggctgtaacagatggacacttagataaccttcatggtctggtttaatttactgcatataatttccacagttctttcagatgattaaatgagtggttcttgacaacaattacgaacatttaaaggtggaaatttatgcatatttccctaaattgcatgtcaggtagttcctgctataattttgctaaatgtccatgaatctcttgaaaaatacaactcataaatgtggaaggcctatacataacttccatttcctccctcagattcaataataatatatcattttgtggcacaaatctttttttctttttttctttttctttttttttttttttttttgagacagagttttgctcttgtcccccaggctggagtgcagtggcgcaatcttggcacactgcaacctccgcctcctgagttgaagcgattctcctgcctcagcctcctaagtagctgggactacaggtgcatgccaccatgcctggctaattttttgtatttttagtagaggggggtttcaccacgttaggcaggatggtcttgatctcctgtcctcatgatccgcctgcctccgcctcccaaagtgctaggatttacaggtgtgagccacggag

SEQ ID NO: 30726 - DNA, 1103 bp, Homo sapiens
aatgaaaatctaggattggaatttgagtctcctaaccccaagcttttgttgaatcaactgattttcgatagtgtttattcagagaagagatatgaataaacaatgtcctgtgagatgataaattctgtattttttcaagcacctggaatattgattcatgtctccctaaaatatctcaatgttactgagactaagtgccagtggtcaggtatgcttactacaccagtgattgtcaggtattctgcacaaaggatatattcggctgttattcacttttgttatgcttttcctcctttaagaattatcactttgctttttccctcctggtcataaagaaatcatagttttagaccttaaagtgtgattttaattgtcctgtcatcttgatggaaataatctgattttcttgactcagattaggaatttttgctatcaccttttcttagcaaaatatgattaatcagcaaagttctgtagaatgaagaattacttctgttttcaccagaaaactcttgaactgttctagtgaattcagtcctatcccaggctgattctagatagttcatctttgggttagattatatgtcggatgaggaaatgggtagatttgggtgtgggtctaggcctgcgagtgtttgtgtgtgcatatacacatatagaagtaaaataattgtagacgtgctgctttttgggggatgatcttcatcaggtccacaaagctgcttcaccatttcctggagagatggtcctttggcctttcatagtggtaattttagctttccacatatttctgtagatgaatgtatccaggcagtgcattggtatgagttaccttctccctcccacgtggaggaaggtgttggaggtgacagttctcacgatgtgtagcttcccacagccattttggtaaataggcttatccataggcactgtgggggctttagtggaaatcttggtgatgcctgtagatttcggtttagggatccgtgctgggattctctgcttgcatacctccttgatcttgaattaaacaagagaacaaaaggtaattaatggtacagttggtggagaagtagaaattgtttaggacatggagtcagttt

SEQ ID NO: 30727 - DNA, 1050 bp, Homo sapiens
cggggtttcactgtgttagccaggatgatctcgatctcctgacctcatgatccgcccgccttggcctcccaaagtgctgggattacaggtgtgagccactgcgcccagccattcccaaatctttaaaaaaaaaaaaaaaaaggcctagcgcagtggctcatacctgtaatcccagcactttgcgaggctgaggcgggcggatcacttgaggtcaggagttcgagaccagcctggccaacacggtgaaaccctgtctctactgaaaatacaaaacagccgggcgtcgtggcgcactcctgtaatcccagctacttggaggctaaggcaggagaatcgcttgaacccacgaggcggaggttgcagtgagccgagatcatagcattgcactccagcctgggccacagagcaagactctgtctcaaaaaaaaaaaaaaaaaagttgttttttttttttttcttgtatgacttatccttggacatgtttcagtaaatgaggtatggagcattaaaatgtgtcatctcttggatcatttttatagagcgttatgtcaaatagctccaagaaagttttgtccaaatttggaatgcatattgcaagagaaatacatgcatatggctcttttaagaccacacagtgaatgttctactcagagttggaggctcctgggtttcatcaaagagcagatgtcttggaggagattaagcaagttggaaagctcattcatagaagaaaacgattttttaataaatgcttaacccagttcaacatgaagactgggatttggaatgccttaaaagtctgaaggatgttgagttcaatgaggcagaagaagtggttccacctagggagcagtagaaagaagaggagtaaatttgtggaatatattaaattctaaaagtgttggtttgttttatccatagattctcaaaagaaacctagcaatctagaagactccctggttacagtgagttattagaaggcattgagtcataatgagcaaaagaagtatggaaaggtgaagtgttttcagttgtattcaaagtctcagt

SEQ ID NO: 30728 - DNA, 1055 bp, Homo sapiens
ttcttgcttttgagatgatagcataggaggggtaacaaataattatgaggtagaatgacgtgcaataatagaattacagacagcagttttggaaactcagtggaaaactaaaaagtaaggaaggttttccagaggaagtgacacatgagggatgagtaggattttagtatgaggaacaaaggaagaagagtatttcagccctacaaacagcatgatcaaaggtaagaaggcccagtagtatgtgggaggatagttagtatggtgtcctggtgaagatgtgagggtatgtccagagtttcaaagggagatgaaacgaaagatgaaggccatggtagaaggtttggactttgggcactaagcaattttaagtgctgttttctgggaggctggagaattgctgtgatcagaatggtatttaaggctggattatagaggtgaggatttaagtgtagtagattaactatcttacagtaccatctgtcctaaattctgggcttggggagtagtagtacaaataagtggggaggacagagaaagaaataatatgacagagtggaggatgagcagagaagtggagaatagttcccagatgttgaacctgagcagtggggaaggtgatggaccatcaatagaggcgagacaaagagcagttcaagaaagatagtatattgggttatgggcgcatgctaagtttgaagtgtatagttgggccttccatgtggaactgtttggtagagttgaaattttggagatgttgctttgaggatcgtggtagagaaattgttgatactactcaagtgcctgagacagccagagagaaaaatgtaattcccactcaactgccgctcttttcttctcccaccataggtacttctacatccctttcccagagcctgagatgaattttgtgggaccctaccatgtgcccacatcctctgcacaaggccactctatcttaatgataagaatataactagttctgagaacagccacctaaggaggcatttattcccattacttgaacagtacatagtgattgaaccactatccaggga

SEQ ID NO: 30729 - DNA, 1048 bp, Homo sapiens
gacactgcgcatgtcactgagacacaagtttggttgcataaggatcgtttccactcacttgattgacagattggcccagagtatatgtacatttgaacaattatatttgtgttaatacattgtacctttgtttctttcaaatatatcaaattataaactagagttttcagataaactggagctttccatttctactatgcctgtggcagaaaaataatgtagataaccaaccacctttgccttttgccggaacagcagataactccctctattgtttagacctttctaaaaggtcctctctcggaagtctcaattccctctgtattagcttgtaaccaccacaggcatgaatattcattagtaacctcacctccacctatccaaaagcctcaggaatggctgaggacgaggtaggctttgtaggtctgtagggcttatatttgtatattgtagttgtccaaatatggctagcctttaaagagctgaacaaaacaggcgcaatcccatcataaaaatgggctaaggacatgaatagacaattctcaaaagaagatatacaaatggcaaacacacatataaaaaaatgctcaacatcactaattatcagggaaatgcaaatcaaaaccacagtgcaataccaccttactcctgcaagaatggccataatcaaaaaaattaaaaaataatagatgttggtgtggatgtggtgaaaggggaacacttttacactgttggtgagaatgtaaactagtacgagcatggaaaacagtgtggagattccttaaagaactaaaagtagatctatcatttgatccagcagtcccactcctgggtatctgcccagaggaaaagaagtcattatatgaaaaagatacttgcatataagtgtgtttatggcagcacaattcgcaattgcaaaaatatggaaccagctcaaatgtccatcagtcaatgagcggataaagaaaatgtggtatatatacaccatggaatactactcggccatgaaaaggaatgaaataatggcattcgtagcaacctggatgga

SEQ ID NO: 30730 - DNA, 1178 bp, Homo sapiens
gaggcaaatctcactcttttaagagcagaaaaaggagcaaagtaactgagaaaaagggtctctgaaaggtgaggttccagaacaagtaaaaggccagtctgagggtccacaggcacagaacttgggtagttaggcagctacaaggagaatattttcatcttgagaacaaaggaggtgcccatgattctgggctagaaaagacactgtccatgctgctatgaaagggccaggtggagacttgaaaagatgctcaggctagacctggaagaagaaactggaactgacaggggagtgacaacaagtacagcacatgtaaatttgtaccaggataattactgcctaaataatgtgttttgacttctgcagtactgtattgttagggagctttctagtaagaacctttggacaatggatgttcatttaataccgtgaatattgtgcctctcctatcactcttttaatttttcttattaaaaatacctactcaaatgaagttttctttatgccgtttactcagatgacatctatcaagaaggagcttttaaaaagttaattactgtgaatacactgctgtgctagagagtctactcatttttctcacttttctttttgttttcctcccccaccccctgctcccaccaccactctgaattggggttcttgattatttagaaaagatcccttaaatcaaagtttcctcttttccatactttccattttgattgttaatacacccccgccctcccaaaaaaaattacctgtcttccaacagattaagactttaggtctttgtcagactaacagtttcaggtagatgtccccttaatcctccaaagcctacctgggccttccacagccatgatgccttcccctggctgccctgtccctctagggagaagtatccaaaaagccactcagcatgtgatgccttgtattatcacagatgtgtgtgtattcctgaaagtgcctcctagttcatggcatacagagctgcctttacacctagcattgtgatggtgctcctcctgggcttgtcctcaggttcctaatgctttcattgtttatcattgtctccattccttcctcccactctctgcagttgattttgtactctctgtgatctgcgttcttctgtatcttgtctgtttgcccaaggtagccttctttaagacagggat

SEQ ID NO: 30731 - DNA, 1926 bp, Homo sapiens
atgacaccatgttgaataaatgcgttgctttgacataaaagtcttttaaatatttgaaaagtttgtcttgagtcttcagttattcctatattatatcattttagtcttttcacaccctgtgtccaaaaggttggtgcttagaatgaacagattatttcatcatgattatttcagcattatcagagttatcctccccttttataggctatgtgaatgtgtgtgttggctggggggtgttgtataaacagattttcttaccattttagacaaccatatcacactgttgagtcaaagagcttactgatcatcagtcttctaatgaacaactgcacacccaaatgttgtcatcatgtactgcttctgtgataatctaggataatcacttctatactggttttgtttgtatgacttcattgttataataataacaaaaacaataataggtgacacatttaatgtttaattgatgtcagacactacacgctttacaaatagtaacaactttaatccacataataaccctatgggatagataactgaggaacagagaggttaggtaatttgtctaagatcacagagctagggaatgatggcaccagagtttgaactgcatactgactccagcaacttctggggaaaatcacactcagtgttttgtagtaagatttggatttagggggtaaacagtactaacagagagttacagaactttgtacttctctcatctgctatttagttcattggacttgaactatgggctaggagagtgagaatggatcttggagattatctagttagcagcccttatagttcatggaactaagacccaggctgtgcagtagcctgttcagggatatgcatatgggaaaagctcaagccagaatggagtgcttttttactgaagaattctaaaatgtttctgcttcatataatatcctctctctgtcctttttccccttctttctccttgtcttctctccctttttatttatggtgctatcagtgttagaacaacaataatagaaagtacatggaaaagatcacttaaaatcctaccacaccatgttttaaactattttcatgtattgctgatttctgaatctgttatcttgttagattatgacattgatttaagtttcatagctcaaatatggaacctctataaagaagttccagggagtggaaagggaagggaaaggaattgctgttatttattaagagcctactgtctgtcagtcactctgcctacctgctgtctctgatgtctcaaacttccttcccactttatgggattctgtaggaggaccagcacaataccctgcacaaagtgagcattctgcaaacctaaagaacgaggaaatgaatgaaaggaagtgctttgaattcagcagaagaaagagataacaatcatgtgcgaactactcccagctattgcctattgactgttagctttcagttcatttttgtacaatttaaccattgaggcaaatgtgtatacaggataccatggaatgctgtttacaggtatagattttggttcttgtacttttgaagcagctgaatactgataaggcctgtgtccagaaactatttttttccttcatttaatcaggtttctttacttccttgaccacaaatattatttgctaaggaaatttcttctttggggtggtatttaaccatgcaagtggggaaaattgtgctacgatactgttctgacagcctgtggacttgagggaaaaaactgcaggagcagagtttcctttcagcagtcaactataggctcagtcacttcttgacaaaacataagttaaaatagtgctgatttctttttgaacataatcaattctaatggaaactgttccagctgagtttggaaacacacagaagcagccttcagttaccattgaggctattattgcccta

SEQ ID NO: 30732 - DNA, 1851 bp, Homo sapiens
actacaggtgtgcaccaccacacctggctaattttttttttccataaagatggggttttgccatgttgcccaggctcatcttgaactcctgggaaggttcaagcaatccatccaccttggcctcccaaagtactgggattacaggcatgagccactgtgcctggcctcctgttgtatattaatacttctcttaggtactatcttcggacaattggtgatgtggagcagcatctattgaaaaattttaaatgtctgctctgagaataaaaataaaatgggtctatgaagttgtaattaaataggagactttattttgaacttattaaatattagaatagctgtcagagggccaggcattatgttgtgcacctgttgctacttgggaggctgaggtgggaggatcacttgaacctggaaggttgaggctacagtgagccatgatcatgccactgcacttcagcctgggcaacagagtgagactccatagcttaaaaaaaaaaagtgactgctagagaatggtttttgagccatttacttgataagtaattatgatttaccaaaggttcttcccagagaaaagttggtggctgggtaaagatctcccaggctacaacaaacaaaacaaaacaaaacaaaagcacccctgaatattaatgagttggttcgttggttggttttgtagaggtgcctgtttgatccatcactgaaaatagagagaggctctttatgttttaggtacaccctcctaactgcttaacctatcaacaattttatatactggctgtggaaggtaaagtagagaaaagaatcttcttagactgctttttgtagagatatgaacactttatcttcatttttctctcttccagcaaaagaaattctataaccatctttgttgattcattttgatgtttcataaatttccttgcaaaaaaataactctgctaagaactttagcttgtctcttttctctccatgatcttattgggctttcatctctttacttagttgtttagaattgtgcttcttaatttttataaacatatttttaggtagaggaagagcatcttttttgtcattgattacattatattcagagaatttgatcagtatgttatctatcctttgacattaaggtttgtttcatggcctcactacatggttactttttgttcaggttctctatctgcttgaagataatttatgtttcatgaaacttaacagttttctgtatataaataaagcttgttaattgtgttgttaagatcttctgtaaccttactgatttttatctgcttggtttattaataactaacaaggatgtgctgtactctcccactgtgatgatggattagtttgtccttgtgtttctggcaattcttgctttacatatttttagatgcacacaaattcaaactgttcctaggaaatggaatctcttcatattatataataaccctttatagatgtttttaactttaagttcattttgtttgatattaacatagctatataatctttcttttaattagtagttactaatgtcttttctgaccttttactttcagctttaccatacccttatgttctggtgagtctcatataaataacgtatagctaggaattataattgttaaaattgctttaatccagttttacaatttttatcttttagcaggatcattttgtctatgtttatagtaattatttgctgtcttatttgataattccatttgtaccacctttttgttgcttttatctcatttcttggcttcttctgaattttatttttatctatttcctctctctctctaccttgtaatacatactgtattcctattctattaggga

SEQ ID NO: 30733 - DNA, 1087 bp, Homo sapiens
tttattccagacttctctctgggaccactttccttcaatctaaatgcatccttttgaagttcctttagtggaagtctgctctttgcacactgtatttatttgaatctgtctttatttcaccatcgttcttgaggatttttactgggtatagaatgcttggttgagacttgttttctgtcagtacattgaagatattattccaccaacttctggtttcccattttactgttgaaaaatcatctatctaattgtcattccttttttccctggctgtttttatgatcttccctttgtctttgatattatactatttcatttgtatgtacttaaatgcagatttcttttattttgtccttaccaggtttcattgagcttcctgagtctgtagattagtgtctttcttcagttctagaaaattcttagtttatattaacatttcaaatatggcttctgaacagttttttctctccttaatctcttataacctagattagacacatgttagactttctttatcttcacatcccttaactactcttcagttattccatctgtttggctttccagactatattctgtgcaatttctttgaatttttcttccagtttactaattctcattccttgatctacagttgttacctatttcatttcccaaagtttctatttgtttttctagtttgaccattttctatagtcttttactttttaaactagaaataccaatccgctgtttttttttttctgacatattaagtatgtcttacatgctgtctgattatttaaatatctgaggtctttgcagctctgattctgccatttaatgtcactggctttcaataattgtatattattttctgtatgctttcagatttttttatatgaagtcacgtatctcagaattttatatgtaggaattccttgagccctgagttgaaggtagtttcctctagagaggatttccatttgtgccaaatgccaaaggggtattttcagcctaaaatctttttaaactgaattttttgacctaggatctttgggatttttttcttttgttttgtttttgtttttttttcagaccacccagt

SEQ ID NO: 30734 - DNA, 1047 bp, Homo sapiens
ataactagaatatttatgcccattttatagatggaagcatcaacacataactagtgttattttttttaatgttgcccaagaaacttgggcccaaactcaaacaatggccaaaggcagttatattctctaagtaaggttagctgagcaacccttttcaaggatgaagagatggagactggcctgtcttcttggcagagctcaggttacagttgaaataaatagacgctcctgtttctttctcttttccagttggttatatctcattgccgtttgttcattcacatgttgctgtaattagccaattttaggctaggcaaagggattaggtagcgcattacacacccacatctccctttctgggatttaggatgaaatgagatttatttttccatttgcttcagccaaatggaaatgtatttcttcaatcctatttggctgtaaagtaagtttttatcaggaagttgtacaataatggataatgtgaaatccatttctcttgggtgttttgctcgtaatagttttctggttgttgtttttgttattatatattatataatatatattatatgttattataacaaaataataagtattattattgttaagttgtttccaaatttgactctagacacacttaacacaaggcctgtatacactctaggttctctaacaacttgccagtggtgggttgagatttttctgcatgacgaatgtctcatggtctcaggataaaggggaaatccaaggttgtggcatacagggtctgtatgccctggctctaaaatactcatcctcacccgaggcttaactccataaatttatctttttaatgtacctgtgagtgcatttctctgcctgctaagtctactcagccttgaagctaattgctgcctgctgggaaaccttcacattcgctccctgcagagctaatccatctttctaatcagatccttgagcactcttgtacatgcctctgttacagctcacaattaattaactcattctacttatgtttccacctgggcctcaaagacaggatccatgtct

SEQ ID NO: 30735 - DNA, 1043 bp, Homo sapiens
aaagaagaaggaaggcaccaagcttgggtatcaggcatagacagagaaacaggagagtaaactatgtcccaggagccaagagagaattatttcaaggggcaaagagctgctgtgacctcattttaacaacattaccactgcttagaacaactttggacctccacttttggagtcatctgctttgaaatatccctcagctggggcaaagcctgtttctttaaaggcgaacttaatttctgataacaagaacaggttccttaaaaacaaatctagtgaatctagtggtcagctcatgcctattttggtcaaaagaaccaattatgacattaaaataatgggactggcttttgtgtgtggccttcaaaggaggtttgaagacatttccaaaatgtgtcagccctgacactttttcagaataagcttcataagataaaaccttcaataacattacacatttggattaataactccgggcttttatttttcatattccatctactttggttaaatgttaaatcttgccgggtatggtggctcatgactgtaatcccaaaactttgagaggccaaggcaggtggatcatctgaggtcaggagtttgagaccagcctgaccaatatggtgaaaccccatctctactaaaattacaaaaattagccgggcgtggtggcatgcgcctgtagtcccagctactcgggaggctgaggcaggagaatcgcttgaacccgggaggtggaggttgcagtgatccgagatcacgccactgcactccagcctgggcaacagaatgagactccgtctcaaaaaaaaaaaaattacatctttggtgtcttggagcttcagtctattttctataatccaaatataagcaaagcagtaataaacagcatggtagacagcaggggaaagagcataggctctggagtcggcctggccgagttataatcttacttccctcgcaacttctgctgtccaaattgggtcaaactacttcatttcttcagggctcagtgttttatagggttattgggaggattagagatg

SEQ ID NO: 30736 - DNA, 1032 bp, Homo sapiens
gggcatagactcgttctgtggtgcagatttaccctatagacttatatgctcagtaggaagtacattgagtttttataagcagtgataattctatcttccaaatccattacgcttcagttagatttaatttttatttatcaatatttatcttgattaatgatcttacctctagctaggttacaggttccatgagaatagggacagtgtctgtgtctagtttctccctagcccagtacaaggcatatggtactcagagacttagggatttctaagtctcttgagtaccatatgccttgtactgggctaggtgatgtttaggatgggtccttaaacaggatcaaggccaaaccacttacattatagtgaggcagtcaaggtcctgacaggtaagtgatctgctcagggctcagagctaggtagtgagaaagcctgtgccaaaacccaaatctcattcctcactctgttctttgcaccatatcactctgacattgaatcaggttcttgtagtgatcttctctgtgtgtctagggccaaaaggaaatgtgtttcctaagctagagcttcccaacctgtttctcaatatggctcacagagaagctgggaatatttgtctagaacagtatggtaaacaaaggaggctttggagggcagccgaagaaagaggtcccctaggagactaatgcccagaaacctccaggctacccaagggggatcataccttcacacacctctcatctactatgctccctgtaactgtggaaaaactctttcctaagttaatattagatcacttgaacatcagtcccatagtgcacagatacaatagtttcccaggctttaagactctgtataaaaattgttcttcaaaccaaaaagaaacatgatccttttcattgtatttcttgaagtacctgatatacttagatactgctgtatctgtaaataaattatgataccttataaagttttaaaggaaatttacaagtgttattttctagtaattaccttgaaagattacattggtccaggaaa

SEQ ID NO: 30737 - DNA, 1059 bp, Homo sapiens
tctccccatatgtaagcccctagtaaaccccatgtctcatttgctgcctctgggtcttttcttcagcctcttgaacctagtgccttccctgctgaggttaataggggtacagcacaacagtgttgtaacacagaaagtgatatttacagggatatctctctcacaatatctcttaggaaaggtaaataaaatgttcacaacttgtaggtgagtaattccttagataagttgtttcttaacttgggaggagtttgggaaggaacctaagcaggctgcagaggctgggcatgggagcttgtcatggctggaagttgaaatggtcaactccaggcagatctcctggggcaaagcagcctccaccaccagtagcccttcctttctgtttctttcatagccccactgctccatctgaagcctgaacccttccagaaaattgatggatagattttttttttcggctatatatagttttagaggttagaactagatataattcagtctagaagatttctccttccccagaaatgattgtttttgtgcagagccccgtcaaaatagtacggagacttagactgagttcactcatcactaacaattaactttataaacattcaacaagtaggacaactattattactgttactcagaacccttcgctctgtatatacagtttgatttaagatgccacatttacatggcattttcaaccttcaaactctagcagattttaaaactaggtggatgaaaatagaatcattctaataaatgtagtgtgtcagatttgaaaaatcatttggtgagcaggatctctgtaaagttatatgggccacgtatacaagacgtaactgaagaaaattaattcaacagagcatgccgtacttgaacgacttagagatttactcgaactgaactaactcaagctggcagaactccgagcagcctggattgtaaagtctgggtgaaaatagatggagtatgcctgactgaacctctgtactgccccacatgctatacaggtgggggattggatggctgttaggtgatcattgcattctcttt

SEQ ID NO: 30738 - DNA, 1035 bp, Homo sapiens
atttacaaatagataagtgcaacggtatgtgggagtgtcagaaaagcatcacagtacttcagcacatctacttgggcaatctcaaacatgtattactcatgtaccaagcagtatgctgttcacagagagatacaatctctgccttagggatccttggggaaaacatgtacaaagagatagttttagcacattctagtaaaggcagtgatcaagggcacctagccttacgtggcaatttagggaaggtaccttggaggatgagacttctcctaaagtcttaagaattgaaaagaacatgggaagggaattccaggctgggagagtagtatgttcatacgccctcagtgtttaaccttctttgaacaaaaaaatggcaaactacagaaagtttggtcttattgtagcctaaattgtacttaggggtacgagtgagaaacagggattaagataaaggacctgttttgctgtcttgtttactgttgaatagtagtatgaagtaggtcctgaaaaactatgtttttgggggaaaaaaaaaaaaaagactgaatgatatgttgggtttaagtccttgcaggcaggctatccaggtaaataaacatggaaggtgatgggaggtaatctgggctggaaatacagatttggaagtcaccccatatcagtggtgtttaaaatcaagagcaaatgaaattgcacaaggagaatatatagaatgaacaaattaccatgggtgaagccttgagtaatacagacatttaagaagcaaacaaaagacaaggaacccatgagggagactggaaaggaaaaaacagagaaataagaaaaaatgagaggagagaattgatacattttcctcaggtgtggcattatggagttcactggtgtctcatcagagaagtttcagtccagtggccagggcagaatgacattgtgtcttgttttaaagtaaatgggtagggtaagaaagttgagaagggttagcacaaacctctctttcaagtcacttgccttagaagagaaggaagggtatggtttctg

SEQ ID NO: 30739 - DNA, 1057 bp, Homo sapiens
cgcccagctaatttttttatttttttatagaataagagtctctcactctgttgcccaggctggtctttcacccctgggctcaagcattctgcctacctcagcgtcccaaagtgctgggattacaggcatgagccactatgcctggcccattcagctaacttttttaaagtatttttgaatcactgaagtgcttaatcatggaagtaaccagaccaccattcatttgcatgattctgttaatgccatatatagtatttcatagaatgatccttcctcatttttcaaaaatgtgcttataaaatttgtgatgacaattgaacagcccaaccctatgaaatggtaatttatgcagcaataaaaaataaataaattcatataatgtaggcttgcagctgaagacagctgtgttaaacatgttttttagtctgttacatcaaagtaatacatacagtgctgtacgaaaatgtgtagggcgaatgtctttgaggtgcccacatataagctgtgcttttgtacccactgtgtgaatatgagggaagtcattgttctgtacccatcaggaataacacatgcaatgatgaaaatattaaaaatgcctttctttcagatggtgcagtctttttacagctattatctcacttgccttaagtgccatttgaaaaaaaatttctcagggatattgttatctaacttctttgaattactgaagtagccaagaaatctctctagcactgatataaagaaatggaagtaccagccgggcacagtgactcatgcctgtaatcctaacactttgggaggccaaggcaggcggatcacctgaggtcaggagttcaagaccagcctggccaacatggtgaaaccctgtctctacttaaaaaataaataaataaatatatatatatatatatatatatatatatgtatgtatgtatgtatatatatgtatgtatatatatatatgtgtgtatatatatatatatatatatatatatatatatatatatatatatgtatatatatacacacacaaaaagaaaaaaattagccaggtgtg

SEQ ID NO: 30740 - DNA, 1056 bp, Homo sapiens
aaccatttattactgatagataatgacagagcagaaacaggaggcaccagttagtctgcattagctcatgagcctggataacttttttgtgaactctaaagatttgtgaaattctatcatttgcattaactttctgataaatttctgatgtggtcagtggtcctctagcccctggtcactgaaactcattctgcacactgccaagaggtatctacccttagaagatctttgcccaaaatttcccccttcaagtgctttttagaaagaatgagcacctttgccaaatctaccaagcctcctctctggccaattactttggctactgtgggggagggaatcctagcatgtaggaagatgtgtagtaagaatagaaagatctatgttttactcagaattctgcctggttgagaaggtaagataagtatatgataaaatcaaggatcatattcagctaatgtttattgagtacattctttgttgccaaacatcagccccaaagcacagtatatagatattaacaaacacaggattaggttaataaggaacttggacaactggaattcccaggttaaataaactgaggatattgctcttagaagaaaagatttagtggaaatgagataactcgtgttaaaaataaatacttaaaggggttgccgtgaggaaggtataaggggcagggtaccaggtatatatggttagaagttgcatattctgcttatccttttttaatttaaaacacagactactagaaataaagttcaaaagttaattggagtaaagagaagattgaacaaaaaatcatcctagggggtcaaaggttgttttaaaaggttgagaaaactgcaattggttctctaaaattagtctcaagaaagtgatctagggcccatcatggtggctcacgcctgtaattccaacactttggtaggctgaggtgggcagattgcatgagcccaggagttcaagaccagcccgaacaacatggcgaaacctcatctctacaacaaatagaaaaattagctgggcatggtggtgcacgcctgtggtactggg

SEQ ID NO: 30741 - DNA, 1091 bp, Homo sapiens
atttagaggtctctttatcactctcctagacagtttctgagtgctgagcattggggctattgggtcagcttttgtttgtttgtttgtttttgagacgcagtttcactcttgttgcccaggctggagtgcaatggtgcgatctcggctcactgcaacctccgcctcctgggttcaagtgattctcctgcctcagcctcccgagtaggtgggattacaggcatgcgcaccacacacagctaattttgtatctttagtagaggcagggtatctccatgttggtcaggctggtctcaaattcctgacctcaggtgatccacccacctcggaaagtgctgggattacaggtgtgagctactacacccagctgggtcagctgtttataacttttctgatttcttggctgtgaagactggcagacttctgtgagggtgccttgctgaaacttcctccctgatgtgaatgctcctaatcttctgtgaccttgaaactaaaatactttgccatatgaatatgcatataaaataggagtacactaggaagctctttcacatgtaaagtccatgcaattcataaactggctgctcttgaatcctttttatcctttcacttatttcttgaatctgaattgtaacattttagatatgtgcaaagttgctataaacttataaagcagacatttcctttatctcttttcttaatagtgcttctaggaacagatgcagatttcatgacatcttagtctatgttatctaatggcaaagtgagaattagttgtgtccaaaatatcaatcagaatatttccatctaattatagttcacagcttccttatgaatcattttatatttacataagatttgctttaattttgttgaacagtaatggagatctttaaatgggtttttgttagtttttcaaattcaccagtttctcacatgtgtgtataattcttcataaagacttctatagcacctcattttgatatttttccttgtcaaaatgatatttcctgaaaatgtttgtcatcaaaaatcagaatttataaaatatctgatcaagtatatgtctgtatctgattatcaattaagctgaa

SEQ ID NO: 30742 - DNA, 1071 bp, Homo sapiens
ttgatgcttactttacccatagtttttgtgttactaattaacacgcatttttctttgaattcttcctgataataaaacagactctttgttattgtagggagttaatcgaggccgtaagatttcccaattctgtcaatgaccatacttagctaaaagagagaaaggctgagtggaagaattttcctatgcctatagtagggctcgtccttcttgccactacacagccccatactgtttgtggctatttttgttggtctaaagggcacaggcctctgaaacaaaactgcttttgggtttgagccagatgattaggtttgtatttatttgatcacattcacaaaccgtatttgctaactttcctaataccaacttgggaagattttttttaaatcactttccttcttctcttccttccttccagtgttgtcttccttccccacccactttcagaaaggatttgatgttgcctagggttaaaatagataaataaaatcaaaaccattaggatgaatacgaaggaacggggaaagatgttatactcgaatccctgaggtaagatggctttgctgttatattgagcagtgcatttagctctgagcttcctggtagacaaagtgaaacaagtctttgggttcatgttatttctgtttgctgaggagaaacataccaggtcgtccacagagacattgttaccaggcactttattctaagccagtgattttcatgtaagtgaagctaaataatcatctagaataggggattcacatatacattagagtttgagaagctctgctgtagtcgacctccattttttgttggtaagcccagggaagataaataatttgccggttaccaggcttggtggtgataacacaggcttagagccagtttgccttggtaccagcctgggcctcggagctcccttgtttggaaagcacaggtgtagtgagatgtggtattagagctggtatggtcaagtaccttacctcgctcccaggcaatatggacacagactatgacctgagtcttgggatttagacttaatgaaatcagaatatgtgaaagaggagt

SEQ ID NO: 30743 - DNA, 1046 bp, Homo sapiens
cactgcttccattctttctctcctgcagccagaactgtaagtcagatcacatcgccccactgcccacaatcctccaaagtctccgcatcttactcagcatgaaagccaagatcctcccaataacccataagactctccgacctcatctctgcagctacattggcctcctgtctgttcctcacatatgccagctcatttcctccttgtgacctttgtccttgctgttccctatttttccaggtatctctacggcccattcatcccctgcatccctttgcttaaatgtcatcttctcagtgaaacctgccttggacacgctatctaaacttacacacatgaatacacacatccttcctctccaccttctctgctttttgtttctccttatcacatatggtctagtacactccatcaattttttattacctgttttctgcactagaatgtagattccacgtggatagggactttatatgattttgtgtatttgttcactgctgtttacatctggaaatgagcctcacacatggtaggtgttcaataaatgtttgatgaatgaatgaatcttaaaaacaatttttttaactttgggccaaataaaactcttcaataggccaaacctgggctgtacttcttttggcctagagtcaaaaagaagaatgagtgcttctccagcagctccttgtagcttgggaacagactttatgaatgcatcatgatgcctgccctgctcaggaaaccacagatgagttcttcccttccattcccacatgtaccctcctacttccaccctgctcaacttcgatacatgcttattgttttgtgcctcaacattgtttttcccaaggtattgctgtttagaatatggaaaatgttgtgtgaattatttcagcctcctgagtgaactttcaaatctctgaaggtagcacacatttgaacagtttgacttgctttctgcaacacagagtttagaactgggcaagcaataagtcagaggaagattatctcagagggaaaagcatgtgtaaagacaggtgtaaaaatac

SEQ ID NO: 30744 - DNA, 1116 bp, Homo sapiens
taatccatccctaaaacattgtcatattaatagaaattctggaatttgacctttaaatgtagtcattattacatattaaaggatctacaaagggcaaaaattgtggcagtagatgaaaacaatagccactgaaattttttaaagcccacaagcttgtaagattcctcttaaacaaacagaatgatccagtcacagagcttagtgctgtaaatgtcaatataaacttgatttttttttgtattctaataagaagaccagccagtaacaaaaaaacattggctctgtgaccagccaataccagatacagtgaaatctgttatctgatgtttcgtcagctagcctgtgagcaccatcatgtaataaaattctctaaactgtgattcacggtgctacaagatctttgtgcaccttttgactaatcagagacaaatcatatcaggctcttgtattattttattaccaagtgtattttattttaattctttggaaattggtaatccatgtatggttcagacattgttaaccagagtacataattagaacaattccaaccatgccagatgatactgtatttactgaagaattttattgccttttatggagaacatgagggaggaatagagaacaggttttttttcttttcttttgccacatagctgataacccagttgctataaccatttcttccacacaaagggacaacaacatgagaaatacacgttttaaagttcctaacaatcgagtacttcttacgggaagctgggacagttcaagaaaaaaatggattgaaggagaggaatagagccaaagttcccagaccttgacaactagggcaaatgtaacaagtccacattcatcatggaaaaatgtaaagtcctacatgtttgtggaagaaaatgactgcattcgcagaacaagagggataaagggctaacatagcctgtgctggtcacagccttctttgctcatctctctttacctcaatgtgaagatcagtgacagaccccctgagcagggaatgttttttgaattataatgatggagacaagtatcctgtgtctcaaattgacaagaagtactccccagtcctcaaagctcagagaggctttcttcagg

SEQ ID NO: 30745 - DNA, 1035 bp, Homo sapiens
aaaatatggctcctggatcaacagcatcacctggggacttttcagatatgtaaagtattaggccccacactggaccttctgaatcagaaactctgggaatgcgacccagcaatatgtacttttaaaacccttccagattattctaatgcacattaaagtttgagagccactgctataagggataagagaacttagagagatggtctttactctttaagagattaccatctattttcccttgcccacctgtcagtgtctgaattcaaactggaatttctgatagctaagagctgacagcagtataatgattttgttttaccatgtctgctagattcagaaatgcctcctgcagctctctgtgggattcttttctttttattattttaatgagagtcaatcactcatttataaaacctcttacagaaattaaagtatgtttcagatgacagttacacttttttatttctccaggggtctgatttgcaaagaattcttatggaactggattgttttgtttatgtaggcagtcatttgccatgtggtgatcttgaaaacagactaaataaatggtttgaatggtgatgtcatggatagtggtgattaaagcaaggatgatgtggaaggctttgcttcttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccattttagccgggatggtctcgatctcctgacctcgtgatccgcccgcctcggcctcccaaagtgctgggattacaggcgtggctttgcttcttaaaccacccagggaccagaccaactcctgaaatcctgggtcacagtttaaagatttttacttgaccataccatatttatagccagtcattactt

SEQ ID NO: 30746 - DNA, 1035 bp, Homo sapiens
aacagatgcaatcaaagctttccctaccctaccacccaggcaagtcattcatgtccttgtgttagtctgtgtcccaaagacccaaggcacctccaagaaccctcttttaagtgcctccacagcataagctttaaagtcaagccaacctggatccaccactaatgatgggaatttaggaataactacttcctaaaattgtgaaagattacatggagcatatgtaaaactccaaggcaatcagagaaatgcacatttaatcaaagaaataccattgtttgcatgtcaaattggcaaattttttaatggtgattcctggtattgacaaagatacagtgaattaggacgtgcacttgcacactgctagtagatgtgtaaatggcctttaaagcaattttgccatgttattataaacctggatggatgcatagtgagacaaacatgaatgatgaaagagcctctgtgtgtgtgtgtgtgtgtgtgtgtgtgtgtgtcagagagatatagtatcttttgactcagtaaacacatttaactacaaaacatcatctgaactaacacacaagtctatctagattctttaacaatttaatgtaaatattcatacatcttgctataggaatattaatgttggattagtgggtgctgccaaagaacccactgcaagtttcatataatacatagtatatgtatcagtttacttttctaaaacatgaaaaattctgaaacaatagtttttttgttttttgtatttttgagactgagtcttgctctgttacccaggctggagtgcagttgcacgatctcggcttactgcaacctctatctcccaggttcaagcgattttcctgcctcagcctcccaagtagctgggaatacaggcgcccaccaccatgcccagctaatttttgtatttttagtacaaatggggtttcaccatgttggccaggctggtctcaaagatgtttcttctgtttgtgatttcagaggttattttgtgaattcacaggtaccactcccaagaaagttcagcttgct

SEQ ID NO: 30747 - DNA, 1083 bp, Homo sapiens
ccagacagtttatactcttaagaattttcactgcttttcacagacattaatagtttcctggcattgcctatcaggaaatgtcgtcatggtctggaggaaccaataaaaatacaagtaacctgttttgacagatctcttttctgccagaaatttcagaatttgtggtaagaggaggtggcagaatggagggccagtctatttgtgagggcataagcagaaatatttgccctacgagagggagctgatatctaccctggatatgagaaatagaggactcacactatccagttcattttgttggaaacttaaaaaaagaaaatctggtttgatagggtaattcaagtctatggtacattaagatatttttctccttttttttccttttatttcaaacataattcttgtttgatcctcaaataaaaaactcatgcgttaaaaattaacagtatttgattaaggatgtacacatggcactgtcataaggtatgcagaaagaggccgtggatttggacagtgataccaaacagctaacatgaagtgctctgtgctcattcctgttacagccagagcatgattctgaactcctttaatgtgagaaacactgaatatcatccttagatagttaattgaagttagattttgtggggaggtcagttgtttctcccttgcaagtttgtggggaaaattgatcaccataatacttgaaagagtgtgatcagagtaaaattaatagacatatctgaaatgactgtttgatctcttctaattaatgaaattttaaagaaaattttatactagtgccaattttgagtactctgttttacttaggacttgaatattaaataatgttgatttattctccccatcagtttagttttcaacttaaatacattttaaggtataaaacttacagataaaccttgtgccaatttaagtggatgtatggggttgtaataagatactgcccatccccatcaaaagttgtctatgaataaagacttcatatcatcgtggggtttttttgttgttgttgtttttctttttttgagacggagtttcactcttttggcccacgctggagtg

SEQ ID NO: 30748 - DNA, 1025 bp, Homo sapiens
aattgctctttcttggccaagactgctcctccccaaatgatccttgtctggctctacctcctgacttttcacctcttattgtcttcttcctgccctggtcccttttcctgtcagctctcaaggcttacacttattgggcacccaacttcattatttcccaggtgtgaaccagtgacccatcaaccaggtgtcttcagggggactttgccatatcagctaattacatttttacaatttggtgtcttgatcggcagactgaaactgaaatatagggaactctctcatctgcagcagttcagaggaccagttgtctccgtggcaaagtaattagcacgttaggataaaactgtcatctttgatggacttaaaactgtcattcttccagaagagaaagatggactcatcacccacttgagcgttacatggaccatattttaagaccaaacactaggcaatatgctgtgaactaaaggtctactgatcttggccactgcaaatctcatgtgccaaagtctttcagctctatctccccaagcccaaacccaaggattattcagtcagaaatagaatgtgtgtaaaattgataggagataattttctcattggcctcctgccctagttcattctgtgcatttccaaatctgggctcaaacttgaacatggctctgagagctctccttgattcaggcttggagctcaagtaacagagttgtctctggctgacttcctggattcccccctttctagatggcccttaatggtgcctgattttctcttatgactgatttcatcaactgaggcatttgcagtggtgcaatatcttgcattactttgtaaagttgtgacaccttctctggcatccagttccagcattttaactgtcaaccgaccatcgcaccccacctccaatccccagctggtacagtcttctttgcaacaattaggaaatctttattgccttccagaaatatgggattgcttgaacacagctgaaatacagattatctactggacagaggtgatga

SEQ ID NO: 30749 - DNA, 1102 bp, Homo sapiens
cacattttgttagagctcctcaaagaaggccaggaagtttttcatgccagtaataaaccttgaggaagcctaggaaataacccactggtctgtcttctaacatgacagccggtgttcactctacattcaaatgcagagtagggtgtgtgccgggcaagatctcctgtttgattcctctgtgggtcttgtctccaggagggctttattaagaatctttccactcactctttttaagcttatgtccctttccttttaaaacaccagaattcaacattcattacctttcttccctttgattgcccactgaagttttcacagaggaagtaatggttttcctgtttcctttcggtgtggccattttgcacgccatggttctccttcccttttttcagtcttgcattcaagtaaaagcaagtcgtcttctactgttaactgcgggaaaaggtttgtgggggccttttttttcccttccctcctccacaactggaaaatatgaggcagatcttgtttatgtatgctgtaacctcaaaaagagctgatacgctgttgtcattaaagaagaatcccaagctgtttatcctgcagtggagtccgagagctctaaatctgacagcccccctgggcctccaggcacagactgtggagagctcttcgctgctttcccaggccagctccaaaatgcaaggcaaaggtttccgttgctgaatccctacactctgggaacagacaagatgtcaatgttgtggctttattaaaaatcagaggctttcttcccttgtattaacttgttctttgaaatctgttttccagaggccttttctactctaaaatgtaacttgaatacccatctttctgctacatttttctctgtggatctcttatcatgttccagaaatcattttgcaaatttattctatagccagtatgtttggcaaaattataataaaataagctttcttatttatctaaaaactagtaaaaactatgcttgagaaatacatctttctgttgaagtttggttcccaatgtttcttttaatcttattttctatgcatgtgcaacatttgatttttttttttttttttttttttttttttttttt

SEQ ID NO: 30750 - DNA, 1074 bp, Homo sapiens
tgtaacactttttatattccatattgttttatattttttgtgtttttcctacttccattactaaactattaattctttgaaggcaaggacaatgccaagctgcattctgtgtcctccgccatgctttgcattcagtagttactccgtgtttgactaaattcatgaccccagggacactgtgcttcctctgggtttgttcatttacttggctatgaaagacaataatttgcaaagccaactttctcctttttctgagatcagtgactaaattatattaaaagtattttgcagtgctataagtgtataggagagaggttttctgtttagggaatgttgctaagccctgtcatcaaaaataacctttccatctaccactaagttctgccagagcatagcagattggcaagagcagttgaaaggaaaaagcaatgtaatgccctctgcttatggcactacaggtgccagtggaggaaaaaagtgtgaggttgaggcttgggagactaagtgctgtaaaaatgaagcagaccgactgtgggtacacagatctagtctttgtgaaataccttccctgacttttgtatattcctgttcaccctgtgattgtaggccaggagtctttaataggaaactggtgatttgaagtctccccacataagcagaccaagcagctttttgaaagaagcccactcagaccatggagaaggcagcagctcacagtggcagcaagagctatgagacagcaagagtcagccagaaacacacatgcagaacccgaagtcttgagcacagcaggaggttgggcaaagctgctccattctgaaggttattatggccccactgggggctgccacacaagtactggcatgaaagcaaactagtgttgggataactgttttaatatttgcaaaatccactctaggtgtgagctcctttgtgtaactgaagatctagagtctttaggagtttattcctcaaaacttgaatcaggttttttctaggcaagttggaagcacggattgggcaggtaacaacaaccattcttcatgttgagcaaaaaggaggtgtgggcagtta

SEQ ID NO: 30751 - DNA, 1035 bp, Homo sapiens
ttcatactccattggctttcgtttttttcttgctttccccttgattttcttcttgtttgttccttgctctttctggactcattggtaaaacaataaagaccttttattgagcagttaatactgttactgtataaggcacactgtaacataatcctcacggcatccctaggaggtaggtggtacccactttacaaagaaccagaggctcagagagatgggttctgggggtcatggcccatctgcttggctgtgagccagactccaaggatactgttgctttcactttcctttttacctgtcctctctctttcagctcaggaaaattggattaaccgtgttctcatgtgttttgttggtcacatgccattgctattttctgccaagcaaaaaaataattacaaaaccttaagctgttactgcccccttttaatcacttttctcttgctttaatttctttcaccaccaaattgctttgaagagtccaagtcctaacccctttctccaaccctatcctaatttccctggccagagaaatatcatttttttctgaattgacatgagaatctgcatgtgctcctctgcctcatatgagtgttgcccatcttggtccctgcttatccccaggagactcacctcgaggacagattttatctgtgcgtctccacagcgcctgacatggaaccttgcccttaattggcactcattatttgtgaaatgaaggaatgaatgaccataccggtatcccagttttctcatgactcttcccatctcagccctttgtcccagcttgtgagctgtcccctccctgacacagctgcctgcagaggtctcttggggccttgtgatgccctatccctcctccaaccacatccctgatttcccaacacaattccctccttgaaaggctcctccaccttgacattcagggctggggtctgtcctctccatccctgcctgcccacacagtccctccaactcccctgtggcctccttcatcctctctctcccactgctcttctccctctggaactcatc

SEQ ID NO: 30752 - DNA, 2108 bp, Homo sapiens
agaatcaaactcactagattatgagaactaaaaagaaaatgtatgtaaagtgcttagcaccatgtcagtatttagtaaatgtttgctgtttttaaatgtttgttccattttatatcttatgttgaatgtccctttaaaatttaacatgattgaatcagcatttgtttcctatttaatcaacattgtcttcaagtatcaaacctaaattaaaatatcaaaaatgtaatattccaaatttttttacttaattttaaaattagtcacatttagggacttggtatgtttgttttgtgttacaaattaatgatactttattttaatctaatatttacaataaccagaaaattgaattacaattgtaattataatgaaccatgcttactatattttgttttgtttaaatactcaacaaagaagaaatgctcaacttgggaggtgtgccctgttttgccatatttcaaataattgttttctgttcttttttccagtttgtcctaagtgggtaaaacttaggaagaaccacagtgagaagaaatcggtcctgatgctgatcatctgcagctcggccgtccgagccctggagctcattaggttggaaggttcacctattccatatcataaatgttttctgaataactgatatatgccaagctattatgttctatgtgctggagatgtagcaataaacaaaacagagtccctgccctcatggaatttatatttcagtgggggagacagataataaacaaatgaagatacattataacgtcaagtacattgataagttatgtaaggaaaaaataaagcatggcaaagggatataagtagatcaggactacttttaaaagggtggtcacagaaagcttctctaaggagatgacaatttgatcagagacttgaacaaagtgaagaagaaagcccagcagctatctggaagaaaagcattccaggtagaggggagagtaagcacaaaagaccccaagataggatgccattataggattttgaggacttacttgatctgaatcatcattttaaaggttcactttggctgctgtgtggagagcacacattatagagagcaagggtaaaagccagatcataccccaaacaaccagttagaagaaaagatctgacttaaaatagtaacaagaaaagacagaagccgggcacagcagattgtgcctataatcctatcactttgggaggctgaggtgggagaactcttgagccctggagcttgagaccagcctgggcaacataataagaccccatctccattataaaaagaaaagatagaataccatggaatatacttaccaaaacttatgtacagacaacatcatctaagggatgcagaaaacttggacaatcaaaaatgtataccatattcttgaacaggaaaactcaatattgtaaggatgtctgttttactcagggtagccttcagatttcacacattcctagtaaaactccaatagaattgtgttgtttttttttttaactggataaactagttctgaattcttatgggataatatacaactaaaaataggcaaagaaattctgaaaaagaatactaatgagaggattatattcctagagattacaaattatatatatatatatatacacacacacacatatatatatacacatatatatacacacacacacacacgcactctgaagtctcaataaaataattaacagtatggaactggcacatgcatgacagatcagatgagtggaacagaattgaaagttcaggatcagacccaaatgcatatgaaaatgtagcatatgcctaaggtgacaaatcagaaatcagtagggaaagacggattgtttaataagtggtgttggaacaactgagtagccatctggaaaaataaagttggattcatatctcacttataacaagataaattccaaatggaataaaaacttaaaggtaaagattatgttttaaagataatttgtcagtgctttactaagggcttgcacatacgttttcatttactattgtttttgtagaataaacaaaaaggcttccactggtcagtggtaatattcagctttcagagaagagccgtgagagtcagatg

SEQ ID NO: 30753 - DNA, 1022 bp, Homo sapiens
caagaggattaataagtgccaccaagtttctaaaactgcagaatcagaggcattgtgcatgctgacaatggtttaaagggtctctcaattttactttaatcccccatttaacctttgtttctttcaaaaaatcaactgaaagcggttaactgaatataaatctattttacagcatttactacgttaatttaaaaatcaacatgctgtaaaatacttacattattcacacatatatagacggaatcatccagaacataatcaactgccaaccccccttaaaaaaaaaatcaacaaatcagtttttatttgcatggccaattatcatttgtactctttgcaactttatttaaaaatccctttaacatgttctaatcttttgttgcacagggaataaaagctgcaagactgcaaacttccttcaacagccacacccacaacacctagacatgaaacagatgtaacaaataacaacaccacaaacagaaatactgatttccaccattcaacacagttcatgacagtgtctttagggttcagttgaagagggggtaaacttttaaaaagagggtcagtctgctttccccctgttttataatgttggtggttttaatccgtatttctttgcaacttctgtctgggcatgggcggcatcgcaaagtgaatacagatgggccatctccatttccgatttggccaggttaatagctttgttgaacatgtcaatggctttctccatgtttcctctaaaagaacaaaatttttaagtctcagattcaacaagcacttcacaatattcaatgaaggttgtaagtgatggtacatgaagtctgaccactaagtttcttcacaatattcaatgaaggttgtaagtgatgctacatgaagtctgaccactaagtttctactatgattctagtaaaatgcttcttttaaaataaacaagagtacctaccacattgaaagcactcaatgaatgtcaactactattacaaatactatgtgcttacattatatcccttgta

SEQ ID NO: 30754 - DNA, 1050 bp, Homo sapiens
tggaatacacggtattttcatgaagacaactattaatagaaaaatcagagtccagaactatggttctccatttctggtatactggtttgcagaagccttacattaagatttcataaatgattgttttgctgttaagtgcaacaacatcacagtagagctacataaagattgaaaggagatattttatcaagtggcaccagaatggactgattaaaatagaatggcctaattggaaagaatttcaggatcaccggtttctcctgcttcatgtaagttcctattagtaaattgccttcaggcaatagggtttcttagcaacagactaaaaaaatgggctaaaaatagcagtggaattgagttgatcgttgcaggcaataggcttttctcccctcctgatcccccaatccccaaaggcaaattttctgccccttaatataagctctgccttgcctttttcagaacacaagttaggatttttttttttttctgaaatttcagttttgctgtggcctcttggaggattgtagagtgctaacaattacaaacttgataggaactaaaacatatttgaagttttttttttaaacctttttcttatttattggagtaagcaatacactgttacggttaaactccaaaagttacagagtttactgtgaaaagtcttccttcagtccctgtcctcagctgcacagttcccctctccaaagggaatcggtgttattttcttgaaacattttttggattaatatttatctaaaggcctgattttgtttggctttatttttaaggttggcattagtaaacgaatctgttctggttacttttatactttgataaacatctcatttccattctctagcctatgctattctctcattttctcctccatttcctaattgatggtactgtagagccaaatagagtgtcgcttactggctttgggaccttactgatctgatgcatgtttttctaatctgtgaaatggtgaaaacatctacctctcaggctatagtaaagatttaattagagaatatttaaagttctttt

SEQ ID NO: 30755 - DNA, 1065 bp, Homo sapiens
aggggaatagtttaagcttattattttttcttttttacatcttcttggataccaatattttaagcttcttaacacatatttctcaaggctttctaagaaggctgcacacatttttaatcccatcagtaagggatgatagttcctgtctccctgtactcctgccagtgttggtattattaaaacacattttttttgctaccctgaaaggtaaaaatattgttattttattttacataatctttgactgctaattaaatattaacattcgtaaccatttggtatttccctttcttctattctttatactgtacattcaatatatatttaatgaacccatgctgtgaacaaggcaaggtgctgggtactagcagagagtaaaacatagccctgatgtgatgcagcacacaatctagtggagaagagaggcactgaacaaaattacccgaattattaatgacagttgtgataagtatcccagaggagaagcattggaaaccaggagagcatctggcaggaacctgaaccaatcagaaaggtagaaaaggctttctgaggaaatgcagtttttcctgtgactgaaggatgattagccattagaaagatgagggagtagggttgtggatgaggtcactggcagggaggagcctgtgccagtgcctgcgctacacaggagcaggtgagctcgagaaagagatcaaagaccagtgagaaaggaaagatagaaaaggaagactagtctagaaccttggggagccccaacagctatgagctgatagaaggaagaagtgagcaaatgtctaaattacagtggcagcaagatcaaagggaaagcaggaaggtgcggtggtagcaagcaaggaaacagtgttttcaaaaggctcctgtggataacagagttgaatgccactgaatgacttagatgaagaccaaaaagtgcacagaatttggcaacatgaagaccaatatcctgatcaaaattagctgtgggcgaggaagctggactggagtgagttgagtgagtcagagaaattgagagagcaaatgtcataattatttcaaaaagtt

SEQ ID NO: 30756 - DNA, 1075 bp, Homo sapiens
aagattacacagtgaacaagtggcaggtgtagaaccagtctaactttgtagcccgagccttacccaataggctatgctaccttaggtataatacagctacagctgctcttcgtgtttgtggtggtgatagttgagaagtacatggaaggaagatcattggagaaagggcatatttggagatattgatttggtaaaatttgcctggcgggggccagaatatcaatgtgaatcttgtctatgaaatgtgctccatatggagacaggagacatgtggatctcattgcaggcatgcactctgtcttttcaccttgtttgaacaaaacccacatagcacctggttgtctagcagacactcaatacatgtcaattgaatgactgtcccctttgaaaaaggaagttgtgaccacactatttttatttaaaaaaataaatagagagactatgaaatgtcccaagacttgtgggaaaatgggtcagatgccaggtaaacattctacttctgcttttggggcatctcagtttctctttttatttctggacatgctgtggttttgggctaagaacttctcatggtgaatatcaatgaaggtctattttaggtatatagttattaatcatacccattctggatttggcatctatctttttgggaattcattccttaaatattttgtgtattgaatcaactttaaaatatttgaaaaatgttttaggttgctctttatctaatgtagttgctcttttcagtatggcatagtgactaagcacacaggctttgaagtcagactgtgagggtttgaattccagatctgattcttaccaatgtggccttgagcaagtcactttcctctagaagcttttattatctgtaaaatgggggtactcatatgcattacatgagaaaagccatggagagcattcagtatattgtctggctcacagtaaagcctgtacatgtaagcaattccttttttattgtggtaaaatatataacataaaatttaccatcttaaccatttttaagtatacagttcaatggcattaagtacattcacattgtgtgtaaccatcacca

SEQ ID NO: 30757 - DNA, 1088 bp, Homo sapiens
gactaacagcggatgtctcggcagaaactctacgagccagaagagagtgggggccaatattcaacattcttaaagacaagaattttcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaactggtaccagccgctgcaaaatcatgccaaaatgtaaagaccaacgagactaggaagaaactgcatgaactaatgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccgagcaaatggaaaacaaaaaaaggcaggggttgcaattctcctctctgataaaacagactttaaaccaacaaagatcaaaaaagacaaagaaggccattacataatggtaaagggatcaattcaacaagaagagctaactatcctaaatatatatgcacccaatacaggagcacccagattcataaagcaaatcctgagtgacctacaaagagacttagactcccacacattaataatgggagactttaacaccccactgtcaacattagacagatcaatgagacagaaagtcaacaaggatacccaggaattgaacccagctctgcaccaagtggacctaatagacatctgcagaactctccaccccaaatcaacagaatatacatttttttcagcaccacaccacacctatttcaaaattgaccacatagttggaagtaaagcactcctcagcaaatgtaaaagaacagaaattataacaaactatctctcagaccacagtgcaatcaaactagaactcaggattaagaatctcactcaaaaacactcaactacatgg

SEQ ID NO: 30758 - DNA, 1055 bp, Homo sapiens
acatacattttttttacaagcattattttctccttttgtccatataattctggtttcttttagcttaaaaaaattttttttctattcttatttcccgaaatgaaaggttttagtatgtattgaatgaaaaaggattttatggtcaactaagtaagggaaagctggtttaaacaaagacaaaagtgtttctttattgtaggagttttcagattatgtaatatgcttatatacattttcagaagttagtagtatgcagtgttcccagactcatttgttgacaaaattatctttatggaaataggttttgaatgaaaaatgtttcggcaaacacactgagtagaattatagtagtagactgtatttcctattcttcaacctgccttctttgttaatatctctgctgaaattttctctttaggtggttaccagtgttttttactgtggaacttacttgcagtgtatttaatcttgacctcactgtttagcactgctacccacaccatccttgtttttaaatacttttacctcttaacatctctgacactgcttaacctagttttcttatcactaacagttttttctctgtctgtgttagggttgggcttaaagtaatgccagcagatataatagaaatcttaaaatctgagtggtttaatagttgagaaatctttcagggatccaggttgaaagaagctgttaccttcaacacatggcttataagctcaccataggcattgacattggcaagcagatgagtgaagacagagtatgaagaatcatatgggagattttactcactaggcctgatggtgttgtatgtcatttctgcccttatgacattggtcagtacccagttacatggctttgctaagatgcaaatgggttgggaagtatagtccctggctgagcagccacttagcacaacttatactgtggaggagaagtgtaaatcactggtgatcagttaaattgaccatctagctaaaggtataattctcctttgtttttgtgatgtgtagtctaagaatacccaaaacaaatttttgagagttgcc

SEQ ID NO: 30759 - DNA, 1068 bp, Homo sapiens
aggtatccctggtgcagtattatagttttaatttagctgtattagaatttttaaattgtaattatcttccttcacattacagtatgttgttacttattatcagggcttaacatgtaagtctgatacttgaaaccagtagtcgccaacctttttgcactggaaactggtttcgtgtaagacagttcttctatggaagggggcaggagaaggtttggggatgaaactcttccactttgcatgtgcaattcacaatagggttcacactcctatgtgaatctaatgccactgctgaactgacaggaggcggagcccaccacttaacctcctgctgtgctgcccagcccggtttggttcctaacaggccacagagtagcactgggttggggacccttgctttagacagtatttcccgaggggtacttaaagattaaaaatagttctgataaaaaccaatagaagactaattttaatcttttagattttttcttttagatcttaatagatatgcaaggcagaactcttaagggacaagatagaaaagattacagagttaaatggtagtgtgattatgtgaaaaataaaatgtgtacactttttccggctgttttgttgttttgtttagcattaattttatttttttttaattttgttgcatgaaacttagagttcagtgtgaaatatgatcatggtctattgatttaatttgtatctatttcatctccatctaggaaggatgaatatgaataatcagaatttaaatgttaataacaaaaactgtttaaaattatttaaaataaaggtatctttttacagtattgaatgtaaaatacttaactattgactaggcataaagcagattagataatctgaagacccttactttaaacaggatctgctagataaacttacaaatgtgttttctgaattctgtaactcagcttgcacaggaaagtaagggaaatatccagggaacaaaaaagtagagggaactaaaggcctgatgtaccaaaagctgaaacttggggtgttcttggtggtgatagtagagattttagcctgcataattta

SEQ ID NO: 30760 - DNA, 1794 bp, Homo sapiens
aaaattggtttcttctctgcattttggaaatcatgccatatgttgttttcttgtatggccattttctagttattgtgtcctgtctgacatatctgatgataagatgatataagaataatacaatctgcattatatttttagagatagttcttatttttttagaaaacaaaaacaacaagaaaaccatacatcagaaactgaaatctagtccacaaaatgaaattgccaatcagctatcagtgctatttagaacctgtggcttaccctcaccaagaaatgtggccacctgtggtcttcagctctctattacagcggttcttggatgcttgttttcctttaagaggcaaatgatgtgtaaactaccttagatagaagattgacctgttgcagtatctccagcagctaatggagcaagtagtaggacgtatagtatgtttcctgatggttttagtttgtgataagtgaaaagaggcataggtagtgagatgtgaggggaaacaacttgtaagactgacgtggtatgctcttgggattagaggaaggaagttggtagggaagatagataactggtagacatgttttaaaggaatacttctagtagtagttttctttttccaaacatttagaaaatattagggtagcctggaatggtatgttaggaatgaatgagctgccagccagtgtgtgctgtgggtacttatattcggtttagcacttaacatttttttcagaagatacattttgtattgattacaggggtgatctaagaactgatgttcatttacttgcttggtaacaaaagtgataatcattgtcccttaattgagtaaatggttagcaacagtctttttgtttacttgttcgtgttttttgtttgtttcttttgatgtcttttgtatcttggacttggattcctatttgtaaaatgtatgttaaaattcttgaactctttttctttcacaagacagtagtataaatgcctgtggaatatcttagtatcctgagaagaaaagcatgattttaaatttaacctgctcataatatttgacattttgtttttctgttgttgttttaaacattttattatagaaaagtttaagtatataagaaagtagacattataatgaatcccagaaacccacatccagtttcaacagttaccaacttatagtatcatataattacactatacacatttccgcccctcctgttacccagagtggagtacaatctcagctcactacaaactttgcctcctgggttcaagtgattctcgtgactcagcctcctgagtagctgggattacaggcatgcatcactgtgcctagctaatttttgtatttttggtagagattgggttttgccaggctggtctcgagctcctgacctcaagtgatctacccacctcggcctctcaaagtgctggaattacaggcatgagctgttgcacccggctcccctcctgtattattttgatgcagatcccatatacatcatttcatctgtaagcattttaataagtattttaataagtaatacatattaaaatagaaggtagcaaattcaaaaatgtttttaatgtgctatttatggaagattatgaattaattatggttggcttgatttccatgtaatttaatagtggaccagtagacagtagaaataaaatgtaaaatttgagattataaccttagttcagtttctttttataaaataaagccttagttcctataattattttttccagagtgcccagtgggtatctgatactaggatataggttattgggctcca

SEQ ID NO: 30761 - DNA, 1035 bp, Homo sapiens
ggattacactggctgttttattaaacagtaataagcctggtgcatgagtgaaagcaaatttcaaaatgtccaacttgttcccagaacatcatgggtcctcagtgttgtacaatgtgtaggtaaacattcacaactgtttggtgttataagaagactaagtggaaaaacgcgaaatcatgattcagattctgccatgcctgttcagttgaataaatttagaaaagcatgtagttgtgcctcattgagacaggtacttaccagaaactggctcactcactcttgggtccgctgaggagaaataaatagaaaagtcagaccttactaggtaaaaccccaacattccagtggcatggtgaagatgatgggggcttacacttgttaagaagtcttatttgcaaaatggtactcttttgctaaggattgaatttgaaagtttgctttgttttggaaattgttcttgattgaataatctcctgcctggtaggtattcagctgtatctgttacatgtaatttgagtacttaggaacatttgtcgctgttccagctttcacttgaatttcaaaagctgctgcttttagtttgatagaaaaacttcatggtaaaaatcaccaagatgccatgaactacagttggtataaaaattatgcaaatattaatgctgtatgtgcagatgtatctcattaaggaattggagattgtaaggtctaattgggaagtttgacagctgttattaaactatcatgggttccctttgtggatgtactcactggtattttcattctagacatgcaggagaggattcattgactagctttttggaagagtatagattcattatgctttttaaattaaactgatgtgtctttaagtgaggaaaaatatgcatggtgtttctctaaaccttcatcagtttgctttttcccacaaatgggtttttagaaattcaagaaacagtacatgtagtgggtttcaaacaaacttcctacgcaaaacattgctccactgtggcccttttacatcctttttgggaatta

SEQ ID NO: 30762 - DNA, 1094 bp, Homo sapiens
ttttcttcttttacaggggttttgttacatggctgctttcctcaaaatgagtgttagtgtcaatttcttcagacctttcaccaggtttttggtgccatttacccttcataggaagagaaataacttaacaattttgcagagatacatgtcttccaaaataccagctgttacttatcctaaaaatgagagtacacccccttctgaagagctagagttggataagtggaaaactaccatgaaatctagtgtgcaagaagaatgtgtttcaacaatctcaagcagtaaggatgaagatcctctagctgccaccagagagttcattgagatgtggagattgcttggcagagaagtaccagaacacatcactgaagaagagctcaaaacccttatggaatgtgtttctaacacagcaaaaaaaaaatatttaaaatatttatatacgaaggaaaaagtgaaaaaagctaggcaaataaaaaaggaaatgaaagcagcagcaagggaagaagcaaaaaatatcaagctgctagaaaccactgaggaagataaacagaaaaactttctatttttacgactttgggataggaatatggacatagcaatgggctggaagggtgcccaggccatgcagtttggacaacctttggtttttgacatggcttacgaaaattatatgaaacgaaaagaattgcagaatactgtttcccagcttttagaaagtgaaggatggaacagaagaaatgttgatcctttccatatttatttctgcaatctaaaaatagatggtgctttgcacagagagttagttaaacggtatcaagaaaaatgggacaaattgcttttaacatcaacagaaaagtctcatgtagatttatttccaaaggacagtattatctatttaactgcagattctcccaatgttatgactactttcaggcatgacaaagtttatgtaattgggtcttttgttgataagagtatgcagccaggcacatccctagccaaggcaaaacggctgaacctggcaactgaatgccttccattagataaatatttacaatgggaaattggtaacaaaaatctcaccttagatcaaa

SEQ ID NO: 30763 - DNA, 1036 bp, Homo sapiens
taactgttaatcaaggccatctcttggagcatcttctttttctccataaataaactcttgatccagtgtagcataatacattccatatggtgaacgggcaaactggggaaagaaaataaaagttttaatcatcagccagccttcttctgtcttaccgcctgatatgttcttagtctcatataacagacccaagaaagtcagaatgtgaactaatttcatcattgacttcatacaaacagaagcaaaattagcaagacattttgccttccaaacctacatatgtatgccttctactgtttgaaattatgattagctcatctttcatgaaaaaaactaacatataaaccaaagtatgatttttttttttaaatagctcttatgggtagcttaaaacaggtaataaccaaattgtcagagtagaattaaatttctcaagagggaatgaccttgaagttccttttcaactcctaagattgtgtgagatgtacgtgaggaacacatcactcaaggaaataactgggctgtattaacactgtcatttgggtaataatgggcctgtttataactaggtactttgtatgattattacattactgaagaatattaaaatttattagccaagtgtattattttaccgtgtgaccaattgctcacaaactactaagtgtaaaagatgttagatagatctgatttctaaaaagcaaaatcccacaaataaccagattattgtacaaattgtagtgtttagttgaagggtcttgactttttgtgaactctgtgtttataattttaaattgctctgtattttatgctagttaattcatgggagcctcttctactgccacacaatctcagttcctgctgtatactctaacaaacagtggaagagactgttgggtcagtaggtgacaactgcagaggtatcttccttataacgatgctttttgaggttgctgctcccatcaatctgctcagtaaaaatagctcatcttggtaagttgtttcgacttcaccaggacctgaagaagaagcagaa

SEQ ID NO: 30764 - DNA, 1209 bp, Homo sapiens
tactaggttatggtaaattaagggtgaaaaggtacattgtttgagaagtaatctttgacgtatgaacttagatgattagcaccctgtttaagaagggtctgaatgaattttatctcaataaagctgttaagaaacaaagatttggaatattaggaacaactattatagggaatatgatttataaaataataaacttagaatttttctgcgttggctgggcacagtggctcacacctgtaatctgaagacttggggaggccaaagtgggaggaccagttgagcccaggaatttcagaccagtctgggcaacatagcaagatctatctctacaaaaaataaaaatataattaaaaaaaaaatcttttttctaagttgagcaagtcctctgaaaaatattgtcagaaagattttccaaagttttttttttatctttcagtgcctgtagtattaaaaataatattgagcaatcagttatttgtatcttaaaagatgaatattagtaaggtattgcttgataagatctacctaattatcttactttggaacgacaaatgggaattgaatactgtatatcttatgttggtagtcttttacaggtcaatatttgatcctttgttttaagatgtcagccttagattaatacttattaaccatggaacctctggaagtgtttgaaatattaatttgaagcatatgaagttgtagatacttgtttctgacctataatatgaaaatttcataaccttcaaccaaatagatttcttatttaaggaaaaaggaagttacttaaatagtgtattgctattggctttggaaaatggttacattcttgtgtgaggagaaaaatcctaaaattgcctttgagttggttatttttatttgtgctatgaaagttaatgctcaattgccagatgtgcatagctttattctacattagatgtttattcaaagatcttaaaaatatggtctggagcagtcagtatatttgggctattctcattttaaaaagctgttattacttagaatccccaccctcactctgctctgtttgccctttttctatttctattttttaaaaaattcagtctgaacaaaaaacattgagcttataacatcagtacttcattactctatttctgtatttcagctggtagtttttgtttaatatgtagttataaaacttgtatagacctaactgcataaatattt

SEQ ID NO: 30765 - DNA, 1075 bp, Homo sapiens
caaaggttacagataataaagaaatcagaaatggtacctttttaagaattgcatatttttttagacacaactattagtacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgttttttgtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcag

SEQ ID NO: 30766 - DNA, 1754 bp, Homo sapiens
aaactcctgggcccaagttgtccacccgcctcagtctcccaaagtgctgggattacaggcgtgagccacccatgcttggctataatgtattttcttaacttatacagtgctgctgcttaacaggtcaggtcctagttaatggaaaacttgaactacattgtggaattaagattcgtttctagtttgactaataaataaaggctatgcgtttcaaggttttttctcttttttaagttttttggttttttttagagatggtgtcttgtcaagtttttttcttatatcaaggttgcttgacacgaagggatggctcaaattatgttagtggctaagtaaaaatactttttaattttttttaattttcattttgaaaaaacttcagacttacaaaacatactacaaaaatattacaaagtatgttcatataccctttactcatgttccccatatgttcttttccaaaacctcaggacaattgtagaaatcaataaattaacataattgcaatattatctgttatactactttatactattctacagaccttcagatttgccccactaatagaaccctagtccaagatcttcattatcactttgtggattttcatctttttttagtctcttttaatctaggacacttcgatgtttattgttcatgaccctagacgaaagtacaggccaattattattattattattattattattattattattattattattttattattatttttgagacagagtctcgctctcactctgtttcccaggctggagtgcaatggcgtgatctcagctcactgcaacctccgtctcccggctccaagcaattctcctccctcagccccctgagtagctgggattacaggtgcgcaccaccacacccggctaatttttgtatttttagtacagatgggggtttcatcatattggtcaggctggtctcgaactcctgacctcatgatccacctgcctcagcctcccaaattgctgggattacaggcgtgagccactgcgcccggcaggccaattgtttttaaaagatacctcaaacgttaggtttgcctatgtttccatataattaaattcagtttatgcatttatgcaatacctcagtatttcattcccgctataggaattccataactaaattatggttgatatgaaactttgaataggtcagtagaaactacaaaataacccatgtaaccatgactgaaaataaagtattttacccaatgaggaaaaagattataacaagaagctgaacaactaagtaatgcaaagaaagcgacattcagggaatgcaagtaatagatattggaatatttgcaaatgattaaagcaaatataacaagattgaattgggagtaaaaagatgtgcatgtgtggggataaaggttatgtgggaatgctgtactttctgctaagtttggctatgaacctaaaattactcttaaaaagtttactaacaacaacaaaagaggtatgccggatgctatggcacacctctataatcacaacactttgggaggtcaaggtgggaggatcacttgagttcagaagttcaagaccactcaggataacgtagtgagacctgatctctacaaaaaaaaaatagcccattatagtggtgcacacctgtagtctcagctacttgggaggctgaggcaggaggatggcttgagcctgggaaattgaggcttcagtgagccgtgatcacaccactgcactccatcctgggtgaca

SEQ ID NO: 30767 - DNA, 1032 bp, Homo sapiens
gaaaaaaatcaaaaaaagaaaaggaatagggcatcctttttagaagcggtcactgtagagcctccaaaacccattccattaatttggggggaaaaaaaaaaactgtatggtaaatcagtagccgcttccaaaacaaaaactggaggctttacacttattagcaaagaaacagttagaaaaaggacatattgagccttcattttcgccttggaattctcctgtttgtaattcagaaaaaatccggcagatggcgtatgctaactgacttaagagccattaatgccataattcaacccatgggggctctcccatcccggttgccctctccagccatggtcccctttaattataattgatctgaaggattgcttttttaccattcctctggcaaaagaggattttgaaaaatttgcttttactataccagcctaaataataaagaaccagccaccaggtttcagtggaaagtattgcctcagggaatgcttaataattcaactatttgtcagactttcatagctcaagctctgcaaccagttagagacaagttttcagactgttatatcgttcattatgttgatattttgtgtgctgcagaaacgagagacaaattaattgaccgttacacatttctcagacagaggttgccaacgcgggactgacaatagcatctgataagattcaaacctctcctcctttccattacttgggaatgcaggtagaggaaaggaaaattaaaccacaaaaaatagaaataagaaaagacacattaaaaacattaaatgagtttcaaaagttggtaggagatactaattggattcggagatattaattggatttggccaactctaggcattcctacttatgccatgtcaattttgttctctttcttaagaggggacttggaattaaatagtgaaagaatgttacctccagaggcaactaaagaaattaaattaattgaagaaaaaaattcggtcagcacaagtaaataggatcacttggccccactccaaattttgatttttggta

SEQ ID NO: 30768 - DNA, 1028 bp, Homo sapiens
tcatagtacaattaagacttttacattgtacttggatcaaatggctacattaattggtcagggaagattacgaataataacattgtgtggaaatgacccagataaaatcactgttcctttcaacaagcaacaagttagacaagcctttatcagttctggtgcatggcagattggtcttgctaattttctgggaattattgataatcattacccaaaaacaaaaatcttccagttcttaaaattgactacttggattctacctaaaattaccagacgtgaacctttagaaaatgctctaacagtatttactgatggttccagcaatggaaaagcggcttacacagggccgaaagaacgagtaatcaaaactccgtatcaatcagctcaaagagcagagttggttgcagtcattacagtgttacaagattttgaccaacctatcaatattatatcagattctgcatatgtagtacaggctacaagggatgttgagacagctctaattaaatatagcacggacgatcatttaaaccagctattcaatttattacaacaaactgtaagaaaaagaaatttcccattttatattactcatattcgagcacacactaatttaccagggcctttgactaaagcaaatgaacaagctgacttactggtatcatctgcattcataaaagcacaagaacttcttgctttgactcatgtaaatgcagcaggattaaaaaacaaatttgatgtcacatggaaacaggcaaaagatattgtacaacattgcacccagtgtcaagtcttacacctgtccactcaagaggcaggagttaatcccagaggtctgtgtcctaatgcgttatggcaaatggatggcacgcatgttccttcatttggaagattatcatatgttcatgtaacagttgatacttattcacatttcatatgggcaacttgccaaacaggagaaagtacttcccatgttaaaaaacatttattatcttgttttgctgtaatgggagttccagaaaaaatca

SEQ ID NO: 30769 - DNA, 1095 bp, Homo sapiens
tgggaatggggagaaaaaggaatctctaccccaagaccagaaataataagtcctgtttctggtcctgaacatccagaattatggaggctttggcctgacaccacattagaatttggtctggaaatcaaactttagaaacaagagatcgtaagccattttatactatcgacctaaattccagtctaacggttcctttacaaagttgcgtaaagccctcttatatgctagttgtaggaaatatagttattaaaccagactcccaaactataacctgtgaaaattgtagattgtttacttgcattgattcaacttttaattggcggcaccgtattctgctggtgagagcaagagagggcgtgtggatctctgtgtccgtggactgaccgtgggaggcctcgccatccatccatattttgactgaagtattaaaaggcattttaaatagatccaaaagattcatttttaccttaattgcagtgattatgggattaattgcagtcacagctacggctgctgtggcaggagttgcattgcactcttctgttcagtcggtaaactttgttaatgattggcaaaagaattctacaagattgtggaattcacaatctagtattgatcaaaaattggcaaatcaaattaatgatcttagacaaactgtcatttggatgggagacagactcatgagcttagaacattgtttccagttacagtgtgactggaatacgtcagatttttgtattacaccccaaatttataatgagtctgagcatcactgggacatggttagacgccatctacagggaagagaagataatctcactttagacatttccaaattaaaataacaaattttcgaagcatcaaaagcccatttaaatttgatgccaggaactgaggcaattgcaggagttgctgatggcctcgcaaatcttaaccctgtcacttgggttaagaccatcggaagtactatgattataaatctcatattaatccttgtgtgcctgttttgtctgttgttagtctgcaggtgtacccaacagctccgaagagacagcgaccatcgagaacgggccatgatgacgatggcggttttgt

SEQ ID NO: 30770 - DNA, 1115 bp, Homo sapiens
aaaaattattaattatttttaatagacaggatcttgctatgctgtccaggctggtcttgaactcctggtctcaagtgatcctcctgccttggcctcccaaagcgctggtattacaggtgtgagtcactgcacctggccaagtttattttttctgtatacatttcttcagccacttcaatcaaacatttaattaacatgctataatgaatgacttttcttactaggctaacaaatgaggcacttggaaacttactttagttacagcctcactttctttttttgtgaggaaattctgtgttgacatactctttaatttctttttaccttttctgactgattttctgtaatttgggaatattgtgatgactgcttattctaataatattaacatatagcattcttttagcacataaatagtttcatttgcatagtaagcgccaggctttgccatcgaatttgataaaataatccatgcttcatggtaccttagagatgggatattttaagtccaattctctctctctctctctcatttttttctttttagagacaaggcctggagttacccatgctggagtgcagtggtgtgactgtagctccctgcagcctcgaactccttggcctcaattgatcctgccaccttaccttctgagtaactgggactacagtgtgtgtcaccacaccttttttttttttgacatgagggatatatgctggtaataaaaataaaattttggggtatggcaataggcatgctactcaaaatgctgccaagttacaaagtgtaactatgatttgtaatggatagcagcagtgacaagtgatgagaatggtctcttgtcatgactactctgttatagtgtaaaagcagccatagacagtagataaatgaataagtatggctgtattccaataaagttttactcatggacactgaaatatgaatttcatataattttgtgtcacaaaatattaaattttttttctagccattaaaaatgtacaaagcataattagctgtggactgtacaaaagcaggaagcaggttggacatggcttttgggccatagttggccaacccctgctagagaacatctatacatagcagccttttg

SEQ ID NO: 30771 - DNA, 1062 bp, Homo sapiens
gatctcattaaactaaagaccttctgcacagcaaaagaaactaccatcagagtcaacaggcaacctacaaaatgggagaaaatttttgcaacctactcacctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcgattcctcaggaatctagaactagaaataacatttgacccagccatcccattactgggtatatacccaaaggactataaatcatgctgttggagcattttaaaagcaaatatcagatacccttttattcagaactcctttttttttttttttttttgagacggaatctcactctgtcgcccaggttggagtgcagtggcacgatctcggctcactgcaagctctgcctcccgtattctggccattctcctgcctcagcctcccgagtagctgggactataggcgcctgccaccacgcccggctaattttttgtgtttttagtagagatggggtttcactgtgttagccaggatggtctcgatctcctgaccttgtgatccgcccacctcagcctcccaaagttttgggattacaggcgtgagccaccgcgcctggccttcctttttttttttttgagacagtttcgctcttgttgcccaggctggagtgcagtggtgcgatctcggctcactgcaacctctgcctccttggttcaagcaattctcctgcctctgccaccctagtagctggtattacattttttttttttttaaagagacagagcaggttgttttaagttc

SEQ ID NO: 30772 - DNA, 1042 bp, Homo sapiens
ctgcattcttcacgtagttctcgagccttggctttcagctccatcagctcctttaagcacttctctgtattgattattctagttatacattcgtctaaatttttttcaaagtttttaacttctttgcctttggtttcaatttcctcctgtagctcggagtagtttgatcttctgaagccttcttctctcagctcgtcaaagtcattctccgtccagctttgttccgttgctggtgaggaactgcattcctttggaggaggagaggtgctctggtttttagagtttccagtttttctgctctgttttttccccatctttgtggttttatctacttttggtcttcgatgatggtgatgtacagatgggtttttggtgtggatgtcctttgtgtttgttagttttccttctaacagacaggaccctcagctgcaggtctgttggagtttgctagaggtccactccagaccctgtttgcctgggtaacagcagtggtggctgcagaacaacagattttcgtgaactgggaatgctgctgtctgattgttcctctggaagttttgtctcagaggagtacccggctgtgtgaggtgtcagtctgcccctactggggggtgcctcccagttaggctgctcaggggtcaggggtcaggggtcagggacccacttgaggaggcagtctgcccgttctcagatctccagctgggtgctgggagaaccactgctctcttcaaagctgtcagacagggacagttaagtctgcagaggttactgctgtctttttgtttgtctgtgccctgcccccagaggtggagcctacagaggcaggcaggcctccttgagctgtggtgggctccacccagttcgggcttccggctgctttgtttacctaagcgagcctgggcaatggcgggcgcccctcccccagccttgctgctgccttgcagtttgatctcagagtgctgtgctagcaatcagtgagactccgtgggcgtaggaccctccgagccaggtgcgggatataatctcctggtgcaccgttttt

SEQ ID NO: 30773 - DNA, 1256 bp, Homo sapiens
tgctttcagtagttctctccccagcctccaatagtttctttatacacatatgcttatcatcgctctgttgaatacttgagtgggactgtctgtagatctcctgagttatttttcttcacagttgttttgctttcctgtgaattataatcaccatggtctttaagactctcagcctcatctccttgccttgggtgctttgccatgctccaccggggctcctcttcctgtgctgcagcctggaaactctctcaagacactaagctaaggacagtccttgggctcatctcgtttgtttactgtctctcaggcatcactgtgttttattgtctgatgcctagtgtctggaaaaccattgtttcatgtattttgccttttttttttttcagttgtttcatgtgagaggctaaatcgcattactgtttctctatctttgctggaagtggaagtttgagggacttgaatttgtggggaaagagattatagagaagctgaaggggggaggagaggatgagatctagagcacagatggagcatataaccttttataggacaaggagcatgagtatattgtgagtattcttgttattttattaactacataggaggagccgtgttccttcctctgacctaagagggaaagatatcctgatggttggcaatgcagatacatttgcttagagggtaggacattcagggagtttctggctgtgaagaagatggaaggtaggagggtagagcccaggaggtttgtgtgggacttgaaataatggttttctagatggagttcgaaataatggatttctagatggagtaggatggcagagggacaataaatttcaagaccttaagtgtgcatggcacttactgcattggttttgtgaatgtgtgtgttaattttatcatattcaacacacaaagtattataatagacaaaaaaagatagttgtgtagttcttgggtagagaaggaggaaggtaaagggagagacagagagacttgagagggtaggctgcagtcccacatcagtaatgttataacagtcaggaaggaatgttagaaaattattcttttgttctactttagttcttggaaacttccgtacttaatgccagctaaaggctctaattatttgaacgaactaactcttctctactgaatggagaaggcaggtatcaatattgaataaacagttgtgatattgaaaatcagatgcgtcttttagtggagtgagctataagcattttcacctgtctgaa

SEQ ID NO: 30774 - DNA, 1057 bp, Homo sapiens
agtggagtgaaatttaagaatcaatttaatttcttttcagtttttatgtacataaaacctgcttactacaagagacccagtttattattttgtgttggttaacattcataagtatatttcatcataataaggctccgtgaaattagtcattttatcatttgccaataaagacatatatctgaaaataaatgttcctgaacctgagcttgtgcttttttattcctcttaaagtggtgtcaatatcaaaatgccagtcaactccagtggacctgattgggtaactgtgattcccaggagaataaaaggtaaaaaaaagaataagcttgatgatttgttgtttttcttactaactgggttgaggctctgtcgtttcatttatgttgcaaaaacttatatgccatagttacttctgggcacaattgaaaatattaaaagtactgtttgattaaaaaaatcagatcttatgtgcataattctgagttttgctatttattgttattttatttttatttttttgagacagggtcttgctctgttacctaggctggagtgcagtggcgcaatctttactcactgcagccttgatctcctaggctcaattgatcctcccatctcagcctcccgagtagctgggactacaggcacacaccaccacacctggctgatttttgcattttttttttgcagagacaaatttttgccatgttgcccaggatggtcttgaattcttgagctcaagcaatcctcccaccttggcctcccaaagtgctgggattacagacatgtgcacggccgagttttgctatttaagctcatgtaaaagttttcttctcttgccagccctcttctgtttggctcctcaagagtcttttgaacaaccttgtccaatatgatagcaactagtcacttgtagtgattcaaatttaaatcaattaagattaaataaaattcaaaatctagttatttaatcacacatgcccaataactatatgtagacagcattttatgtagaatttatccatcatctcaaaaagttgtgttggacattgctgctcta

SEQ ID NO: 30775 - DNA, 1035 bp, Homo sapiens
ttattgtgatgtccctaggtgtcccagggatggtcagtgggaggaactttggaaagtttacctgtacctgacaagtcttgaggattagccaggaagtggctgtgggtttatgatgtactcttctggttagagggaagatagatttggtaattagtgagccttttgatatatttttagaggaagaaagtaactatgaattagtaggagcagaatatcctggttttgaataggaaaaccatcttgttgtaacaggtatataactggaaagaaaagagaagggcaattgatttatggactatggaaggaacccagcttggcagaacttcattgaatttcactctgtggaccagcagggggcattcaaagaccctaaatcaagggctcataattttttttccttcttttgcttcattctatgcaaacattctgtttctgcttaaactttcaccaactaattttagcattcatcaaggttcatcagatcttgcctgtggcaatgatttctgtggaattctaattgtgacttttaatgtctctcattctttcaacatttattagttggaattcttttgcaaagaagagttgtcccttcttcattttaagtatttatatcagtgtagactcatgaaaatttcattccttggaatgaaggaaaaaaaattataatccaatccaattcaatcattattttatttgcttttatttttgctcaaattgttccagttttggcagttggggaacactttcagtttggcttctttgtgcccttttgtcatcctgtgtgctgtcatccttttgtttgttttgagcacttccttagtttctggcaccacaagatatttgaggcttgtcttgtattttctttgccttagccttagaaggggtttacagtatttctacttttatttcacttatgaatcctatattttgaagttttttccctgtgaaattgtatttatgtattagctaattaatattcttacaaggtaaaactattgttaagattcatatttagattgcctgagattggcagtg

SEQ ID NO: 30776 - DNA, 1032 bp, Homo sapiens
gctttttttttgagacagagttttgctctcccacccaagctggagtgcagtggcatggtggcatgatcatagctcactgtgtcctctaccttctgggctcaagtgatcctcctgccttagcctcatcagtagctgggactactacaggtgcatgccagcatgccaagcttctttgttcttttttgtttctttctttcttttttattttttattgtagagatggggcttgctatgttacccagactggtctcaaactcctggcctcaagggatcttcccaccttggaccccaaagtgctgggatacaggtgtgagccaccatgcctggcttcatatttatttcaggaaagctttattgattatatccttaaatactttaaatatatatttttaaattgtgataaaagatacataaaagttgccatcttatccatttttaagtgtacagttcagtgccactaagtacttttcatattacaacttttgccaccacccatttctagaactttttcatcttccctttgactgaaactgcatatccattaaacaataattctacatttctccctcccccaagtccctggcaaccacccctctactttttgtctctatgaatttgatgactctacataccttatgtaagtggaatcatataatacctatcttcttatgactggtttatttcatgtagcgtaatattttcaaggttcattcatgttgtataaatgtcagaatttccttcctttttaaggccgaataatattccagcgtgtgtgtaggtgtgcataccacactttgtttatccattcatctgtccatggacacttggattgtttcttttggctatcatgaataatgctgctgtgaacatgggtgtacaagtatctgtttaaatccttgctttctttacttttggggatatatcaagtcattctatgtttaattgttttaggaactgccatactattctacacagtggatgcaccatgatgaatttgtttttaattcattttgtgcagtatttggcacagtg

SEQ ID NO: 30777 - DNA, 1051 bp, Homo sapiens
aattcctttttttttttttttttgagacaaggtcttgctctgtcacccaggctggagtgcagttgtatgatcatagcctactgcagccttgacttcttgggctcaagtgatcctcccacttcggcctcccaagtagctgggaccacaggcatgtgccaccatgcccagctaatttttaaattttttattttatgtagagatggggtctcattatattgcccagactggtcttgaacttctgggctcaagcaatacttcctgccatggcctcccaaattgctgggattacaggcgtgagccactgcacccagcccagccctcaattccttttttgaaactctggattattggtctcaagatagtgttacaatgttaattgacaccataaaactaaaaaatgttctattgcataagatacaataaggtaaattattaacatttataaagcctggggaaagatagcgttctcatatttttatttcttctttacagtttcttccagtagctttggattagatttctcccctctatgagttgtcacagaactctctgatgtatcatttcatctttttcagtatctttagatgtagacagtacctctgagcctggagtaaatgaatcctctaatctcgttttttaaagcaaaagatgaggcttcagagtcagttagatgaagatttcaatctcttctttgctttcgatggagcagtgtaactggacaaattctcaaggccccatatttcgtatacagtttttgtgcatcagaaatctcttgagtgtttttgagggttctggttcaaagtgtctcgtaagactatagtcaagatgttggccagagctgcagtcatctgaaggcccgatgtgcagctggagaatctactttcaaagtagctcactcacatggcgggcatattggtgctggctgttggcctcagttgacttttccagacagtgtcctcgtaacatggtggctgtctcccacagcatgagtgttcaaccatatttgattagaacaatggcagcatcctatcattcgacttaatagatcaaa

SEQ ID NO: 30778 - DNA, 1029 bp, Homo sapiens
gtgtgttgggggctggagaggagagagaaagacagagacagagagagagagagaatgaattctgaaggattagaggcatggaatttattgtcacaagttaaaatatggtaaaagaagggttgttggaaaaatgagaatgttcttttgatgttctttttgtttagccccccatttgagagctgaaataaatgaaaccacaggtttaagagattacctaaaatccagtagcaaattaaccacaattcctagtgacatgttttcagtttcatttgcgcctaaactcatagattaaaggttttgacctgtaaagaacctaaaaattaattaactacttgactaaggtcacattgttggccaatccagaactaaaactcatgtcaattgatcattcagcatatataacagctttcaacaaatattaatggagtgctcagtatgtactacacattgtgcttgaggatatggaaataaactaattactatacattcaagatcctatcactcaaagatgttatgttctctcagggaaacagatatcaattaattaactatataactatttgctagaaattttggtaaatgtcacaagaacaatgaacagcattttacaacaaaggggccagatctagtctgggatttaagagaaactcagaaaacgtctagcaggaagtgatatctgagctacgtgctgaggaataatctagcaaaggatgtaggctgaggaaataacatgactgaggatgctaaggtggtaagaaacatggtttctaactcctggaggtgaaaatgtgcctatcccttttcatgaaaactaaagaagttttgaaggttgaggcaaaaaccaaggattccttgaagttgttcaaatactttcctgcaatctccctaattgacttgccagttgtgggatctacaaaaggatgtctttgtcttattgaaatattcacatattagtaaatatttgtatgtatacctccctacttaaaaaataaagtggaaacataccatatacatcattttgtacctttc

SEQ ID NO: 30779 - DNA, 1025 bp, Homo sapiens
agtcagggtaaaatagtaacttcttaatatagcatttaaagtttttcttacatttctcagaacaatttttcttggaattccatgtgctagccatatttctaaatgtgccatgcccttcctgcttcctgagtgggttgttattcacgtctctgtcttattcaagaacaccctttgcttcacaccctctcaatcaccctttctttgcctgaataacgtgtatccctatccttcagaacacagtttatatgccatcacctccagaaattcttccctgatctctctaaggtgcctgtcctctgtagttccagagttcatttcatgtattgcctattcattcttctctctctcccttagtgaatttttatattcctggaggcaggagctgtgtctacttaatcttttttctacccagcgtctactgatacatggtacattttcggtacacacccatgatgattgaataaatgcattagtcaaaattagatttcttagtctactgatacatagaactttctcagtacatacatgacaattgaataaaggcattagtcaaaattacatttcataattatcaatgaagcctattttaaacaacaacatataatgttgtatgaataagaaatatctacattgagaaaattgttcaatttcttttaaaaattgagggaatgacaactctcctaaaatatggtcctaaaaagaatttgccttattctacccatgctatgcaaattgagtgctaaaacaaatggaataaagttagatttcttctgagtgccaatccaagttaacataagtactcttcttgagtttccatattgaacatagtctgttcattaaatgtgagatcatcctgagaattatagaaatttatttaaactaatttattttaaaaactgtaggtttgtgaagatactaaaactactttttctcccacaggataattgtagacatacattcaaaatagaagtaaattaatggtaatattagttcttctatttttaattaatagattaaacctttgg

SEQ ID NO: 30780 - DNA, 1045 bp, Homo sapiens
tgccttttgagattaataaatttttctcttggcatttgttcccttatctaactggcaatgtgagtttaagctttacagataaatattatactattgttttaagttttgatttttgtttattccttataaacattacttttgaaaaataaagtgtatcttctgcaagttgtacacatgtatatatgaagtaaacttagtcaaagtgcttgagttgctttgtaattcaaaattatgtaagtacattatgttatgttgaataacaaaaagtgataactctaagtttaaatgggtgactaaatttaaaaaataatttataccaagtatagagataatagatttaaacatatcaatttaaacttatagctatcacttcttgttatttaacataacataatatattcatgaataggtagtagattccatttttcatgatcaagctttcctcaaataaccctccctccaattttcaataacaacgaaacacaacaaattaaccactcatccagaaattctaaactatttacgtataatgattgtcacatacctttttaaagaacactttgttttccaaatataatttgactaaatgcaaataagaactgaaccaataaaatgaagcttttaaaaaaattgaacttctgtttgataaatggaattatttatttgacaacactaaaaatatgtaaaataatgctttagaatatcattttaaatccactttttaataaaagctttcttaactaattaattcaacaaatatttgttgagtgactaccatgggttagctactgtgttaagttggatgctagggatgcagtgataaagaaaacatggtcctatgaagcttttgttttggtggaatggtggttcttaaacttgcacgtgcctctcaatcacctggagagtttgttaaaacataggttgttgggcttgacatctacagtttcagattcagtatttctgaagtggggttccaaatttgcatttctaacaaggtcccatatgttgctgatgttgccagtcctgggaccacactttgagaaca

SEQ ID NO: 30781 - DNA, 1027 bp, Homo sapiens
gcataatgtatcatttgcatttatataatgattttaccactgtcattttagaatactataaatttagaagagtaatacagtaataataagaatttttaacattttttagtctcaggttcagagatgagtaaaagaccctcaggacatacgtaaagagaagaactctttctagacagaagtgaagaaatactaaacactcaagtgtaagattccctgaagatggaatgatggtagttgtgttggaagtggtggtgggatttgttggttgagggaagagaagagaaactaatctattgttcagagatggggttaagtagaccagggattagatttctactcagttaccagctagtcatttgccgttgagaaagttacatcagtctttggatactttaattcccatctgtaaaatggggaaggtaatacctgttttataaagttagtggcataattaaattttaaaaatgtgtattaaagcattttgtacacaaagtaggcactcaagaatcgaactattactaaagactcttactattaaagaaaagcaaaactgtattataaaggaaaagcaaacaaactctggacaatcagaattataccagaagtgtattttccatggaagttgaacctagattagtgcataacaaggaactgctacaggcattgatcgtttcttagaaattggctactgattccacaaggaacacccacaccttagtagctgatgatccccttttgtgtggaatagaaataaatgtaagtagacaataaataaaaactgaaattatgtactgtctctgtaatttacgtctagtatttgaaagatcaccactgaatcttacgaattttgctgactcctatacacaactacttgggaagtttccttaggggctgagacacaggagcagcacagtagaggagcagtacaaaatgttcaggagaagataatagtcagatagcattgtcacaagaaatacgctgtattttccactaagctcatggttgctctcagtgcggttgtttattc

SEQ ID NO: 30782 - DNA, 1028 bp, Homo sapiens
gacacagcccagatgtggtggctcacacctgtaatccctgcactttgggaagctgaggatctcttgagcccaggagtttgagactgcagtgagttaggattgtgcactgcactctaccctgggccacagagtgagatcttgtttaaaataaataaatgaaggaaggaaggaaggaggaagcaaggagggagagagggaaggaagaaagaagggaggaaggaagaagcagaaataatgttataatactacagacgaaggtatatgaaatcaggatggtaatgacagttgcaaaataggtgaaagcatttgctcttcctgccagagcaagatggctggggggccttagacagtgagtaatcaaaattggaagcagaaactatggcttcctagttgctagtagctagggtaatgagttagagagttaggattaatgatacaggatttgtatttctcactagtcaggatccaaagaactttagaatcattaattgagagtgggaagtgtaaccaggtctcagaagaaattctatttaattgtttaagttatagacctatactgagtgcaaagttccatagtggtgatgacacagagtggactagaatcccagagcagtcattatttgaatggtttgtgcaattgacatatgcctcagtttttgtttttgttttttaaccaataagcatggaaaaaaaaaacctcctatgttagtttcttatttttcatatatagaaagtcatatggaatactcctgctatatggtaagtactccacaaattacagttactaggctacagataaagaaatggtctaattttgaaataagcttatgatcttttggaaagtaagtaccttatattatgggaattgggtatgtgaataatcggggctcaatatgaaattttgaagttctaccattctgaattggaaaattgaagcaagtgttgatctgaaatctaaaatgtcatgtgcactgagatcaggatacacgtattcagagagcagaatgaattcaatctcaaggcagagg

SEQ ID NO: 30783 - DNA, 1106 bp, Homo sapiens
tttagtttcacctagggtatttctaggagttagaacctccatccaagaatgcctgagctaatgtaaattaagatctgactttatgtcttggttctacccatcaatcataatcactcggttattaacagagtatttgccaaaggccaatggcacttcgtgaccaaacaagaagaaaaggaaatatgaaagttcttaatatataacttttcttgtgggtttacattttctttttttttttagttctgaatcaggtaattgattcagtttttcatgtttgcacagtttatttaactatgttaactaaatggtctgaacagaatagttgctaccatggcttaagttactggttcagtgtctatggcaatgcattaaatcaagtttctgctcccagttttataaaaaggaaaattgactagatgagaacattgccaccttattcattatgtatagctcattagttcccttgtcaactttcctttgcttttaatcaattgaaagaaaaagtcttcatggatttttagtaggaaacatatggagctgtaaatcatcagtaatgtgtgaacttatatttacaggtgcaactgaccttgactgtgcatccttcccaacttacttcttataaatcctgtaatcaataagtgaaatagtattccatacccttcataattcaccttccaatgtctgtttttccacacatcatctaagcttctataaaacattcttttcctctgtaatggactccaatcctgtttataagttttataaataagagcttaacatttcttctcaatacttagaaatgacgataaaagaattagttgacaagattggtatcttaagaatttcaactccacttaaatatctaagtggatgctgcattttttcaaagagttaccctgagtggcaatatattcattccaagagtgttgcctttgcacatagatcattgcagctatccctttcaaatagcatttagaatctattttcagatttaaaaaatagtctaacattagttttaaaaaataaccaaaggtatttaatgcacaccactacatattatttctttctatatacatttgtgaatttattgggaagagtaaacagtt

SEQ ID NO: 30784 - DNA, 1024 bp, Homo sapiens
tcacttacctgtagaatctacaggagttgatctcatagaactaaagagcagaatagtggctcccagatctggaacgtgtacaagaggaaggatggggagaaactgagtcagcaggtacaaagtcacagttagataggaagaataggttctggtgttctattgcacagtagaatgacaatggttaacagtattgtatattttaaatagctggaaaagaggattttgaatgttctcgccacaaaaaaaaatgataaatgtgcgaagttatggatatgctaaatgccctgatctgattttcgcacaatgtatacatgtatcacaacatcacactatataccccataaatatatttattattatgtgtctcttaaaaacaaaatttcaaaaatggtaatcttgttatactaaggtttctgaaaatgcaaagagaaatgtgatatatatatgttactcctttaaacttaaagagtaaaaaattaaaatcaatgtatcctaaatactaaaaaaaaattagaatgttgagctaagacgacaagatgaaaaagagtagtacttttagtgcaggagtaaatttcagaattttagagattgtatttttaaaggtaaatcactacctgtcctgttaagaggaagctaagacagatactgtggttctcacctgtaatctcagcactttgagaggccaaggcaagtggatggcttgagcccaggagcttgagaccagcctaggcaacatagggacatgccatctctaccaagaaatacaaattaaaaatttagccaggcctggtggcatgcatctggggtgctaccacccagctactccggagactgaggcaggaggattgcttaagccagggagatcgagctgcagtgagccataatcatgccactgcgctccagcctgggtgacagagcaagaaactgtctcaaattaaaaaggtgcgggaagataagtttgtgtttatacctttgtaaatataattctgaaactgtagcgtatttttgacaagtgctttgcttt

SEQ ID NO: 30785 - DNA, 1026 bp, Homo sapiens
agagtttagttatggggggtaaaatgaaaactttaaaagaaatattttctatttaacaaagacgtacaggtgactcttagttactcaaggtaggacaatctcagtccacaaagagattgtaagtgtgtttgagtcaggagcctagtttttcctttatattttctccttcataattataagcatattaggacaaataacaactttttattgcattgggggctcttgaaataatgtagtatgttttctaccatatagaaaactatattttatcataaaaacagaaaagttttagcaaggagtaatccttcccagaagactggatctgttgattaacagcattttaatgtgaggactctgtctttgcaaaattaactgcagataatattatggtggaattagttgacaagagatgaatgtataagacaacagtttggcagaggaaatattagtatgcatgccatccttgaagaatattttaaaaatataatttacataaagatcttagtggtaggatttaacagattttgacagatgcattcaacggtgtaaccaacaagctagtcaacagatagaacatcttcgtcacccaatctctttccagtcaatctcccctgtacccagcgcatagaaaaccagtgcttccatttttatcatcataaattggctttgtctgaatttcatataaatgaaataatatggtatatacttagatattgtgataatgaaataaatgagaaaaaatagtatcacttagaagttagaagaggcaaggaaagtgttgtcaaaatagaaaaggcttgtgtatattgttcatgagctcaaggaaaaagatctgtggcaagaaagagctaaaagattcaaaagcaggagtagcaacgatgtgattttgaaagagtaaaaacatcttttctgaattgaaggtaacacgatgtgcaaacataaattcgtagtggtgtcagtcaacactgttacatgacctttttcagaaaattctgagctgttaaggagtaggttcagaagaatcag

SEQ ID NO: 30786 - DNA, 1058 bp, Homo sapiens
tagtctattaatgtagaaggttttaagtttatagtttcctcaatgaatgcattttaaaatggtacagataactctatataatatcctccatatgaatttagtttatatgctagcaaaatttaaatgagatttaaaaaatattctggttgctctgaggagaaatcactcaggtaaatctagaaaaataaaacagtaaattgcaatatgcattctgttcatctgcttcagttgtgtacttgcttgaaactaatttgctggctatgttatcacttccctttaaaatggtctttactgagtagagaaaatatatctgtaactttttgttaattggcgcataagttttaaacacagaagacttcatcacgaacacataatttggtagtaaaatttttttagcatcaaatgtaactactttataaatttcatgctcagcaaaacatttgattatttgaataagtttaaggaaaaacacttttttaatgttgtttctgactattggactagtttttaaaactggtagctcatatctgtcatagcttctcccagtttctcaggaactttacacgcttgtgtacaccctttccctctgaactggatcctggcccccatcatgctcttaaatgtcccatttaagataaaaaatagatttccataactttaccttccccaactcttctatcaccttcttcttccttcctcttttacacccaaactttttgtaaatagctatctataactgctgttatgtccccacatcctcattttctatgcatacctttctcctgagggtctaattctatttcaagtttcagccctccacgaaaatgattcctcctaagaccaacaatggcctgtatttctaatccaatgggatttctgagttttcattttcatgccttctctggtgcattccaagctattgatgatttcttctttgaaacaccttgttcctgtaatccaacacagggcacaatactggtttctttcctaatcctgggtttcctttgctgctcactcatctacctacacttccaatgctggaattccttgagcctccg

SEQ ID NO: 30787 - DNA, 1557 bp, Homo sapiens
atattattaattcttaaaactgaatcctccatagaatcctaaaatttgtcatggactataacatatatcacatttaattttctcaaaggtcttgtagggtacataaaggagggactgcccctgattttacattaaattgcttattaggtgagagaatttttgtgggaccagaggaagaaatgcgttatatgtctcagtgctcttggcataattgtgtatgcagagtacatcttattttggtgatgtttttgtatgaaagacttttgagctcattgttatgactcagcaaaactatgggttgtattagttaatctgactcattccttaatggacataattattttacaagggtaaatactgtttctccatcaagactggttaaactattccatgtataaaggtcagctacatcagttttggttagaggtgtggacatttaaaataggtggattaaaataaagaatattccaaagataattgcccaaaatatccaaaccagtatttgcagctcaagtgtatacctgccgtgatggttatctgaacatcattttgtacctttgtttgcatttatttatgttttattttatattaaacatatgcagcccatgtaagtttcaaaacagttaataattctatcttctcaatgaaaaaaaaatctgattcctagagctctaccctttcatttttactcattatggcttctctcttatgaaggattttctgtaatcaaatatttacgtgagacttgtataaaaattattcttcgtagacaaaaaatatagatattggtagaatatggccaaggaaatgttattttgaatgtaatcctgaaacatctgaatatgcttgtgtttaaatgtattattattttaatttttaggaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcagtaagtagtctgcagcagtgtcactgctaagtgggattgatggccagtaccagaccatgttctttagaaagaagactgaactctctgtagtgtctctatagcaggtatctatataaggggacttaaagagatcttcattctgctcatatatactatcagcaaagaaaacaaagagtatgaaattcaaataggagatttgcagtgaggaactaaaataatattctctgttactttgtcatgtaaaaatgtcgtgagctatgaagtactactactgataactagcaggtgatcttaatttttactgacatgtacaaataagtgttgtgtgatacatacatagatatatgatatatatgtaatcatgtatatcacgcatacatatacatgtatttggctgaaccaaatgaaattgccattttgctgcataataaaaaaatataagcaaattcaaactata

SEQ ID NO: 30788 - DNA, 1031 bp, Homo sapiens
gtcattttctttttttcttctcctctctctcttcctttcccctttctttctttctcattcttctcatttcatcctttcttcctttttactttccttccttccttctttccttccttttatgttttttcttttaatctggatatatagtgtatttccttttaagctgcctcaaatatttttgtcaaattacataaggcataaatataaaaataaaacattggactttttaaaaatgcccttgaaacttgagcaaaagccatgctgtcaataaaataaaagtcatcaatagaaaataaatcagctctcaaattccttaggtccaaaatattaattatttgcccaggaatcagatattggtaacacaaactgtactctttttgtgtgatcaatgaaacacattcccttttttatcttacttgataaaatgctatcttcatcaagaaatacaactgttctcattgtagcgaccaagtataatcatctgacattttgcctctatcaaaagggacagcccgaaggaataagaagctcaaatacttacacactgacggatgtgaggcgcaatgcaacaggagactacaagtgttccctgatagacaaaaaaagcatgattgcttcaacagctatcacagttcactgtaagtcacctacttcttcatcagcagcttcacctcaaaggcttctaatagcttaatgtagctatcttttcaaataaactgcacgtatatctttcttaaataacttggttgcaatagatgcagtagagagagaaagcatcgggataagctcaactttgtccagatttgtactgcaatattgaaaccttgcatggctctgataaccgcaacttttggcagtggtacatctccatcttctttctaagtgtcttcaatttgtggtgtcaatgaacaatattcatatagaccttaaagaaacaactctgtatattttaagaaaacatttccatgttcttgaagtgcaccagctttgcagttgacccagcattatcatttgtgttacagaataaattt

SEQ ID NO: 30789 - DNA, 1089 bp, Homo sapiens
tttaaatagtcaccaattaattattttgaaacaagtatcatcaggccaaaatgttgactaaacctgagattctatttaaaaagaagagtttaattaacttaattattagaattcacaaaagaaacataaacagaaatttcattatggatttactaatctttgtagatattggcatacatgggtcttgatctatgatcttacatagcttttgaacaccagaatgctctatagagcaccacgcctatcctattacagtcatcattactctttcctatgctttttaatccattttgatttctaaacccaccttttttcttctttttccagacagaggaatctccttatattaatggcaggtattatagtaaaattatcatttcccctgaagagaatgttacattaacttgcacagcagaaaaccaactggagagaacagtaaactccttgaatgtctctgctagtgagtattttatttctggcattacaaaagtaagaaaatttgaagttattcttcattagtttaaaatcttcaattccatcttcctgtactgcattatggtaagttttatttatttattttgcatttggtatcatcatcataaggttattttttcttttttcctgtccattcttgtactatccttgtcttgacagttaaatcatttcatgttttatgggtcagaggccttatcctgtacaggaatagttcccaaaagcaacagagaataaaaaataagtttctcttatttaattcatgttttatgttcagagtggagataattcaaagatcatcttaaaacatttttgtaacagttttaaatttggtaaatttgtaattccctttgatctattattttgccttctaattctttgtggtatttatcctacccttatgttgtactagaatgccacaagcttaaagtcatttagtaaactagcaagagtgattttagaattcatgaatctagtttacaaaactgttccttttgtcatatcatatttaaactatagccgaaaatcagataagtgaaactatctcagagaatgtggaaaaatctgtcgatgttgaaatcagggtaatacatacat

SEQ ID NO: 30790 - DNA, 1051 bp, Homo sapiens
tcaataatctggttgttgttgtattcagtaaaacagaatattcataaagatagacatagggtgttagctcaactgggatacatgatagggaacaccagaagggaacgcgccttcatgaaatgtccttaagaaaatttttttggagaaaattcgcttagaacaaaaatttacactatcaaatgagttacttcccagaaagtggagagaaaaataacctagctaaaaacatgatgcacaaagtgttgtatagtctgttttcaaaataattgatttttttttctcttagcatacatttactggaaccccatcaccaagctaatttcagtacaatgtgctccattatcagtcaaggctcacagatatggaaatttttgcctagcggtttgctgtaaaacatttgcttttcaaagacacattaattcaaatcttaaaattaaatataaaagttgaacatgtatgtgtcaatatgatgaagtttatttaattctcttacaggactgcatcaaaacatgtaaacaaggacctcggtaatatggaagaaaacaaaaagttagaagaaaacaatcacaaaactgaagcctaagagagaaactgtcctagttgtccaggtgagtagtctgtacgaggttcatagaaataattccctagcaagtaggaaacatccttaaagatgaagtcctttatgttaagatgctccataattacagctttcaaaacaggaagagaggggttttttttctttttattatgctttaagttctcagatacatgtgcagaacgtgaaggtatgttacgctggtataaacgtgccatggtagtttgcacgcatcaacccatcatctacattaggtatttctcctaatgcgtccctcccctagccccccaccccctgacaggccccattgtgtggtggtcccttccctatgtccatgtgttctcactgctcaactcccacttatgagtgaaaacatgcaatgttgagttttctgttcttgcgttagtttgctgagaatgatggtttccagcttcatccatgtccttacaaaggaca

SEQ ID NO: 30791 - DNA, 1046 bp, Homo sapiens
ataaaaggccctcctgtaaagtaatttactaaattacttttagtacaaagtatctgttgatgttaaaaaattattgctttggaagcttatctaaattatttttttttcatttcagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagttt

SEQ ID NO: 30792 - DNA, 1103 bp, Homo sapiens
agtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaa

SEQ ID NO: 30793 - DNA, 1032 bp, Homo sapiens
taagcatgctattgttcatgtacacagactggtataataattgtttaaaatatttgatatctaggttacttgattccaatacttacgttaatcagggctgatcatagtatactttatagcacaaatcaaaggtcccggaggtttgtcaatgtcttcactgttcataatgtgttcttactcccagagttattattgactatatccttatacttgtgttgtgtatcatacctaaaagagaattttgcttcgctatatgtccagaggatttagatttcgaaagagacatcacaggaaaaaaagtgtccttgaggcttgatgaaaatgatattttcagatcctattaatacataatacaaaagaaaaactgtaaggtgtggactctaagatctatatctctcaattaaagaaatataattcatccgtgaatcactgaaaggatggtcttagcaggacttcaagctgaggatccttaggaacttaggaattctccaaaagcatagattttgagggtggagacagcttcaaattaagaccatcagatcatggaaacaactgtgaatagtagacaacttccattcaagatctatgaagaagatccagatgaccagaaccagtgattcccatgctttatctgcaatatgtcattctttatttccctagctattttctctcctctttgttaaagtttctgattgctaacagaaagttattatttcttaaacataatatctgtacggttcccatccttaataatatttcggcatgtttacatacttcttggcctgattccaatacctgccagcagttttattgcaatttggctaaagaatacaatcaaactgacctttggatttgtactcatttttatctgggtgccatccagctttatttgataccttttccttgttataaataagttggtttccaccaatcaacttatttagatgacaaaaaccgtaacagaccagagagtcaagaaacctaaagtctctgctatgtcaaacctataaatgaggtgtttcttcttctgta

SEQ ID NO: 30794 - DNA, 1044 bp, Homo sapiens
ctctctcaagttctctttcttgagtaacctgtggtgtttgtaacagttacttttggggtggggaaaggtgggattggcagtgtggtaaatctagcgtttagtgcactaatttgattcaaaattgatcataatttcttttaaaacttacatgtttggagaaattaggaacaattcggtagcctgtaaatttaataaacaaagactttgagatctgttgttaagtgcctttttcagatatatgactcccaagtggaaaaatctgcaaaatatgtgtgggacagtaagtgtgtggaaaatttgtgagaggtaacagtgtgggtaagaactgagggtttacagagcatttgaaagcagcacagtgagcctaatctgcagaaaaccaccttgtaagtttgcccctccattgtaaaggaacaccccaggtactcttgagttgttgatgtttggaaactagtactaaattgtgtaaatcagctgtagtgctttgtaatattaccatagtgaatttagagattgtattttgtgaatgaaaatgaacttgaacttacttttctgtgaaagaaaatttagagacctcatctgtggtgtttcctggattgctgacataatgtgtacattaacaaaattattgtctttgtattaagaatataaaactgttgtcttagtattgagttagaggactagacctttctggtagtgtccatttggtaacaaaatatactttcatgttattgaagactttagataatctatgtaagttttgcattgaacatttagaaaatctagagaactttagataatctgtatatgttttgcatcgaacattttctatggaatataaatattgcattactgctgataattaggtggtttgttcactaagagctcagaatacatcacatacatagcaggccaatcggagtgtcaaaatgagaaggttctataagttgaatttagtgcacactaaaatacatggatttcattgtctttgagtttttttaaagcttgtttgaaaagtttcattttgggcaagagtattcaaaa

SEQ ID NO: 30795 - DNA, 1941 bp, Homo sapiens
aggtagtttatgtattcactcctctttttggaatttttttttactgagacttcctttttaaaatgatggttaaaaattcttattttatggtcataaaataaatctgtcatgcatatacttgagcatcatcagagttggggagaacaaacatttcctccctgagaagcatctttctcctttagtggctggccacatgaaagcatgcctcgttggctctcttatacttgttattgcaacttagactttacattgtgatttcactgacgttgctttgtttgctctgtataaccatgctcttaggtaggtgtccttattcccattttacagatgaaggaacaggctcaaagttgttaagtgtcttgacctaggatattgagtttgcagtggctcccctgcgaccagcactcatatattctggccatttgtctagagagcagtgcaaaatttatctttttgagctaaaatttttttttcttgtacttaatttcaacctgataagttattataaatatttggagtagcagtggtgaagaaaatccggtgctaattttgttcatgccctgtgagctacaaaatatcagttaaggcccatgtagggccttaaattttgggtgtacttaaatttatttgtgcatttaaataagtgtactaaaattatgtagaaagactgtccatttgacttaacttttttcacaacttgtgatggcaaattaaatgtatagtgaccacatactgacaaacaatgaacttttaggtgtatgttgggatttgtaagtgagatttggattatatttagattatgttaatcccccccccatgagacatatttctgaagttacaatgaaaattaattagagaatatgatttgatattcagatacctgagctactcctatttctgtaacatgttcatattgtaacttgatattaactgatgtttttaaagaagtataagcaaattctataattttttttttttttaagagatggagtctggctctgttacccaggctagagtgcatcggtgtgattatagctcaccacagcctcaaactcctgggctcaagtgatccttctgcctcagcctcccaagcagttgggctacaggtgtttgtcaccacgactggatagtttttctttttaaacttaaaatgctttttagtttggcactccgtagtaaaggaggttccagaagccagtaagagaacctctgccaactatgaaagagaagatatttctatctacaagttatttcaggatcaattattcaattaatattttatataatagaaaggttttatttgttaggactttatctttaagttccccaagagtaaaaaggtctagtcattattatactgtgggagaatgatagaagattgattacattagaactccagaacttctatttatttaaaagatttaagatttgacacaaaagcggtttattttagaatgtttatttctatagattgtcattacttcaactcagttttcataatttgtatttgagtatactaactttggaacatagtgtaatattaatggctacagaagaggtttgttgaagaattgtaatttgaaagaacagcatatgtttattgaagagagcatatagagatggaagtggttagaaactatgaactttctttagtttggcttttcatgtaaagtggaatatgaaaacaaaagtcctaaagacagttcagcagagttcctcttcaccctgtttttaagcagtgatgtaaaccatgaatttagtgtttccaccctcttttataccatgcaacaacctgtgaagtaggaactattatctccactttgaatgaggtactgagtttcagaggctcagcaacttgcccaaggtcattcttctggtaaatggtgttgctggcattccatcccagttcattctgtctactggaggccatatttataatca

SEQ ID NO: 30796 - DNA, 1219 bp, Homo sapiens
tcattcctgcctataaattatttgcaattttgttttacctttactactgtcataaatctaggaaattttagtttgggcaacttaaggaccatagtttttatagcccattgtcagaacactagttatttacttactttttgtgacataaaacccagattttttagattccatgatacacagaaccatatgattaaatcagttgttattatgtgcttttagtgacaaatctttttagggctacatcatcttatcttacatgagacagataatttctgtaagaaacttgtatcagaaacatgtagcctgtcgtgaatttttattactttctttgttgtttattgaaagggttgggacttctgagttaaataatttaaaaagttacattttactgttataaaaatccatgttaatccaagaagaaaatttctgttaaatgcctttttgatttaaagtgtgtgaattagatatttgatcatgatttgggacctgaaaaactatcttatttctttataaatgtaatatagttactgtatctgaaagtaatatatggttcctttatcctctctactactgctgtattttcagaaggagaagcaattatattgatttgctgagtaacttcttactcaaccagtttctgttatagtatattaacataactgttctgttagtttatttattctgacttgtgggcatgaatattttaggtaaactttataatgttcaagatagtttgaaagattaatcaatgcttatttccttgctttacaaatgtataagagctattcaagtaacagttatctaaacaagttgttttataatgaggtagtataagagaagtatttccctagacaacatgaaataaagctcaaacatcctcaattttttttgtttgtgaatatttatagctttgaatctcagctgtagtcgggatgatggcataaattgtaattatactgcagaactgaaagaaaaatttgaaagaactgataatggctctaaaacagtatctttaataagctaatggtattggtgaccattcagtaagtatctgctcagtcaatgaaatcattgaacttcatcttatttgtgtaagtgatgattgtgccctccatgacttcacagtacctagttcaatacctactaagtaaatgagcattcatgaatgaatgaaatgtaaggctgaattttgaattttgcaagcttttttgacatacga

SEQ ID NO: 30797 - DNA, 1090 bp, Homo sapiens
accaagagtcaactgttgactcttggataaagtgattagtcactctggagaggtacagacaatatggtcagatgagggatcggtaacttttgacgctattgttggggaagtcctcatggaaacttgaaatgggccttggagttgaatgggatttgggcacatccccctgagcgtggggagatcaccttatttggctttgtatttttagcaggtggtacagcataggttggaaataatttttttagatgaataaatgaggggaaaggacagttttggtgaggggtaaaccgcaagcaatggcatgccagagattgggaagtacaacagagtttaggggctccagcagtgattcagttcagctgaagaaagagtaactacaagggaaatgtatcttctaagtaagatcagggtcagatcctggggaggtcatagttgccaggccaaccatgtaggatctaaagcaggcttggtagccaacactggtgacattggagcagggtatgggtggcaggagcctcagatgaggagactattacagcatcagagctggaagtaattactcatctagggtggccatagggactatagagacctggatagaggtaagtgatattttagaggcggaattgacagcacactaaagtaagtacttcaactgtagctcagtggaatgattttgaatgcctccttttgctataggaactctttttgagaaaatgaaaacctcaaatcaaatttcctggaacaacttttttggagagtttagcgctatctaagtcattctcctaggagctcttataaaacattatgaaggcaaaaaaaatgttaaataaagttattatatcaacaggtaatttacagcacagttcaatatttatacactgtaaatatatttttatagttcttttggaccctttgtatattctgtgttatacatactcacatacaaacacacacataccaggaaaggagagaggaaatacagaagtagccacgtgttagttaattatttgatgctgcatcttcgattactaatgagcccagtgacaacactttgttgatttttatgtgaaaattctttatgatcatc

SEQ ID NO: 30798 - DNA, 1048 bp, Homo sapiens
atagttctttagaggctgagtcattgctttagacaaatgcagaatttatttaatgtgcttttttttaatatattggtaattgtctatataagtaataaaaatcttggaatatctcattttatgtagtaattcatttagttttgacaggttaactgaatggaatagaattttaaacaaattaatatgtaaaatatatttgtgagtatatttttaagaaacattaatgataaaataacaagtgaaggagacttttttaattttggaaactgcttcttccttaagcaggcttacaaaactgttttttttacacttcatattttagaatgaaaataaagctctaaaccaggaaggatactattcacatttatatttctgctgaagtggaaatggatgaagaagaatcaggttacatgtgtaacctgaaaagaaatgaattaacgtgcttcagacttgtacaaaatattttaatcaaacagaaaataactttcaaagtactgatatttgagatgatctatttttaccaaatgaactgcagagtataagccagtggtcttctttttcccctccaaaatatgggggaaatttttatgtgtggtgttatgcaaatacttaggaaatatccaaactgacatctccttttgacctggaagcctgagaatttttattttattgttaggttctttggttcagaagttgtgttaggctcacagctttgcctcccatgtgggaggagtgctcagggtcagcgatttatgtgtgtggagggagggaaggggtggaggttgttaatggagggatctcttccaaacatctcctttgcccagtcagggcctgattgtttgtggcctcagaggccctcctcttccctgccttcttctcaggatccatggatcttgttcacatacccctgtgaagctccttgcagattttaggtccatctcacagagccagactgaaggcagtacccgctacttcctaccacaaggagtgtacaaatatctctatacaaagcctgcatttctttttattaaactcatattttctggtc

SEQ ID NO: 30799 - DNA, 1050 bp, Homo sapiens
agccaggatggttttgatctcctgaccttgtgatcccctcggcctcccaaagtgctgggattacaggcatgagccactgcgcccgaccattttctgctcttttcttatgttgcctcttctccaatttctctattctcacctcttggaattgccaacagatggaaggtagatctgtcctctatgtctcctaacttttctttttttaaccatttatttctttatttctttcttttgcattctggggaaatccttggcccaggttccactcataattctttcttcaacgatattctttcagtggtgtcctaacagtctgatcagtcttatagttcaataaataaatttttaatttccagcttcccaaagtttcatttccaggactcaaggttcattttagatacatccaaatgttttgaagtctatgtaaaatatgtgtgtgatacaagtatagattccaacaatcacacagagctctgttcagatcttgtttctctgccattaactgtgttgtggctggttacctgattcctctgagcttcaattttctagcaaaattgtggtaaaaatgttatactgcctatattgttgtagggatgaaatcccataattgtaataatattacctaacttagctaactacgtgccaggaactgtactaggttattttattcacgtgttatttcatttaattgagcaattccttcataacaatcttaagaatatatccttgatagtttcttgatatcctacttccttgaaagtaactgaacttgttgaaattaattacaagagtgagtctttgatcactagttctcatattgatatctcaaacttaccacgttaacagtattttatggaggtgtgtttggcatattcttgactgtctttcttatttagagtaattccttttttattttttatttttttaatttttttttatttttatgacaacaaggctgtttatttcacctgggtgcaggcgggctgagtccgaaaagagccagtaaagggagataggggtggggccgttttataggatttgggtaggtag

SEQ ID NO: 30800 - DNA, 1029 bp, Homo sapiens
tgactaggaaagctaatttttaaaaatatactgatttacctctattgttgtattaaaaggctcattttaaagaatgcaaaacatccaggaaaattccatgaagagatattgttaagtgagccaccctctttgttaattttgtcttcaaaagaagtctgtgcatttaatttgctaccggtgtacccaatatatgtgtttcttggcttatttaaaaattttaagtaaatttccaactaatataatattttaaatgttatcccagtttagtaataaattaaccaagtgaaaacaatgaaaatattatattcaatcttacatcctcattattggaatgagatcgtatttacaataattaacctacatcaatgcaactatttttcagtgtttcaaagttatgattctttaatgtgtacgtagaataaatctaaacaacaattaaaaagaatcaaacaagctatgtctaatggagattaagaagcattctccgtgaagatttagtatatcatctggtatctctttgtataaactcaaaattttttaggtacaaataataaataaaatgtttgttggctgggtgcggtggctcacgtctgtaatcccagcactttgggaggccgatgcgggtggatcacaaggtcaggagtttgagaccagcctggccaatacggtgaaacaccgtctctactaaaaatacaaaaattagccgggcttggcgggcatctgtagtcccagctgctcgggaggctgaggcagcagaatcgcttgaacccaggaggcccggaggttgcagtgagctgatgagatcacgccattgcattccagcctgggtggcagagtgagactccgtctcaaaacaaacaaacaaacaaacaaacagtgtttgttaacatgttatgtgggctttaaaaatgaaactaaatatagattaaacatagttacagttttgttaaatattttcagtacattttaaaggaaataaacagctttggtttcctgtgacagtcctaatttaaaatctctctctctttt

SEQ ID NO: 30801 - DNA, 1036 bp, Homo sapiens
tggtctgtactatatatgaaagcaagaacaattaaaaagtctttaaattgttcaattttctataattccaatgctcctaagaagctcccctccccgctgccattatggggctcttacctaactcaatataccaaaaatactatcctatttctttatctgtggttctttgtttatcttttttggaaaatgttttatcaaaatttataatttctaatgatgctgtattggcataaccacttgaaaaaataagagaaatagtcctagaataggaaacttgtgatatatatgactctctggagaactaaagtaaaaattaaactaaaaagtgaacttattttaattatgttattaaaaacacagtaggcggatgtaagaaaacaagctatttggttatatttatttcagaaaaaaggtcagtgacccattaactaagaggtttcacaaacttcagttttcacttggctattactcttggttagggtcacattataatttttggatatttttgtgaaagaacgatacaaaattgagttttaaatatgttttctgatgttctttcatataactgtattgttaaatattttcatttaatgtttagtattctcattttaagaaaacccaatgcaaaatctgaagttaataaaaaaaatagacggtgattatttggctaagataattcacccacatcattctcttaacagtaatctgatattctaaagaggttatttatatattattaactaacttgtataccagagaactgtggctgagtgcagagaaatttaaaattaagaaatttaagacttttgaatattaatcaagaatgaacttgtatgcagtttgttgtacatacgtattctggtactacaactatatattcatttcttgagagatattcgtaattgttttttttagatctggatttctgaaacttgagtcaagtaatggacatatcaggggtcacctagtttttaatgtgaattaaacaattttaatgtttcatttagatgataaatataaaagaaataatgtcttc

SEQ ID NO: 30802 - DNA, 1590 bp, Homo sapiens
gactgtggcttcatattagagattaaccccatcaagaagttaacagtctcccagtttagtatgactttcatatttgagaaaacttgtaagcttgtctgtttacaaaatgtaatctacttactgttcctatatttttcttaatgttttgggttaaaaatggtgtattaaacagctgggtttagtggtgcgcacgtgtggttccagctactcaggcgggaggattgacacttgagcctggggtgtgaaggttgcagtgagccgagattgcaccagtgcactccagtctaggtgatagagcgagaccctgtctcaaaaaaaaaaaaaaaaaaaaaaaggtgtattaagatgactgtatgttctttgtgagattactgattttaaaaaaatcttataaaactgatttttaatataatagcagccttagtattgaacagaatgctcaatcttaaacgtctattggagtccagtaatacaaggaaattttagggaaatgtgaaacatttaaaaatagatctttgcatagaacctaaagtttaaatttaaaatgtgtttatttattgatattgctgtgtttaccagtatgtatgagctcatgttttattgataaaaggggcatgtgcaatttttaggaatgccgaggtaactttttcaaatttttcaaataagtatgtttagattcatcaaatagtaattgaatttggggagtttcaggaatattataataggtgatccttgatcctgagcctcccacctccacacatgtcttaagggccaacaatttctgttaagttgtacagcttatcttatggaagagtggtttttttaagatcaaggtcaaatgctcgtttagcactttgtttttcaaagatctacttgatctttctatacagaagtaaagaattatgattttttaaggttttcaaaattgtctctaagtatatataattttaactttgtacttctaaaaagctaattatctgatcttaaagtcttactggtgttctgctagatctgttaacaccctcgttgggagttcaaggattgtctgcatttggcctgtggcagttctaataacaggagtcaattaatcaaccaatataaaagtgtttatctgacactgaccttgtgctaggcactttgctagatattatgggataaacaaagccctttgaggtagttaataaattttaagtgatcatgaccctaaggcgtatcttctgtttgaaaactgaacactggctgtttgttcaccaaaatagatactgaaagatcaacccaagggaggcttcctttttattttcccaaccaagtgccatgccagagtaatcactaatccactaaatcctaatcaattttggtgatctgagattattactgcctaaggagataggcttctagagtaagttcagtgtcaatggaaaccttgaaggattcagaaaacagacttgaaaactttcaaatagtttttcttccaacatttattgagtgcaacacagcatactaggtgctggggttgtaaagatgaacaagacatgggtcttctatgggatcgtagagggtaatggggaaaccagatctatagtcacagat

SEQ ID NO: 30803 - DNA, 1202 bp, Homo sapiens
atgcaccaccatgcccagctaattttttttttttgtatttttagtagagacaaggctttaccaggttggccaggctggtctcaaactcttgacctcagataatctgccagccttggcctcccaaagtgctgggattacaggcgtgagctaccacgcctggccttagaaatgcttttacatatttattagtacttttagtttttgaaagtgtctaggtgtgtctacttgtaatctatttgaagttaatttttataaaggaaatatgattttttaatttagggttgttggaattttcttttattgcttttatgtcagatgtttggaataaccttaagagaagggttcacacaataaaaatatgtgattacaaaaagagctcacctgttatcaaagtagttatctgtatagtggaattttaactgaaagggaatgtcccctggcaggagaaaaatggtaaaatcccttagcaagtcaattataaggcatgttaattctacaaagatattaaccttatgatcttcaattctggggtgcattctctaccctgcaaggtcagctaaaaatatgctgaaaagcaaattttataagataatgaaataaaaatgtgaagctaagtctgtaagatacaaattagaagataaaatcccttgttaaatgattctgacaaatccttttgctcttttacaattagtagtctgttctttcgggatgttcataaaatactgattaaaaaacaacgacaaccaaaagtaaaacaaaactgatgtacatagagaagccttgtagttgaatgacttacccatctgataatttgtactgtggagattatttttcatatttgtacagttaatgagtataactgtagctattgttagctctgttcttaatatataacatgggaaaactttattatataagttactataataatttttaatagatttgaatgtttctaagtgctttgaatttcaaaaaacagttatatgaaaatagataataatgctatttattttgaatttcatatgttaacagtttcaatttagtgcaataaaatgagcataagctaaatatataatagttgaattatattattattaaatcttttgattttatgaaaagttctgtactatctttaaattagaaactagcatatgatcaattcttagtttcttaaacagtttgatattaatactgatattaat

SEQ ID NO: 30804 - DNA, 1073 bp, Homo sapiens
tttcacgtttggatatcagagttggatatggtttgaatcccagctgtactagcttttaaacgttgggcaatctacttcacaatgctgaatctcaatttccacatgtgtaaactaacaccggaaatatttacctcaaagagtcctgagtacgtgctaggtacttgctactcgcggatacttaaaaatacctttaaaattgtttgttaaataaatatgttatttctgagagctttttaaaagtaagaatgctatatatacaagaatgtttgtatatacagaaaatgctatagatacaagaatatttattgtgcatggatattaatgaccctttgtaccttctgctaataaaacattagaaaactgtgtttcacagtaataacaggtataatgtcacaatactgaattaaatattagaaatggtgaattagactctctgtatgtccctatggtctgcaagctgaatatgtgcctttaaacaaaaaattttattaacttgagaaataagtttgtggctatagtcagcaccctattatgctaccttctctaccattgtctgtgtttataattctgcagtcatatctttagaatcatgatgaatctaaactatgataattttttttgctaccctacacaaaaatatttatactatgtagataaggtacaaagaataacattaacacgaataactgagaacctaccactagtttaagaatagaacattaccagtttctttgtagcccacagtgtgccccacccagattccattgcctctctttaccccctcatcacaatccttaatgttgagtttattacttctgtgtttttcttggtcgtttttctcatacttatgtaccccctacattaaattttgcctgtttttaaattttatataaataatacatactacatgttttcttctgcaacaactatttttcctgctcaacatcgtatttgactcattcctgcttgtctttgtaattcatttattgtcatatatgtataatcttttattgtatgaaaataccatagtttatttactttcttttaatggctatttagctgtttttctttct

SEQ ID NO: 30805 - DNA, 1985 bp, Homo sapiens
aaatgaaactgatgtcttaattttcaagaataaaaatgagatttgttaaaggatataaaatgacagctaaatagcaggaataagttctagtgtaatactgctgttgaatgactgtagttaataataatatatagtttcaaatagctagaaggaagatattgaatgttcccagcagggagaagtgataaatgtttaggacaatggatatgcaataattaccctgatctgattactatacatcgtatgtattgaaatatcaacaccataaatatgtatagctgttatatgtcaattaaaaaataaaataaaaatttcaaaaagaataaaaattatggaataaacaggaatgtttaggaaagaagagtttaggttactttattcattgaaagctagaaaactttttagtttcatatttgtgttacaaatataaaaatgttgaatacacttgactggattaataagaaatagtagagggaagcttattttttaatgagaggatcactttaatgaataataattattttacagatgtttgaagaagtaggtactgacacccaattaattgcccactaccaacaccaacaacatctctacctcggcactccctgcacaagacattctggaaggctggtgtttgtttttaattgatgctagctttttataatttgttgttttttcctaaaaacaattttaaaaaatatatggctagttgaggaatgtctgttagttgtgttctgagatttacgtagatcagattgctgttttatccttaaacatgttaaatggatccttcctgttgagcattttaaaaaaattttttggagtattctgatttttttttttttcattgtacaacctgcgcttccttcagtgaaaatagttttgggttcacaaacaagaagcagctgtcttaaatatgttcattgactcagccgagtgtctgcagttgcccaacaaaagttatttgattttgggtagtgcaaagaaatcaaaattagcattcagattatattttggctgctgtaataagagcttctgtctgtaacttgaagttctgaaatccacatgtagtgtatttttgtcttaaaatttgtagagatttgagcctaaacaccactgagactattaagagaacttaactgatagagctcagtatttcttttgaattatttttctgatcctcagaggaaaacattgagtcttcatttcaagattgacctaacaagggctacatctcaatgttattcacaagctgagaaaaaaaagtcataattttgtgtgtattatttggtgaaattaagtgaatgctttagttcactgaagaaagtcaattcgaagaatgacatggacaaggccagaaacatacagagaaacatatctcaaaaagacttttcagaattgtaaaattgagcgctgcagaataaaacaattcacacattttattagatccgtatagcactgcaaactcattgcctccttgagagaccattgctgtaaatatgtagggagcaaaagagtgttgatgagtctctgacataactaaatattcataatggaatagcatgctacaagaataatgaccacacgaatgcagcctagttttacgattctgttttctcagatcctttttgaaaaatcttacatcttcaaagtctctacttgtgattctttatctcagacaactacagaaagatcaacatggtttagaaaagtcctaaacaccaaattttaatcgttgataaaatgaatttttgaagttttgatatccacatgtagtgtattttatttgaaacttggaggcaaattggaaaaggatatcttctgtttcataactttctaatgaggcataatcttatgtctggactgttaaattgagaattagagcagatgtattagagtcacttgtatgagaccttaagtatctcttcaccttagctccccaagtgtaaaataattatgttaattatataactgttagtgcaggt

SEQ ID NO: 30806 - DNA, 1051 bp, Homo sapiens
atggcaaggacggattagaaaagaaggatggtgaacaaggaaaaggactatgggcaggaggaatggacttcagggaacagtcctagaactcattcattcattcatttgcctgcagtgcgcccggctctgtgtcaagccctggagacacaccatggtgaacacgatgcagcccctgttctctgtcacagttgagtgtgatataaagaaggaaacaggtcatttcagtgtagcctattaagtgtagggtgctgtggagacacctctctcagacttgaaaggaccagaagtggcgtgaggtgagatccaagctaagccccgaagcagggataagagttccaccggaaggaaacagcagccaggttccaggaggtgggagtgcatggcaagctccgggtgatggcatgtggctcaatatgggtagaactttgaaagtgagaatgagcaaagaaacatcagctgtaaaggcaagctggactaggtcaggaagagtcttacatgtttatgtgaaggaaggaatttggaatttttcattaatacattgagggactattaaagagactccctttaggagaaggacatgagcagatatttgttgaaaattaaagtcagcaaagctataggtaagaagatcagacagctgaaccaaccttgtggggctggagaggagtagactctttgtaagaggtagaagggacagatttttgagagattagatgtcagggtgaacagctgattgcagtgatttcagtttatgaagagaaacttgcaaagaaagataggctttccagatgcttatgtgaagggaagggatgtctagtttctattcaccaggctctgacataactccacaagggtatggtggaggcagaggcctggcccagacaagatattttctcgagaggatagaaattaaagacatgtgagtcatagtgaggtagagaagccagaggtgatagacatgttggaacaatttgtaagttctttctaggaaactaatcctgaggtttagaagcaagaatattaggaaccaggtcacttagtgaagcacatc

SEQ ID NO: 30807 - DNA, 1023 bp, Homo sapiens
ggactttcagagaaaatgggagacttttaaggtgagaaggagaaaggcttcaaatttggagtatttgctgttttctgtggcagcaggaccccttgaaagactgaaagcaaggtgtgatttgaaagtcccagaactctttagaaagaatgaaagcaggtgggtccaatttgtgtggaagtactagagtttccactatgttacagtgtctttgggctggtttttcctctcctccgtagactctggagaaggccgtgcggttttgtagtcttaattggacccagaagaggccctatttgtggttagaatatgtggttgtctagcagtggtatttaatgggcctcccatactctcctgtttcactgggcgtgaattttaatgaccaggatttgagtggaatttcattggacttttaggaaacagtttaaaataccaccgtgacacagttcagtgtatactaatgttttaatgattaaagtgtaactgattgcctaaattgtaagacaagacaatagatgagaggatcttattcacaaaatttatgacggtgccaaggcactgtttctgactgtgtatcactcagacaaaggaaaggaaactctccatctttctttttcagtttctgaggctgcagattatatcatctgggcagcatatggatcactatcaaatgggagacatctatgctcccttttgaatgacatcttaggatgagtttaagtgagcagatgctgcctgttaatcccatgcttcccagtctaaaaagcttgttgagtaaagggtggatttgccaacagtgaacgagaatcttctagacactgtgctgggtattacatgtgttctcacagtagagctattattatttagttttaacatgaggaaagatcagcacaagtattaactttccaacaggtagtttgtggtagaggcaggattctaaaggaagcctatcaggctccagtgtcctttttttttcttcttcttttaataaatatggcatttgctttgtactctttccttctaaaa

SEQ ID NO: 30808 - DNA, 1041 bp, Homo sapiens
aaaactctatacaaatgttggttttagggttatttctgataagcagctttatgttggtttctgtttcatacttctctatctaaatgattattatttttattatgaactgttaatacattgaagggctactaaaatgcaaaatcagtctttgaaacacaaaaatgaacaaaactaaaaatatcatttgcccaatttggccaatactgtccagtgttattaatagcctctagcaacatagatgttaattaagtgaactatttgattttgaaatattagtccatttgccaattgttaagtaaacacttgtatttaaatattcaaataaatttataaagactataaaaactccataactagggaataataaattgagaatttaaactgcgtctctcaaaactcattttggtatttggtttcagatgttaatttttagattgacagatcttagtagacagatcactgtccacctttttaaaagtagtaaaattatatttttaaataaattctgaaatttcagcttttaaaattagtgcacactgattaaactgactcttctggtaattactcaaattaaagagtaaaattatacttgtaaaaaaactactattgccataataattttcgcccttatagccaaatgaagtagccagtttccttgctttcaaattttcatttatgacatttccacaacacaacaagcaaataatttcctggtcacatattcaaaccactttttcaagtgtataatttctgttggagtggctttattatgaaagttttgcaggtttaatgtagaacttaaaatattgttcagtcaaaccataaatttaattcaattttctgtcagtgaaatagtctaattttttttctgttaaaaacagctagcaagaataattcagatcagataatgcattgagttatattatcctaacgataatttttaaatttttatgaaggaaaggtcctcaaactaaggaagtaacagattagtaccacttatcagataattccttctcttcttccacccttgtataatgtaat

SEQ ID NO: 30809 - DNA, 1056 bp, Homo sapiens
ttgtggtaactgggtctgtgatgaaaaaaaatggatgcgttttgatagtttgttttgtttattttatttgcacataatcggccttgtttttttatacccagagtacattgaaatgcataaattatttgggataaattatttaaaacaatgttggttgttacagaatttattgattgaggaagcaaaatcgatacattgagcacgaaagacataaaggagtgactcctggctcaaaatagcagactaagcatgtccctactgagaccctgtaaaatagaagtatagaagtctcattagtaaataaccccataataataaaggaaatggaaaggagtgtgtccagtgaatatgagattacagcaaattatttaaatcagaaatcaaatgtagttctttaatcagtaaaatgtaagtaccagacaaaaataggcggcagggagctacaacggagatgacagcctctctattaaatagaatgcccagaagtttaagtgaatatcacctttttttttttaatttaaagaaccagaaataaaaatgtagaacaaataaaagtaatcatgttcacatcaaactcagggaagaactaatgagaaggcagagaattaagcctttatgttttataccacagagttatctaaaaatgaaaatacaaaaaattgtcagtacttgatctagaatttctagaagtaatctccaggactagaaatccttatatttgttagttatcttaataaaaatggaaagctaaattaaatcttaaaaaacaaggcagggagtgatataattcagattgtggaaggggcagttattcaccatgtcatgtatacaacaacttggattgatctcagaaaggatgacatccagtatcagacctaagtgagcaacgtaaattcatcttggctagaacagaaggagaggggtggttggagaaaagtagaatataagttagtcagattaattatagctgatgaaaagcttcgaaggtatcaatatctgtgtagttgtatgactgttggaagctaaactttcaaatatatgggaagtaccttagac

SEQ ID NO: 30810 - DNA, 1034 bp, Homo sapiens
ggtaagtagcagagctgagattcagtctcccagataccctgacccatatccatatgcttcaccaacactgcatcacagctgcctctaactagagaacagcttggaaggagtggtattgggaagagagtgagggagtggcttcacttgcaacctccagcttttaacaatatacattttttcctttttttttttttaagtaaggaaatttatgtcaacaggtctccttaactgctgtttgatatatacctggtacccttaccaaagacatggcaaatgagccatactcagtctttgttctttataatcatctgtttttagaaacatggcctttgtcttcccttatcatttatactgctcttctaaagggattgagggtaatgactcatttttaaatctttatcagtgtctacagttgaaaatatatggcagaatcttatgatctgatgtggaaaaatgtcattgtatattaaaaattgcttgtttcctttcagatatcttcaagtacgtcccactctgatgcttctacaaagcagtgtcaaacatctgccttgtttcagtttgcagaggtatggcctttttaaaatgctttttaggctaagaaaacttgttgagctcaggaatactggaatggagttttaataatgtatagtgaactttaggcatgcctgttgtcattattaacataatacacataacagaatatttattgctttttctgctgcctttgatctaatcatagtcaaatcagctcccgattttacacccattttataagtattcattaaagagttcattcagaataccagtaatgtgtttatttcattttatcttgtttttaatttattttaaaagcttggaaaaactgctgtcaacaagaatgtcagaggctttcgatttattaaatttttccaatagtgaaattagatgctataattcatgaatgactctctcacagtgattgcagtggtgaatacgacctgttaaatcaggttaaattagctttcaatgtgatgtagcttcagccagtattttta

SEQ ID NO: 30811 - DNA, 1592 bp, Homo sapiens
ccctttgagttcttttgtaaattttttgtagtttatttaacttaatgagctgaccaatcatattctaaaattgctaaattttatggtaatttgtatcataaaacttatgcacttaaaatatataatatctttaaattaggtttttaaagattaccaagtccaaattagaaatataaaaatacaaaggccttaaaaagtaaaattaataaacaatggaacaaactaccccattgttgtctgacactacaatgacacgcttcttgtgtaagacaagttgagaccaaaatagagggctacaagtgactggaaaactctaaggaaaactaatgaagacagcagggaatagttctcaaaagaactgcatgagtcagtgcaaagtactactccaaacagagctgaaacagtgaagatctgacaagagagtgcctttagagttagagttgtaaacaaatcctagtaaacagacagactgtgaggtcatgcatttgtctagtaactctaagactgtatatagattgtcaagaaaatttatttgaacgaagtgattatttttcttgaataatatggatgtatgaccctctgcttgtgctggttatataattgcatgtgtatgtatgtgggcacacatatataggaaaatacatatgatttcttaaatattaaacaatactaaaatgtaaaaccagctttcaatgtatgatatttacctttaaacagtttttttttgttaaaaatgtatgaacctttggggtactttgctgcatgggggggctggtaaagaagtggattcgtcattttctttctttggcatagcagtcataaaaaaaggattccttattaaatcagagctcattaaaaagaacactcttctaatttgtagggatgcatcccaaatatgaaacagatgctatggtttaacagatgtttgaatgttggtatcataatttaacggggtaaaatgactgaaataagcctattccaattatagcaaatcagcttataccaagactgagtttcttatgacatttgagcaaagatttatacttttgattaaacagaatccctaaaaaagaaaactttctggcattgttatttgcactgaatcagtgtgatgtcttaatacagtgtattttagaataacattctaaaacctcccagtttctaattaaacttaagtatatgcacaatggattaaccagcatctccaaataatcaccagcagatttatgcttccttaatttttttattgcatgtgtacttgatattcatttttcattcacaaaatataacgtttaattatttctgatgcattttaagataaataaatataagaagatattgaagatttttcctattgcctagaattggtgatggtgtctgcaatttgaagacacaaccttaaattcacacattctaaagggaaagtcaccaagaaactacttccaatttgggccacacccatctcgggatttctaaagagatagcctaatacaacttattatcctatctaccactccaggagttcctcctcttatccccactccaatctcaagtcatcctttggtagagggttatcataggctgtccacaca

SEQ ID NO: 30812 - DNA, 1028 bp, Homo sapiens
gacaattcagagatacgtttgacgagttaaatgactgtataacagtgcccacagccttctatcaatttgattcatttcagttagtttggcagaagtgggctgattgttgtaaagtttaaagtgtgttttgattatttttaaaacagatataattgaaaactttaattttgaaggtggaataataaggatactttcgggtgctctcccattttgttttaattgtttagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacacca

SEQ ID NO: 30813 - DNA, 1025 bp, Homo sapiens
aaacacttgcacagatttatggtatcagtaataacagcaacagctgtaatttcttgagctcttactttgtgataagcagtgcattaagagctttatttgttcatggaataaatattgagaacctgtcatgtgctaagcaccattgtaggcatttagattatatctgtgaatgaaaacaaccctactgccatcaagattacattataatgggggaaccagacaataaataagcctaagcaataagcaaaatatataatttgtttgaaggtgagacgtacagtggaaaaagaattggtggatagagcaactaggcaaaagatcaacaagaaaaggctggaaccaacactacaaaccaactagaactaacaaacatatagaactctccactcagtaatggcagaatgtatattcttcacaagcatacatggaacaatctccacagtagaccatatgttaatccataaaaccaaccaataaatataaaaggattgaaataatacagagtgtgttctctgaccatagtacaatgaaatttaaaaatcagtagtagaaaaaaattggagaaactcacgaatatatagaaattaaatacacttctacataactgtcacatcaaaaaagaaatcaaagagaaatcagaaagtactttgaaatgaataaaaatgaagacacagtataagagaatttaagagatgcatctaaagcaaacttagagggagaaggggagaattatagctctaaatgcctatattaagaaagaaatctcaaataagtagcctagccttctactgtaagacactcaaaaaagaagagtaaaccaaactcaaaggaagcagaagaaaggaaataataaagattagagaagaagttgatgaaatgaaattaattaaataatactaaaacagtagagaaaaatcaatgaaaccaaaaactagtcctttgaaaataacaaaattgagaaattttagctagattgaccaagaagaaaaagagaagactcaaattattagaatcagagatgaaat

SEQ ID NO: 30814 - DNA, 1049 bp, Homo sapiens
acaaaaaaatctcagaatgttttaagaaagtttacgaatttgtgttgggctgcattcaaagctgtccccagccacatgcagcctgcaggccatgggttggacaagcttgctttagacagagataaccagagcaagcagatgaccaccatgtcagcaaatgactgtaagcaactgtggttcctactgaaaaatgagtctattctgcagctttctacagacctccaaacatgttttattccatgtttaaaatcatagctagttttccaagagcatatctgaattcctagaaaagaaaggtagtttttaggactgtcatcttccctttatctttctcaatgtgcacaaaagcaatcttaattccaggagatcctatacttttaaagatactagatgaatcagtatttgaccatggtctgctgttcgggtcactacaagccagattaccaggcattcaaaccagtagattaagcttaaaatgcatccaacattcacttcctatataactggtttagaccatgcagggagcctgagaatgcttctggatttcttgagttatctgatttaattcaccaactggtgaatttctccattttcaatcatggcctgttgtctgtttgctgttcctggtagcctctttggcagtagaatgaccggaggagcccaaggtaaggggtgtggccgaagagtgatactgagaccccccggccgcaaaatcttggagtgctataccagctaggtactagtggccttggctgttgcctttctgcctctcagcacctccgcaattttattttatgtgatttgggttaatctaggtgttaatagaggggaactgtttgcttagttagaggacagtttatgaattttgtgcacttcttttgtgtgttttgaatatttagattgttagaaacatagagtatattaaaggccctgattttgccctgtcatataagagaaaaaattcaaagaggtggaagtttttgtttgagtacattcaatacaatagaagtagaatgaggactaacacctagatgtcctgatgtttagcc

SEQ ID NO: 30815 - DNA, 1043 bp, Homo sapiens
cattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgc

SEQ ID NO: 30816 - DNA, 1027 bp, Homo sapiens
gatatgcttcagtacgccacttgggtgaacgcttctggggtgcgcttctgggactagtgatcagaacacaccatctttccctgaactgggacaaaactgtggaagcgatttcattaagagtgttacctaagtataaactcgcacctcagatttggtgaatacaatgttcctaagttgttttttttaatcctttggaaactacacgcatgcatgcacacagtattaattatcaacaaatagactttgtattcagacagttcttctacccatgtaccattgggttttttttaacctccctaattcagatttattgatagtgatgatacctcctcataccattgctgtggtgaagaaaagagagtatatatgaaaatattgtcatagggcctgtagcataaatgcccattaaatggtaattattgattgtattgttttaattccaactgtaaggttagcatttttttaagtacattcaaaagatatgatgagtataactattcaagataaactttgatgctgtagagataagctgttgcaggagatttgatggtatggaaaactcagaataggtaaaaatttgcacccattaactcataacttttatatgtagcactatgtaagatttttctataaaattagcctgtctaatgaattatacgagatattccagcacacctcctttccattgctgagaataagattgtgtgtgtgtgagggagagagagagagaacatggggtccataccaaagattaaaattctgttaggaaaaaagtgacaggatatacataagtgtagttttatggtcctgtgtgtattacacaattgcaccgatccttttgaatagaacataaaacctattgcaaggaaaaattaagtgattctaatcaacagtcagctaaaacatactactgactccattccatacatattttaaaaggatttatactaaagataaaattatgaatcataatttatcataaacctttttacctttttgaaattataggaattttcaaatacagtat

SEQ ID NO: 30817 - DNA, 1047 bp, Homo sapiens
tgctaaaaataaatttaaaagcaatattctgcacatgaatctttgaataccttaaaccttttaatacataggatatgaagtatttaacaggtgaatgctagcctcacctgcattaaaaactgtattgttagaataaaattgcatacagttcttcattccattactctgtttcaaagcccatggaaaattatttcatctcccatgctttgacttcagaagagttttctgttacccacagctcatatcatgcacccataacaataatccattcagcaaatctgcattggatgtctactgtgtgcaagtaccaagaagacagtctagcaggggttagagacagtctgttgaaatgcagtacagatgaagctggggatcaaagcctgtcaggggaaaatgacatatgagctcatgggaaactcgataatctgcattttgaagacatcaagaaaaaaaaagtgtatgtgttactgttctttaaaattttatttttaaaactttttctcacagaaaagatcttagcgcaaggacaaaaggaactgctgagactaggccacagagctccaagactgacaaatatgtgatcaaagtctttgggggcgatccatcatgctgtgtacctttcctttctgagtggcttaggatagggagcatctcagccaggctggttccaggactgatgtcactgtggggctgggttgtgcaccagctacagccttgacatagcctaagaatatttggaaacgtaaggtcaggaagtacagctcaaacatttggcccaggaaggaggtggttctgtcaccagatagtgtgattcccccaactcttttccttctccctttgccatacccttctttcctcaccttagttccagctctcacatactgctgaaatctaatttttttcaatcgttgaatttttctacagggatggcaccccatgcccaccagagctattttaatttccctttcttttttacttttttcttcactgagaatagctgtaaggtttttatggctgagggaatgactcaagaaatcctttgctcta

SEQ ID NO: 30818 - DNA, 1035 bp, Homo sapiens
aaatgtatcttatttctttattgtaaaatgtgctatttttgtatttcagatttggcatttaaatcctatagtgatataaagtagaactgcttttttaaggtcaactctagttcgtttttttgatcaggattatttattacttaccttgttattcatgttttgtttgttttatattcactgtggcttcactctcattgtatgtttcaaatgttaagctaagaaataacattaaacattttgaaaattgaactactttagggctattttttttccccattacttgcagtttgaagttgtgagaaaggatgaatatatcaccattgaaaatttaggagcaaggtaagcttaaaataaaatactctgttaccttttttggaatatgcatatattttttggttgcttaattcttctgtgtttctgtcacctaatagagctgcattaaattttaaggtatgtgaaaaaatcatatttaattgccatttctttccctctctatcaccacttattgtagacatttacattctaaagcggagatggagaaattatgtgaatactttcccattaaatatgaaaataatccttttctttaaacaaacatatttttcttaaagttagtttgttatgaaatacttttctatctttcaaaacttatccaaaccactaagcttgtcttacaattagaatcttcctgtttcttacatgagaaaactgtattgcagagtaatatatttgataaagctagaattaatagcggtattatagagtgttgctactgaagttagaagtttcaatataaaagttttcccagtcaattgattctctttttcttctgtttaacgtgtaaatgccatttttcaatctagtagggacattgcattgacatctaaagcatcagttttcccttattagttaatgaagcccaaatctttatatctagcacaaatctctctcctaaaagcttgaccttatatacctacctgcatactgagtatctccatttttatttttcaaaaatatttataatccagcatgtcc

SEQ ID NO: 30819 - DNA, 1064 bp, Homo sapiens
ggtcaggacatgcaaaaagttagtatttagagtctacttatgttctagagtatctaatatctagagtctacctaagattccagtaggtaacatagcactcaggttcacactgattagttccaggctggtgtttgtacatattatttggtaactgataaatgaacatcacattttcatcgagtaattgaaaagagtaagatatattttatttctgttttgtgaatgttgcttttttgggcaaacattataacattgataagaagctgaaattgctttcatctagattttgagaattttgtcttttatgtttaggtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagtataagctctcattaatatttgagttagaagaacttattctgggcctttaatttgttgcatgtgctgtacttaaagcatcccagataattttagcttatattttcatagtgtttatacagagcttgaattggaatggtcctttccttccttgcctcagtacttccttccataatctttcctgccataaccatttattttgccaccatttcttaaacacttatgtggcaggcattatgctagactgtaatatgtttttttaatcccagttgaagtggatgtgggaaggtattagaaagtagaagaaagtatagtctaaaatagagaggaaagaaaggaagagaaaagtgggatatttcaaaaccatttgcgcagaggtagaatgaaattcgtccagaatggaatctccgtatttctttacaaataagtggtaacagttattatatagtcactaaattatccttagatctttcatcttataggcatgaatatgttgctttttaaaaagtgtcttcctcctttgttacatccatgtgtgtaagtgagcatctgtgaacttttatcagtaacctacttattgaca

SEQ ID NO: 30820 - DNA, 1039 bp, Homo sapiens
tactgtttgatagcacaacagggtgactatagtccataataactgtgtatcttaaaataacttagaaagtgtaactggattgtttgtaactcaaaggaaaaatgcttgaggggatggaaaccccattccccatgatgtgcttatttctccttgcatgcctgtatccaaatatcccatgcaccccataaatatatgtaactattatgtaccacagtttttttttctttttttttttttttttaaaacaatacaaggatcttctcaactccttctgggcaaatggcaggttgctggcactcattaagacccagaacaggccgggcgcagtggctcacgcctgtaatcccagcactttgggagtctgaggcgggcggatcacgaggtctggagatcgagaccatcttggctaacatggtgaaaccccgtctctactaaaaatacaaaaaaattagccgggcgtggtggcgggtgcctgtagtcccagctactcaggaggctgaggcaggagaatggtgtgaacccaggaggcggagctttcagtgagccgagatggcgccactgcactccagcctgggcaacagagagagactctgtctcaaaaaaaaaaaaaaaaaaaaaacccagaacagacaacacatgatattataaatgtcacctagttcagcaactggtttgatattttagacgaagactaacctttaacctatttatgtatgtgtttattgcatctggaaatatatgccactccatgaccttgaagactctgtgccatgagctagtcttaatataggtcagaattagaggccacattgatgtaaaccccccaagaacttggacatgaagaagataagattccacactcaaaagttaaatataagatcaccacaggaaggatctgagcaggcaaatccaaattcacttggaggagacaggactgttcccaggccaaccaatatctcattaacaaaaaagaatgtatgaacatatctataaaagatgtttttaaaaaatcagaatgggcttggtcattctcgaggca

SEQ ID NO: 30821 - DNA, 1032 bp, Homo sapiens
gatctgggcattgatatattttctttatatttatagttaatagtaaaaatgtttaaatatataagtagctggtgaaatttgtatttggcatgccccaaagccccttttccttcaaaagctttaatcctgacagcatctcttgaaatataaaacaaatttgaagttccctaagaaaaatacatgtttttctttgaggatactactgttgctttgctgccctctacagtcatctaaaatagtcactctagatttttctccattcagatacttagaatactttttccctgacctgtgtatgagctttatatttcaggaatgggttaagtaatatttactgttacagaagtaaagtttagtcacagttaatctatatatgtcatgcaaaaaaaaaaaaaaaggacttagagatttgaacaagggataaattggggactattgagcaacaaccatgtgctagggagtataaaggataccacggtggaatgaggcatgttggccctctaaagcttatgaactcattaatacgattaatggcatgcttatatatcaaatgacatttgtaacaacatgccaagtgatatgatatagtttacagaaatattagtaagggctggaagagttaaaaatgagacttttgagctatgtcttcaagagtttagacagataaaacagggtggttttaaacatatttaaaacacaaagcaggctgggtgcagtggctcacgtctgtaatccctgagaggctaaggcaggaggattgtttgagcccaattctttgagaccagcctgggcaacatagtgagacctcgtctctgccaataaataaataaataaataagccaggcatggtggagtccacctgtagtagcaactactcaggagggtaaggtgggaggattgcttgagcccggaaggctgaggctgtagtgagctaagattttgcctctgcattccatcctggacaacagggcaagactctgtttcaccataaaaacaaaagacaaaacaaaacaacaagaaaaaccacaaccc

SEQ ID NO: 30822 - DNA, 1033 bp, Homo sapiens
agaaagaacaaattgctaaatagtgcagaaaaagactccagacatctaatctggttatattcagcctccttcctgttcccctgccccttacttttttcaacagctttacatattaatatggtttggtggtgtcctcacccaaatctcatcttgaattcccatgtgttgtgggagggaccctatgggaggtaattgaatcatgggggcaggtctttcctgtgatctccttgtgatagtaagtctcatgagatctgatggttttacaaaggggagtttccttgcacaagccctctatgcctgtagccatccatgtaagatgtgacttgctccttgttgccttccactgtgattgtgaggcttccccagtcagctggaactgtgagttcttcattaatcctcttccctttgtaaattgctcagtctcgggtatgtctttatcagcaccatgaaaatgggctaaaatagtaaattggtgtcagtggagtggggcattactgaaaagatgcctgaacatgtggaagtgactttggaactgggtaacaggcagaggttggaacagtttggagggctcagaagaagacagaaaaatgtgggaaagtttgaaacttcctagagacttgttgaatggctttgcccaaaatgctgataatatggacagtaaaatccaggctgaggtggtctcagatggcgatgaggaacctgttggaaactggagcaaaggtgactcttgtcatgtttctgcaaagagtctggtggcattttgcccctaccctagagatatgtagaactttgaagctgagagagttgatttagagtatctggtgggagaaatttctaagcagcaaagcattcaagaggtgacttgggtgctattaaaggcattcagttttaaaaggaaaatagaccatgcaagtttggaaaatttgcagcttgacaatgtgatagaaaagaaaatcccattttctgaggagaaattcaagctggctgcagacatttgcataagtaatgaggagccaaatgttaatcatcaaga

SEQ ID NO: 30823 - DNA, 1026 bp, Homo sapiens
aaacgttagtttaaaaaaaaaaaaaaaagatgagcaaacaaacttaattaagaacttgcctttctggccttatctcctgtcattttgttaccaatacttgggtttttctgagttttataaactttccttgtgttttctgttgctgtgagcctgtttgcttttgtttttcctttagtgcctttaccctgcctggaaaatcccacctcacctaacatccatcataaatgctactgatctcctacagcttacagacaaaattagtcactagtttagttgtagctgaaagaaaatgttactttctagatgtagcttttcttactctacacacttctctcattggttttcctaagtatctttttaagtttgtactcttacctaggaggctctcataaggataatatgtccctgtttgccttggaatatctaggtttacaagtattgtggtaaaattattaataatgtttctctaaacaaaattttcgcttggttaacaaattacgtggtcactgtagccataacgttcattgccttgtatgtcttattttcttttctagattatcagttcttggaatttgtagctatacaatcttctgtgttgtagaacatagtattaatactttatattccatgagtgaaaatcaataaatatttgaacacttaatatgtgctatgcatcctatattttgcctgtattagcaccctttttttcttaaccttcagttgtcttagagtatctacgtgtctcaaacaaaaatttgcagtcacaccagcctcgcaaagtctaactatggatcagtctggctctatacattctctgtgcttacctcttagctgctagtgatgctggggttaggggagtggggaagaaatcatatagccttgtacattagtgccactacagaatcaggctttagttttaactggacctcaaacaattttagtgcttcttcctttggtgcttagttagtacctatttccatgtttgagtgcttccttttaaattttattgagaccttgttaattagg

SEQ ID NO: 30824 - DNA, 1079 bp, Homo sapiens
tattttttgtagagatggggtttggccatattgcccaggctggtcttaaattcctgacctcaagcaatttacctgcctcggcctcccaaagtgtttaaattacagatgtgagccactgcacccagcccttattttctacttttgatgctattctacgtagcaatgttttacattttttattttctaattttctgctgctaatgcatagaaatacaatcgatatgtatatattggtcttaggtcctgcataaggtctgctactaaacacccttttcatagtagctttattgtagattccatcatattttctctaaagacaattgtgttttctgtgaataaagacatttcatttgttcctttctgatttggaatttatttctttttcttgcttgattgtactggctagaaccttcagtacaattttggatataactcaaagactgcctagctctatttagtttctctgtccttgtgcttcacttcgtctactgcctctgagggatcagaactttgttgcctgttgactgttaacttgaaatggttgtttcaggcaaaaggataaatcttattactccttcatgtctgtaaggtgtcgtctctattctgtttcaaatcaagcttttattctcaccactccaccaaaacagttgctaaattcagtggttacttaccagtgcttttttttttttttttttcccacttcttggcagcatttggaataattgacccctctgtaggtactttcttcacttaatgtataggataccctcttggttcccttcttgcttccctggccagctttattgatgctactgaatttaaatgttagaatgcactatggatccttgacatttacacctctgttctctatatttttagttccttgctaattgtctgtttcctcattaaaatgcaaactgtctaatggctcagcacctagagcagtgcctggcacaaattgttcacccaacgcattctgatgaatgaatgaagaaatggttggttttctcaaccagtttttggcatgtgacccaggtttctccttagaatatagaaacctttaattccagaattatcat

SEQ ID NO: 30825 - DNA, 1032 bp, Homo sapiens
cctaatctagtgcttttttcactgcaacacatattggcgtattgttaatttatttgacagtcacatttggatctcatatcaagcccagaaaacacctagttcatttctttttgttactcagttgtacgttttgtgtgtggtgcgtgtgagtgcatgtgtgtgtgtgtgcatgtgtgtgtgtgtgtgtgtgtgtgtgtgtgtgtgtagctagagatagttacacagggggtcaggaagggaggagagtgttgaccacttttttctattttaaaaattgtagtacttttttttcctccataggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttaggtaggtatgcttgaattatgtattttggtgatagtggtgaagattataataaaaatatttttaagaaattaaaatggttgaaatttgatttaactttaggtttaaagtaaaataattcaaatacgatttttcaagatccttcttaaaatttatgattctaggttccctgtaaataaaatcttgtctatatatacctacttatctatgtaatgctacatagttttatctagtttctttatgaaagatagtgatgagttttaattatatactaagttctgagtttctgtgacatctttattttcattacctcccctcaaattttcagcctttaatcaaattaccatcttaaattttttcatttttaaaaaattgagttttgcatctaggagc

SEQ ID NO: 30826 - DNA, 1105 bp, Homo sapiens
ctaaaagtgaaaccttcttaaatccccattctaaattgtttttatctgtataatacatgattatagtaatagcagaaaattttaattaaattttctgtcttatccttccccacctgtccccaccttcctaccccctcagttctgatctttagaggctactttagcaattttagcagtttcttacggttagttacagtcagaggtcttaagctgctactacttaatagtttttaacattgtcaattgacttcttagataaataattataattttatgtctactccttcatttacaaacacacccatatacacacattcctacctttcatagtccaaacgaaattttagctattttaaattaaactcagtaatcactgtttgcttctctaggacaggtaaatgttactaagagctaagtagtagtataccagacttctgttttctcttgtctatagccatttgttttcctaatggctaatatttgcctctttttacttgtgtagttactacgtgcataattttctttctctgaaatttcaaactgttataccaaggtttttattcatattttgtcagtatttagggcctattttgatctccagatgtatctatcaacttgaataattttcttattttttggtcatttccctcttttttattcctgttcactctttttggaactcctgtttattgtataataaatatcctttcttttatattttcagatggtcttattcttcctagaagattttcttgatttttttttaaattttccattgacttaatgatataaattttttttggcctgttttcagtttttaagagcgtcttctcataagacggagcatcttctcattgaatattcattagagaatgagaagatgctcttataaactgaaaataggccaacaataaaaatatgttattttcatagcacgcttttcttattttatgagtgtagtatctttcttgtttcttcccagggatactagaattatttcttccccagatagtttttttctgctttctacatactatctcttttccctccaagttcttttattttttggtttggtctttcattatgtagatatttcttaatcttg

SEQ ID NO: 30827 - DNA, 1046 bp, Homo sapiens
tttgatgcctgtacatatagttaatttttcagttcaacagtactatttctttaatacatagtatgactttctagattcttttatctttacactaagaacaaatagtgatttttttcttttgctttgatggccactttgtacacagttgtctggtaaataaaatggaatattaaatttgatggcttgttaaatagcgttgtttcccacttaatatgggactataccatattgtgttactgagaggtgaaataggaatgctactgaaaatgtgttaatgaaataaaatttgtgatgttttttattgtctttaaactactaatagcttagatttttcacattctgtttcactttgaatatttttgttaatttggctgagtataaattttggcattcgtaaaatagagagctaaaaatacatcttttcctggttgtggctgcaagtaataaattatcaatagaatgcttatttataaaaattcaataaaatattttgagcatctccttactgattacaagaatgtagcaatcttcctgtctaacaaatggaaaattaagaggtaaaaggaagagaacctaagaaactcaggtttgtatggtaattatggaataaatagttaagggttttatctttgttcagatctaaaactagataaattagaggttttggtgaaattttgtgcttgcttaagtgttatattctcagtccttgtgtgatcagtccaagaaaagtaccacgtattatattgtcttagagcactcaccacagtttttagttgtatgctcatttctttgcttattatttatcttcacaattcagcaatttgtgcttgctttattcacgactgtatactcagcagtgagcattgtgcctggcacatgatagaggtgcaaactttctttttttttttttttttttgcatgagtctagaaagaagcttagagctgtatacatccctagccctttctgccagtatcagtactttggtggaaatctgtatttttttttcttttgagacgtggtctcgctgtgtcacccaggctggagt

SEQ ID NO: 30828 - DNA, 1045 bp, Homo sapiens
ctgggactacaggtggccgccactacgcccagctaattttttgtatttttagtagagatgtggtttcaccatattagccaggatggtctcgatctcctgacctcatgatccaccagcctcggccttccagagtgctgggattacaggcatgagccaccgcacctagccgagaatgtttttttttttttggtaatcagtagttagactttacttttctatccagagtctgtaacacagcatactatcctgagattagttaactcatctaacaactgcttggagtatgtcaggtatcctaggtataatgctgcctttccagaatgactatttagtaaaacctagtaggcttttacaagagtgagaagccataattcacaaaataaatgaccagttaatctttttcattgttacatgtactcattttcctctaggaaaaaaatgttacctcagtattaaaatagatatttaaaaatttgagaaattatttttaatatatgtaaaataaatgcatcttaggactagagatgaaaagttctgctcagaacagaataagcaactctgagggaaattgttcttaattttgttacacattttcccacattgataaatgtaagattttggataacaggtttttgatttaggattgcaatattcaacctcagttattaaattgtactctattatataatagtaatactctcaagaggtatagtagctctttgactagtacttactgactactggaaattgtgtttttctggtttgcttttgatgtatatttttcccttaactaatacctgtttcttatctttaaatttagaaaagcaaattttgatatgtcaaataagtgcccctatgtctaaaactcttattcctgtgcacagcttgaatttcaggtcatattgattttaggatccaagtgtagtttcaaacttaagaatctgcttacttagcaatccttaaacattaaaatgcattatttcatatatttaaacacctatatgaagtctaaaagaaaaataagccaattaatttttatgacact

SEQ ID NO: 30829 - DNA, 1033 bp, Homo sapiens
gacagggttacctgttataaatttaaactcaaaattagttatattgtacttattaaattttatactgtacttgctaaatttttaccacattctatacatatggcattccgtgatgaaacctgttcagtaagtatttttctttagcttgtaatattagaataacttaccccatgtagatttagtatttttctaacaatcattttttaaagctctatcagtaccactcatttaaaaattaattataggagattaccatttgggtcatttatttctttcactgtgaaggaaacaatatttttaaacttaccctttcttcaaactctacagttttgtgttacatgacctataaatactacttaattgataattaaccagtctttaatttttgctatttatgtttagttgctttttaatattactggctatttactctgttatctaatgtcaatacacagattcctttgcatctaatatttaagtattattagaatgttctctctaaaatattagctgttctttttgagactccatcctaaagtagtgacattaaattttgcagatatagttgaagtttttaaatttctgaatgtttagataacttgcccatagggtgttagacatggtgatgacatttttattactttataacatatttttactttgtctattagtttcctttggtaatagcctatcaggctaacataagtttaaacatatgcttttttatttttttaaattactaaataatagtgtttactatatatctccttccaaaaattttgagcttttttatttaaagaaaatatttttgagagaattattaaaccaacagcttatactatgcccacttaacaagagtctatagtttttcattcttttaaagatacgctcagctcttataaaaataaaccatattattaataggtaaaatggatattaagaaaaactttaatttttttattctttttattttcttgagctactggctaagaaaatgtacatttgaattacttgatttacttttttgttatag

SEQ ID NO: 30830 - DNA, 1023 bp, Homo sapiens
ctaaaggaatgtttctgccaagatgttctcagcttttgttcttcagctgaccatatagtcagtttactgtccaagaatggggcaggaaggagcattccctggcacatgggcccactgtcagtgggcactagctttgtcatcttacacagttaggtgtcctgatggtgaagatgtgccatgttttcagaccttttgttctcacataaagagtgtagtctcatctcttggcaaataaatgaaattgacaagtggtgtgaaatgtcataaaattcttagctggagctgttgttgtattttgttttgttttggttttggtctggatttgttttttttgcctgttagataactgaaaaagtagctcattaaaatgttttgtagattcctggatgaagttgatctgcttttcatgatcgattggttataggtattaatagttctgtaaattatctttttgtatcatttttcagatttttggtttctttttgaactttgcttcttagttttttaggaactctttgatgtggatagtaatcttttgtattatattcatctcttattttttaaccttatagtatcatatagaaaattgtacgtttttatgtagtaaaaatctgtttgtctctttgcttgtatttgttggaagttctgtattgtctgaaatggcttccttacatttccttctctctccttgaactagaatgtagaaaaaagtcttagaaaactaatagttttatggtttatatttcattttaatctgaaactttattaaacttgataaagaggtagagacccatttttcccaatgggataaccagttgtccaaatacttctgaattacctatacttttgcatggtttgagagcacttttatcctaaaataaattctcatacatattaggtctgtttctgaactcttaattctgttgtattgctatgtctttctcttcctaaaccaagatactgctgtttcaattactattgctttataatatgatttgatattcagtaaattcccttatctct

SEQ ID NO: 30831 - DNA, 1025 bp, Homo sapiens
aagtgaaagtgcttggggtcctcaagatgtaaaagatcataaaggggtcgtggggccaaaaatttgagaactgctgttgtaaactgtaagcagtatgaaggcaggggtcatgtcactattgtttagtaccatattcttagtgcataacacagtgcttggcacatataagtacctgataatttttttaatttgacagatcaaaattgtatatttttatgatatacagcatgcagcgtgatgttttaatatatgtggaataactaaatcaagcaaataaacatatgcattaccttatgtattccgataaacaggttttgaatgagtaggtaaaggaatcaagcccttttttatattctcttcagtttataatctgttaaaatttctgcatcatttataatatccatatcacagatactatatttcagtatatttaatgtcagtgtctataatatcactgtatcaagtatgagatatcaatatataatgtatgaaaaagaacagagaaaaagagactatagaaatatttttaaatgttagcagttatctttgtaatagacttctcagtgaatattatttttgttatattttctgtagtttctgttttttctgcagtgcctttccccacctctgtaagtagccttttagcataagaaaatagagatctattgaacacctgagtcactggcctggaatgttaagctggtcatactggttatgcagtgtgtcagcactgttaactatctgagaaaactgaatttctttccaataatttactatagtatattgcattctttagtaaatgtttgtaaatattcatgacagtgttagtagagaaagaatgtttttacatttttttagtgtatggataatacatacaaaacaatataaagaggtgttttctaaggtctcattcctatacctatttaccctacccccatctacagataaccacttttattaatttatgtcttggcactgtttctttaagcatagacaagaaaacacacacacacacacactcaggt

SEQ ID NO: 30832 - DNA, 1037 bp, Homo sapiens
tcaaatgttgctaaactttgtggttttaaggatataagttcaagagaaaagtctctccaggtattcagttacaatcaggccatatttcatttaaacctttcttgaacccatcattatatctttttaaaagtcatttttgtaatacatcattgccatcttccaataataatttttaggtaggctgcttttgttagtaatcattgatggtcttattttctcccaggatctgaatattttaacatgtttccagacactacgagtagttatgatctttgggattagggaagggagagaggaatatgatagaagagttaacatttttttccaaattatagagaagtatatgactgagtggattattcaaataaggattgagtatttctagcatggttctccccttgagtagaaaaatgttttcgtcttttatattgccttcagttagtaagtagtggcaattattgagacaagtagtgaaagaattgtggggctttattctgctctgaggtggaaaaaaaattttgtgatcaacaaagcttggataaaataatgatttataaactaattttagttggggagggcccttcaaagcaaaaagaaatattaaaaatctaaatatctaaaaatatttgtcaagaatcataaaattaaaggagatacagatgtaacatgtgaagtataaaagtttgatgtcttcatcatatcaaagcttttgctatctgtcttataaatgagaaaaagataagcttgttttataatgttttatagggattaatcaactaatatatgctacatccttagaatagtgcctgacacagtaattactgtgcatttgctgttattgttatttaaaaagctgtataattcctgataaaaatattaaagatgctaagcagtgaaattatttcagtagaaaaacaaagctgatgctactttgatttatttaaacttagcatatatttcttttagaagtatccatacctttattataagcttagtagtgcttgaaatgaaactagaatatatggagtctacactgt

SEQ ID NO: 30833 - DNA, 1068 bp, Homo sapiens
aaggaaggctggagaattgacccccagcaattaaatacttgaagcttcaagtgctatcttgctttctcccattctattagctcaagcacgtcacataacttcaagggggatgggttatataatcctcccaagtacctagaaagaggggaacaacataccagtgaacaatgttatgtccaccatgctccttttctgatccctgtccactttcttgtgacatgatacacaaccgaagaaaacaatgagcagcaaggaaattgaataatgcccaaactaaactcataattatctacctaattcctttgtagaacctgcagaagtctcagataggaccctgagtttagggaaatagttaagactaggaaatcagcccaagataaatgactttcttatattatcctgttttctgtgcctacttgatgtttatctaatttgagatctgggatcaatctagattaaggtctgccattaagagacagaactcctgggtgcagcatgaatatggattcttagatgtgtataaatattggctttgatagtcttgagtgaaatgatattcgcttgacagtaatgatcgaaagctttgggtccattctctttggctatatcacaagccttagtaatctttctgtttagaatttttatcactaaaactatatactatgtatatgtgaatacatgtaatgtaggaataatatataagtagtaaatagtgtttataatatttaataaagataggtaggtaggtaggtaggtagatagatttgaacccataagtgactgaaccagatgtaaatgtaggtgattcacccatttgagctaagtgatttttgcattttgtagccacattcactttgtaaaattgaatgtcagttagaagtgaatttttgcacacgtaggtgattcacccatttgagctaagtgacttttgcattttgtagccacattcactttgtaaaattgaacatcaattagaagtgaatttttgcaatgagtcaaaagatatttaaagagataactctacatctggagatatttctgcagctgggaaatagttcaagaataaag

SEQ ID NO: 30834 - DNA, 1057 bp, Homo sapiens
cttttattcttccttcccatatttaatattgaagcataaatctccggctgtgttcttctttattaggcatgaagatgaagaaaagtgaaaggtagagggggacagtaagtgagggtaggatggaattaggttggcgataaaaagttaaagcttttattgaattactatattgtgaataatagctattatttattgagtgctacttatatggtaggcattgttacaagcactttacatgaactgtgtcatttaatccttacagtcaacccctcaggtagaaattactgttttctcccttctgtcagtgaggaaactgaggctttgaggggtattaaggaaaaaaaacattcagtgatacttttattaaagcacagtgaggcaaactttattcaggaccatagaaataggtatagggagtcttgtaataggggagaaagactgggcttaattctgaatacagcatatgcaagtgggcatttatagcaaaggagcagagtaggggtcagtggatgaaaaattactaagaggaagcatcagaggtaaggggaacttctggctaaaccaacataacaggattcctgttgaagacagggcagtgtgatcagacattacctgggaggtagtggaggatgaagcacctgatgagctatctgggatgatcatatattgagggtgggagattcttgctaaactaacttagcagggattgctaaaacacagattttatgaggaagtggacagatgggccttgaagaaggttcagaagactcaagtttggccaagcaaggaatctttgtcaaggattaagtaattttaccagggtcatctttaatatacagcttctgaatttgggttcttaacttctattccttgctgcctaccaaccaagagaacatatgtcattactaattagagcttatatttatttagcattttctaaatgtgtggcattgttgtaagttctttatacatattacctcatgaaattctcataacaacgttgtgaagcacatgccgttattatcttcacctttaagatgagcatactgaagctcag

SEQ ID NO: 30835 - DNA, 1050 bp, Homo sapiens
gtatgttcaagtgagttctcccatccaaccaataaagtgtgagtcctcactaatactggttaacctttacctcttcacagcttatgttgattgctctagcctctgaacccctgtcatttctgtagtctgtattttaagtcttcagtatgttatctacaatttcaaaaatctctaagcaaatcaagtttttcctaacccattttgcactcaaatctgagctgaactactgattctcacagtgttatttataatcatttttctcacttaatatgaacgttcaattttccactgcggatatattgatgtgcttgaccgtggggttctgtaccatatcctgcaggaggtgctttataaatatatggaatatgtacctatcacttttctaaaatcagaaaaattctgaattccaaaacacatctggtcctaagagtttcagatgagagattgtggacttgtagtgatttagccatttaataatattaggtcagcaggtagttacatgtctacagtgtgctgggtactgaaacgggagggttccttgatcccccttgcaggacatacagcagggttgtggcttgcctgttccatcgccactgctgctcaaaccactgaggtttggggggtggggggtggggcgagcatgcagacagacaggtgcaagagcccaggtgtgcatgtgttacagtgtgcccttttagccctgctgtctgtagacggcttgagtgttaaccagctcagtggaccctctgcctttctgcaagggcagaaggccagtgtgacaactttctgtatcctgagctcttgtccagtgtcccggtagaattgggtcacacacggactcagtggatgagtgtggacttgaaggatgaatgcaggatttcagtgagtggtggaggtggctctcagtgggatggatggggagctggcagcggggatggagtgggaagatgatcttcccctggagcctggccatccagctgccaaactcctcttccaccacctccagccaaactcctctcagtgttcaaatgttgctcctcttctctattt

SEQ ID NO: 30836 - DNA, 1051 bp, Homo sapiens
ccaaaacttggaagtaaccaatatgcaaatgaataaatgaactaatatattcagacaatggaatattatttagtgctaaaaaggaataaaccatcaagtcatgaaaagacatggggtaacgttaaatgcatattacagagtgaaagatctgaaaaagctacatactgaatgatttccactatatgatactgtggaaaaggcaaaacaatagagactggaaaaagataaattattgctataggttgggtggctagggaggatggtggaacacaggagattttcaggccagttaaattattctgtgtgatactacaagagtagatcgtgtcatgatccatttgttaaaatccgtttgttacaacaccaagagtgaactctaatgtaaactataaactttaggtgatgatgtgtgagaaggtgcatcactggtaacaaatgtgccactgtggtgcaagtatgttcatagttgtggaggttgtggcatgggggcagggaatatgtgggaattatttgtactttccactgaacttttctgtgaacttaaaaccactaaaaaataaaattgattaaataaaaagagacgctagtttatgcaacatttcaggtggtctgtggattgacagaaagagcatgtactcatctgccattagatttaagttccttatgtattgagccaatgtcacaaaatcttgtcagagtttatatagccacacagtgcagaaacagatacataatgctttccatagcccagttccctaatgcagggccttttctagggtgtgttgggtccttgtctgcatacacaattttactaaatattatattacaaaagttacagtgatttaatgatgaagattcagaatatgggatagagaaaagaaatttacccattcacttattgtccgatcagtgcacatgaagattgtttgtagtgtccaggcaccattttttcctgttcaggtctgagaactttctcttcttgtcctttactgtcaaattcaccacttctggctatttaaaaaagtcttctaccatgagaaaaagacagcaa

SEQ ID NO: 30837 - DNA, 1047 bp, Homo sapiens
tcagaggtatagaaaatactacagagtgtttaggaaagagtgacataagcaataaaatacattaagtatatttccaacctaacttcaagggtagaggagaatgttagcatagatttctaatgagatgccaaagatacgttatgatttatgtcgtgctggctctagttcttctttgtgtgtttgtttcttctttctagttgccatgctttatcaaattatctaggtagttctacagccgaaatatattctcccccatttacgcgagtgaccagcaactctgggagacaggatgcttagatttcaactcaatgctttagctaggtaattagcagttttaaagtctgtagctgtaaggatcaaagggtgaatttcaaggacgcccattgctactgtgctacctcagagtaggagtgtactgccctttgtagcaaagaaaatattcaactttattatttggaaggccaacgctgagttagtataactgaaggtgtaggaatcctggcatttgtcttccgataggaggatggctgtgatcagagctctgcttgacagggaagtgtttcataaacactggatgttatggaggcaataagggggtatgtcagctcctttagaaagctttaaaaatgtcaatgtcttacatgttggggatggtttccagggtcctgctgggaagtaaattgttgaattagttcacaaaagcatactatagacccaggggagtagctgtcttcatttgcaccagagaaagggatctggaaacactggttctcaggagccctgtggcctgtcttcagcaccctccataccttgaggaacccactgtctaccttttaaaattctcagtgtagttatggaaaagaaatttcaggatgtagtctcacctctcctgcagccagtgagttcagtatcttctttgccttgtgtcagctaggatacttctttaacaaactggtagatgttatagctcttggccctttacacaggtcatagaagctctataatagcttatcctggtgccttccatctgttctctctaaaaactgg

SEQ ID NO: 30838 - DNA, 1035 bp, Homo sapiens
atggctgactagaagtatttcatgcccacttcctccatttggaagaaccaaaatagtatatggacagtcacactttgaatacatgatccaagagaatactggaatttaacacaaaagtgacaagaaacatcaaaagtgggaaacgggaaggaagagaggtagcctgcttggccagtattggctgggagctgggggtggctttccaacatgcagaaagggtgaatgagaaacttccagcagctcacatccccattatgatgttatgtgatctgggccacaagagaatcacttgactctccctacccctgttactaacatagggagcttctgggaaacagaacagatttgcagtcccaattctgggatactctgggatgagatggaactgctccaaggaaggagcttgtgctgtggcccacaccctttctgagatctaaatgtcttcagcatcacactgttttcctttatagtgatgcaaatggaccaaaaccacaaagaactcaaatgactcaacaggaaaaaaaaatcccagtaaaatgtgggcaaaggacatgagcagacatttctcaaaagaggacatacaagtggccaacaagtattagaaaaaatgctcaccatcactaatcatcagaaaagtgcaaatcaaaaccacaatgagatatcaccttaccccagtctccagtcagaatggctattattgaaaagacaaaaaataatacttgttggtgacaatgtagagaaaaaggaactcttatacactgttgatgagaatgtaaactagtacaagcactatagaaaacagtatgaagagttctcaaaaaaaacaaaaatagaactactatactatccagcaatcccactactgggtatccacccaaagtaaaagaactcaatatatcaaatgcatacctgcactcactggtttacggcagtactattcacaatagcaaaaatatggaatcaactttagtgttcatcaatgggtgaatgtataaagaaaatgtgatgcacacacacacacacacacacatatac

SEQ ID NO: 30839 - DNA, 1028 bp, Homo sapiens
aagcaaatgcccaaaattagagatgagaaaacaagggcaccttcaggaaacagagaagggctgccatggtcacctgtagaagtgacaggagaaggaaatgggaaagttacggaaagacagacaagccagttggagagagattttcagcactgtgctaagcactttatgctttgtgttgtagaccatagggagccagtgacaattttgggcttgaagaaaactgtgaaagaaagtgttctatccctgttataattccagtctttgaacaccctcccttccaataacccaccttcgctttgcctcgccaattacagttcagttcaggtatgacctctgtgcacatttccattataggacatgatataccccattgggactgtttctctctgctgtatacaactgttttgtcatttctgtatacttgctgtcttgttcagaataagcaccttatgataaaagtggagggaaagaagaaggaggggaaagatggaatcttgaaatatatctacaaagaatttaagcataaaaaacagatatttaaaaatctatatttctagttaaggagaaactaggacaggcaggaagcaagtagtaacgcctaaggtaagacaaaatcttataactgcattgcagtcttctcaagatgcctcaaggctttaagagtaagaacaagtataataataataaaagaagcagaagaaagatagcttgctcatttaatatttatatagcacttcctaggggaccgatattgctgtttgatttatataaagccaattaattattataataaattaatgatgtagatactcctactatccccattttacagatgaagaaattcagtcacagagaggttaagcagatggccccccaaaatcctgataacaatactagaattgtaaaaattaggtcatgccaaattcatttaattgcatttgaataaaagtcattgatagagttggagattgacccagtgttgggttgtaactttagtttcttttgttggttgtaataaagggtaattt

SEQ ID NO: 30840 - DNA, 1026 bp, Homo sapiens
acaacttgtgagttggtctggggaattaatattcacaacccttagcacagtacaaattgtaatgtagctggcccttctacattcacctgaaacatctgagtcattttagtttactatctccttcacctgtaagttctattttgttattctgtgttacttttggaaaagtagccgaaaaacaacaacaacaaaaaacacaaccttggaagatctgaggagcaagacatacagttcccttaagaaacatgctcaccttctttcctgcttttccaagatggtggtaattgcttcatatgggttggtttttcctcaatgtgaaaactcagggagaggaagaggttgtggcaatgtcactcattgccagagagataattcttgtatgttttaaattacatggctgtcctttagggatttgtttttcatactacaaggaaatatcgtccatgtagttggtgccaatgtgaaacttttctatgccacaagcctttttttgaaatcataagaaaatatacgtgtgtgagcttttcaaataatttctgttgtttttttgtcatttgcataataaataattggaaacaacttaaaaggagcaattagtaattccaaaagttcaagtatcaaaggtaaatatttgagtaatgaattatttcgccttccttaaaaaaagacgcagcttcacgcatgtgactataccagcttcatttaatgctgtgtggattgatcattataattcatgacattctatttagtcttgtggtgtgcttttatgttttccatcttcccttagctaaatgctatatggctttaaaaaatacatatgtatttataatttataatggcagattatattaaagtaacttattttcccagaaatgtctgaatctgaaataacctattttcacttaaatatctaaaaccactccaaatactaatggtgtgaatactctgcatgaaactaaaaccattttacagaaattttgacatacaatgctttgttaaggcatcatggatgtggcttctattttt

SEQ ID NO: 30841 - DNA, 1046 bp, Homo sapiens
tatgtcaagtgaagttcctcagaggaggtgacatgacttaaagggtgactacgaatttgggttggggaggaagctgttcttggcagcagaacagcatgctaaggctctaagttataaaagggtgtaactgggaattaggagtagttcagtatgactagagtttaggtaacctgtgggtgtggtatgatactttataccaccatgattttttattgatttgatacccttaaggagaggtaaaattcatagatcagacagataactgagcctagataactaggaagttggaaggagaaagggatgggttggtgatgatgaattttattctggtctccttcccttccatcaattcactaaatatacactaagcacctaccactcgcaaggaactgaactaggcactaggaacgcattgaaacaaagcttgtgcccatgtggaactttcattctaatgtgggagatggaccataaataatcaaatatatctcaagtagtaataagtgctatgaagaaaatgaagcagagtaaagaattagagaatgatgaaagcagcacagttttaataattgaatggtcatgggaggcttttctgaggatgtaatatttgagccaaaggcctgaatgaagtgtgggagcaatctaaatggctatctggaggagagtatgccatgtggagagaaaagctgatgagatgggagcttcaagaagcaaagcgaagatacagttgggagggagggagggagagagagaaaacaatgagaaatgagatcagagaggtgatcaggcaccaaagtatggtaagggctctggatttaaagattatagaaagcctttggagggtttgcaagacatggttttgttttaaaaggatcactctactatatagggaaagacaatgagtgtgaaaatgcaaacaggagactttttaggagactattgcattcagttaggttgagagacagtgtgactagcaacaggctggtagcagtggaggaggtgagaaagtgattggacacaggaggtatttgaaagttaataagccaata

SEQ ID NO: 30842 - DNA, 1070 bp, Homo sapiens
gatggagaaatttcagaagcataataaagttcacaataaggataatactttatataatgtataaagtatatataatataatatatatgttatataaactgcacattatattcaaacttaaaattgagctttttttttaaaggcccaaaattgtacagtgatacaaggagctatttctaaaatttggcttatgtataatatatttaaatggggaatttcatctaaaacaatgatgtagtatttttaatattctgattggtaaaattaaagaggaaattaatctttatatattatttcttgcagaaacattcattattttattaatattgccctaagtacaactaggcaagtgattgccacctaaatcagaagacgttctaaagtcagtaagaaagtgtgaaatgctagtataaaggttattttttttctttcctaaataactaaagtgaggtgtagattgagccttgatattatttagttaatgttttttattaattaattttggctggactttatttagcttgattaggttattatctgtcaaaccttttaagttgacaacatgactcatatatatacatgtgtataagatgagcatgtgtcgaagacttattcgactcattaatgaggaaaccagcagatagtaaacctggttcaaagtacaattcaagaaactgagtatttatgggcattgaagaaaaaatgttgagataaaattgctgtgcagaaaaaagtgttaatgaagccgacctgactacttaaccttagagacctgctttacaaggttggcccttgattggcatctgggaacttggagttcagggggcttccaccattcccagaactgatcaaagtagcttactatatctaaactgtaaaacaatatagtttctcctgaacacctgctttccttctgggagtctggaattttggtatgtgccaggcagagactacctttgtgaccagctcccagtaaaaaccccaggcactcagtctctaacaagcttttctggttgacagtgtttcacaagtgctgttacaactggttgctgggagaattaagctcatcct

SEQ ID NO: 30843 - DNA, 1031 bp, Homo sapiens
accaccaaggttactttgaaatctatgtatatagctagttacagacgggagctatgtgtttcttcattattttgcagctcctcgttgttcctgtgattcctgaacacctttttggaaatatgggtctctgtgagttttgagcacactactatcactttggatagtcactccatttatatttttataaacttccattagagaatcattaaggctgtttaatatctgctctggatattacgcattggctttttgttgcctagtgctacaaaccttcctgtgggactcagtgtcttcaggcaatgattgtgtatcctgttacagatggttgtgatacaagaagaaccactcttctttgaaaataaactcttggaagcttttgccagctatttggggggtaggaggaatattagcaactgtattggttgtctacagatacagaattgcctgttgtgagggaactgattgttttgttgggaaaagaaatttaccaggagaaagagttttgtgctgtattgtgagagatctcgcctctcagttaaatgagccctgggttaaagtcagtgtgaagggcagctgtgtgcgggcacgagccagagtgtctgcctcagactagatttgacttgagttctttatgacccaggactctggataatgtgaatttgctttcctatttaactagaagatacatgtactatagatcattgtctcattttagtgattgttccttaaactagtgaaactagtggatttctcttcttcctctttattttctgcatgttaaatgtgaaccttagtgtatttgtattttgtagaaaataatgaaaaattttaatggagaatgatttaaaaacatttacaatacattatttttgcatctgtgttgttgcattcccattggctgagctttgggctgggtttttgtttgtttgttttttgcagtaaatggtgttgagcataatttttttcatttcccttagggcagcttcctcttctgggtgaataagatcaagccaagtttggctggggcggcc

SEQ ID NO: 30844 - DNA, 1085 bp, Homo sapiens
tctaatcatacttgcccccgcctccccactgtgtaaagccagtatctcctgcagctgtcaggacaaagatgaaaatctttaacttggccaggaggccccacccctcccctatcccaggctggctttcttgcagtttcttgtaagtgcctttctcctccaccttttgtatccttgcccccagttactgccttcagcctccaggcctcaggcactaactgaggaatttggagattaatgagccaattcctgcttcaatgagctcaccatctactgaggacaaaggacatgcaattggatacagtaaagcaaaatgtgtagatattgtaattgaaatatgcctaaggggctttgggaacatagagaagaagtagtttggaaatgtaagtcttatcaaaagtgaaaatactaggaaatcaatgacttactttcgttttgggaatcttgcctcttttcaaaaatgagtatttttttcctgtaaaagaaaagcaaagcaaattgttttaatattcagaaactctcaaaggaaatgacacaagcctacaaaacttacttttaactctttgttaaagttatataccttttataatacctccttcagcatagatgagttaagtaaaaaagaaaaaagtaaaagatgaggccaaatagaaatatattcctttgtgcctctttctctctctcctcctctctttcttttctaaatctgatagggaattgatttatagatggggaaatatggtgatagaggttacttttttggagactttttttctgacaaagtatcaatttcttttctatcatgtgagtgaaggagccaggattattttcaatctcaattctaatctatgatctccaaaacaaacaaacaaataaacacactcttcgcataagggaacactgtaaaaagactccctgaaaaaatgtgatataaatataatggaagcccactatcgtttcagtagacaagaacatctgctgtgagggtaaccctatgtcctggtttgcctcagtctggtgaaggtcattatcaatcacttagcgagctttaactatttttagcatccctttcactctcaaaggtatct

SEQ ID NO: 30845 - DNA, 1035 bp, Homo sapiens
gcaaatctaccaccttgactccaacgatatagttaaataacaggacttctctctcttatagcacaaaggcttagaatctctctgcagtcctgcatctacattaatgtataagtatcattctgtacatttttctgaatttgaggcatagtcaactacctacatggttgaatgtgaaagccctttataaagtagtatcagttacagtatgtaaaaatgtttggaaaacaccatccaaaaatatctccccccgtgagctttcccatgaagtttcatcaggaggagcagtggaggagaggctgactgcatcgtgaccttggctgtgatcacctgcttggctgagcattctgacaacctctaagatctatgcatcatcaaagcctttggggcccagaggcacagctgcagctcttcctcttctttaggttaccttcaatgtgcttcagaccgtttgcttacattatctgctttgttgctaaggaaacatcgtaagaaaactactgaatcacaccaagttaacaaaccagattcactgaggagaaatgaatgagataagaggagggggatgattttgagagatattctctgaactcctgaggccacagtttttaaatctataaaagaggatgtatatactgcttacacatggagttataagaataagctgaggttaaatatgggcaaaaacgatctgtaagctggctgtttctcctacttgacttttctgcagtttattcttgcatttcaacatggtggttttggtttgggatgggttcagatagcctccaagaagcaagctagacaaatctctatacccttaggctacgtgtcaggaatttgaggtatctgtctctttcacaatgccttctctggctctctggtctacccaacctctcccttgttataatgccgtggcccttctgatttatttcatcatttgaactgtatgccttaaaatatgcccaatgatacccctgaaaatatgtaattctcaacttgaactgaaaaaattcaccctgttgaaaggaatctctgggt

SEQ ID NO: 30846 - DNA, 1035 bp, Homo sapiens
tagatattgtattattatttctacttaaaataaagaggctgaggtccagaaagtaaatctgagttctgtgcctatttaatctagatgacctctgcttacctgcttgcagggagtgcacatcaaaggaagactcaaggtggcaggaagcttgctgtttatttcaaacttaaaatagtggctgaaagagggtggtgattttgacctccttgtggagcatgaggagctcaggagagcatctccttcccgggctttcagaaagttgtttcatttcttaggtggtaacctattatatagaccttccttggtaaagtctttccacctttcagctattctccatcagctgctcaccatgattcttgggagaaggcaaaacctatgggaaatttaatgtggtatctggcacagagtaggcactgaaggcttggcagtttccttacccaactactttctaccccaacttagtgtgctaactgtatactagctttctttttctcttccttgctgtattgtcctgtcccatctcctctgctctcccacagggagtctagacttacctgttttctctcagcagagaatttcccatcctctcagtcctctcagggcttcccctccgtccctttaccacttccttcttgccttgtgctctgacagggcaactcctgacttaaagaaagggctgtgtggctctggccacccgtgcagagacagcagaaaggagaagggtgtctctgcagagggaaggaagaggctgggggaggagtgttagaggcacgcatgtgcagaatgtcctaacatgtcagtgcctgaaccaacctggctgttggccataaccagcaactacccgtcaatgagagcttcgaacctctggggaatcccaggtctgaaattacagatgggccatgggagtttttccactacagatatttacgtttataaatcacgttgtcttcttagaaaagtcagaaggaggttaaaacagtcaagccacagacctgtagaaaatatagtatcaacaactctcaaatctgaaaacaa

SEQ ID NO: 30847 - DNA, 1008 bp, Homo sapiens
atttaacttttgtaagcaactgacaaactgtttcagaccaaaaccactgttcaaattaaaactctgtttcagaagttgttgcaacattttacactctcatcagccatgtatgaaaatttcagctgggcgtggtggctcatgcctgtaatcttagcactttgggaggctgaggcgggctgagcccctgaggtcaggagttggagaccagcctagccaacatggcgaaatgccgtctctactaaaaatacaaaaattatctgggcatggtggcacgtgactgtaatcctagctacttgggaggctgaggcaggagaatcacttgaatccgggaggcggaggttgcagtgagctgagattgggagccattgcactccagcctgggcaacagagtgagactctgtcagaaaaaaaaaagaaaagaaaagaaaagaaaattttagttgctccacgtccttgccaatacctgttattcagtgtttttatttttaggcaatgtagtaggtgtgtattgacgtaccactgtgggtttaatttgcatgtttctggcagctaatgatggtgaacatcttcatgtgtttattggccatttgtatattctttgtaaagtgtctgttcacattctttgcccagtttttaattcagtagtttgtcttcttatttttgaattgttaagagttatttatagattctattatcaaatccttttcttggggaacttttgaaaaatccctaagcccatgactcatatttttccctgagcctgctgctcatattttttgtgatgtcttttgaagagcagaagatttttaattttggtgacatccaatttatcaatatttcgttttatggttagtacttaaaaaaatcctggctaagaaatctttgcctaccttaagttctcctatgttttcttctataatttatatagttctatctttcatgttaaagtatatgatcatgccacattacattttgggcctagtacatggggatcaaggttcattgctt

SEQ ID NO: 30848 - DNA, 1050 bp, Homo sapiens
tttcctgaagctaaatggaacaccacagccagagttttcagtcacatccgtcttggcatgggccatgttcttattatagtccagtgttttatttcttcaatggctaatatctataatgaaaagatactgaaggaagggaaccagctcactgaaagcatcttcatacagaacagcaaactctatttctttggcattctgtttaatgggctgactctgggccttcagaggagtaaccgtgatcagattaagaactgtggatttttttatggccacagtgcattttcagtagcccttatttttgtaactgcattccagggcctttcagtggctttcattctgaagttcctggataacatgttccatgtcttgatggcccaggttaccactgtcattatcacaacagtgtctgtcctggtctttgacttcaggccctccctggaatttttcttggaagccccatcagtccttctctctatatttatttataatgccagcaagcctcaagttccggaatacgcacctaggcaagaaaggatccgagatctaagtggcaatctttgggagcgttccagtggggtaagtttgtgagggtgttcctttttgcttgttcttcccaaatttaaagcatagttaattcaaggaaaaaaataaaatcagtactgatttgtcaaagaatgtattggatctctgacttttaaaaccgaatcaacaaacattccttttactcctgatgtttgcaagggctcataatcaatgctgtcaggtgtagagaaaaagtataagtcaatctcaaggaccttatgtgttacttcatagaatactatagaattatacacctggaagatacctcacaggttgtcttgtcctgtctgcatagttttacaagaaacaggcaaaatggtttacagataataaatgaaagaactggtacacctatgtctgactccaagtccctttctctttcttttccaccatagttagggaaaataagctcatttgtgagagaagttggcctttcgtattagtaagtcctgttgaatagaaagcctg

SEQ ID NO: 30849 - DNA, 1029 bp, Homo sapiens
ctattacatttaaagtaattgctgataaagagggacttacttttatcattttgctatttgttttacatatgtcttaaagctgttttcctctcgttttttgcattaatgtcttcttttgtgttaattttattgtggtgaaacatttaaatttctttctcatttcctcttggctactgtccttccttttcaacttacagaacttcctttagcacttcttacagggcaggtctagtggcaacaaactccctcagcttttgttcattggtgaatgcctatttctccctcacttttgaaggacagttttgccagatagagaattcgtggctagcaggtttttgttttgttttgttttgtttttcctttagcactttaaatatattagcccactgtcttctagtcttcagagtttctgatgacaaatctgctaataatcttattgggaatccctgtttataatgagttgcttttttcttgctgctctccaaattctctgtttgtctttgtctttcaacagtttagacacaatgtatctcggtaggggtctctttgggttcttgctacttggatttcattgagtttcttggatatttatactcatggcttttatcagatttgaaaagttttcagtcattattttttcaaatactctatgtggccctttctcttttccttttgaactcttataatgagtgtgtttgtctgcttgaagatgttccatgggtcccttggtctctgttcaattttctttagtctttctgttctcagactcaataattttcattgttgtgtgtttaggtttcctgattctttattccacctgctccaatctgtctctgagttcctctagtgaattttttatttcagtttttgtacctttcagctccagaaagtttcccaaaagggaggaaagagaaaaattgaagtggatggggagaaggaaaagggccccagccttttaaatcccctagaagtcacttcaatccaagagaaagtggcttagaacaatgagaggaagtgtaacaccattag

SEQ ID NO: 30850 - DNA, 1028 bp, Homo sapiens
attcacttctgaattttaagaatcagctcattttatatttaaaaacataggtaatttcaaaagtcagaactcaagtggtgcaattttccataatcacagagtgcagtgttattgggattcaaggggaaactggggtaagtggtattttgtgtatctacaaaaatgaatattaatatggccttcaattgttaaaatttactaattagtatttctctagaattagtacttacagagctgactgacatttgtgtgaacatcaattttaattaaaaaacaatcgtgaaggttatttggcctcttaatttatccttttctctggaattgtttcttgctccttcctctttctgccaaaagccagagacagtaagcagtgacatcctgaacaggtcattccaatgctcatcacagtcccacttgggtggaaatgtggagtcagctcgcctcctccccactctagtcaaaggacactgcatctggtttaaggagaggagagaagagtagagggatgtggcagaatggtgacatggttggcattttaggaagggaaatcttttgtaatcaaagaataaacctcagttgagttgacactatctattctggaacaaattcaccaaactcttttccaccccaaaacatgttacgaaaacaatgatctcatttgaaggggcagagaatggttagatgaagacttcatcagacaaggttactgaaaaggaaaaaaaaaataaatcaacatctgagttttgtaagtgccttaaaaaaagttgctgagaggaaaaccaataactctctcctctctactcttcctctagctctaattcaaacatcacacaaaatccacactcttattttgagatttcgttttcttctatagtcttgttcctcttccccttcctgaagtttttaatattttgaaaacttttccgtcatatgacattcattttcacaccttcgacagcttatgtatttctgagtccttttagtgagcccaggtctcccagacaagcctcacttcaggataaagtggg

SEQ ID NO: 30851 - DNA, 1072 bp, Homo sapiens
ccaagggctgagattctctttgagaagaaggtcccctcccattctctatgcattttttatttgtataaatttaaagggtacaagcgaaatttcgttacatgcatgtattgcacagtggtgaagtcatggcttttactggatttgttatctgaaaaatgtactttgtaccaattaagtaatttctcataatctccccaccttctgtgcccccacccttccaagtctctagtgtctatcattccacactctttgcccatgtgtacacattatatagctcccacttataagtgaaaacatgcagtatttgactttctgtttctgagttgtttcacttaaggcaatggcctccagttccatccatgtcaccgcagaacacattatttcattcttttttatggctgaatagtattccattgtgtttatataccacattttctttatcctattatccattgacaggacacttaggttgattccatatctttgctgttggccacacatttttttagatgtggttactacagcaacacacttgtcaggtcagccttgggaagacagcaataacttctgtcaggatacagaaacaaatttatcttcttagtagctggccagataatttcctaagggagaaagggctttgatagcaatgaggtgggtaaaagacatagccttggtcttaagtgaagaaggaaagtagacggaagactgggaccaagcactgcagaggaaatgtgaagagtgatgggagtctggctggagaagtgggggaagtcgggggaggcttagagaaataggtagctgcaggaggtgggggactgagcagagcattgggagatgtgactctttcctatgaatctccagatcaccactaaaattaccaaaaaatctttgctgcaaaaactggtgaagggccttgggtattaaggttggcctggggcagaaacagagtcacctgcacaaataagggaaagggtcaggtctaggctgaattacttgacacaggcagttaagtattatacacagagtcaggatgcagttgcaggacaggtatggagccagagctaaagtattt

SEQ ID NO: 30852 - DNA, 1050 bp, Homo sapiens
tttcatagtaattaaatgagatgatagtatataatgtggctaactccagagcctgaacacacagaggcactaaataagtaactgtcatggagtagtctattatgaaatgggtcacaggacaaataggttttaatgaatgtaataactagccaattagctaggcactgttctaagtgctttacaaatgcagactcaggccgggtgcagtgactcatgcttgtaatcccagcactttgggaggccaaggcagtaggatcacttgaacccaggaggttgaagctgcagtgagctatgattgtaccactacactccagcctgagtgacggagcaaggccctgtctcttaaacaaaaaaaatgtaggctcattcagtcctcacaaaaacctttgaagtaggtgctattatttctatttaatagatggggaaattaggataaagagagattaatttgcccaatatttgggcttgtattagttaaaagtttttttattattattattattctatagcttcataaacaactctgaaatctcagtgacttaacacagtacaagttttcttccttgcccaagtcacaggccaattagacattcagtgaaggccatcatgtagggattcggagttagtctgaatcaccaaaggtggtaactaccaacttttaggttctcagaatcctcttgtggaccctctgcatccaggctggagaaagaataaggaagagcttaaagcaatctttctcaacctcagtatttgtatggttaattttatgtgtcaatttggctgggttaagggatgcccaaatagctggtaaaatattatttctggggatgtgtatgagagtatttctggaagggattggaatttgaataaacagactgagtaaggaagatctgccctcagcaatgagggtggcaacatccaactcattgagggcctaaataatacaatagagaaaggacaaattctctctcttcttcagctggaacatccatcttctcctgcccttaggcatgagagctcctggttctccggtcttccaactctgggact

SEQ ID NO: 30853 - DNA, 1034 bp, Homo sapiens
tggtgagcacaagaaaaatcagtaacatcaaagttaaatacctgtctctaaggttgttatttcagacaaccataaatgtggaaagtttgtggttctttcattaaaggtaactaatacggcattcaagtggagctagctggacatgttttatttagataattacatgttttgtttagagaattacagtcagtgagatccacagatctttaaaaaatctataattttgccagttgagccatcccatgtaagtaaaaaaaaatgcctagtgataagatgtttagaaatattcatttctagtttaaaaagtagtgtggcatataatttttaaaaagctttattttcctttggacatttatcatgaaaaagttttattgcaaattggtgacattgtcaaatatagcctttggatattttccttccttcctgtttagtcacacatacaaccccagagagttcagtggtaaactttcctcatagattttatttctgtatattcaatccaattctcaggtgtaaatgtagaagtcgactcctttctgtccatcttttaaagtaaaaattaagccctgcatcctacaagcatctgccaacatagattctcatgcatctcgtaagccaacacaatgtttccacaactgatcagggtttactaagaggtacttattctgccgaagtatctgtcactactcacctgtaacaaaggtgagtgtcagagatctcatcactatagcataagcagaatcagttgcagaggggcaaaactttatgtggatgaagtttgtttttgctacaccctgcaattaatatctctcctctcctgttttggtgtcacctgtctcttatgtggtactttaacccttatatttgacagtcaaataatgatcacataaccagatgcagaaagaagcaggactttaacgcagacctgaaaggtcattaaatccacgctccttccagcactccaccttagcaaaggttcagaggtaagcaagagtatggcttgtttggagaactagagactgggacattcaggg

SEQ ID NO: 30854 - DNA, 1049 bp, Homo sapiens
catttgctaaatacagaatcctttccccattgcttgtttttgtcaggtttgttgaagatcagatggttgtagatgtgtggttttatctctgagttctctattttgttccattggtctctgtgcctgtttttgtaccagtaccatgttgttttggttactgtagctttgtagtatagtttcaagttgggtagcatgatgctaccagctttattctttttgtttaggattgtcctggctatatgagctttttttaggttccatatgaattttaaaatagtcttttctaattcttgaagaatgtcaatggtagtttaatgggaatggcattgaatgtataaattgctttggggcagtatggccattttcacaatgttgattctttctatccatgagcatggactgtttttccatctacttgtgccctctctgatttccttgagcagttctccttgaagaggcccttcacttccttgttagctatattcctaggtattttattatttttgtggcaattgtgaatgggagttcattcataatttgattctctgcttgtctgttgttggtgtgtaggaatgtttatgactcctgcacattgattttgtatatttaaattttgctgaagttccttataagtttaagaagctcttgggctgagtcaatggggttttctagatataggatcatgtcatctgcaaacaaagataatttgacttcctctcttactatttgaatacgctttatttttctctcttgcctgattgctctggccagaacttccaatattatgttgaataagagtggtgagagagggcacccttgtcttgtgccagttaaggggaacgcttccaccttttgcccattcagtatgttattggctatgggtttgtcgtaaatggctcttattattttgaggtatgttccttcaatacctagtttattgagagtttttgacataaagagatgttgaattttattgaaggtcttttctgcatcttttgagataatcatgtggtttttgtctttagttctgtttaggtgatgaattacat

SEQ ID NO: 30855 - DNA, 1035 bp, Homo sapiens
cttcatgctaaaaactctcaataaactaggtattaatggaacgtatctcaaaataataaaagctatttatgacaaacccacagccaatatcatactgaatgggaaaaagctgggagcattccctttgaaaaccagcacaagacaaggatgccctctctcatcactcctattcaacatagtattggaagttcgggccaggacaatcaggcaagagaaagaaataaaccgtattcaaataggaagagaggaagtctaattgtctccatttgcagatgacatgattgtctatttagaaaactcccatcgtcccagccgaaaatctccttaagctgataagcaacttcagcaaagtcttaggatacaaaatcaatgtgcaaaaatcacaagcattcctatacatcaataatagacaaacacagagccaaatcatgagtgaactcctattcacaattgctacaaagagaataaaatacctaggaatacaacttacaagggatgtgaaggacctcttcaaggagaactataaacgactgctcaaggaaataagagaggacacaaacatatggaaaaagattccacgctcatggataggaagaatcaatagcatgaaaatggccatactgcccaaagtaatttatagattcaatgctatctccctcaggctaccattgactttcttcacagaattggaaaaaagctactttaaatttcatatggaaccaaaaaagagcccatacaacgaagacaatcctaagcaaaaagaacaaagctggagtcatcacgctacctgaattcaaactatactataaggctacagtaaccaaaacagcatggtactggtactaaaacagatatatagaccaatggaacagaacagaggcctcagaaataatgcctcacatctacaaccatctgatttttgacaaacctgacaaaaacaagcaatggggaaaggattccctatttaataaatggtgctaggaaaactggccagccatatgcagaaaactgaaacgggacccctttcctacacct

SEQ ID NO: 30856 - DNA, 1074 bp, Homo sapiens
aaagcaaaatagaagatatagtgaaatttttggaatcatgaaggaaatggatcagataatattgatcatcagattttagaatactacaagacgcggctgggggaagagaagaaagctagaacacattaaaagatgttctgctttcatatatgaaatcataagaatttgtaaatttttttaagttgatgaattcagatgttatatctgaggaaaggaagaaaattatttctcttttcttttcacagtgctgtgaccttttctggaatccacctgttgagatgctttatagccagtgtaacaggaagtcttgactaatggttcccggtttagctgaagattcaaaaaaaaaaaaaaaagctttatgctaactggagttaaatacctagaagaatttcaacattgttttaaatgttgtgcatctgtaacttcaggaggatcacttgagctttaaaacctgtgccttctcgaaacaagaatttgtgcctgaggtgaaaaaagtttgtaagttattgaattatggtgttcattagaacagctactagctgattcccctattttaacaaactgacaagagcacatccataaaatgaaaacctgttacaactatgtacagaagggtttgacgttttattgggcttttgtcttttaaagaatatgtctactatgggtattttttttttaaatgttaaaatgggctaggtaaaagggggctgcttttctgttaagcatcgataggtaagttgatggataaaagttactatgtaagcctatttttttgagtccttatttgaatattgaaaacattcttgataaaatgtgttagtccatgttggaaacaaccgaaagaacagaattcaagttctagttctgatgtttattatatatgttggatcttgggcaacttacttgatttctcggaaattcatttgttactgtaaacgtgaaagctattaagattcaaatgaatggttttacagcaggtaacatgtgagaagacagctacatatttgtaaagccaaaccaacaaagaaatatagcaaaattcacaggtagatttattacaagaaatgtcct

SEQ ID NO: 30857 - DNA, 1035 bp, Homo sapiens
gccgggaaggagtgcggctgcagctctgaggtggggtagagggttgtctcctcccccagtagggaccaaactgaaaatcgactccttcgggaaggccaggagctagaagctcactgttaaccctttacagctggtttcagtggagccaaagccctctggtctgatctggtattaagaggatgttgggacccttggatggccaacggctgttctacttctcagtgatctgagtccctggaagctgctggccttgttaaagcagtcattggtggcttctcaggctttgatgtccaaacgcttaaatttgcgcatgcttggaaaacatcccacctctgctagcatctaccttagggccatcctatccctgcccctagaagcaattgttcctggccccagtcagcagcagccactatggctcagggacctgtttgtcacctttgctactgtagaggccgccttggcccccaaagtagatgttctttgcaatggcggcctcctctttcatctttatttctgtgcaaagaagagaaaatgaagaatctgaaaatccagaaaatatctggggaaatctgagagaagctttttgggaaaaatgttttcttccttaaaatgtattaagatatttaatttgtgtgagaaaaaatatgtattttagctttaaaaattataagaatttctttgaaatgatacagtaaggaacatctttatgcaaagtgttcaatttcaaacaccgtatccagtacagaacatttctggcagatattccttaccaaaatgaccccaaaatccacggcagagacacctgcactgggattctcaacgctggctgcacattactatttccaggaaggagtggtgaaaatattgatgtcaagctcccatctccccagagattctaacttcatttgcttgaggtgctgcccaggcattgttatattttaaagtatccccagatgattctcctgtgcagtcagaattgggagctacacatttaatgttatcagagaacagaaggaaaatgagagaacctaggtt

SEQ ID NO: 30858 - DNA, 1007 bp, Homo sapiens
attttctcaaaaaataaatactctgaggctacagtttctcaggattggtcttaaccccagagtgtgttttgttgttgttgtttttggaaagtttcaaaaacatctgtttggaagagattatttcagtggagaacatgtgtgtcagcagttaaatgtttcagacccattttctttctttttttgtgtgtgtccaaataaccctttaaactgtcaagtacctaggcctcaatgaggtgtcaaatgattttgatatttttttcttgatttctctgctttgtctcagaaaatgactaaggaaaataagaaggatcttagatatattttgcattgccaagaaaaataataggccttactgttgccttcacccaactttgaaattgtactttgttcatttcacaatgggacaacgttacactgcaattaggttctccagcttaagcgttacttgccttttttcccgaaacattaaaataaagttctcaggtaactgaaatctctagaattatctttctaaaccaaactcactaggtaacttggttcaaaaagtaactcactttccccagatactaaataaaatgcatcattttatgtatttataattttatttatttatttataatcatcatccagtgaccaagccccccaaccttccccaaacatagccatattttttggtcatagttctgcttttacatgaatgagaccccacgcatcctgttttggggtccttaaaatggtacttcttacaactgtgttgtggggcttaatgggttaactcctttctccctctctggatacctgcaccttctcactccctctcactcccaattcttttctccttgttgtttttgaaagcaggatggtggctggcagcagcaacaggatctgtttccattttgaaccttataaattaccgagggtgcagaagtaacaggaattgtttggctggtcctcgttaagcaggagagggtctgggctgaatttcctcagtaaaatatttgttgctg

SEQ ID NO: 30859 - DNA, 1073 bp, Homo sapiens
caaaggacataatctcattctcttttatggctgtgtagtattccatggtgcatatataccacattttctttatccaatctatcattgattgacatttaggttgattctatgtctttgctattgtgaatggtgctgcagtgaacatatgcatgcagatgtctttataatagaatgatttacattcctttgggcatatacccagtaatgtgattactggttcgaatggtatttctgttttgaggttcaaagtaccttttaaatctcccaatctcttcccacttaacaaagaagaaaactgagagtaagtgatataaattacttgcccaaaatcatgtactagtttgaagcatagccaggaatgtaactcaagttcccaagggtatttcctcaagatagttgtactaaatcacaagatgtgcccacgagagcacatcagctatgcttatcaacaacaaaaataatttttaaatatcatattttcacagtcgtgtcttttgatcatgcaatttaagactatgtctgactcccttacaattactgaaaactgaaacaagattttttattatcgttttcccccaacgaattgtccagccatctgtttgtctgtgtaccaggcaagctgggttgatactaagtaaaactataaagttgtcaaattttctttagtgtttcaaagagccacagcctcccatgaaccatggtcttactctgactccctgtggatcccgggggtaaagttttaggggtgtgtgtgtgtgtgtgtgtgtgtgtgtgtagtgtgtgtgttttattttcatcaatgctgggttccttctttgtgtcaggaacagggcatcttggagacccgagcagttggcctgtctgttacttcagggaagtgttattcctgagaactggtatttctgggtccccactaagccaccatgaagataagccatgacaaacaggactaaccgactgtttctgtccctctagatttaactgcccttttgtgaacaacgtgactcacacctatcttaaataaacgcctacctggagcatatgttatgggccaaaaagttaacatttgagtg

SEQ ID NO: 30860 - DNA, 1030 bp, Homo sapiens
aatcccagcactttgggaggccgatgcaggcggattgcttgagcccaggaattgaagggcaacatggcaaaaccatgtctgtacaaaaaaaaaaaaaaaaaaaattagccaggcgtggtggcacacacatctagttcccgctattcgggaggctgaggtgggaggattgcttgagcctgggaggcagaggttgcagtgagctgagatcgtgccactgcagaccctgggtgacagagccagaccctgtctcagaaaaatatatatgtaataataatatgtgctattatttgctcagtcaattaggtgcaatatataatagttttacttggctcagttgttttaacattcatttactcatccaacaatatttttaattcagttgaatgggtaatacatgtacaaatatggtaaaatttatatattcatacaagtgtgttttctctcccctcatccttattcttttcttcccccatatatttatccacaaatggtagcacctcttcgtattattctggaccttacatttttcgcttgagtattacgttggagatcttttcacattgatacagttaaaactgcctcattctttttaatgatagtttagtattcaattgtattaatataccctcatcatcatatgtaacatttattgagagcttactcctgatccaaatgctttcttaatactttagttttattaactcatggaagcctcataacaacctatgagataggcactatttttctatatttaacaaatgaggaaaactaggcacgggatgattaaatgtccaacagtcacacagtttataagtggtagggctcaggattagagcccagggagtcactttccagagattgctgccataataccgctaaacatgtagcctgtcatagtattacaaggtatttaaccagcctccatattaatggacattccaatcttttgcttaagaaacagtgctatagttaatattttgttaatagaacattttgtacatctacaataaattcctagaaatggactagc

SEQ ID NO: 30861 - DNA, 1010 bp, Homo sapiens
atgtacaatataaaaatatttatttttcaaagtcctttcttgttgtgttggttaattgagtgtgccaataaaggcaacaaggactcagatgtcttttgtctttctattttgtcatccttagcaaggtgggctgcctgcttagctccctcaaggtcctaatatggctgccgcagttccagatgtcccaggcagatgaccaaatcccaaaggagagtattgtttctcatagcctgtatctttttttttttttttttttttgagatggagtctcactctgttgcccaggctggagtgcagtggcgcaatctcggctcagtgcaacctctgccttccacgttcaagtgattctcctgcctcagcctcccaagtagctggaactacagacgcacgtcaccatgcctggctaatttttgtatttttagtagagatgggatttcgccacgttggccaggctggtctcaaactcctgacctcatgtgatccacccaccttggcctcccaaagtgctgggattacagccaccgtgcccagctgcctgcatcttttaaaagaacaaagaaattatttccagaaggtctccaacagattttgccttaattcttatggttagaacatcatttattatgtgcttatttccaaagcagtcgagggaactggaattacaataataggcttaacaaattttgaacaaagttggcttttggttggcaaggaaaaatcaggaaactaaatatacatagtgaaataaatctgccacataagccattctaataggattgctaggtaggtggattgaaggagatgaatagagagtgtcacaaaatgactagcactatactctaaaagtatgatcaggtaatgttatttgttggaattccacctgttctataactttctgaccaaacataaaaatattaaacagatttaagatacctttctctaaaaagattaacagtgtgtgaaaataagtaattggttataatccattagattcttctgaatctttttta

SEQ ID NO: 30862 - DNA, 1156 bp, Homo sapiens
ttgtatttttagtagagatggggtttcaccatcttggccaggctggtcttgaactcctgacctcacgatccacctgccccggcctcccaagatagcatattttaggtactgttatacaccttgctttttttcacttaaaagtatgtgtattctagaagataaatagatatgtgataaatatagtaaaatgttaaatatagaacctagcttgtagagactgggagtccactgtaaaattctttcaactttgttgttgttctgaaaattttcataatcaaaattggaaatgaaaatacatagtttagagagatttctagaggaattcatgataactctggttcttttttttacagccatataacaattccatcatataaatgtaccattatttacttatcaatgtcttaatgatagaagttttggtttctagtttttggttgttataaacagtgctacattgtaagtatagtaagaattcacagaagttggattcctaggtcacgacttacccattttgaattttgataaatattgctaaattgctctcaggaaaagttgtactgattttactcctgtcaacaaatgtgtagaataaagtggactcattatgcttatttatatattttattcttatttgtatgttttcaaaataactttattcttaagattttaggttttgtccaagtactaatacccttattaggggactgatattcctcagcagcatatgtgaagcaatgtattaatgagggagttttgcttctgtttttagccctgtggttcccaaactttgcagagtcattctgagaagctgcagcaaactcatgtggtgccaggatatttaaaatttttgaggcaaacacaggaatgttagacatattgtcagacaccacatgaactagtagcttgagataataaacagtttcattatgttgctgtactatatttttgtcaatgatgtcatatctttgcaaagctgagtttttggcagttgctaagctacaaaagcaggtatcatgtgacaatcaaaatggaacaagtttccaatctgattgcaagattggaaaattatatagttccccaagggcatatacattcatgagaattatggatatttaggactgaaattaatattattttttctttcaacttatgc

SEQ ID NO: 30863 - DNA, 1062 bp, Homo sapiens
aactagcatctttcttgtgtgtatgaaccatttaaaaactgccttgtgttcattttccttttggatgatagttgtttttcatactgatttctagaaactctttttggttttttgttgtttttttttgtttgtttgttggttttgagacaaagtctcactcagtcacccaggctggaatgcagtggtgcgatcttggctcactgcagcctctgcctcctggattcaagcagttctacaacctcagcctcccgagtagctgggattacaggcatgcaccaccaccacacctggctaatttttgtatttttagtagagatggggtttcaccatgttggccaggctggtctcgaactcctgacctcgggggatctgcccaccttggcctcccaaagtgctgggattacaggcttgagccaccgcgcctggccagaaactctttgattaatgaataaattcgtcctttatctgtcatgagttgcaaatatgtcccagcttgtttatctcttgattttgtctgaggcatatttttcttgtaggcactgatacctgtaggtctgtcagagaattctcacttactcatatgtatctgtcttttctgccatttctttctaatatcacaagtatctgtgacatttcatcacagatttaaaacacagcatgcttgtataagaaagaatctgttcttattagattggaatatgtggtaattattgtgttgttgaagccttaatattgataagtaatgtttcctaaagactttcttcatgagaccattttatggatgcctgaacagtcagtattttttattctgaaagatgcaatatgataaataggaaagtactgaattttccactaattatgttaattttacttatataaacctctgtttctttaccagtaaaataaaaaaaccaaggcattataaaagttccaaaatcttttggaacttttataatataactatatatttttcctaatatcttagtgtttcatagcgctttgtactttttagatgacatttatttaattcacttcatctgccatatatacaagtatataggg

SEQ ID NO: 30864 - DNA, 1071 bp, Homo sapiens
taggcagaatgactggggaaaactacatgaagagtgtgaatatgagtaagttttaggtgaagaacatgaggatgagagcatgcaaaggcactgaagcaaacttgagttgtttaggggatagtgaggagaccactgcaacttcagaaatcttttaggaaaacgagtctgtcactacgcttaatttgattaatggacctattgggaggtagactatgtagcagtaggaagaagtacaatactccagcaaatgggaagaactctgtagcaatcatactgatagataccccaaagaatcaggtattttgtatttaacgttttatttgggcatcagtataaacaaaactatattaagtgtcactgtaaattttgggcataaaaaacagaaattttcaaatctgattagaaaaattaatctgattttgaaaattaactttgtttacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccctgaattgagtggtatggtctcatttctacagtgaagtctgatgctttgttagcacagaatccgtacatgtccaataggtcgcttttgtaactgagataagaccaagaggataaacaggacaatataagaagaaacctctatgtcattactgattttaaaggttctgttttcaggcatataacatttccaggtttgtgtactgtaaagattataatgtcttcatttatttagcatgcaaatttaatagtcaaacttt

SEQ ID NO: 30865 - DNA, 1048 bp, Homo sapiens
aacatgaattttcccatactatgtaatacttctgatttagcatttttaagttttcataattctatttatctccctttccttaacatggtgaggacaatgttagatctccatagctgggtaatattgatatttaggaagatttgttagccaggttctgctttttatacttagtcttgtccttaaactgacgatatgattccactttgcgaagagtagagaatataagactgcattcctcagggtgcaagtttttaattccctaaaattgaaaaataagagaacttcttaataactggaatttacattttccctatttaaaaccttgtcttggctgggcgcagtggctcatgcctgtaatcccaacactttgggaggctgaggtgggtggatcatgaggtcaggagttcaagaccagcctggccaacatggtgaaaccccatctctactcaaaatacacaaattagctgggcatggtggcatgtgcctgtaatcccagctacttgagaggctgaggcaggagaattgcttaaccgggacccgggaggcagaggttgcagtgagccaagatcgcgccattgcactttagcctgaactacagagcaagactccgtctcaaaaaaaataaagctttcatgtttattatgtaagttatatcaagaactcttaaaaatgtgtttgcttttttatttctctatgctgttttgaggataaatagctgcgttggagaatcaaatcatcaagcatttatacttgcccttttgatcttcttgctcacctcggtgtatgggatcacactgaccttggacaccatttgtagagacagaagtgtcttcacagctcttttctattgtcctggagtttatgcaaattacaggtgagcagtgggtaccacagtatggaggccccctgggaagtaatgggtgttgccattgacagggactattactacttggttaggagttctcaatcaaaacataggccaggctatggaaatgctgggtatccctggaattgccagcaaaattgtgcattggtgatgtgtgttttt

SEQ ID NO: 30866 - DNA, 1051 bp, Homo sapiens
aaaccacaaccctcaacgcaaaaatgatggaaaattgcgtgcagaatgtgccaaagttacaggcattgaggcctcagtgcgtagacatattttaaaagcctgctggtaacctgacctccaacagcagcaataacaacaaagaaccagtcttgaatatcagttgagaaaaaataccctaacatcaggttctggaaacatggtatggaagactgtttaagtgagtgtctgtgctgtcacagggaagcatgcaatggccttttaggatttattagtgtccaccacagctgaacactaggggcatcaaggtaagccaggtaccgtctgccccgggagaggctgaaacaggtgaccagagtttccatacagtgggaaggtacagcagtggagagcagcacagaggactacccagtctggtggtgaggagcagacctttttgaagatgatgtctgaactgaatttttgtcaggcaaagaaaaggctttcctagaggagagcacatcttgagtaaaggcaacgaagcgagaatagcatgccgtggtgtgtgtgtggagttacagtgttgaaacgaagtgcagagtagttaagcttatattttcacaactataggcagagatgggatttgttctggcctcttgaccatctgagggagtcccagaatgcacatcagtcctcattaattttatggctgttggttaatatttttgataatgctgatttttgttggtggaggtactgctttaaaaaaaggcatggctgggtgcggtgggtcacacctgtaatcccagcactttgggaggttgaggcgggtgactcatttgaggtcaggagttcaagactagcctggccaacatggtgaaaccccatctctactaaaaatacaaaaattagcccggcatggtggcaggcacctgtaatcccagctacttgggaggctgaggcacgagaatcacttgaacctgggaggtggaggttgcagtgagccgagatcaagccatggcattccagcctgggtaacagagtgagactcttgtctcaaaaaaagaaaaaaaga

SEQ ID NO: 30867 - DNA, 1061 bp, Homo sapiens
ttctataaagaaataaatacaaattgatgtaagagcatagaggagtgagtgatcgattatgtccaggaggtttggagatcagattaatatgtgaactcagtgtctcaatggacacgtagtattttgccaggcaaagaagtagaagttccagcacctagaaataataaatacttgaggtgatggatacttaaatactctgacatgattattacacttgccctatatgtaagatgtctcacatgtaccccataacattatacaaatatgtatcaataaaaaaaagaaaaagaaatacggaactgtcagtcaaaaggaacagtgtgatcaaagtctgtggtatattcaggaacagcaagggttaggtaggggtggggcaggtgggataggggagagcagaagatgttagaaaagtataacaaagaattcttggtgggtagctcaaaagttgtcttatatgaccactgaaggattatctgtaagctataagatcctattacccaccatgtctggatattgaattgtcaccatctctgcagttgtaaagaagaattattgctttatcattttaattattttatttttatttgcattttactcttgctaattcctcatcattttgctccatggcagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggtaaggctgtgccactaaccactcctttctcttgacactcttgcctcccttacattctgtgataccaccttttctgttcttcctcctactgctgtgctcctcacttctttgtctattttactctctatttttattttctttttgaaccttaagtattattgttctctaggtttctatcttaggtttctcttttcatccctttctatatgttgtccctg

SEQ ID NO: 30868 - DNA, 1013 bp, Homo sapiens
tgagcaatctttgtttattttacccactccctggtaaaaagtgataccgagcttccaagctgacaaagaaaagaaggggcgacgattgtgccaaaaagggctgcagccacgtgcagcctgttcgctgcaccatctgcgcccaatgcctgcccaaggacaaggctattaagaagttcctcatccaaaacacagtagaggccaccgctgtcagggacatttctgaagcaagcgtcttcaccgcctatatacttccgaagttgtatgtaaagctacattattgtgtgagttgtgccattcacagcaaggtagtcaggaattgatctcgtgaagcctgcaaggaccaaacactcccaccctgatttacatgtgcaggtgttgccctacggcctccaccaaagcccttgtaaggagttgagtccttaagggctgaagaaaaactgttctctctagaaaaataaaatggaaattatacttaaaaaaaaattaaaaggtgatattgcttgctctggccccatggctctcagtgatggcaacacattagaattacctgacagctttaagaaaaaaatgctgttgctcagacccctctaagaacaatgaaatcagaatcttttttagaacatgtggatacttaggcaggttgtaatctctgctcagattacagaccattttcccctggataagcggccttagccattcagaacgcaccttctgaatgtttggtaagaaccgtcagcctttttattcctaaaatttttttcctagttcttaccgcacttgaaaaatacacattaacatatatatatgacatatctttcatatataatgtatatatttgatttgaggcatgacagagggaaggttcataacaaataagtgcccattacaaatatgactttaagcttgatgagagtaagccctggtatttcaaagaacaaggataaggcaacgggaacttttagatgtgactcttctacatttctgaggctaaatgattctctttctttatctat

SEQ ID NO: 30869 - DNA, 1047 bp, Homo sapiens
cctcattcttaagatgatcagtgttagtgaagcatacagttcaagaaacaagtttgcttctctctcattaatctgctcagttcacgaccttctcccctggggctcactctcaggcacatgcggccgttctctgtatccattagcacttaagagcctccaccagtggtatcccaaggagcaggtggcaagaaagctgctcatccagtaaataaaactttgatcaggtgattccactgatgtgtgctttatgcagttaaactgaggatttaaatgattttaaatgagttgttgttgcctaggaatgtgctggggattgactgagatctttctgtcctccatcagcagccccatggagtgagtgatgtctccccctacaaatctcctaataacaaagctttctccacagacagtagaaaggatgaaccacataagcctttatcaattacacaaagcacagcagcttcatcaatgggacaaaacccttctgtacagtttctatgtacaagatgaatagggccagctctaagaccaaggtcacatggggatgtcttgcaggtttgttttctatgttcacagcatttgaatctttttctctactcagcaccacccttcctcagccacaaccactcccaccccaaacacacacacccagaggcaccctgtgggagtccctcttaagctctccccactggctcattcgctactgatgacttgtggacccagacactttcatcactctcaaccagtcttttatgtgtgagtcagataggctcttacctttcctaaagaaatttcaggcaacagctagagaagagtgagtcctctcacttcccctttcgttgacgaaccacgagaggttgtcccttctgaccctaaagggactccttatttttttctttttgtggcaagtcttttcttctagattacctcccctccctcttcccacacacacacacacacaaaagcctatttctttgaagggaagaacttcagggttggccctgatgaggaagctgaaggtctagtcccaaagctgccagtattgga

SEQ ID NO: 30870 - DNA, 1052 bp, Homo sapiens
gtggcttgtgcctataatcccagcacttcgggaagtcaatgcacgcagatcgcttgagctcaggagttcaagacgagcctaggccacatggcaaaacctcatctctacaaaaaatacaaacattagctgagtgtggtggcatgtgtttgtagtcctagctacttgggaggctgaagtgagtggatcacctgagcccaggaggtcaaggctgcagtaagcctgagccgtgattatgccactgcactccagccagggtgatagagcaagacctgtctcaaataaataataataaagaacaataaaaaagaaagattatttaatatctcactaccctgaggaaatcagttaccctttggctatcagatatcggaggaaataaggttgtagaggaaaaaatcgttaaggtattttaaacagacatttgtttcattatttggaactcaataatagagactttaagtacaaattgtgagtctaggagaatttttgatttccacagatgagaaataaaataagaatatagacattgttggactttgaaagcttacccaatgtttaatagtttgctgaacaattgccaaatgaaatgaaatgctttcaaagtttctgaaaggcacaattctcttcttcctgagctcagaacattttggtcataatcatgagcttagaaatgttctgaagggagtacaggaccttcattagcaataaaataatatatatttccaatgacactgaaagttccctatcctagctacatatacaactaaggaaaacagagagggacaaaatacgaatagaatgcagtattccaaaacacaatcctgaatgaaatgcacacagtcgtatgatatctcaaagattcccatatagttagaaataatatctttctacgtctagatacttttttttttttttttgagagagagaatctcactctgtcacccagtctggagtgcagtggtgtgatctcggctcactgcaacctctgcctcccgggttcaagccattctcttgcctcagcctgctgagtagctgggactacaggcgcccgc

SEQ ID NO: 30871 - DNA, 1043 bp, Homo sapiens
tacctcattcacaaagcctccatgagtataggagctcacactaaagcaatagttaacatttataactttatagagtgctaactcgtttgttacatcattagatctgtacatcagttcttttgtgagaatattaaagctcagagaatttttaactttttattttgaaattatagcaggcttgaaagttgcaaaactagtacaaagatttcctatatacctttcatccggattctccattgttaacattttaccatgtttgttttatcattctccctctgtataatatgtactaatttgttctgagctacttgacagtaggttatagacatgatgaatacttcagtgtgttatttcctaaaaacaaggaaattctcttatacaaccacaattataatatcaagatcaggaaattaacacagatatagtactattatcttatttaaagacctgtaaattttgctagttatcccacagtatcatttattttaaaaataaataaaaaaatgtatttttcagaagttaggcttgagttcttattaaaaaattaattaattaaatttttttttgtctggtccagaatctgaccctggatcacatgttgaatttgcctgttatgctgctttggtctcatttagtctggaagagtttctctgtttttgtctttcatggccttgactatgggtgatttattttgtagaatgtccctcaatttgggtttgtttgatggtttctcatgactgcattcagactatgttttttgacaggaataccctagaactgaaattaaattagaaacccatgatatctctgtccctttactggtgatgtttacttcagtgacttgcttaagatggcctctgccaactatacactgtaaaattactatgtttttccttggtaatttataagtattttgagtacttgttagttcctttgagactatgtaaatatcctgcttttcatcaaatttctactacttaaatgctattataaactataatatttctactatctaaaaactattctaaattcttagcatttat

SEQ ID NO: 30872 - DNA, 1065 bp, Homo sapiens
aggaggtcgaggctacagtgaggtgtgatcatgccacctcattccagcctgggcgacagagcgagaccctgtctcaaaaaaaaaaaaaaaactagaaaccaaggaatgatatggttctgctcttttttctctttccacttcttgtcctattaattatactcattaaatatatatggattctttcacttcttttttcccactgctactatcttatcgtccctgtttctaatcttgatgtgctctacctgtaacctagttacatttttgaaatatgaatatgattttgccacttttctgtttgaaattcttctatagtttcctgtcactttaatgtcaattcttgatctggcttccatgcgccactcttttgctttcactttacaatctcctcggatttcccaacatgttctttccttttgtgaatcagtccctcttcttgaatgcactttcccactaccacaattaattttgttcggctcctacttaaccttacctttcaaagtccagatcatttgtcagcctcagcttccctagagagttctccctagccattttctccctagccatgtttagttctatttagctgtctttcccttgtgttcacatacttcactgtttttttctttatctttgattttctgcagtttgaaaatgatatgcccaggtgtaattttgaggaacatttactgtgcttggtgttttctgaactttctggatctgtggtttgttgtctgacttaatttaggataaattctcagtgattgtttcaaagatttctttagctttctcttctccttctggtgttctagtacacttataccttttgtaattgtttcacagttcttggatattttattctgtgtttgtttgtttgtttgtttttggtggaggaggttcccatcttttttctctttgtctttcggtttgggaagtgtctgttgataatgtcttcaagctcagggattctttcctcagctgtgtccagtctactattcttcagttctgttacagtgggtttttaaatttgttttatcgctagcatttctttttgattctctcttcgaa

SEQ ID NO: 30873 - DNA, 1090 bp, Homo sapiens
aaaattagctgggcatggtggtgcacatctgtaatcccggctacttgggaggctgaggcaggaaaatggcgtgaacctgggaggcagagcttgcagtgagctgagatcgcgccactgcactccagcctgggctacagagtgagactccatctcaaaaaaaaaagttaagtataatttactgtgcaactcagcaattccatgtcttagaatctgcccaagataaatgaaaacatgtccacgcaaagacttatatataaatttttatagtggtgttattctcgacagcctcaaactgaacccataaattcatcaactagtgaatggataaataaaatatgatatgtccattcacttgaatattttcatcagtaaaaaactgatacatgctgcgacatgaataaaactcaaaaacattaagtgaaaaaagctagacacaaaagacttcatattgtataattctattcatatgaaatgtccagaataagcagatctgtagagttagaaagtacattagtggattgaggtgagattgggaaccaggagtaaccacaaatgggcgtgggggatctttttgtaatgatggaatcatttaaaaattggattttggtgatgattatatagcaatgcaactaaatttttttttttttttttgagacggaatcttgctctgtcgctcaggctggagtgcagtggtgcgatctcggctcgctgcaacctccaccttccgggttcaagggattctcctgcctcagcctcctgagtagctgggactacaggcatatgccaccatacccggctaatttttgtatttttagcagagacagggtttcaccatgttagccaggatggtctcaatctcctgacctcgtgatccgcccgcctcggcctcccaaagtgctgggatttcaggcatgaaccaccgtgccgggccactagatttttttactaaaaattattgaattgtacatttaggtgaattttgtgttatgtaaattatacctcaataaaactgttaaaaatatattaacacagaaggggaaaaaggcagtgcttttagataggaggaagcaaaattttctgtatttgtagg

SEQ ID NO: 30874 - DNA, 1043 bp, Homo sapiens
tgactactttagatacttcatatgagtggaatcatacactatttgtccttttgtgactagcttatttacttagcataataatgtccttgaagtttatctatgttgtaacctgttgaacggattgccctcttttttaaggctgcataatactccattgtatgtgtatgttacattttctttaaccatctgtcagtgaacatttatgttgcttccacttagcaaaaatagttattagtatgaggttacttaaattgtagctggaggaaatttaaggtgtatgaaggtcaaatacttctagtctgagaacacaagaaccaaactctcttcatcactataataattattatctaaatcagtttctcaatgggttgctattggcattgtgggtgagacagttacgccagactcttgaacttcaggatattttggtggtcccacccccaaaagccagtagcatccctccctcaaccagaaatgccctccacatttcctgtctcctagaggagctggtgccattctgaactagaaatttcatttttgagaaatctttggtgtggggctacttactagaacttgtcataaatatatatatttttcctctttgttttgatttatttctcattcctcataaaaacagccagtttctagatctgttgttttattatatatcagttaactttaggaggttgtagtgattgtttttgtctgttgttcagaccaaggaagagattacctcaatgtttttctttatttgacaaggacactttaattctcaaatgttcctgtacctaatagtgaacaagtggctctggtgttgctcacaccttagcagagaatctcacatgttgcaaggtctaatgactcgtttttcctaagctttccctctcctttcttctcagcactcctgtaggaggcctgctgatggcatttcagaagtactctggtgagactgttcaggaaagaaaacagaaggatcgaaaggcactccatgagctaaaactggaagagtggtaaggaacatgttgagcccagggaatcttggc

SEQ ID NO: 30875 - DNA, 1087 bp, Homo sapiens
agagacaaggtcattatataatggtaaagagatcaattcagcaagaggaaataacaactgtaaatatatatgcacccaacaccagagcatccatatatatatatatctaaacaaataatattagagctaaagggagagataaaccctaatgtaataatagctggggacttcaacaccacactcccagcactggacagatcatctagacagaaaatcaacaaagaaatatcagacttaaactgtactgtagatcaaatggatctagcagacatttacagaacatcacatccaacagctgcaaaatacacgtttttcttatcttgaagtgttcttcaggataaaccatatgttaggctacaaaacaagtctcaacaaatttttaaagatcaaaataacatcaaatattttttcagaccacagcagaataaaactagaaatcagtaacaggaaggactttggaaactgtgcaaatacacagaaattaaataatatgctctggaacaaccaataggtcaatgaaaaaattaagaaggaaatttaaaaatttcttgaaacaaatgaaaacagaaacacaacataccaaaacctatgggatacagcaaaagcatcactaacagggaagtttatagcaataaatgcctccatcaaaaagtagaaatgtttcaaataaacaacctaacactgcacctcagggaactcgaaaagcaagaacaaactaaacccaaaatcagaaggaaataaataaaaagatcagagcagagctaagtgaaatagagacttaaaaacaaacaaaaaaacacaaaagaagaactaaatgaaaagttggtttcttgaaaacaaaatcaagaaaccacaagttagaaaaaagacccaattaaggtaaaaaacaaaaaaggagacattacaactgataccacggacatagtcatatcattagagattattatgaaacaactgtatgccaagaaattggaaaagctacaggaaatggatacattcctgagcccctataatctatcgagattgagccaagaagtaatagaaaacttgaacagaccaataacaagtaacaagattgaactggtaa

SEQ ID NO: 30876 - DNA, 1035 bp, Homo sapiens
aacaaatctatatgatatttatatgatctacatattctaaaatataacatggggttaattactatttcattgtaatgtatgactctagaattaatcattttatagaccttatgattgcactaggtgttcaaaagatctcactatataaaagagaataatgaagtaccagccacttaggaggctgaggcaggaggatcgcttgagcccaggagtttgaggctgtaatgtgccattattgtgcctatgaatacccactgcactctagccttggcaacacagtaagacccagtctctaaaaaaagaaaataagagaaaaattgaaatacatagatttcattgaacctaaatagggctacatgtattttcttgttgttgttgttgtttttttcctggttcccatttaggtgtctaattatgaaatggccaatcaaatccttattttcttcgagatcagttttcatttaagtctgcctggattggatggcaggtcaagctttttaaactttaacccaacatagattctgtcagaagcaccactaggtctggtgaatttctggatctattctgtattgcctcctaatcccttggggtatgaatctctgagaagccctttcaccttcagccctggcctctacctcccacatgttgtgggaagtcagggacccctaacagagggaccggctagagccgaggcagaggaacataaattgtgaagatttcatggacatttatcagttcccaaaattaatacttttataatttcttatggctgtctttactttaatctcttaatcctgttatcttcgtaagctgagaatgtatgtcacctcaggaccactattgtacaaattgattgtagagcatgtgtgtttgaacaatatgaaatctgattgtaaaacatggatgtttgaacaatatgaaatcagtgcaccttgaaaacgaacagaataacagcaattttggggaacaagggaagacaaccaaaggtctgactgcctgcggggttgggcaaaatagagccatatttttcttctt

SEQ ID NO: 30877 - DNA, 1030 bp, Homo sapiens
attttgcaaattaatgttaaaacctattaatactctacggacagagaagcacaagctgcctgtgtggggaatagctgccgtcagcagcctgggtatatgattggagagaaagtcaagctgatctttggcaccaaaccattccacatctggtactaaaccctgagctgcagcccccaggcttgtgttgccactggagcccactcgtctagctttgtctttaactggcccatctgcattcccattagagttcgtgtattttgattatctggtgaatgatctacttaacagaaaggtagtccacattttcccagaaagtgtttgcattttgctttcaatatatggttttatgggataatatatttctaatgactaaaatgtgagtaagatgtttttgaataggagcattttcttactgtgtctttagttcctcggattactgtttcttcgcacactccctgggctttagacagtgggattgcaattaggtttggagtgtttcattctgtttgtcagttgtacggtgggttgtgccaaaatgcagtttttcttaccttttttatttatttatttttatctaatatagccaactggcagaatatattgtctttaatgtactttttttctgtctttacaggataggaaagaaaaacttatccaggaaggaaaattggatcgaacatttcacctctcatattaagtctggcaatgatgactatatgtattcctgcctaaataaatcatctattaatcattaagtagtagtttctctttcttagtattaccttgattcaatgttaaaaactattaacaccctaacaacacagaagcagacgcagcccgtgttgggaatctgctgtcagagtgacagcaaacatttgctgtacattgaatgaatgaacataaacttcattaaactgtgagctcttagaaagtacagattctacaatcagttgttcaacaagcgagtgttaactacgagccaggcattatgttatgtgcagagaatacaacagtcagtaagacagagcct

SEQ ID NO: 30878 - DNA, 1034 bp, Homo sapiens
catttaaaatattttataaaggcaatttgaactggctttgattcttttcaaagtgttgcataactaatatatttactgggtttgacattcaaaaggtacaacagtgtatgcaataaaggatctttcttctattcctgtcccctggacacttacttacttcccctcagcagagctaaacagtgtaattaatttgttttttctttatagacgttcattacatacatatataagcaaatataatatgtaacataattttctttcttatatgtacataagccaaatagaaaaccatatatttttacatatatcatatatagagagaatatcatatttttttgttaaacaaattagcaagacctttaaacaaattagcaaggtctttataatatattataaagagggaaaaaagcgagacaaaatatacatatatatttatatatattttattacacacaatatattgttaaacaaattagcaagatctttagaatatattataaagaaggaagaaagcaagacagaaaactgcataacatgctacataacaatgaaaataaataaactacagttaaatgcaacatggatgaaactcataaatacagtgctgagcaaaagaagccgaaagaaaacttcatatatattattccatttttgtatgcgtcaaaaaacaggcaaaattaatgctacatgttaatgtagcatgttatacagttttgtgtcttgcttttttccctctatagtatattctaaaggatcactctttatatagactttccctatttctttgtttgtttgtaaattttactgaatcatcaggaaactgtttaaatcttaagtgtacaccttgaaataactttgccgttgtgtaacaaacacctaaatcaagatacagaaaattactagattcatagaaactcccctatgttaccttccagtcacttacccccaggtatcctaatttccaactctatagattaattttgcctgtttttgacacatataaaaatggaataatatatatatagttctttgct

SEQ ID NO: 30879 - DNA, 1045 bp, Homo sapiens
acttggagattttattgtatctttcttttactgatttctagtttgattccattgtactcagagaaaatattttatataacttgagttattttaaaattgttgaggtttgtttttcaaccccaggatgtagctcatctttgtgtatgttctgtgtatgctagaaaaataatgtctattttgctgttgttgacagattattctgtaaaagttgattagattctatagggttatgattttcttgcattctatatccttactgattttctctttagttgttctaataattgctgagagagaggtattgaagtctcctacaagaatcatggatttctttttcctcctttcagttctgtcatgttttatttaatgtattttgcagcctgtttggtgcattcacatttagggttgctatatcttcttggtagagtgaccattttattattatttggtgtccctctctatctcataatttcctttactgtgaaattttcattatctaacataatatagtgtcttctttctagtgattcatgtttgcacgatatatctttgtctattcttatactttaaagttagctatgttaatatattcaaagtgtatttcttatagacaagcgtatagttgggtcatggtttttaattcattctgtcagtctatatattttaattaatgtttacattagatataattattgatatattagggcttaggttctccattttattttttgttttttggttgttctatttgttattgctctgcttttttccccttgcctttctgtggtttaattgaacactttttagaattccattttgacttattattagttaattttagtgtatttctttgtatcactttttaaagaggttgctataggtattttattatatacaaacaacttactggaatctactgctgctacaaattaccagtttgaatgaaatgcagagacttttcctttctttacttccctttacttctctcatttataataaattttattgtttttccctatatatattatgaaccacatcagactat

SEQ ID NO: 30880 - DNA, 1035 bp, Homo sapiens
catgttggtcaaagaataacataattacagttatgtagcaggaataaattgtaagatatctaatgtattacaaggtgattataggtaatgatatattgcactgttgaaaaatatagagtgtagatgttatgtgatcttatcacaaaatgataactatgtgagggaatgcttttaactataataagtttaaccattccacaatgtatatatatttcaaaatactgtgttatatgtgataaaaacatacaatgttatctgtcaatataaaagaaataaactttttaaagactgaaaaaataccgaaattgaaagaaaagtatgttaaacagcaatgcaatagcagaaggaagtgtgaaacttaggccagacatggtggcttacacctgtaatcccagcacttgtgaggccaagccaggcagatcacctgagattgggagtttgagactagcctgaccaacacggagaaaccctgtgtctactaaaaatacaaaattagctgggggtggttgcacatgcctgtaatcccagcgattcgggaggctgaggcaggagaatcacttgaactcgggaggcagaagttgcggtgagctgagattgtgccattgcactccagcttggtcaacaagagtgaaactctgtctcaaaaaaaaaaatgtgtaaaacttattgctaagggtaaatatacaaacaaattcagaatactgtagtgtgagatgatgatgggtacatcacttaattctattaggacagtgcaaaagtaattgcagtaaagtaattcaaaggatacaattagtaaaaataactctaactgaaaattatgttagaagatacaccatataagtagatgaaaattgtgacaacaatactataaagtatgtgttaggggaagagaagtttaagtgtagagttttggtatactattgaacttaaggtgttattgcttaaaatagagcattagattttatgtaagtcctaaggtaaccacacacacaaagaatgcctaagaagttacacaaaataaaaagaaatcaaagc

SEQ ID NO: 30881 - DNA, 1020 bp, Homo sapiens
gcaacaaaaggcaaaattgacaaatgggatctaattaaataaaagggcttctgcacatcaaaagaaactaccatcagagtggacaggcaacctacagaatgggagaaaatttttgcaatctatccatctgacaaagggctaatatctagaatctacaaggaacttaacaagtttacaagtaaaaaacaaccccatcaaaaagtgggcaaagggtatctacaggtacttctcaaaagaagacatttatgcagccaacaaacatatgaaaaacagctcatcatcactggtcattagagaaatgcaaatcaaaaccacagtgagataccatctcaggccagttagaatggcaatcattaaaaagtcaggaaacaacagatgctggagaggatgtggagaaataggaatgcttttacactgttggtgggagtgtaaattagttcagccattgtggaaaccctgtggtgattcctcaaggatctagaactagaaataccatttaactcagctatcccattactgggtgtatacccaaaggattttaaatcattctactataaagacacatgcacatgtatgtttattatagcactgctcacaatagcaaatacttggaaccaacccaaatgtccatcagtgatagactggataaagaaactgtggcacatacacaccatggaatactatgcagccataaaaaaggatgagttcatgttctttataaggacatggatgaagctggaaaccattctcagtaaactaacacaagaacagaaaaccaaacaccgcatgttctcactcataattgggagtcgaactgtgagaacacatggaaacacagggaggggaacatcacacaatggggcctgttaggggatggggggctagcagagggatagcattaggagaaatacctaaggtagatcacaggttaatgggtgcagcaaaccaccatggcacgtgtatacttatgtaacaaacctgcacgctttgtgcatttatcccagaacttaaaatataata

SEQ ID NO: 30882 - DNA, 1534 bp, Homo sapiens
acttggacatgataaagtagttttcacataaaaaaaagccttttaaacttgtaggaattaagaaataagaataacctacaaaatgctagcaaaatttatctcattttttttcattgtattttcaggtttaactgaactgaatgacagtccagttcccctagaacttgagcgctgcaagtctcctacctcaggtaaacatgagtggtattttgcagacttctggtaattcactgcagtaatctgttgctttattttcatgatctttataatgtgaaatttataattttagtaattaggtataattccattcattaaatttactgtaagcaaatttgattccaaatatcaaatacaaacaaatgtcttttaaaatatttttatctcaaaataaaattaagatcagaggtaaaagtgcaacactttaaaagacattttaaaggaaagttattttgcagatacattaataatgcttactaagtattgaataaaaattggtgatatagagaaacttgtcatcttcaggctagagctgaattagtgggaaatatacagtatatatgcagaagcaaatgataccattcctctagaccacagtttggaaacatgtatatttattcacaaggaaaaatgatgatagaatatgatatgaagcaaaacatcaagacaaagtgtgcacccattaaaatatatttaaaatgtgagaataaagattcctagggataaatctttaaggtactgtctgttaaaaaaaaagttaacagttatttttgggtggtgggaatatgactggttggcctgttttttaaaatttttacatatttgataattctgatttttctataatgtatatatagttttgtgtgagtttttaaacaccaaaatcattaggtatgtctttactgaatgatagatctgttcttacagacaagaaactgtagttcctttttatttacattattttaatttgaaccttatacaaatttataaaagtttaataatgccattataaagcaacgaatttggacttgtagaaattaatttagaattgcagcatttcttccatttattccatccctgaaaagtggttagttctttattcttattcttcaggaatctaggctatgtataatctagttatatcctatgtaaatttttctcttagtcatatatttttaattcttattttactgatcttattgtaaagactgtctcatatgtttaccctgccttttgcattctcattgacaccaacccaatttaggtatttattgcctcatacctatggtatcatacaaatattctagtagatgtctgtattttctctcttcaccttttacaattaatgttgcatgtcatgttgtaaaattaatattcttaaaatattactttgatcatattttcccatgcttataaatcttcgatataaaatataattcaataccctttatcaaatttacatacgtaacttcaaattttgttatagctggccaggcacagtggctcatgcctgtaatcccagcactttgggaggcca

SEQ ID NO: 30883 - DNA, 1030 bp, Homo sapiens
ttatttaattcatttggtgaagtcatgttttcctggatagtgttgatgctagtagatgttctttggtgtgtgggcattgaagagttaggtatttatcttagtcttcatggttgggtcttatttgtatccatacttcttgaaaggctttccagatatttgaaaggacttgggtattgtgatctaagctgtatctgctttgggggcaccccaagcccagtagtgctatagttcttgcagactcatagaagtactgctttaatagtcttggacaaatctgggagaattatctgggttacatgacagagactcttattctttacttactttctcccaaacatacagagtctctctctctctctattctaagccaccttaagctgggggtgaagtgacacccttgtggccaccactactattattgtgatgagtcagacctaaatttagtgtagcactgggtctcacccaaggcctgctataattactccctggctaatgcctatgttcactcaaggtcctggggctctatgatctgcaagtagcaaagccagccaggcttgtgtccttctcttcaagggtggcaaggccccctaggtcctgggtaggtccagaagtgctgtctgggagccagggctggcactcaaaacacaagacagagtccttcctactcttccctccttttttaaaagcagaggagctccaccccatagccgccaccaccccaggccatgagaagtactgtcatgctaccactaacattccaataaggtccaaggtcacttaagtcagcttattgtgaatgctgcctggcctgggactcagccttcacggcagtgagttaccctctggcccaggacaggtctagaaatgccatctaagagtcatgtcctggaatcagggaccccaagagcctgcttggtgctctcctcctctgtggctgtgctgatatctaaggtacaagacaaactcccctttacatttccttctgcttttctcaagcagaaggagttttgccccatagccaccacagctg

SEQ ID NO: 30884 - DNA, 1057 bp, Homo sapiens
gtgaaactacacaacatcaaggatgaaataaccttaaaaactacagagaagacaaactacaaaagaatagtctgacagcagacactcttagctagataggtaagccaaaagatagtgggggaaatatttttcaagtgttgaaggaatataattctacctagaattttatacccaaacacaatgtcattcaagagtaaaataattttcaggcacacgaaaacagcttattgtctgtagaatttagcaaatgtattattaacagacatatatatatgttatatatatatttcagcagaaagaaaagtgaaaacagaaggaaagtgtggaatatgagaaacagtagtgaacaaaaaaatagataaaatgtcaggaaatttgattaacctttgactataaagataacaagtctgttttagatgtttgtacatttggaaaatttttttttgaagattaaagctaaaactctagacaatagttgctgagagagtattcaatcagtagtttaagtatgctgagatccatgtcatgttaggaggatagatacactgaatctgactttattagataaatttgtagtgagttatgtatcctaaaatgttaagggtaccatttaattaataaatacaatctatagtttccacatcatcagtgggaaaaccagggaacatagaaaactttatctagtagaaagcagagaaggagaagtgaaagaaagtgattgatcaacccaaaacagaaaatatgaagtagaaataaatctcagtatatcagtaataacaaaagcaaagcattatatccacctaataagaaacagattatcagattagatttttttaaaacgccatatgctgattataacaaattgtctaaaaaccatatggaaaataaagagatagaaaaaaagatgctagctaagtagtaattataacaaaaatctggatcatcaatatcagaaataatacactttaaggcaaaatgtactcctagagataaagggacttggtaaattatgagaaaatgttcagttcacctggaagataaacaattctgaatttgt

SEQ ID NO: 30885 - DNA, 1026 bp, Homo sapiens
gtttctgagaaaggtcagaaaacctgcattctgtttgaatccaaggacaggcaggtagatctatctgtgcatgcttatgcaagtttcatcgatgcctttcaacatgcctcatgtcagttgatgagagaagttcttttactgaagtctttgggcaaggagagaaagcacttacatcagaccaagtttgctgatgactttagaaaaagacatccaaatgtacactttgtgctaaatcaagagtcaatgactttgactggtttgccaaatcaccttgcaaaggcgaagcagtatgttctaaaaggaggaggaatgtcttcattggctggaaagaaattgaaagagggtcatgaaacaccgatggacattgatagcgatgattccaaagcagcttctccgccactcaagggctctgtgagttctgaggcctcagaactggacaagaaggaaaagggcatctgtgtcatctgtatggacaccattagtaacaaaaaagtgctaccaaagtgcaagcatgaattctgcgccccttgtatcaacaaagccatgtcatataagccaatctgtcccacatgccagacttcctatggtattcagaaaggaaatcagccagagggaagcatggttttcactgtttcaagagactcacttccaggttatgagtcctttggcaccattgtgattacttattctatgaaagcaggcatacaaacagtaagtatttctcaagtccatgggtttcttgccactatgctacgattaccagggcaaaagagactgtcctgttgcctattagacaatagatttcccaaggaattatctccagggtcatgtgcaagggactgaaatagtggtaaaggtcacaatgtttgctggtaattcaaataccttttgtgtctatttcttaagacagagaaagggtgggtggagattatatcttgagatgggggtatcaggaaggtggacagtgtttccagcatgaattcaaggaaagaggagaaatatgagttattgggaatatgagcataa

SEQ ID NO: 30886 - DNA, 1058 bp, Homo sapiens
ggtccaggagctgtgatgtggctgtggtctaggggaatcctgcctgccccatggagttgcgcagcacaaccctggctccaattgccagaaggctctttttaatgctgaaccaaaatgtgcctttttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggc

SEQ ID NO: 30887 - DNA, 1058 bp, Homo sapiens
aagtgctaggattgcaggtgtgcaccaccttgcccagtgtgcatgtatctttaaatagtgatgctctgtgctgatgaagcagacactgtcagctactactgatgggaatgtaaattactactaatcctcctgaaaaacagtttgcgagtatatttcctaagatctagagtgttcacacattttaacttactgaccctaaaataattttgaaagtagctaatattcacatacaaagattgtcacaccagcattattaatattagcaaataagttgttggaaacaactatccaacattaggaaaatggttaaatgagattttatatatctgtataatataatatcacaaaaccattaacaattattataaagaataatgaaatgagaaaatgcttgatagaccataaaatgacttagtgcataagctgtatattcagtatggtatctgtggttacctatgtacgattaagtattgattgatcaagagagtgagagatgcattaggaaaaaaactgaagaaaagactggaaaatcaaaatattagtagtggttgtctgaattggggtattccatttatagatgattttttttcttctttatgcatttcttttcaaaattttctactatgaatatgtattaatatatactcttaaacaaaaagacaaaataaaagttatgtgacaagaaacaaggaatgaaacaaaatgaggggaggtagacatctttcagaccaggactaaggccatttttcccctgtgcattgctgagagattattgtatatgaccttaataaaaatcttgtgagagaaactgggcttgttggctcacacttgtaatcccagcactttggaaggctgaggtgggtggattgcttgaggccaggagttcaagagcagcctggctaacatggtgaaaccccatctctactaaaaatataaaaattagccgggcgtggtggggtgtgcctgtagtcccagctactcaggaggtgaggcaggagaatagtttgaacccaggagacagaggttgcagtgagctgaaatcacaccactgcactcca

SEQ ID NO: 30888 - DNA, 1043 bp, Homo sapiens
ccagtctcgttttatctttgtaccacccacttcccacttcccaccttcctgcatcatgaaacaaatcccagatgacaactccatttcatccagaaatatttcaatatgtgcaatatatgtcaaaaatagactctttttaacatatagtgccgttattttaactaaaaacttttaaataataatttgctaatatcaaatcagtgtttaaattttcaattatctcataaacatttaacagtttgtttgaacagtttccacattagggccacacattgcaattggtccaaagtgccttagaatctataggtttccttaacatggctctttgtttcttataatttaattgttgaggagccagcacttttattcccaacatctggattttgttgatttcctcattgtatagtttgacatgttcccctctcctttatggttcttgtaaagtatgttgtgattcaggttttagttttgcttttgtttttgttttacaagaccgcttcgtaagtgatgctgcttcctttcatcaggaggcgtataatatctggacaactctcattttgtgatgttagcactctgtttcaagatgcacccctgctgctgtgtgtacacctagttctttgtactccatggtattaatctatcacatttcatctactcattctcattgtgtacccagattgcctccaatttattgttaccataaacactactgcagtgacatcctcatgcacgtcaccatagacctgaaaatttctttggaaaacagaccctgtaacatgattgctaggtcataaaatagtctaagcttaatttgtcaagtactgccagattgtagtgatgtgatcatagcacacagtaaccacctgcctcagccttgcaattaactgggattacaggtgcacaccactatacctggctaatttttatatattttttatagaggtgaggtctcactatcttgctcaggctgatcttgaactcctggcctcaagttattctcctaccttggtctcccaaagtgctgagattacaggcatgagcca

SEQ ID NO: 30889 - DNA, 1050 bp, Homo sapiens
gtttatgcagcataccaaaatgtaaatctgaaaactgttaggtaagcgtgggattaaaacagtcttttggattttcttgaggaatattttgtaaagctgtggaaactttttcagcatacctaagaattttctgcttgaggacaaatttaagtcactgggcaaaagtgcattcatttttcccaccaaaagatggcatcagctctcataggaagtcattttattctagaaaacacaaacatgattaaccatatcatgtcaaataagtacaaaacagaagatagtattcaaagttttaagaaggacagtcacataattacaatagaaatgtaaatcaactttagaaaattaaaagtgaagagaatatagtaaatgttgtatttgagatgggatcagctattctataagaggaacagttctgaaggacagaataaattgtgcagccagaggattgtgcccgtacaatcaacagttaatccacaggtgaggaaaagcagctggcaagtggaaaatttttttggcatagctaatgataagcgtctctaccagatgccctttagtttcatgaaaactcaaacatgaaaacttaaaatgctataaaagtcccaagtttagaagaataatattcactattccagatgccgtgtatgttttgttctcaagaagtttacaatctggtagggaagacaaaaataaatgcaaaaacaagagtttccaatagagaaagtgctatgaagaaataaaatagaaagtggaggtgggatggggaaagacttcttcactgagcccagagggccttgttgaactgagacctgaatgacctgaggggtaaacaggagtaagacgtgaagatccgggtggtaccagcattccaggcagacggaacaagtacggaagctacatattgctgtggtaagcaaccatggcatgtatgagaaacagaaacatggccatccaactggagaacagtagaagaagagagagcagggccaggcagcaggtcacataggacctcagaggctctggtgtaggcatctgtgtttgttctctaag

SEQ ID NO: 30890 - DNA, 1162 bp, Homo sapiens
agtttatgcaataaacaaaattttgaaaatacattattcaccttatctgagaactagatgtctagcagccctgttagccacaactcaccaagtcattttgtactgaacagatgaatgctttgaaaatggcattttgaaaaatgttagcactttgttgagtttactgaaacagtataatttgactgtttgacagaagttgccttgggagagattatttatctaatttcatctaaacttactagaatgctatgacagtgatatcagaaacatgctggatgggggagtaaggaaggacaactagctagacagaagcccccagggagtgatagctgaccacaaggtgacttcaagtgttatttaaagaaaggaaacatacccagttgtattgaaaggcatgcaacagctgggtcagtgggttatgcctgtaataccagcactttgggaggccaaggcaataggatcacttgaggccaggagtttgagatcagcctgagcaacatagtggggccatgtccctacaaaaaataaaaaaattaccagatatcatggcatgtttctgtaatcccagctattcagggggctgaggtgggaggatcactggagcctggaagttcgaggctgtagtgagccatgaccactgcactccaacgtggatgacagagtgagatcctgtctcttaaaaaaagaaaaataaaagggcattcaacatgtataggctagagagtaatcctcttactatattttcatgtcttttgcctctgttcttaactactgttttcaattttatggactaaaagtgacaaagtctcatgctcatgacagacagctcaaggaagaaaaagtagaatatggattaaaagaagagaatggatttgtgaaaaatcttaatgtaagaatcattaaatgctgaggcagatcatataatgtttatccatggagattttcaagaagagaaataagtcttgcagcagattctgtgtttcttacagttagagggcttgactaggtatcagtgagcgttccatgatttaatagtaccttacagcaaaatatgcctcatcctcttttggaaccacagttgcatatactgcgtattttaatcagaagtaggttatgaaggccacagcagtcactttttttttaggaagaaatgtgatgctga

SEQ ID NO: 30891 - DNA, 1036 bp, Homo sapiens
acctaaactttgtgactattgtgaacaaaagtgaaacttattttttaaataatttcaatgtttcttttagattcaaggagtacatgtgcaggattgttacatgggtatattgcatgacaatgaggtttgggacatgaatgatcccatcacccaggtagtgagcatagtaccctatgaaactataaataatcattaattttaatccaccaaggtggtttccaggaaaaaggtctcattaaattttggcattttaggcagttaatgagaagatacctgtaaaagagccaagtccagggcacagctggcacccaccagtgtttgttttgtttcttctagataattagctgactgatgctaggaagttaaatatctagtcttccattgtaaagaaatgcttttatatgtgtatttatgagtgtgcataatgaatacacagaaacatcgtccacatctctctagggctaaagttactagaaccatgaaatctatgttgaaactctttttagtaggattaattgatcttcccctaaaagtcctgcagcagaggtccacattctttatggtctcaggtatgattatacacaaattgcaaatctaaaaattctgtaaaactgtttcctaacaataactgttagttccacagcctagtaccctaaacattttatatgataaactgaacccccttccattaaagccagtgttcatatgtcattattcagttattttgaaacttgaaaactcacccagaagttaattatatgtcaaaattcaactattagttatgtgattagaaggcctgaattttttaggggtgggggagacagggtcttgctctgtcacccagtctggagtacagtggcaccattatggctcactgcaacgttggcctcccagcctcaagtgatcctcccacctcagcctcccaagtagctgggaccacaagcatgtgccaccaaacctggctaattttttgtattttttgtagagatggggttctgccatgttgcccatgctggtgttgaactcctgggctcaa

SEQ ID NO: 30892 - DNA, 1027 bp, Homo sapiens
cagggacaagagtgatgatgatagagggtacttaaaaaataattatcaaactaacatttaaaggtgattgattttttttctttgaagtaatttattttgtaaccaaagtcaaggtggattaaattgatgaaaagttatgaacaatattgattaaaaatattccacatggaagccccgtcatatattacacacatcacttagtctccagattgtcactatttattgaaagccagtttctaggccttccagggtacatttattataagtactttttaatgcagagcagattccttccggcatacaggtggtggtctgctggtgatacatgaatgtttaaaactgcatgtttttttgtcttacagagttgtcttggttcaactggtgccttcccgggtcgtgtttgctcagtctcctcctcattctgtgcttcagggaatcctatgacagactctatcttgatgtggttgtctccgtttaatagcacagacttgaaggagtttaaaaggaggctggaaatcaatactgcacactgcacatttgctcagaattgcacatctaacaggaaaagagggagaagaaagaaacttcattcagaggttttgttaggttacagattatcacattaatttaattactactaggtaataataatgggagacttgagtgataataggggattttaaaactctacagatggcatacctgtgcctgcttctggggttggaagtgtgacttcttacacataaagcactacctaagtaattctctctctgttttgtgccagtgctaaactactgattacttgtaattatgaaaagaaataaagggtgtctatcatatgaagataacgccttccctaagtcacatatcagaataggaagatatgccactaacttctaaagaagttcaaaccctgtatccaattttaatgataaaatagccaagaggtatatcgatgatggaaattagccacatgtacactacattttttctaataaagccatttcttatatgactccttatttta

SEQ ID NO: 30893 - DNA, 2103 bp, Homo sapiens
tcattttagaatttatagaaatgattctagagaggtaaagtacaactgaggctcacagtttctgactcctaaaccaggtgtttttttcctacctcacagaagcttaatttagaccattttgggtgtgcatgaataccttcatgttaaaaaatgatagggctttaacagtaagcttccattattgagtatgggaagtacaaggattaagttaaggtgattatttggtttataagtaaaattcttttttctccatcactatcctgaagatgctctgtcagctcttagcccttgggttgtaatgacatcatgtaaaaagattctgatgaataattcaatcccataaaccaagtcaacaccaatattaattggtaaggacatgctgtagtgcaggttccctgtggcttatcaattaatacttcacagtttatgggaagaagcattttttaatatgatccctggtggaggtataggaacaagacagttgtatacacaaatgcatttcactggaggatggagctaattacgagagaatcaaatacaaatgtaattttgtatatttaaatatatatggcctgagggccaagttttttcgtagatcatgtactcatgtttaattatggagaatgtttacagcttgtttttatgaagcccttctaatgagagatctaagctaagggattttaaattgaagaggttaaatccccatctacttaacttttaattagttttttgtttgtttgtttgtttgtttgttttttactattttactaaaatccaggcattcatcttactgtttgcataagtacaagcttcactttaggctcaagattgaataaaaatgcatagcaaatttgctttaaattaatgtttaaaaaatcacattgcacatttgtccctgaaataagtacagaaattactatcattttgccatattaaggcaagtactaaagctgtgatatgaagaaaatgtcatattaaaaaagaaatgcaggaaactatgagaacattttatcaagcctattttatgaatatcggagaaaaatgcaattccactttgatttggaattatattcatgcagaagggacaagatagtttatttctttactatcagacagtgtgctggtctgttaggaaatgtgagcaatactcagagggaatgtttctgggtgtcagaaagtcagttcaagaaagtggaacaggactttacagtgggctgtggggtactttgtgctcagtagaggcggggtggcctgctcactcagcagacatcttggctctcgagctcatttcctcacgtgtccttctggttcagatggaacctcaaacttaggagaggattccaggaactaatacagaggcccgtaggggtcccttggagggtgtcatctctggccagggggatgggagtgatacaggcagttacatggccctcagtctctctgatttacatttgtttgtggtcaggatttagatcactttatgattttctgaggctctgactcgtcagatacctttctcaacccttggatgaatctgacctcagctctgtccctgagaccttccactttcttgaactgactttctgacacaggcttcttcaccctcaacccctctccaggatccccagcagaaatccattctcattcccgaataggaaataaggccatacgctcagagtttcctctcctgaacgagacgctagcaagctcagaacatgagtaagcccaggtgctccagaaagatttaacaggtcttctcacagctaagctttagaagttcgagtatttccttgatatgggaatttcaaaggtctctaacaagtttctatagttattacttgttgcatttttagaatatgggctaattgctttatgtggtcttttggttgtgctctagaatctgatatgcctcaaacagtagctttccatcttagcccactctcaaaaagagagaacaaaaagctacccagccccagctgttctgttcattcaacaagggagaattaaacttttttttaacctagctaaaaaatgaaagcatagaattgatttcagtagctttgatgaaataatcaaaacacatcaagctattttaactctaaa

SEQ ID NO: 30894 - DNA, 1034 bp, Homo sapiens
atccatctggcagctcacctgggcatgagggacatgatgagtaaacgtggccatgggggcccacaggattctcctacctggaaaggggctttgtccaaatgcaaataaccatcaaccaaagaactgtgtgaatcatggttattcaataattttaaattatcttattgaatcaccctcttttaatttcttccaagcattcattgagctctatctaaaatgatctaatttgtcatacagcagacgcttgataactggactttgtcaaggtcgacgttgtcccccagcatctagaacaggcttggcacacggcagggtttcagtgtgtgttgcctggtaggaggactcattctcatgggaatctgccccatcttccataacacctctgtactgggtatggccattgaggaccccttctcgggcttccctggtgcatgaccctcaaccggaaacaagttccccatttctgctttatactgtcttcctttgaaaaaacaacaaatgatgaggaaaagctacccagcatgtggaatttgctagatggtcaagaagaggccagtggccaatgtgggaaccactttctgaccaaacattctgatggctttactcatgcggggctcctccagtttccagatgtgcttccctggtctcctcctcttccagtcttggctcagatggcgaatcatacagagcgcctttgccccactcacctggcacctggaccacctccctcatccctcacatcacatcatgttggaattgtccctttatccaacccctgcccagacactgagcccctaagtggggacagagcttgtatatggggttggaagaagtgactgtaatagcagctgacatttcctgaccatgaatctggtgccaggttctgtgctcactggcctcactggaattctcttattcagtcttcacaatatcctgatagcctagatactattattatccccattttacagctgaaaaaaatgaggcaccaagaggctgagttattttccttaagtcttactgtccaggcaaac

SEQ ID NO: 30895 - DNA, 1050 bp, Homo sapiens
tctggtgagtcctcctgctttctgcattcctgcgtgactgacaccccagccctgtgcccagcggtgcaggcagagcctgagcacagcagtaacatgttttgtctgcttggtggtatttctccatggacagcagagtggccttgtgctagtatcttgtctttagttataagtagcggtcctagagttggattcctccagtagttcaggggggcgttgcttaagctgcagtacttggaagcacgctctggtggccttgatggggacttggcctgcaggaacagccctcctttcctggacccagctcccttcctcctggcctaagtccttcctgctgatgaatctgctgagaggaggacagagcctccaagttcttcacagctgttttgacgatggtgccactgtgggtggtttcattaagggaaatcaaggttttgagagcccttgttctgtgcagttctccaactttccaattgaccctcctgccagttcagctcttctcttttcccctaagcacccacttccttggcagtggcccctggacttcacccaaggattggatatgaaagacagaagcatacatttagacatcattgaaacacaattattgagtcccttcctgttggggaccatgaacatcttacaaggtgtcatttaatcctgacacaggtgtttaccattctagcatgtgtgtgtctggacatgggtctccttcgttatttggagtatttgtagggggaacatatttgcttgtgtttttcaaaaaagttttttgtttgtttgtttttgggttttttttactgcaccttttcaataataatctcacaagagccacttcctggctgaggaccactagtgcccacctgcgaggcacagggcttactttctggccattccacatcctcagagttcagattttcctggcttagcttctatttgaagacttaaaaacatgaaatattgtcaaatatagatttaaagaaattttttaacacatcatgaaatggaatcctcttcacatccctatttattgactttgggcatgacctcagc

SEQ ID NO: 30896 - DNA, 1064 bp, Homo sapiens
aaacaccatctctacaaacaatacagaaattagctgagtgtggtggtgtgcacctgtagttccagctacttggggtggtgtgcacctgtagttccagctacttgggaggctgagatgggaggatcacttgagcctgggaggtggaggccacaatgggcctatggcaccactgcactccagcctggacaacagagtgaaaccctgtctcagaaaaatatataaatatatgcaaaatttgtgacaatggtaaatatctatttacttgaaaaaaggaaatcacaagttaaacacttaaaaagctgaaatataccacaaataacacaaaatccagaaaaacaatacaatgtttttatttctatttattttttcttaggggtctactcatggaactctcctctgaccagtctatataaagagccagtctccgttcttcaccctgctttcttttattccatagcatttatcccaagagcatcacatctgtcttatttgttcatgtattttctttcttcccctctagaatgtaagatctagagggcaaaaacattttctgtctagtttgccattttgcccccaaaccagaaaaggataagtactcaatgagtgttgaataaatgttggaaattttcacgtagaaccccatagctcacaaactgtatgtagtgtatgatccagttttcgtttaaaaatattcatagaagaaaaagaccagaaatagatcaaaatatttaaagtgattatcttgggatgataaaactaggattgattttcattttcttaatcctgtttttctagatattccaattttcatttcagtgatgtatttaaaattttacatgagtgaaatgctcatgatgaaatgcgagatgaaaaagctagaaacaaaatgtatctactatgatcctgatttctttaagacatattttaattaaaaaaagacttgaaggaaatgcagcaacaaattgaaaatggctacctctggaagttggaataacagatggttttcatttctttctacttgtttatgtttttgcagattttataatgagcatgaattactttga

SEQ ID NO: 30897 - DNA, 1048 bp, Homo sapiens
tggttcataattaattactgtgtaaagtagaggatttgattctggggtgtgtcaatgataacttcaagaggtcagtgatcaccttgaaattgtgtgcaatcttctgtgttctggcatctttctagggagagtgttcctgtcatcagaatcttgaaagggttctggactcaaaagtggaaaacatattgaagggttagactttaagctatctgtaatacttacaatacatttgtatatccattcccctgctttttaccccaagtgataactgaaatgttagaaccgtattgtgtgtccctctgtagtacattctattttttgtcttctgtttttaaaccacaacttaaaatagtgctgtattttggttcctttaaattttttcctagaatatataataaatgttaagatcttcattgccaccgtagtagcagtttatggtgtatagaaccagtcttgtgaagcagtgaattaccttgatttaatttgaaattttaaaaccaatgttttttacactgtagttttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttggtaagggcctgatttttttttcctttttattctgtctgcatccaatcataagcaattttaaatctaatattgggtggaggggggacttctgctatcttgcttttgatataataatttggtaaatgatctataaattatggtaactttttacttagatgcttattagaaaaaaattgtgtttgagctgtgaaggggattgtgagtattggtccgaagaattaatgccagaggataacttctcaatgagaaatttataagccagagattcagacttttgcgtttctgtaataatcttttatagtctgcttcatgtagaataggggatggcaaacatttgctggaaaggaccagatagtacatatttta

SEQ ID NO: 30898 - DNA, 1049 bp, Homo sapiens
gttgtgctctgttaatttttaaatgtacaataaattattgttgactgtagtcaccctattgtggtatcaagtactaaatcttattcattttagctaactatattatgtacccattaaccatcaccctttctcccacccccactacccttcccatcctccagtaaccaaaattctactctcttatctccatgagttcagttgttttaaactttagctcccacaaatgagtgagaatatgtaaacttttcttttctgtgtctagtttatttcagttaataaaatgtcctccagttcatccgtgctgttgcaaatgataggatctcattctttttttatggctgaataatactctgttgtgtatgtgtgccacattttgttaatccgtttgtctgatgatgggcacttaggttgcttccaggtcttacctgttgtgaatatactgcagtaaacatgagaatgcagatgtctcttcgatatgctgatttcctttcttttgggtatatagctagcagtggggttgctggattatatgatagttctctttttagtttttgaggaacctcaaaactactactgttctccatagtggttgtactaatttacatccccaccaacagtgttccctttcttccacgtcatcaccagcattcattattgcctgtcttttggataaaacccagtttaactgaggtgaaatgatgtctcgttgtagttttgttttgcatttctctgatgatcggtgatgttgagcaccttttcatatacctgtttaccatttgtatgtctcttttgagaaatgtctattcagatcttttgcccattttttaattggcttgttagattttttcatatagagttgtttgagctcattgtgtattctagttattaatcccttgtcagatgaatatagggattcacattcccttctcagtttgcaaatattttctatcattctgtgggttgtctcttcactttgttgtttcctttgctgagcagaagcttttaaactcaatataatgcaatttgtccacttttgcattggttgcctg

SEQ ID NO: 30899 - DNA, 1048 bp, Homo sapiens
aagtgctttgcattttgttaaaatggctacattcaaggccagtgttcttgactgtcacggaaggtgtaaatactttagtgatcgtctgctcaaacctcccatcccaaagaaggaatactatcgtcaacagttgtgaaatgatataaacttttgcttaaaatgaacacctcattattttataaggtagcatatgccattgtcagactatttgtttaagaaaattattccaacctaaggctttaggaaaaaaaaaaaacttccttatataattgagctaaagtcagcttccctatgtctactagtttgttttgtgatctgttcctcccttccttcagcagaaccagaataacagttaagtcagcaactgtgtgtcctttccatcctcttagactagtctacttcatataaatatctccaattcaccaatgagaacacatggacacagggaggggaacatcacacacgggggcctgtcaaggggttgggggcaaggggagggatagcattaggagaaatacctaatatagatgatgggttgatggatgtggcaaaccaccatggcacatgtatacttatgtaacaaacctgcacgttttgcacatgtatctcagaacttaaagtataataaaaaaagaaataaaaatgtaagacaatatcaactatagaatacaaagcaaacacatttatcattgtatattgacaaagggcaaaattttcaattaaactgcaacaaacatgcacctttttgaatcacgaggtcaggagttcaagaccagcctggccaagatggtgaaaccctgtctctactaaaaatacaaaaattagctgagtgtggtggcaggcacctgtaatcccagttactcgggagactgaggcagagaattgcttgaatccaggaggcagaggttgcaatgagctgagatcgtaccactgcactccagcctgggtgacaaagcgagctccatcagaaaaaaaaaaaaaaaactccagttcacttagccttttcatttatggcatttcaagttctccccatcctagaagcttcctc

SEQ ID NO: 30900 - DNA, 1739 bp, Homo sapiens
tttgggaggccaaggcgggcggatctcctggggttgggagttcacgaccagcctgaccaacatggagaaatcccgtctctactaaaaaaaaaaaaaaaaaaaaaaattagttgggcagggtggcacatgcctgtaatcccagctacacgagaggctgaggcaggggaattgcttgaacccaggaggcggaggtggcagtgagctgagattgcaccattgcactctagcctgggcaacgagagcgaaaactccatctcaaaaaaaaaaaaaaaaaagaaagaaaatatgacccacacactgtgggcatggggtagaggggacagaatgtaggtaacagaaactgcctctgagagcaatcagctgtcagatttaacagacagaggcttcaaagtagtcattataatcatgttcaaagactaaaggaaactattaaaggagtaaagggggaggtatgataatgttgcatcaaatagacaataccaataaagagaaattatttttaaaaaacacagtggaaattctggaattaagtaaaattactaaaatgaaaaattcactagaagggcgtaacaatagatttgaactggcagaagagttagcaatttgaagatagattgatagagattatctaatctgaaaaacagaaaaaagaatgaagaaaaatgaatggaacctcaaaaaaatggggcatgctaacataggtgtgataggataccgaagaagaagggggagaaaaagcagaaaaaatatttgaggaaataatggctgaaaagttcccagatttactgaagaacattagtctgctcttgcaggaagctcagtgaactccaaatgggatacacacgagatccacaaatagatgaatcatagtaaaatgctgaaaactaaagacaaggagaaagtcttgaaatcagcaagagaaaaagaacttgtcacttacatgagtttacctgtataacaaacctgtccctgaacctaaaataaaagttaaaaggaaaccaaaactcatcacttacagtgaacctcaataagattaacagctgacttcttagcagaaccaatagagactagtaggcaatggaatgacatacaaattgctgaaagaaagaaaataaaaactaccagtaaccaagaatcttatatctagcaaagttatcttttaaaaaaatgaaggcaaagtaaagatatttacagataaatgaaagataagagaattcgttactagcagaaacaccttataagaaataataaaggaaattcttggctgcatgttgtggcttacgcctgtaatcccaacactttgggaggctgaggcgggcagatcacgaggtcaggagttcaagaccagcctggccaacatggtgaaaccccgtctctacctaaaatacaaaaattagctgagcatggtgccacacgcctgtaatcccagctactcaggaggctgaggcaggagaattgcttgaacccgggaggcggagattgccgtgagccgagatcgcgccactgtgctccagcctgggcaacagagcaagacttcatctcaaaaaaaaaaaataaataataataataatggaaattctttaggatgaaaacaagtgaccctagaaaataatttgaatccatttgaaaaaaagcaaagaacaagggtaaatgtaattaagtaattaaaaaagacagtaaaggcccggtgtggtggctcatgcctgtaatcttaatactttgggaggccaaagtgggag

SEQ ID NO: 30901 - DNA, 1031 bp, Homo sapiens
gtggaatgaaattgatgggggtggccaaaatgaagaggaacacttgtacctctacctcacactctttaggtcttagaatgtgctttatgttttcattttaggactcttgagaatttctatataccagtgtgtgacaattttgactgtttgtaaatattgttacatcctatcttgatggattgtttctggaaatgggctcccaccggaaacaaaaataatcttttattttgcttttgcagagtgatggtgatgattttaattacatcattgcatttttccttggaacagcagcctgcctttaccaggtaggttttcttccattttaaagaaacacttaccattattgtttacttcgggtatcagttctaacaattgtgcattttaaataaattattaaaactctgagttctttgcttctcttttaatttgagcctcttttaactttgtgacctatgtctccattttgagtagacatacatcccagtgaacctgatgttaaccttcttcctgtgctgaggcttcagtggtggtatgtcatctgcctatggtagtaaagactacttctaggctgggtgtggtggctcatgcctgtaatcccagcactttaggaggccgaggtgggcagatcacttgaggtcaggagttcaaggccagctggccaacacggtgaaaccttgtctgtactaaaaatacaaaaattagccgggcatggtgatgtgtgcctgtagtcccagctacttgggaggctgagacaggagaattgcttgaacccaggaggcagaggttgcagtgagccaagatcgcgccactgcactccggcctgggcaacagagcgagactacatctcaaaaaaaaaaaaaaaaaaaaaaaaaaaaaaaaaaaaaactactagattttctggtggttgattattcagcttccaggttctacttatactctaggctgaggattttgtattggagggaagtttttgaatagagaacagcacagtaaaaacaggattttaggattcaatttagcagtaatgaata

SEQ ID NO: 30902 - DNA, 1049 bp, Homo sapiens
ggcccaaagatctttactctaaaacagttctgttgaatttcaacctggcaatgtaagttgatatcttcacaggtatgggacataggacagaattcaaagtcttccctctcctcacctgagacaaatgcatatctgattgcttcctctgccctattgtctacgttatcttatgtaaaaatacagattaactgagccagactaaggcatgaatatttcctccactccccactcacatgaaaattgtgtattcaaaaggatgcaactgttttatctttttatctactgacacaatttaaaaatatttcttggctgggcgtggtggctcacgcctgtaatcccagcactttgggaggccaggcaggcagatcaggaggtcaggagtttgagaccagcctggccagtatggtgaaaccccatctttactaaaaatacaaaaattagctgggtgtggtggtgcgcgcctgtagtcccagctacttgggagactgaggcaagagaatcgcttggagttggaggttgcagtgagccgagattgcgccgctgcactccagcctggtgacagagcgagactctgtctcaaaaaaaaaaaaaaatttctcttcccccagtatccaccctttcccctttaagtactgaagccctcaaaatcatctttggagataggcatatacctgcctccctggcatgcatcctttactatggcaaataaacctcctaaaatgattgagacttgccttgatcgtgttctttgatttacagagtcaaggtgggggctggttagatcagatctctctcagtcataattttctcactgttacaatttttgcaaaagaagtttcaagacctcaagagatgaagtgagaggcataagttgacaattgtcagggtcccatcctttcccgccatggcagattgttcagagattctgttgccttgttttcctgaaattttttttttttggagacgaagtcttgctcttgtcccccagactggagtgcaatggcacactcttggctcactgcaacctccgcctcccaggttcaagcaat

SEQ ID NO: 30903 - DNA, 1034 bp, Homo sapiens
tgatggaagcttaaaatagtatattcagccattaaaaatggttttgcagaaacttacttttaaatgaggcttctgagtcaaaaacaaaaacaattaatcatttgtagcaaaagcagcagcccaagcaacatcctatgttggtttccaagggtcatcatgagggcgagatggtacctgcacatgcagcggggtgcattacaggacaggagccctgtaaaaattaggaaactctgatcttctatataactgccagagacctgcccatcatcctctccagagagagagaaaccttagtttactctggaatgtaagcaagtcttgtccaggaagggaggaagaagagttctttatctttactatcctggaccatctccagggaggtaaacatgtctacgctttactatcctgagatgtctccttatataagtattcttgaattgtttgcaattgccttcgatcagaggacctgagccatgcagaaaagtgagatgttcagggtaaatcttcttctaacattgactgtatgtgaagggcattagatgcaactgtcaattttttttctcagtttgaaaaagtttttattttttatttcccatttcttagagacagggtctttctctgttgcccaggttagagtacagtggcatgatcacagctcactgcagcctcgaatgcctgggctcaagcctcagcctctcaaagtgctgggattataggcatgagccaccatgcctggttttgaaaaagttttaagagaaagtttgggaaaataatattgcataaatgtatttgacatggacgttgtttagaatatgctaagtaaaaaagtggattatacatggcatgtagtaagatcccattttttaacaattaggtataggtgtttgtctatggagaaaaaaatctggagggggtataccaatatattaataatgtttatttttgggtgagagacagcatcatttgttttcaaatgttctttctgtttatatgtgttttgctttttctccaatgaatgtagtagtttttgtgat

SEQ ID NO: 30904 - DNA, 1065 bp, Homo sapiens
attctcctgcctcagcctcccgagtagctgggactacaggcgcccgccatcacgcccggctaattttttgtatttttagtagagacggggtttcaccgtgttagccaggatggtctcgatctcctgacctcgtgatccgcctgccttggcctcccaaagtgctgggattacaggcgtgagccaccgcgcctggccagaactggtacttttaaaatgtctttttattttttaattaattttttttaaagaaatagagatggggtcttgctatgttgtgcaggctggtcttgaacttctggcctcaagcgattctcctgccttggcctcccaaagtgctgggactacaggtgtgtaccactgtacccagcctttaaaatgtcttaaaaagtgaaaaactatatttgaatataaataaagaattaagaacaacaacacttgagtatcgagactatattatccaatacaattgatgaaactatagaccatactctctagactttcacacaagcttttcagttttaatttcacataatttgaaaagtgatgtacatgtgactgtcgagcatttgaaatgtaactcatacaactgaggaactgaattttttattttattttttaaagtaacttaaatttaaatagccacttgtgagtagtggctaccatcctggtcaccacacatccagaacatggtgataagcctgtatcaggatagtctaggttatgttgcagccactgagaaccccaaaatcttggtgatttataagaacaaatgtttatttcttgcttgtgttatgtccccattttgggttggctagagacccagatggctgcagcagccaccatctcatgtgttgcccgtcattatggagaggcttgtaccagcacataaatgctctggtcccgagggtacatacatcacttctggtcacagctcactgactaggactagtcacatggccccatctaaccaggaagccgagagtgaagccctaactctgtgcagagatccttagcaacaactgccaccaacattagccccccctttcaaattacaggaaggagtcc

SEQ ID NO: 30905 - DNA, 1023 bp, Homo sapiens
cattacatgtattgtgcattttatttctattattattacattgtaataatatattttattataatataaaataagtatacaactcatcataatgtagaatcagtggaagccctgagcttgttttcctgcaactagactgtcccatctaggggtgatgggagacagtgacagatcatcaggtgttagattctcataaggagcgtgaaacctagatccctcacatgagcagttcacaatagagttcgttcctgagagaacctgatgctgccgctgatctgacaggaggcagagctcaggcggtaatgcgagcaatggggatcggctgtaaatatagatgatgctttgctcacttgcccactgctaacctccttatgtgtgacctggttcctaacaggctacttaccgggggttggggacacctgctctataagatatccttctagaatgattgatatagtactaagctgatgctcaagagaaattttgaactaaatgtgtaaattcggctacctatataaacaagaacttcctaaatcattctgttccatagcaaaacacaaccacataagccagttcttcacatctaggcaccacagtgtttgtttttcatttccaggatatagctgtgtcctttacaactggtagcatggaaagaaagagaagtctgcaaagattgaacaaacagcatgcactgtggtatcctttatttaaaaattgtgagctgactacagttgtagtgttctcatttaccattctgatggcataataaaccaagagaacattaacacaattccaagaaggcattaacctgtaacacacatatacgccacacatgcacacacacaacatacacgcacacaaaggttatattctgaacacaaaagtgatagaaaaaagctttgaatgcgctaaatcaaataaaaaccctttattataataaactgtggcaatactgtggctatcatgaaaaatattgtaactattttaaaagcaaaaggaaaaatactggcagtttgaaactag

SEQ ID NO: 30906 - DNA, 1049 bp, Homo sapiens
caagtaaatagcagggcatcctgctcaaagctgcccctgttgtcagggaagcaaccgtcacacaggaggacagagccagggccacatgcactttgctgcctggagctcccatctcatgtcccacaagccactggcattgggagggaagagctgggtgcattctgagtggacaccaactactgtccctgccccccattacacaaatgcacagccttgaccagcaaatacaaggagattagaaagagtaaggatatcagttctgcccagaaaacctcactaaggctggaagaggaaggaagggtgtaatattcccctttactccttgccaccagggtactgttttaaacagagaaaccttcatcctataaaccacctggggcaagagggctgatctgcaccccactccccacttcctatacccttatacagaccccaaacctcgggaaggcttcactctgttctcttccctttgtagttaggagtcagaatttgtagaaactgtaatggagaggatttaggctggaattttaggaagtctgtcataagagtaagaatcgtgaggcacaggagtggggaatgaggataaccatgtcctggagagagaactttccattcatctgggtgggcgggaggatgccaagatgacctctggccccaactagaggggctcagaggcttagcagagaccaatcccatctggaaattttccctcaagtcagggtggggctaaggctttgggaacagatatcccacccccaacgcacatcctgttcaaatccttgattttctttcagtttcagtccctcagctgccttgagtcttaagtcaaaatgatacaagctgcaaagacagtacacagagagtagaggggcatgtggacccggcccctgcctcctctcccagggcaaggcatggggcaggcagcttttccaacctgcccagagcctggacccctggccatgtgcatgggcttggggaggcccccctagcaggcttgcaggcttggctaccccagatgaagaatctggtatttcctgtgggacagttca

SEQ ID NO: 30907 - DNA, 1068 bp, Homo sapiens
tgaaagctgcccttcatctattcccctttcatttattcagcacatatttattgagtgacttctgtgtgccaggcgctagggatacaccaatgaacaggacctgggtgggaagacagatgataatatggggacattaatatggtgttgaaaaagtacaagatgtggtgggtgcagatgcagggatggctggtccagctgagttggccaggaaggcttcctggagacctgaagaattaacacagatagctagatgaaggcaggatgggaaacagtgttccaagcctaggaagagcatatgcagggatccaaagggaagagatagcttagcatggaaacgtgaaggctgacaacataatgataatcataaacacatatataatgctttctgtgtgccagatattattctaagccccttacatttatgaagttatttaaatactattatcatccccattttacagaaaacggaggcacaaagaagtttagtaatttgcccgatcttacacaactgttagaattggcatttgaagggagttggctgcggagccttagtggtgacaaaacaattactatgcctgtgtgtgtagcactgattcccagtgagaatcctggcatgctgttagacgtgcatgggccttgtggtaacaatcaacttggaaattgtcttgttaagactgacagaacttctggcatatcctaattgttgactctgtctttgtcaggcagacgatgagattccttgcctcagtggatggttttgttatgtctcatcctatgtgaacaggctgcagggaggttgtccctgacctcctagcgagaagggacttgggactcaaacaacagtttaactgtggatgaccaaatcacattttccacagtagattcccatccctaaatggggagaaggagaaaggaaaatggtttaaagatcaatacccagaaatggccgacctctgctggtgctccgccactgtgtgtggttgttggagctacaggctgtgaggaagaatagtttggttgattgccaacttggccccgagggagtaggcctgaaagggggttaaggca

SEQ ID NO: 30908 - DNA, 1042 bp, Homo sapiens
ggaattgagacattaggtcattttcttttctatgctgatttttcaaaatttgatgaacatgtattgcttttataatggttaaaataagtttgataaagaaaaaataaaaagagaaagcttgggagaacagagcctatgtagtggcctatggctagattatggacctgggtgttccagactggatgtagtgaacaaaggacagacagaattgggaataaacactaactctttcttaggccttgcagaagtgatgctgaggttaatctgaagttacttgggagatagaggagaggggaatgtagagagtcaacaaatcattgtattgaagtttcctctactttgtttgtcttttgccttggcctgctggcctagtgataattgggagaagggggagtgagaggaaagggaccaaggtttcctgtgctttttttaattattatttttgagacagagtctcgctctgtcaccaggctggggtgcaatggcgtgatcttggctcactgcaacctctgactccctggttcaagcgattcttctgcctcagcctcccgagtagctgggattacaggcatgtgccaccacgcctggttaatttttgtatttttagtagagatggggtttcaccatgttggccgggatggtctcgagctcctgacctcgtgatccgcccacctcggcctccctaactgctgggattacaggcatgagccaccgtccctgtgcttttgaatggccatgtgtcagggctacctagaaagatcagggcaaggcctcagaaatccccatcaggatagactgggatgagattcactccaggagctttggaagaaaatatataaaacttgttattgttaccatgacatacaaaatgccccactatttatcattatcaaaaaattcctggtacttccatgggctttctgcagcagagaggtgggtacttttaaaagtatagcatttgggccaggcatggtagctcatgcctgtaatcccagcactttgggaggctgaggtggatggatcacttgaggttgggagttta

SEQ ID NO: 30909 - DNA, 1062 bp, Homo sapiens
tgacagaacctacctcatagagttatacggagaatgaaatgatagtccacataaaatgtttaggctattgcaagcatatacgattgaaaatagtcaatatatggcatacagcttacaaacaatatgctgagatttaaaaaacaaaacaaaacaaaacaaactcttgttctccaatcactgtgcctttaaaacagtacaagaattctctatactctgtcttgtttctcacacccatgctcttgcatcctctctaattaggccatggccccctccattccactacagctgcttttttcaaagtcaccaatgatctccatgttgctcagttttaagacttaattcttaggtcaactctcctgacctatcaggcagcatttgacacgccgatttctccctttgtaagacattttccacgtgcagcctccagaacaccccaccctcctggttttactcctacctcactggctactttcttgtcctctcgtcttcctgcttctggcttagtctttggactttgtctttatccatacccatgcctctcgctgatctcacccagcttcatggcttccaaccccatctctcctctgacaactctgcaattatctccagctcaccagcactttctcccctgagctccagacttgaaggcaagctgctattcaatttctccactcaggtatctaatgggcatctcaaagatgtctaaacctaaactcctatatttcctccctgagtcctgttcctcctatattcttccacatctcaggaaccccatcctaacctcagacccaaaacctgagatacccttgactcttttttcatatcccatacacacatagtctgtcagcaattcatattggcccttccagcaaaacatctccagaatctgatcacttctaacaaccactaggaccaccctacttctaaaccaccaacatccctcacctggaatagtgcagtggcctcccaaccagtttccctatttccacttgccctcaatatagaaaccagaatgacctttaaaaatataagccagattgaatcactctggctcagaatctt

SEQ ID NO: 30910 - DNA, 2326 bp, Homo sapiens
tttcttcacttgactccaggagttcagttggaagcaggaggtaaatctggtcactggtcgtggctcttccaaaaatgcttctttacccatggcaggcaaaataaaactttgcatattattatacacttgcttaagaaaagccttcttagtctagaacaataatgaatgagccctttggtaactatgtatctttggacaagtcagtttacttcttttagtctaattgtctgtaaaatggggatgataacagtattgacctcataaggtaatcaagatgctttaatgagataacatgtagaatatttaacacaatgtcttggcacagagtaaacactctgtacttataagcccttattcgtaagccctaataattgtttgactagatattatagttagggtctaggcttttaagaatacttaaagtatcttggatttggaagataataagccatttaacagaatgcttctgaaacagcggaatttaataaaaaagcaaaatttaaggattcgggtttatggatagtctgtgtgaccacttgatggggttcttgtatatggtagtggtcaggttagacttgctcagcagtgccttgtggtgattctaagatgtgtgctaaaattttcttcaattgtgaggccaatctttattgtatttttttgatattgaacctttctttgcaacatatgagttttacttctttttttaatatattgttaagctacagatgatctaaaatttgacattgagggggtgaatatttagggcaacttgaatttatgcttctggaaaaaaattacatgaaaaaataatgataaaataaataaggctgggtgcgggggctcacgctcgtaatcccagcactttgtgaggccgaggtgggcagatcacctgaggtcaggagttcaagaccagcttggccgacatggtgaaaccctgtctctactcaaaatacaaaaattagccgggcgtggtggtgcacgcttttaatcccagctactcgggaggctgaggcaggagaatcgcttgaatccgggaggcgggggttgcagcgagctgagattgtgccattgcactccagcctgggtgacagagcaagactctgtctcaaaaaaataaataaataaatagggcggggcgcagtagctcatgcctgtaatcccagcactttgggaggctgaggcgggcggatcatgaggtcaggagatcgagaccatcctggctaacacggtgaaactccatctctactaaaaaatacaaaaaattagccaggcgtggtggcaggcgcctgtagtcccagctactcgggaggctgaggcaggagaatggcatgaacctgggaggcagagcttgcagtgagccgagatagcaccactgcactccagcctgggtgacagagcgagactccgtctcaaaaaaataaataaataaaaataaataaataaataaataaataaaataaactttaccattgaaaaggagttggtgatcatctttctccatttgacgtctctggcctacccagtgagtctcttcagctcctgtttttacgcagttgctgtacaaaaggggaacgaaagtaggggcatgtttttatttaaagctggttagatactttttcagagaagtcatgtgacaggttttctgatttttgtattatgtgaaacaacaatttttgtgtttcttgcaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctatagg

SEQ ID NO: 30911 - DNA, 1062 bp, Homo sapiens
acccggtgggtgggagtcactcagtaccagttccgagcctgaacccaaactctcgtgtttctgctcacccctctctggcttctgccaccacatgggaagaatatgccctggttagcccatggcttctgaagagcaagagaaagtagagcagagcctactccagcctcccccgtccaatgtatgaaagccccagctgatctgtaagcctgggagcgtgataaatgcttagtagtgcatgccatggagttccagggtggtttattacacggcaatatctagctaaatacatttaacttgctgcagctctctggatccagcctggttaccaggaagacaaaaactgggctccaccaggaaccagtcttctgccttcccaaccatcacctctggctgcatcagcgatctctcccagcgaaatagctgcttggtcttgtgtgaatcctgtactttaacacagtggaccaagtgtcagtcattgaaaatgaccatgagtaaccctgtggactctctgcagcttggttcctttgccccttaacaggtgggtatgaatcgtgtcttcagtgccagggctgaatgagaaagggcattcctttttgaaggaatctgatactaaacacaaagcatgagaaaaatcaggacttgttggagttatatttttaaaatatatattttaacagttatatatattagatataatatataatagtatatataaataatactatattgcccaggctggtctcgaactccttagctcaagtgatcctcctgccttggcttcccaaagtgctaggattacaggtgtgagccactgctcccggcctgttggagttctttacatttattttataatcaatgctgttttattaaatgcggattttattttggattacaggatgtagaatgccatatttttcttagatcatagggcctttcacatttgtaatttggccttgtatgagttaccctgcaatccctttgttttccccataacccttccaaaggaaggccgcaatagaaatacaaagagaaacaaaataattagaatattttttaacttct

SEQ ID NO: 30912 - DNA, 1062 bp, Homo sapiens
ccccttttctcctagcctgcaaggtttctgctgagaaatcccgttagcctgatggagattctaagtgacttcatgcttttctcttgctgttttcagcattttctctttgtcttttgacaattttaccataatgtgccttggagaagatctctttgagttgtatttatttggtaatctttgagcttcctgtatttggaagctttcaggaagttttcagttattattttattaaatgggttttctatgcctttacccatctcgtctccatccagaactcccagaatttcagtttttggtcacatatgtgtcccatatatcatgtagccttccttcattcttttttctttctttttgtctgactggattattttaaaagactaggcttcaggttcagaaattctttgttttgcttgatctagtctattgttaaagctgtcaattatcttttgtatttctttcaatgatttattcttttccaggatttgtgtttggttctttgttatgctgtctatctctgttgaatttctcattcagatcatgaattgttttcctgactttttatattcattatctgtgttctcttgtatctccctgactttctttaataacattattttgaatttttctcagtcatttcatagattttcttttctttggaatctgttgctggagaattattgtgcttctttggagatgttatgtttcctttttcatctttcttgcatccttatgtgactatctgtgcctttgacataacagtcacttcttccaattttatggattggcttttatatgggaaaaccttttcttatagctgtagctacagtattcattggatatcacactttggctttgattctgggtgggtacagtggcatagtctgcatatgatttcttcagctgtaattggcatgagtggtgtctgtgagtcattcagtggcttagactgcagttttgtgtttttttttttttttttttgtgtgtggttgttgagatggagtctagctctgtcaccaggctggagttcagtgacacaatctcagctcactgcaacctctgcct

SEQ ID NO: 30913 - DNA, 1034 bp, Homo sapiens
gctagcaggggcatggggcatgaagaacagaagaagagaggaagtgtttccgagcctccggaaaagaaatcagagccaagcacagcttcccgggtcacagaaccaattcattcaccaggcggcaccactgccgtcatttcagcttctggccactgggaggcgctgctcaaaagggtttgccctgagactccgagaagaagctgcgggaaggacagcaggggtcccggggttttagcctctggcccaggagttgtatgtccataaccaaagggagcacagtctgcacccagctctcatcccatcggagctgctgcgactcccgcaggttcttccaaaactggtttagcttgcctgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagttcctaactctctcacttggactcgagactcttcacgccccagcagcgctccgcctccaacttgacatcatgctttctggaaacttccccgtatgtcccactttcccacacttggtgccctggagcacctcccggcctctaacgtgctgtatgttcccctgcgagcaccctcctcttggcctctggccaagtcccacccatctgtgggtaacaagggggtgtcggtgttcttttcagccttgctaaactctctgaatcaaggatcacaaactacagcctgcaggccaaatccagcccacagcctgtgtttgtaaataaagttttattggaacaaagccacaccccttaatctacagatgatctgtggctactttcacaccacaacagagtaccatggttctgacagagactgggggacccagtctaaatgacttctgacctggacctttactgaaaatcctgccaatcattctgttggcaagaatgatgtattacttttagcaataagaaacaagtaacctttgcagaattccacccatctttc

SEQ ID NO: 30914 - DNA, 1070 bp, Homo sapiens
cttacctggagcctggcatatggagtatgctctaggaacggcaagtcagggtcgtttttgtcattagccttaaataggcacccttatcatcagtcttgggttgcagtcttctcttctagccatgagctttgctgcctgcctctggagtgtggggaaattacattcttacctggcctgcccctaggctcttgtatgcctgggattccctaacatctttctagagaggtagcctcttgtagcttcctgtgcaacctgtttgcctgtggaacagagctgcatggatggacttggaacatgacacacccacacagagatcaataatgtggctcaataatgatgcctgcctctttcccacgagccatactcagggccttgctatcagttttccctcatccctgttactttaggagtttttcttcttgtggagtgcatcttatttttaaatgccagctggtcacaatttctcatgaatcctttcagagttttcccaaggccgtggatacaagtgcactctttcctttctgcaagtacaaatgagatcacgctattccgtccattcccttttcctcttacctgcgcattcagtcagatggtctgaaatagtttcacttccttggcgtcttttgtaaccatcccctccctgtcactgcttcagttgtcacacttctcagtgctcctcctcctgatttgcactgttgtggtggtttccctgctaccagccccttcgtgatttcagtccctcctcctgctttgccagaccttcctgtgcaaagagaagactgaccacatccctgcttatagccttcactgactcccagttccagcttccttggtttgccatccaaggctctcaacaggtggcactccagcaactcctcacacctgatgttttcacgtccctgccagactgagccgtggtgctccttggagctccctcccttccgtgcctttgctcatgccacacctctctctggaacgccaccttctgctcacaccccttctctgctgtcatcccttcaggcccaattcaggccatctcccttctagctggaactcggagttccattgtt

SEQ ID NO: 30915 - DNA, 1032 bp, Homo sapiens
gctgtgaggctgcagctgtgttcagacggcctccatcactgtggttccttcgtgtttctatgatgctgccttacctgcaaggtgaggggcaggcggtgctgtgcgccgttgggaaagttaggatttactcttcctccttcacttccacccatgtctccatgacagaattgatgtgaactcattcttaaaacaaatcagtgattttttttttttttaaaggatgtggagtcaagaaacaagtgaggttcatgtagcttctgactggttctctggagagagaagctgaagtcatgtgggggtcctagaaacactttattgatggccagatgccatggagcatcctagaggtatggtgtgggtgtggaatgaggctgctcctactcaacctgctgttgaaagacccttttgcctgtgtcgcctggctctctgttcatctcactgcctgacttccacacctggctgtgcatctggatcacctgggaacttgttaaaaatgcagatatttggatccgatactgaaacaactggataagactcttggatgctgtgatcctggaatatgtatttctaacagcctcccatgtgattctggtgcagcaagcccaaagctggtgcctggaccaatgccgggagccattgaccccagagtgttttttggccctttttgcagtctagtcaccccagggatgtgaagtgttcctgccagggatgtggctccctgtggtcctcaggccaggaggctgtactgtttgaaaagtgtaccaggtgattctgatcgcttcccctgctttgtctccctctccctgatgcagctcctgcctagatgaatagctttgttgggcttattgacctctaagagaaacagatgctcttttctctgccagggtctgctagagaagagaatctgctgtctgtgttaccactcccttggtgagggatccaggccatctgggttcagcgttttaggggatagtagtaagacctctgatcccaaatccaaagggatggctgtgggatgcaggtgataccgag

SEQ ID NO: 30916 - DNA, 1098 bp, Homo sapiens
gttgggtggagaggtgcctgggggagggtgttcatcaggacaagctggcctgtgtggtgtcattgagcaaggagaaggtgaaacgcagtctctagctgttttgaaccctatggggagcttgtggactcctcctctttaaagaaagctgttactctgtggactgctcagattcaagtgtggggatttcagaatctcgctgttctagaatggccctgctgtaggaagggggagcccaacattttttgagtagcaggagatgtgcatgtgtattctttgtttaagaagctggaaggacacgtgggttttgcaacctgggcttatttggattttgtggagcctcccccattaccaaatcacaggtctgcggatgccttcagttttcttttctctggctatggtgcctggctcaggcgacctctgctgtgtgctgacagaagctggacatcctcattagctgctaactttgttaggcaaatggctgattgcggttccattcctggtgtcactgcttctaattagcagatcgcatgtctctgaaaatgtctgttagcaccagggatgactaaagaggctgacagctggggctgggggctggagaaactgtgcagaagtgctttctcttcagcctcttgagggtccaggctgccgacctcagctaggctccttggcctctgagtgcccactggagcccaagggaacagagcagcagggttccttgaaaattgcaccaactggaggggtgatctgagccatctgagagtggcattggagcagcaggtgacaccgtccctgacttcctactttgttcttgagagaagtccaggccagtctgagagttttggggtttcttgttttgaacagaggtcttacgtggtcatatgtgaacctaatactgtagggaaacctgattggatcggtgccatccctcctggctcgcatcagatggtatgcgctggcagtgagggcacaggtagtcagaggaagtagcaccaccccttctgctgccatgcttgctgtacccctgctcctcttccttcgggtcagtgcccaccagccctgccactcttctgtgtgtggatcaagtggggcagcccttac

SEQ ID NO: 30917 - DNA, 1028 bp, Homo sapiens
tgtgtaccttttcatcctgtgcagcagaactgcgagccagttaaaccatttttctttataaactacccagtctcaggtatttctttatagctgtgcaagaacggactaatacaatatgcatgtgtgtgtctttatggcagaacaatttatattcctttgggtatatacccaataatgagattgctgggttgaatgatagttcaattttaagttctttggggaatctcgccacattttccacagaggctgaagtaatttacattcccacagcagtgtctataagcatacccttttccccacaacctcgccaacatctattattttttgactttttaataatattctgactggtgtaagatggtatctcattttgattttgatttgcatttcgttaatggttagtgatgttgagcattttttcatatgctcattggctgcatgtatgtcctttgcccacttcttaatggggttatttttttgcttattaatttgcttaagtttcttgtagattctaggtattagacctctgtcagatgtatagcttgcaaatattttctcccattttgtaggtcgcacgtttactctgttgatagtttcatttgctctgcagaagttctttagtttaattagattccatttgccaatttttgtttttgttgcaattgcttttggtgtctttgttgcgaaatatttgccaagtcctatgttcagaatggtatcttccagtattttatggttctaggttttacatttaaatatttaatccatcttgagttgattttgtatgtattgtaaggtaggggttcagtatcactcttctgcatatagctagccagttatcacagcaccatttattgaatagggagtcttttcctcattgctggttttgtcaaagattagatgattcttaggtatgtggcattacttctgggttctctattctgttccgttggtctgtgtgtctgtttttgtaccaatactctgccgttttgtttactgtagccctgtagtatagtttgaagttgggt

SEQ ID NO: 30918 - DNA, 1058 bp, Homo sapiens
gttccggtaaaggaaccctgctggggtcatgttcctcagaacaagaagggagaggaagcacactgggtgcaggtgcggatttcctgtagcactccctattggagagactttcatggagccacatcgccacacaggagtgggattcgctgagtgccagccaggcccagcatcacggagaccagtgtggaaggtgagctgggatctgaagtggaagaatatgatgatcggctcagctaccattcccttagtaggtgttgccttggggtgaatgtggagtgggaaacatgaattggctgtgcttctggttgtcttgggtcttctttaataatttctctgttaatagtttgagcatcttgctacagtgcgttttagtgtgaacattgtttttggtacaacatggctcctaaattatattttgcatatggatgctatcctgggtactctatgtcactgcctttgtagtatcatacagaattggatataaagttgtatatatgtacttcacaggggagacagggtgtttcaagaagagttctgattatgtctgatgctctctttactttagatcctaatctgccttacattctctcagctcagtaaagtgaggcttcagttatattccagtcaagctagagatcaccacctgtgaccagtcctgcacacatccctcttctgacttccctgttttttgtcctgtttggatcgattctgaattcctaaggattgggaccatgtttatcttaggcataggaccttgagggcacttagtagttgctcaacaaatatttgtcaaatattgatagcaacaacagcaatcatatttactttacatataatcatttaattctcatatcaactctgagtagttgttaccatattcaattctgaggtgaatttttttcttataacatctttgaattagggatacattttataaccagtgacataaccaacatcattttttttcttagtggtaatggaataatggttcatgttataatcgatggtgtcttagattcaattacatatggtgttattcccactttataggaaactgg

SEQ ID NO: 30919 - DNA, 1049 bp, Homo sapiens
atgctgcaccatcctcagactcagatttctggttttctgtttgatctctagcctcccaatgtggcaccaaatgaagccagctcttaggtaagacccataaaaacaggaaactcacctggtactatttcctgctcccacatatcagctctcctccaacttctgcttgcctttggtcattttccagggcctttagagggttgttttttatattttgtctagaatctatcacttatttctgcaggagatgttatggactgaatgtttgtgtcctgacaaaattcgtatgttgaagccctaatcctcagtgtgatgtacatggaggtggggctttgggaagtcatgagggtggggcctccatggtaggattagtatctttataggaattagaaaaaacaagagttctcttgctctctttctctctatcatgtgacgacagagcaagaaggtggctgtctgcaagtaggaagagagcccttaccagacatcaaatctgctggcacattgatcttggactttcacacctccagaattgtgatgaaataaatgtttgttggctgggtgcggtggctcacacctataatcccagcactttgggaggccaaggcaggtggatcacctgaggtcaggagttcaagaccagcctggccaacatggtgaaaccctgcccctaccaaaaatagaaaaattagctgggtgttgtggcacgcacatgtagtcccagctacttgggaggctgaaacaggagaattgcttgaactcaggaggcagaggttgcagtgagccgagatcgcaccactgcactccagcttgggccacagagtgagactctgtctcaaaaaataaataaattaaataaataaataaatcatgtttgttgtttaagcctccagtgtgtggtgtttgtggtagcagcctgagctaagaggagggctggtgtgggaggagttcttctgccatgtggaaagtggacacttcactgttcatgctagtgttggccacctcgtgtcattatatgccactgggccccacctggattgtgaagactaaaa

SEQ ID NO: 30920 - DNA, 1009 bp, Homo sapiens
acaatttctaatttaatccttttgtgatcatagaacatactttgtgtgatttcatccttttaaacttattagctcaagatgtggtccatttcagtgactgttccatgtgtatttgagaagcatgtgtttcctgctgttgttagatgtagtgttgtatacatgtcatttgggtcacgttggatgataatactgttcaaatcttccatatccttgttgatttttttgtctacttgttctatcaatattttgagagcagatcaaagtatttgactgtgattgtggatttatttatattcctctttagtctcagatttgctttatgtatttaggagttttattataagtacctatacatttagaattgttattcttgaataattgtcccgtttatgattatgaactgcccctctttatatctggtcttattttttgccttgaattcttctttaactaatattaatatagctacaccagcttttttatacttagcatttgcacaatatatctttttccttttttccccaaatttttgtgtcttcgtatttaaaagctatttcttattaataacacgaagttaggactttgccttctcattggggagtgtgataggaagaataatggccccccaaagatttctaccttctagtacctggagcctgtgcatgttttctctcacatggcaaaaggaactttgcaggtgtgattaagttaaggatatgtgatggggaggttatcctttgttatccaggtgggttcagtgtaatgtcaaggtccttatgagggaagggggaaggcaggagagacagaaaagaagatatgataagggtagcagaagtcagtgtgatgtgaggccatgagccaaggaatgggggtagccgctagctagaactggaaaaggtaaggaaatagattcttctctagaacccccctgataggtacagccctgccactagcatgattgtagtcaaataagacctgtttgagacttctgacctttagaatggtaaga

SEQ ID NO: 30921 - DNA, 1063 bp, Homo sapiens
atgcattttgttttcaaactctttagatagtcatttagtcaaatatgtttttgcaaatgtaaaaaccaactacccagcagcaccaaggcagggctggctgcctagcctttgtgcagatagtggtgccacccaactggacggccctgcctcctcccacaccctgccagtggagtgattacggcagtagatttccttgtcgatcctgtttactcccagcacactgtggaattccctccttgtctgccctcacatgacttctatccatctaggttaaatgctgttctgtactttgcagccatttgaagctctctaccttcctttctgctttaacaccctctccctggcctcaggttggctccaggggatcccatcctggtctgcaggccctgggtctaggtaggatgagatttacctttcacgtaccatagcataattttaaaaattgttttttacacatcactttaaatgggactttgatcttttgcctttaactgttgatcaggcgtttcttccatgaagtttttcttgaataatcacatttctctgaacactttttctgttatcttcttatataccaaaacacaaacccttccctcatactgtctcctacagggacagtgttacagagctgcctttcacccctggttagcccctcctcttacaaatcactgggtacatttggttagccctgtagtcttcaaaaattcctgtgtgtgccctttccaggaaactataggctaaaaccccttgtatgtgtctcctctggggctcccctgtcaaggtccaccatagaggtgggtcattcccacccaaacacttgtcttggccacttgcagtgagaaatatttctgggatgatgctcagcactcccccaaagactgatggctgatgtttagtattcagtgtgaatcacattgttaaaaagcctgtgcggctattgctaattaacacagctatacgcttatctgttgctttactctttgcaaagtctgtgtgtgtgtgtatgtatacatatatacacacaactacatacatcggcagcatacacacaccccagtagtga

SEQ ID NO: 30922 - DNA, 1025 bp, Homo sapiens
aggtcatctgtggcagaaagtggggcacagctggagtcctagccaggctcccggggaggggcagttcccctgggcccagcccagccttgttgaggaggggacggggagcagagctgcacctgacagtgattttgcctgtctctgccccagtccggggacacggatctcccacctcaaggcagggcagtcctggcccattcagcaaagatgctgaggtacacagagcatgctgatgcgtattctagggccagctgggagtcttggtttcccagcctggctgactgtagggagtggtcagaggctgcctgtggttggaggtggtctccaagggggtgccacagaggtgactgtgggaagcacagaggttcccttggaagggcacctcatatggttgctagcctggagagagggggctctggagccaggaaggaagtcctgtgtaggatgagggtggagagggagcggttgtggctgcagaaacttccccctaagctggcgccctggtggctttgtgggcgtgaggcttgggaggcctggaggccgcttagctgggaagcctgacggtgccatcacctaacagtactcctacgaggggaacgatgtcagcgacctgccagtgaacctgtcagtcgtgtggaacggcaactttgtcattgacaacccacagaacatccagggtgagtgggcgccccggcggggtgggcagtgggcgggcccgagctgaccgcacccctccccacagcgcacctctacaagtgcccggccctgcgcgagagctgcggcctctgcctcaaggccgacccgcgcttcgagtgcggatggtgcgtggccgagcgccgctgctccctgcgacaccactgcgctgccgacacacctgcatcgtggatgcacgcgcgtcacggcagcagtcgctgcaccgaccccaagatcctcaaggtagggcccccagccctgcccccacaccccatgccccgccctgcaccaccgcacaccctacgccctgtgggatgcctgtaccccagcct

SEQ ID NO: 30923 - DNA, 1033 bp, Homo sapiens
tgtcaaggcggagggagatggtagacatgcactcctggtacccagtggatgggggcattgagttggacttcctttgagctgctgcaggcccgctgcaggggttgctgttcaaagggcccagtcacggagagggtggcgtgagcagcccctctcattctgcacccagccgcactcgtaacacctttgtcatgtcggcttgcaggggcttctcaggctgccacagggactctgtggccaaggctgccctgatggcaacaggcagtggtggcagcacccaggtcgtgtccattttgctaaggacaggtgaagcttgggaatgacccgccgagctgaggagtcagggcaacttgtcacttgccttccaggcctgtcctctgatggggccctgcctcaccagccaggcctggacagcccctcactggtcagcttgggggctggggctgggtgcttctctgtggtctgagctctgtgtgctccctcaggtgcaggccaatgtggagaagtcgctgacactgttcgggcagctgctgaccaagaagcacttcctgctgaccttcatccgcacgctggaggcacagcgcagcttctccatgcgcgaccgcgggaatgtggcctcgctcatcatgacggccctgcagggcgagatggaatacgccacaggcgtgctcaagcagctgctttccgacctcatcgagaagaacctggagagcaagaaccaccccaagctgctactgcgccggtgagcctggggggcactggggttgggggaggcaggcccatgcctccagctttggacaggttggtctagcaggcccagagacgttgctgtggcagttcccaccgggcaggggtgggaggactcacctggcctctgaggctcagctgccacctccctaggtactgatagtgaggacccaggctggagtctccatacacacaggcctgggctctgggcgaaggactggggtctccatggcagcccctgaagcgcctgctgcccactcatgtgggtgcctttcgagacctgaccttc

SEQ ID NO: 30924 - DNA, 1012 bp, Homo sapiens
ggcagtccctgaggtggtgtttggggcacagagggctggtctctgcaggaatgggtcccctgggccggagctgagctgcaggtctcagtgcaggagccatgagtgcaagccagcatgcaggcctaggagggtggtggctgtgtggagtgggcccctgagggcctggtcacatcttgcccttgtgcaaacgagtgcgtttgagcacgcctatctcatgatgctctgcgtgagatgcaggtggtgggggcagcacatctctggttgggtggcaggggacggccttcacttaaccatgggccctgcacctctgtgggcctcgtttccccgtctgcatggaaagccatgcccactttggattcggagctgggagggccacaaggtcactgctcaggagggagcagaggcctatctgagcagcgcctggactctcgcctgcagcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggtaggtggagggtgcaggggtcgggggcaggggcccgggggcagcctggactctgctcatgtgcccacctggccactcacctgcaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgaggtgaacaccgtgggagcccacaggctgggctaggagggcttgccggcccctgccagagtcacctgctctgccccgccctgccactcctccctgaatctctgggctgccactgaccaccttcact

SEQ ID NO: 30925 - DNA, 1023 bp, Homo sapiens
aggggagcagaggagcagccagagactgcatgtattagggtggggagtggggacaaaagcctggggtcctggggctcaccagggaaaggggagctgaggctctctggggagctctgctttaaaggggcacagaaaccccagggtgtgaggactgggtggggacatgtcagcagcatggccaggcagccaagggatcagagcctgctgttttagggggtgagagtaggatgatgacaggggcagggctcattctccatattggggtcctggagggtccaggctcacaaccaaggtcctttggccaggggtagatggggttgaacctctggcacctactctggaggcatctgccctgggcctgctgagtgcatggaggctggtggcccggcatgctgacagttctcctggccctgcagatcctggcagccctggagaaggatgagcaggcgcggcggcagcggctgcggagcaagctggagcaggtggtggacacgatggccctgagcagctgagccccagctgtgatcatccagcatgatgcagcgtgaggacagctgagcagggaccgggacagccctcaccgcatgcgtgtggagtgtccggtggtgctcgggccgccgcagtgcagcgactgcccggccctccctcccctgcctcacccggtcgggtcccggctcttcctgtgtggaggtgatggtacctgccacaccacagctgcgcacacagctgcttgctcaggggccgggacagcactgggtgctcaggctggccaaggaccttcattgcctggcaagagctgcccagtggccttcatgggagaagggctgacctctgaggggctgaggggtgaggccagggccctccagggggaggggtagccagcttgggctgtccccttgagaccaggacaagaggctgggggtgtcagcattcccagctttccaagctgcccccaggcggcagagtctgagggtcccggggcccggttggcagctggagaaagaggcaaaaagcccgtagccg

SEQ ID NO: 30926 - DNA, 1067 bp, Homo sapiens
ggctgtttttttcagtagcccctagcattggctgggattcctgttcctgggtgcgcctccacctcccttctgatgtttcctggctatggtggggtgggaacctcagtttcccccaaagtcttccctggatgctggcttcaggttgaagtccctggttcttccagttcctcacgggttaggtaggggctcctgcatcaccttcagaatccagttccaacccccactctccttaggccttgtgctctgctctgccctgccaggctgcccttgtccatgtgagtagcatgggcgggtggtggggacggcagtggtgatgaagggggtgcaccacaggcctcatgaagcagttcccacatgggcgtgtggctggggcgtggccaccacagagcacatggctgtgtctaggcgcaagcactttagcagtatctgtttacatgcgcaaggatcaagccgactacctgtgctgtctactgggacagcagtctccgagctactccgtacctccctctgccaggtcgtggagttaggccccagtccctacttgtcactggttcccactgtgctcctaactgtgcagcacctgggagctctggcctggggctggaggccctggtaggagctgcagttggaggccgttctgtgcccagcagcggtgagcggctcccatgggccctgtgtctgcagggagccagggctgcggcacatgtgctgtgaaactggcacccacctggcgtgctgctgccgccacttgcttcctgcagcacctcctaccctgctccgtgtcctccctctccccgcgcctggctcaggagtgctggaaaagctcacgcctcggcctgggagcctggcctcttgatatacctcgagcttcccctgtgctccccagccccaggaccactggccccttggcctgaggggctgggggccccacgacctgcagcgtcgagtccgggagagagcccggagcggcgtgccatctcggctcggccttgctgagagcctccgccctggctttctccctgtctggattcagtggctcacgttggtgctacacagctagaatagat

SEQ ID NO: 30927 - DNA, 1814 bp, Homo sapiens
ggagtgcagtggcacaatctctgctcactgcaacctctgcctcccgggttcaagcgattctcctgcctcagcctctcgagtagctgggactagaggcacatgacactacgcccagctaatttttgtatttttagtagagatggagttttaccatgttcgccaggatggtctcaatctcttgacttcgtgattcatccgccttggcctcccaaagtgctgggattacaggcatgagccaccgtgcccggccattttctatttttatacagatggggtctcactatgttaaggctgttcttgaactcctgggctcaagtgatcctcctgccttcacctcccaaagtgctggaattataggcatgaaccaccatgcccagccatcttaaccattcttatgtgtatggttcagtggcattaagtacattcatattgttgtgcggccatcaccgccatccatccacaaaagtcttttcagtttgaaaactgaaactgtctcggttaaacactaactccccattcttcccagcacctagcaaccatcattttactttctgtttctgtgaatttgaccgctcagtgagtggaaccatataggatttgtccttttgtgcctggcttctttcactcagaatcatgtcctcaaggttcatccatgtgccagcacgtggcagaatttccttctattttaaggcttcatcgtccatcatatggacagatcgtgttttgttcatccattggagatcttttctgagccttctgtgtttctgacctggaagcgctgagcctacccacaatggggctcctgaaccttagggaacaggcccagttcctggatggggtttggtgcttagggttttcctttttggcagtaaccacatctgttttggtgctccctcagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatggtaggtccagttgtctgcctgcccgagggactgggaagctgggaaggagtctgggaggggagtagaaggtgctggggatgaccgcagtagcaggtgtctcttgcctccccagacagcgatgaggaggacgaggagcgccctgcccgcaagcgccgccaggtggagcgggccacggaggacggcgaggaggacgaggagatgatcgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaaggtgtggcttccctacgcccccgcctcagcccctgtagcgcctccctaaatcctccccagaaagttgtctgagccgagtgaacacgtgaagcacagggcatatggctgagaggtctgtcagagaaaccaaaagttttgagttttgcatcagggctctcctgctggctatgcagtgaccacatctgggccaccaaagcgttttttgacaagcttgaaaatggacagattttatataaaaatctggattactactttgatctttgtaataggaattgactctttttttttttttttttttttttgagacggagttttgttcttgtttcccaggctggagtgcaatggcacggtctcggctcactgcaacc

SEQ ID NO: 30928 - DNA, 1050 bp, Homo sapiens
tttagtagagaaggggtttctccatgttggtcagactggtctcaaactcccgacctcaggtgatttgcccgccttggcctcccagagtgttgagataacaggcgtgagccaccgtccccagccaggaattgacttttaaaagggacatgtagatcttgattcctgcaattccttccactgctttttgtcctgtgtttgtcagtttcttcctggctcttgtaaggcgtttcatgtttgtagctgtgtaggcactctgctcatatttaatttaaccccccagcaactttgtacactgtgtgacatgcccattttacggagtaggaagttgaagctcaggctatgtcacagctgaagtgtggtagacctagaagtgaaagctgggctttctaggtcaaaatcaatggtcggggtgggtaggccttgcttctcacacaggcattgttgcagcccagcccaggcctcatgcttagttaactctcttcccactgtgcccccttctagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggtgagctgagggcaggtgaggatggcaggtccgagctcagtgctgggtgactcggtcgtgattcctgaagagcgattgtggtgtgggcggggagggtgcagccagcagcatcctcatcgcaggtgagttgtggttgcacaggagtgtgatgggagggatcttcccgggctgggggctgggcccaatttccaggacagtgtgttgggacactctcgtctgcagcctggcctcaccctggctcacggcttctgatgcaccctctgcctccgcaggcagctgcatctgaaccagctgatccgcaccagtggggtggtgaccagctgcactgg

SEQ ID NO: 30929 - DNA, 1078 bp, Homo sapiens
catttattgaatgcttacagtctgttgagtccagttctgtgcctgtagtctgacagcaggggagtgaggtgagtcctgttactgccttcctgttgtgcagaggtggagacagatacagggcagccaagtaacttgtctcagtttacacgcacagcttgtacagcagagatttgaagccccttaatcggcctctccacccctggatattttcctcccataaatggaggtgatggtgtctgaaagtgcactgtaactggggcgctctggaaacagcctgttctcacaccactgatggctcactggacacttcctccttgcaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaag

SEQ ID NO: 30930 - DNA, 1764 bp, Homo sapiens
cataattgaggggtctcacttcctccagtgatgagagggctctcagacctccttcggggactccaccaagaagactcttataacgactcactagaaaaggagtagggggacccttcctagtgggttgttgtgggatcttcttggtgaaatccccagatgaggacaagcaagcacattacaaacacagtggagaatatatacctcaaactactcatggctcttttggaggaatgcaatatacaaaactttctacattcctgtgttcattgagttttggtgataaatttgtattattttatcatcataaaggaaacagtgactagccttgtccctgtgtcctcccacagtctgctcccctggcctctccatcatgacctgatgacccctgccctgtcagtgtattgtggttcttttatgccatctgcccagtaaatactgagtaaagcaatgaatgatgaaacaagtgaatgaacttttcatctctgtccttagattatgtttttcctgacttaactgagaaggcaggttccattgaagacaccagccaggctcaagagctgccaaacctcccctctcccttgcccaagatgaatctggttgagcctccctggcatatgcctcccagagaggaggaagaagaggaagaggaagaggaggagagggagaaggaagaggtagagaaacaagaggaggaggaagaggaggagctgctccctgtgaatggatcccaagaagaagccaagcctcaggtccgtgacttttctctcaccagcagcagccagaccccaggggccaccaaaagcaggcatgaagactccggggaccaggcctcatcaggtgtggaggtggagagcagcatggggcccagcttgctgctgccttcagtcaccccaactacagtgactccgggggaccaggactccaccagccaagaggcagaggccacagtgctgccagctgcagggcttggggtagagttcgaggctcctcaggaagcaagcgaggaagccactgcaggagcagctggtttgtctggccagcacgaggaggtgccggccttgccttcattccctcaaaccacagctcccagtggggccgagcacccagatgaagatccccttggctctagaacctcagcctcttccccactggcccctggagacatggaactgacaccttcctctgctaccttgggacaagaagatctcaaccagcagctcctagaagggcaggcagctgaagctcaatccaggataccctgggattctacgcaggtaaagtgaggggcatgcgggccaccaccctgtaccttcttcacagagcctggccatccccagggctagtgtggcatgggggcaggatctgccaggttgaggagggaggccctttccacagcacgtagaaccccatggaacttgtggggatgcaaacctcagggccaacaatgggtgttctccccacacttctgtgcaaaggcctttggagaaacttggtggcctggcctgggtttcatttgttcatgtgttaccattgccacccttagacatcttttgttttttttttttcccgagatggagtctcactctgtcgcccaggctggagtgaagtgggcatgatctcggttcactgcaacctccaccgcccaggttcaagcaattctcatacctcagccccctgagtagctgggattacaggcatgtgccaccatgcctggctaatttttgtatttttagtggagacagggtttcaccatgttggccaggc

SEQ ID NO: 30931 - DNA, 1047 bp, Homo sapiens
gggccagttgagaggagagtgcccatcgataggtgtcctcatctgcaaggggaggcagtgactctcctgggcgcacagggtcccgtgggtgaagcagctggtcagcctagcactgctgactgctctgcagggcaccagccccaggacaggtgccagaggtgcagggagtgagggggctgctagccccaccagggggcccctccctggcaccaccagcccctttccggcgcaggcactgcagggcctgagcacctgaatacctcaccagaggcaggccctgcgttggtggtgcccaaggatcaaggagaggctccagcagcctagaggcctccccaggaggaagcgagcagagccctagcgatgctccctgcccacctcgcaagtggagtcttcttagggggctgttgggggatcgatgacgtcagggaggccacggggctttgtagtgccaacgactagtaggtttattttgagaaaggagttgagctgcagcaacagaaaagaaggatctggcacctgtggagggtgccgcgggaaccccctgggtggggttgcacagacggccgcgggcctggcgctgtccgggggctggctcgctcgcccatggcctctccccaccccgcctcagtcgcacggcgaggagctgcgcttcgtggagaacggctgccacgacaaccccacgctggacgtggccagcgacagccagtcggagatgcaggagaagcaccccagcctgaacggcggcggggccctcaacggcccggggagctggggggcgctcatggggggcaagcgggaccccgaggactcggacgtgttcgaggaggacacgcacctgtgagcgcagccgaggcgcaggccgagtgggccgccaggaccaagcgaggtggaccccgaaacggacggcccggagcccgcaccagccccgcgcctacccgggccgcccccgcggcctggccctcggcgcgggctccttcccgcttcccccgacttcacacggcggcttcggaccaactccctcactcccgcccgaggggcaggcctcaa

SEQ ID NO: 30932 - DNA, 1056 bp, Homo sapiens
agagagagagagagtgtgtgtgtgcgtgcgcgtgcgcgcgcactataaagcaatccccatatctggtggcttaaagaagaggggagtttgtttctccttcacttctgactgaggtgggtgccccagggcaagtggcttgcggaagatcaggtcatccctccatcttgcccctgtatgcctaagggtgaaggtcaaaaaccttttctctgaaggtgagtgtttcaggttctgtgggccatatggccctgttgtagctactcaactctgtagcgcaaaggtagccagagacagtacagagatgagtgggtgaggctgcattccaataaaactttacttgcacaaacaggctggatttggtccacaggccgtagcttacccatcctgcctggggcatcgcgtttggccatggagattgggtcctaggcaaactcatgctctaggaggaagaggaaggcagggcaagcaatgctgtttttgtagaagccaccggaaattgcaccacttctcatgttcccctggagagaacttcgtgcctacctgccaacaagggaggcttggaaagtcattctgtggccagggccctgttttgtgggggaaggggaggaagcatgctgggagacagagggcagtccctactgctgctctatctccagtggcagctcccttgtccatccctccgcgcggcctgacagcccctcagcctccatctttcccaccccctctactgggcatctcctgcagctcagcccagctctctggcccctgtagcaggggttacctttgcccaccctggagaagctccctcttcaaggagcctcgccacccaaagggcaccttgtctcagagtgtggcttgggctcttaacctgggttgatactggttgagctgtgtgacactgggtgagctttgtgatcttgggccagttacttaactgctctgtgcctctagaacatggggatagctctcgtcgtcacttcctaaggccttgtgcagatgcatgggttacccaggtaaaggaggtggcatggcacatggcacatggcttgtaatgtggtc

SEQ ID NO: 30933 - DNA, 1050 bp, Homo sapiens
tgatcattactatcggccagtctatcgtgtatgtgatgaccgggatgtatggggacccttctgaaatgggtgctggaatttgcctgctaatcaccattcaggtaattattatgctaacatctccctttgagtagcccctcacacttacctacaattctcacataacgaatctcaagcacacctaaaaggaactcctactgaaaggaagcagaagcctaagactctgggttagccctctgaattcagcagagaaaggctttactgaccgctctctggggctgaggatgtgatctcattccgtcttcagcgtttatatcagagaacccaattactgaaggacggaaccatgtccgtggggagcagtaacacatagtcttgtatttttgaatttttacagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggtaagggccctgtgctcccctggtggcgacagctttcagcaaaaacaattgagcaatgcaaagcagaagacaaaaatccccccattccacagaaaaataatgtcagttttaggtttatctcttctggtgtttgggtccatctgcaaagttttaaaaacacaaataggcttgtaattatgatgatacctaacttgcacttttcatataaaaatatctcctggacgtttggcacgtcagaatacacaatcctgcctcacttttcttagcacagtataagcttatattgcaacgataaagcaacgttaagtcatttccaggtttttttatcgttaacattgaaaccatgactgtcctcatatgttcatctttgtatattttggcagctgctctcagtgaataagtttctaaaaatgaaattcctaaaccaaagcacttggtcatgcaaggggcagctttctgaaaaaggcctgaacttggagcttagcacctgcgttcaaat

SEQ ID NO: 30934 - DNA, 1613 bp, Homo sapiens
atctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaa

SEQ ID NO: 30935 - DNA, 1049 bp, Homo sapiens
aaaaaacaacttttgctgttgagagagaagttgactttccctctttccatatctcttgtgttgtgatgattcctctcttgtcttgaggccttcaggaagactaaaataatttcctttgtctctaacctacttcctgaggatatttatttggtgccatgcacaggtgctgcttaaagataaacctgacttttttctttcaaaattagtgcttgaaatttgctagcattgccctgtctggcagcaggaacttgccttgcttggcctggtggctacatcccttaccatagatttatttgggttgcttagagctccagagggtcagtggcttgtccttggtcatttgacattggcactagagctcagtcttcccagatacatgacggtgtggcacttgaggaaaaaatggccctgtttgtggtcatttccaggtgagtttcaggatctttcgccatgaacagtaaaggccctcgggtttgtgttctcagcattctctattttctaaaaagatgatccaggggacattcagagatgatcttcagaacttacgctctagagaggaaagactttacataagaaggactccatttcttcggcacttgctgtctgacctcacagacaagtagaccacaggaagactggaagggagccctgaggtgcttacagcacagccgtgtttcccatcagcacccagcccttgcagagagggctgacagacactttggctggaaaaaacagtgttttaaaaaatctctgcagtggcttgatcagtactttccagcagaactttctgtgatgataggaatgttctacagtggcacggtccaacatggcagccacgagcctcatggctgttggagcacttgcactgtggctagtgtaactaaagactgaaattttagttttatttaattttaattaatttaaatttatataggcacaggtggctagtggctgctgtatttgacagcgcagggctggatggactgaggaatgactaggttctgtgtccctattgtagagttgggtttgagctgtcccctacatgtgat

SEQ ID NO: 30936 - DNA, 1010 bp, Homo sapiens
tattcctttgtatatatattttcccatgttttaaaagtatagggtaagtatgtaagtatctatcagtatatttatttatagccatctctgtagttctgtattttgctttggcttaacgtgtatttttcaagttattacttaaattttgtgagtattgttagtgataccatactgttctgattctgtttaaaatgaaggacattttttttccttatctcttatagaatgaactagctgtattacactgtttgcatatttctagaattgacatttccaagggacagtttagaaattctcaattgtatcacaaactctgcagtgattgtattttgcaccttacccagacatggtaagaaatacaggtctggcatggcatgatggctcatggctgtaatcccagcattttgggaggctgaagctagagattgtttgagcccaggagtttgaggctacagtgtgctatgattgtgtcactgcactccagcttgggtaacggagcgagatcctgaaagaaggaaaaaaacaaatacaagtctgccataccttatccataaatttgaaaattcaaatagctctgtaaactgaaagcagttttttggagtttggatgcaaaaccccatctgaactgactgaatcttttatttttcccatttagtgtgaatatttaatgtttgattatagggaatggccccatcgctgctggggtattatataatgtatgatatatttatgtatgtacagaattatcttttggggggataattattttaatttattcatcattttataacttaatattatgaagcacttcatatataccttctttttactaagcaataaaacagactttttctgtgacattaatttataatagaatattcttttgtgtgcaaccatatcatatttttttagaaactttttttttttcttttttgagacagagtttcactcttatcacccaggctggagtgcaatgacgtgaattaaatggaattatatatactttatga

SEQ ID NO: 30937 - DNA, 1050 bp, Homo sapiens
gcataaacaggacgagtgttgcgagttcaagccggccaccagcctccccaggcagtgatgggctggcgctgccacatcagccagctccttccagggctgccttcctgggagcatggcagccacatcccggggagcagcagtcctctgctagcacacatctgcagcgccagcttccatccttggtctcatgttttaatagcaaatctgacaaattctcattgaccctcagtgggggttggctgcccaccacaccttctgcattgcctcatgggtggtatttctcccaaggaaagccttggctagggtgagtgggagggagagcaaggacgctaggtccgagacctgggttgtggcagttgctgcattacttataggctgtgtggcctgggcaaacctttcgtcttccggatcttaggctcctcacctggaacatgggattgatgatacccctggttggtgataccaggtgaagggtctggggagccttagctgtgacgggaagaaagtgcttggcatgtccttggcatgtagttggcgtagtagaaaatgcagtctagctgatttggagggtgtgggtaagctgcttaatctctatgagcctgttttcttgtctgtacctgaagaattgacacttcagatacctggcccagtgccattcaagacatggtagaggtcacaggcatgtaggtcctgaacgatccagaggaagaaggggctctgtagcccaggaactgccttacacagtgccagggcccttggggatgctgagctcctgcttgtgggggagtcaggtgaagctgggcaggacccagcagggttgaggtcatgtctcacggggagtgccgggccacgtgagggaagaccagtggacaggcacattaagttttaaactcacatacttactttaatgtacgttagaaaaaaatcaaataagtagtacatcaaatctgtactttttatggaagtttttgctttctttttggttttatagttttagtatttaaaaaaagtcaatttaaaggaaaatattaagtaagtaataaaccaggc

SEQ ID NO: 30938 - DNA, 1033 bp, Homo sapiens
tctagagcagcatggttggatatagggaaggggcatttcatggagggcaggcatgaacagggttcccccaaatgaaggcaacctgaggtttcaaccccccagctcattttacagcagtgtgtctattacttccttctgcaggggccaggggtattagggaagagtctcctgaccagaaaggacaaaacaaaagaaaggacttggctctggccaggttccagagctccttggatctagtgggaggagtcgaatggcagggccccaccatatccaaggagccctggaacctggccagagctgggtgttaggatgtcccccagacactgtgagtcacagtcccctcctttacctgctgtcatgtcctcctctgaagaccattggtcccagaaaaagaccacttgaataaaatctagtttaagccagggactaaaagtgcaaatcttcaaaaataaagcacaaaagtgtaaaagtagattcagtttatatttaacaaaattaagattactttggtgactgtttgcagattctttgctagaacagaaaatgaatcagtactaaatttctttccagtctctgtgcttcctaagtcagacctctgggggccactctgacctggcatcccttccactctgggagaagacatgcttgcagcttgggagaggacctgggagtatgaaagaggtgtcaaaagagggctctctggggggtggggtagactttgaattgggggtacctgaggttctagagggagaaaaaggtttttgataagagtcagtggctgcaatgttagggctgagggcatggagaagggctgaggcagagaagtcagtagtggtaaggaggcagggatgttcgagtggggtcctgttctgagctttttggccaccctctttgtccttataaaggtggaacttgcctatcaggatgccagttactgatctttagtacttgggcacatggcaggtgcttggcagatacaaatttaattctccttttacttttgtgcacctgtttttccccagcctacttttta

SEQ ID NO: 30939 - DNA, 1027 bp, Homo sapiens
agaaggcagagaaggaaaccaggaaggttttgggaaagccagaggaagccatgctaggccctttgagcagatcagcccacccttggttgtcgccctcaggagggacctcgcagatcaggcccttcctctgcagcaccatggccactgctcaggttcaaactcccgggccctgcagggccgcttctgtggcatgctgctcctccccttgcctcccaggtcttcttcttgagtccagcccagccctgctgacagaaaagccttattgctgtcctgctcatctgtctgtgggtcctcattgtctccaggataaaatctaaagtgcatggcacggaaggcagagcatagctcttcattatcacctctccagcctcagtttcttgtcttaaagcctcataagacctcccactgctctctgtgtatcaggcagtactctggtttcaaaggacagaaacccaacttcaattgccttaagcaggataggaaacagataggctcagggctggagacgtctggatgtcatcaggagtgctggctggctccagaactggctctgccctgtcgtgtgtgggccacacactcaggtggcaccttccctggcataatccccacagctctggctttccattttctccttcaaatccaagatgcagtgctacttgtggttgactcctgaacatcacgctatcgaaggatccgtcctgacagtggaacacccctcccctggcagcggcttgttacctgactctggccaatgatatgtgaagggacatgtcctaggggtttggggaaaagcttttctgctttttggaactcaacaggaaaagacagcttttctccttcactggacattgaagggaggaaggatgtgacgcctggactcaggggctgaacggccaccttactcccaggctggaggtttgcagaggctgggaggcaggagagttgcccagaagcagagcctgcacctgagggctgctgtgtgtctgccccgcctcagaacttcgtgtattgtgagagctctgtctcc

SEQ ID NO: 30940 - DNA, 1070 bp, Homo sapiens
gcactctccggttctcagctgttttgtagttgacagtgtgtgggaagctggggcgttcccctgagttagtggtggtcgtgggatctgagcaggcagttgcagacctgatcctgctttggctctggagcctgaatggatttctgacaggagaagctgaggctgtccagcctgccttgggaacttggctgcttcaccaagtgggagctctgagactctcccacaggtcccgtgctccccacgtgcccttacagttacctgcccaccagggcccagaggaggggctacctggagcaagggtgcctggactgggcctctgtcttcccctgctgtgagcagagttctcacctcctgaccccgacttggtctaaccctgtgacccacatgaaatgccagccactggtggtgggaagtgggtggctggtctcttccaagccaggagtgcatcagctccagcctccttccctgctgccggcctcggttcacagggagccctttgaggggctttttgatgtgcaccatggatgtttggcttgaccaaatttgtttgcttaagcattgctcttgccagttcattcggaccttctctttcttttaaaaatatgctgcttgccaaaggttattttggatctgtttttgtttatcaggtagaattgttccagcgcaattgaaagcagacccacatgttgacacgcactggagctgcttgccaggacacgtgcacatgtgcacacgcgcacatgcagaatatgtggcaggcatctcatcgtgagccctagagtgtacacagcttaggaagggggactggggaagctgcccatttcaccggggacttggtatgtgaagattttcatcatctaggtgccagcactgacagacttcaggtggggaaaatctagggactgttacctcctgggagaggcaacctggtgagtctgagtaccttggggttaggctggctctgccgctggttgcctgtcatccttccctgctctggcctggcttccttctctgtgactgatctcccgacttcacaggctttgtgccaggctgtggctgacggccttcgggaa

SEQ ID NO: 30941 - DNA, 1027 bp, Homo sapiens
aattgatgtctcctgccaacatccaattgggggagtccaggaaaagggcagttgtctgggtaaccatttgtgaaagccaaggacagggcaaaatggagatgcaaggaagggtttatcctcctggcaacagggttgcactcatgtttctggtcgatgcagctttgtgcttcttgcctttccatgccatgtgggagccacgggtggcatgttgcattcagttagtgaccaggctgcatcttcagagcccaggcatccctgtcaccatctaagctagttggtcagccagccaggtctggcaggtaggcctcccactcccagagtctatggatgccacacccaggactcaggcatgaggaggtccactttgggaacctgacttcaccgctgcctggtaacggggctttggcaagtcaggctcttggcatctccatttttaacagggcacttgtaaccaggacatcctcatgagcacagcagagaactgttcccgggctctcatgagatgtgtgagaaggcccctcatgtggacatatatgaatgtagcacatttttgttagtttactttgaaaaggtaatactggcagatggttaaaaaggcaaaagatgccaaggttatgcagtgattagagttaagtctccctgacaaccccctgtcttgggtccctggtctctccctcctaggcagccactgctgctgccattctggtgataacctctgcatgtggaagcttatgtatctccccctgtttcttacaccaggccctacccagtgtgctaccccttgcttttatctcctccactctagatgcaagatggttctacatctgtacatgtggatgtctgtttagcctctgcctaggaatctaccgtaaggacatgctgctctctctctccctctcattgaggcatagagtagttgtttggagagcacgttaaccaactgttggtaagaacagctgtgtgtatcctgtctgctttgaggtttcagtggctcaatgtccttgagagcagtttttagggagttatc

SEQ ID NO: 30942 - DNA, 1059 bp, Homo sapiens
tgtcacagtgatgattctcttttcttcttccctatttcttcttatcattactgtcatggacccaaatgccttcaaccactccccctccagcacccacggagggagagcgaggcccaggctcagctgctgggcagcttccctggggcccctgtctctgcccttggcttgctggtcatacccttgtctagccttgctgatgctctggtgccagcagccacaggccagtgctcctgcaggatgtgagtccaagtgatgttgcccctgcacagctgcactggggtgcaggggatcatcagttgagtgtgacggacgttcctgagcatgctcctctgtgccagggacggagattagtgccacccagccccacccccccccacccccgctgatgctctcagtctggacaggaggcaggagctaaaggcatggctacatagcaagtatcggagataaagtgggggtcaagtggcgggggctgtgggggccaaggtgggcaggcagcatgacctgctctagctggagtaaggctggaaggacgaggaggggcctggcagtcaggaagccagctctgcccaggcacagggctgggaggcaccatcgggcctctaggccatgagttggacttggcccaagcttagggtgctgagggcagtgctgaggagtgctcaggagccagccagatggccacaggcctgtgtgcccatccagcagcctgccctgaggggcgggagctgtgggagccacacataggagggacatggccagtgctgggctttcataaacctggctgaaggacagggtagccttggaactgtggggatctttctgtccaccttggatccattcctttaagacccagacccacctgggctctttgctcaggcccagggcccacaggtgaggtactgttcactgctccatggcggtgatggcttttctggctcagccctgaaaacagagctggatcccttggcttacctcccaaggattccttaccccctaaaaagcccagggatgtcattaaaaacaaagtcccagttgtatagaaaacagaagaatcca

SEQ ID NO: 30943 - DNA, 1022 bp, Homo sapiens
acacggggtgacttggcctgcctggcagcatggcctctggctgggaagccagtatgggttctgggaagagcctggatgtggagtgaagatctggtctgagcagggtcaagattggagtctgagttcccactgcaccatttaccatctgagggggccttgggcccgcaccttggtttctctgtggaggcgggaataagattgagcctacaggcagtttggagaagagcaggtgagggagaccgctgggggcctggcatactgtcctggcacgtggtaaggtttccagggatgtgagttgtcaccctcctttgcccagcacagacccccaggctcagcaccacctgctgagtttgtgctggggcctctccgtgggctgggtcagagggtgtgtgtttgctgctggagagcccttggattttgtcagtgaactcatccttcaatcacttgtgcatttattcagcctacactgcatcatgttcttctgtgttgcaagcattgtgcttggtgctggggatatggagcttacagttgtaggaaggtacaaacaataaacatactaaagaaatccctgtcagatgggagtaggcaccacgtagaaagataaagcagggacgagatggaattgctgagcatgctgctttggatagggtgatcagggaaggacagagggagggaaggagccacatgggtagtcagggagagcatgccacagcgagggggaagtgaatgttaaggtcctgaggtgacagtgagcttcaagtgcatttgcaggtcagttgtttggcaaaagtgtgctgagcagagaggtgtgcaggacataggccagggttcatactgtgcgctggggaccgtgggaaggactaaagcctgtgttcgtatgaatgggtcatgagccactatcttttttttagagaaagggtcttaccctgtctgtggaatagaatgtggtgatgcaatcaaggctcactaaagccttgacctcccaggctcaaaccatcctcctgcttcagcctcctgaatag

SEQ ID NO: 30944 - DNA, 1031 bp, Homo sapiens
gcacccagccatgggaggcctccagcggtgaagctctaaaattctgtcctgtcctccccacttctccatagtggctctgagtcctcacctcagccaaacaggagtctttgtgcatcgcttcagtttggctgtgggttgtcctcagagactggagcccacagggcccctctctggactccagggagcatgcagggggcatgagccagacaggccagcgtccagacctcagtccccaagggcctcgtgcctatgcctgcctgggctattgtgagctttctgggagggaaggatcccgggattcttccagctgggtcgggggccatactgaggagcactgatccttcccctaaacagctctggggccctgctggaccaggcagagggaagagcttatggtcttctcctttgggaactgctaggatcacgctgacctcccctgagctcccttcctgtagcccaaggcaaactcagagctggggtattcccagggcaggcaagaaccaagaggagtcttggttgggctgctggggtgggagtgaagggagcctctcggggtgctggggcgggagtggagggagcctctcagggtgctggggtaggagtggagggagcctctcggggtgctggggtgggagtggagggaggaggggtatagggacactgcctcagtccactagagttcacattccttcgtctggtcaatgttgactttttagtctgcctgcttcctgtttgtggcttttaagctttttattaaatatcactggtcagattcctccatcccacccaccaccttccatccctcccacccccactccctgctgattcctcccttttaacctttttgaagtgccttaattgtgaaagaatcttcaggaagcctgagccatccagtgccaggtgaagggagagagagtgcattgctagctgcagcctggacatgcagggtggggaagcctgggttttggtgccatgagaggtaaggctcccagcctgcagctcgtggacagggctgggttcagatgcacttc

SEQ ID NO: 30945 - DNA, 1046 bp, Homo sapiens
ggagtggtggggactatggtgacctggagagctgctgtgtgggtcctgccaactcttcactatatgggaacgtaggcctggggtctcattttatctaattttatttttatgtaatatctcctgattaaaaactacaactgtctgtgctaaacaaagcatgcctttggcctggtttgagccctagcaactcgtaactcctgtttgaattttagaaaggacacttggccctcaggttcacgaggtgaagctgaaccgtaatatgcaaacagtatgttttaaggagccacagacacttgcctcagagacaagggtcctgatgctagggctgttgactcccagaatgtgctgtgggaaatcagagggctgggggacggccccatccttcctgatatccaaggagccttcccagagagtcttgggggatctcaaggttggaaagccccgtatttacaaaacatctcccttcaaagaccttgccatttgcagaattgtacttcatgggaggataggaggcctgacaagctgccagtaggaacctactggggaattctgctggtggtgagagagtagttggaggaaggagctggacatggaggaggttcctgtccaagtcatagcatcacttgtaattcccaagggttgtagggtggagtgagtcttgttatctccatctcacaggtgggagccgggtagcagagagcctgagggctttgcccacggtctgtctgtgtcacctcacccctctccatcagctctgttgatgcccctagagagcagtcatgtcttcaaagaatctggagctgggaggcccatgtggtgcttggagaagcactgcacctgggaggctgcgctcccaaagctcatcttggcaagccgtctgtcccaccgctgccaccctcccctctgcctcagtgtgccaggcatcagcactcactcacagaggcaggctggatggcgggtgggacaacagcttccgcagcccctcctgttcccactttgcagggagaaaagaacaccttgatgactcccaactggagaagaatcat

SEQ ID NO: 30946 - DNA, 1049 bp, Homo sapiens
gaggaggaggaggaggagcaggagctggggtcctgattttcaaggtcagagacaggagggctctggcctcacacagtcactctgactttagctagctcttctttaccaagcactgactcttgtgtgtggaaagtatttttctggtatcagacatagtgttgggttctgggcacatggctcaaacaagacacagtccctgcaccccgggagttcacagctaatcacccctctgttcaacagtgtgcttttgagcccctgttatgtgtcatccttgtgttgggttctagaaagaccacagtgagccacagcccacatgacccctgagctcatggggctgttgggttggtgtactagtcaactcgggctatcataacagaataccacagacgcggtggcttaaacaataggcattcatttcctgtcagttctggagcctggaagtccaagatcaaggtgtctgcagggtgggtttctcctgcagcctctctcttggcttgcagacggctgccttctccctgtgtcctcacatggctgtccctctgtgcgtgtctgtgtcccaacctctattttgaaggacattagtcagtttggtttagaactcaacctaaagacctcatttcatcttaattacacctttaaaggccctgcctccaaatacagtcccattctaaagtctgggggttaggattccagtatatgaatttgaagggacacagttcagcctgtaacagttaggatgctggcactggcagactttctcctgagcatttgtgtattggcagccacatgcatgctgtgcacagaaggtgcacaatgccatgagatcttacagtaggaccccaaccgagtctgggcttgggaaggcttccttcggaagtggcattgcactggggtctgaggacaaattggagtctcagtgcccctggaggtgagggtgccacagtggtgctgctcaggctattcctgctggccctgagtatcacctccgcatcgaaccagccacctgctgtgtggactcctgtgcctgtaagcaagagccacatcctgtt

SEQ ID NO: 30947 - DNA, 1079 bp, Homo sapiens
gggaagggctcatggtcgggagtgagagttgaaggcccacctccttcactggccattagacctggaccagccccgctgcctccctgagctgcactcccctctgcagcatgcaagggcagtgctgatgtctatcattagctctggagggtgcagttggaaaccatgagtatgaagtgcccacccagggtccagcacctgaagatgcaccatcggtgcccagtgctgtcatcgactgtgtggctcttttggacgtgacaccacaccagacccccaggtcatactgctgctttccttggggcttcctcagaggctgctgttcatgttttcccctcgcctccaagggctgtgcttgtagacttgtgtaagcggaccgtgcttacctcaccatctcctactggtcaggtacctacaatttttcccactgtttttcgttattatggccaacattcagagtcatcctggagcttttctcaccatcaacctttgagtgtgggccattcagtcaggacacacttactcactctcagatttctttagtttgcctcagtgggtgagtgggggagacctagggggctttctactggggaccccattccagttcctggcactaattgtggctcaataaaggcacactgaataaaagaatgccagaaatttcactgagacgtgattttcctccatgtttatgattcagtgatcaaagttagaaattgttaaaaaaaatgaaaaacaataatatatttctcactgtatgccatatacttttctaagcatattatatataataatataatttactcttcacaacaaacctgaaggaattataattattgaaattgccattttgcaaatgaggaaacagaagcacagagaggtaaaggaaagtgctccaagtcacacagctcttgagccccagagctgagacttgagcccaggccatctggcactggagctcatgctcttagccctgtgttctctgcctctgactgttctcatttttgtccatctgttccacctggccctgagctaagggcccaacatgaattccagaagttcccattttggtttggcccagcctt

SEQ ID NO: 30948 - DNA, 1025 bp, Homo sapiens
cctcaaatcagaaatgcttccttcagactcctgggccttgaggcaagtgtcatgggaaattggatgccaaccaagcccagggcagacacgctgtgccaggattcagcagagcagggagcgtgcagggagaggcaaccctatgccctcgtctcagagcaggctgtgtgcgcccagcggacacggcaccagcaggagctgtgtgggctcggctccatgcaggtgcgcctacgtctatgtgtgtccatgtatgtgtgtgcgtgctcacgcttttgtgtgtgtggtgtgtttttgacaggggggaggtgagtgagaggccagcttcctgacagggcagttgtaaaacattcataaaacttttattggacttgccacccttccagataaatatttttcgattttatgggcttgttttaggaccccaagcttaatcatggctttgtggctgccttaaagaaattaaatattgttttggcaaaaggagccctcttcccctacccctgccaaaggcagcctgaactctgagctcataaattcctgccactctcaactcttgccctttttccctccgtagtctcagagccatactaggatgagcccgaaaaaaaaagagggagagagagaagaaaaagcaacccctactcttctccctccaggttccccaactcccctgaccctggcgggaaattcaacccagctcatttgtccacacaagggagcgggcagaggagtctgtgctgggcagtcacctgctgcctccctgagatggcaggctgccttggctggaggcgcccccattcccccagcccctccctgcctcctggaagacctgagtggatccctgcccccagttcctcagatctcattgcctctgaggccccacttcccacactgcctcctcgggcccctctgaataccctttccaaaagaacacccccaaacccagcaccatcccgctgtctctttgctgtactgccttcctagcatctagcactatcggaaactttctcctgtattcatctattggt

SEQ ID NO: 30949 - DNA, 1047 bp, Homo sapiens
tggctgactctacagatggcctctttatccagcacccttgtcactttttttttttttttttaagactgagtctcgctctgttgcccaggctggagtgcagtagcgcaatctcggctcactgcaagctccacctccctggttcatgccattctcctacttcagcctctcgagtagctgggactataggtgcccgccaccacgcccggctaattttttgtatttttaatggagacggggtttcaccgtgttagccaggatgatcttgatctcctgacctcatgatccacccacctcggcctcccaaagtgctaggattccaggcatgagcccttgtcacctttttaaacatctagagctgcagggccagtgcacgatgctctcacagccttgagaaccattgtcagaagccctctgaaaggggtatcccccacccatcactctgagtggagagcagaagctggctttgccattgggtaagggctgtagctcaaatcctggctcttctgaactcactgtggggcttccagtaagtcactggcctcttagaccttcattttctcatccgtataaagaaggggtggccaacatcttcaggaaactgagccagaaataacccacacagccccgccagccagcgctcccagtctgagacgacaggccagggccctccggactgaagcttgatgtgcgagccttatagctgccttgacttttcagggacgaagctagtactgggcaggactgggaaaagggaggaaaattcttcaggtgccagcaggtgcagtggcacaggtgccaacggcacataggaagctgggccctctgcctgtgcctctgcccagcttcctccctgctctggtcctctaggttcccagcctgtacaggccctttgtgcacatggggaggggatcctggtgggacacctccttggcaggcagggtatgggctgccttcacccccacctgccctcagtgccttcatacccagctgcccctagcagcagtctcaggagccaccacccactggggctccctgtcccatgccact

SEQ ID NO: 30950 - DNA, 1100 bp, Homo sapiens
gccctggacgggagcaatgggctgaactggctcctgccgactggagctgccatcctccttagggagacagacagtgtgcaggcaccaaatacactcgtaaagtgacttcagatcatgatccttagccaaagtgggcacggagggcttccggaggggctaagccttgagtgacaagaaggggacagccaggccaagaactgtggaaagaggattccaggcggagggaacagcaagagcagaggcacagaatgctcacgctcacgggagggaggcctggggcaggggcaggagcagtggggtggagactgggcatgaaggcagtccatgccagtcctgaggagcagtgccactcagcccctgccagtggctgccttgtgggattggggacacggtgtggccagaggttccgattttgcaaggaaagctggaggtctggaattttgcataaagcatcctgatttttttgttttgttgtgttttagaaatgaagtctcaatctgttgcccaggctggagtacagtggtgcaatcttagctcagtgcagcctcaaactcctgggcccaagtgatcctcctgcctcagcctcccaaatagctgagattacagacatgtaccatcatgccagtcttatatttatttcttgtagaggtgggggtgggggacgtctcattatgttgcccaggtttcaaactcctggcttcaagcaatcctcctgcctcagcctctcaaagtgctgggattgcaggcgtaagccaccatgcctggcctcctgatttttaaatggccacagtttattcaattttttctgaaactgttcgagccacacaaaacctttctgagagccaaaaacagtgtgtgggccactagtttgagaccttactgggaagtgaggtcctggattcaaatccggcctcccacactttctagccatgagacccaggcaagtgacttactctctgtgcctcagcactgtcatctgtagaatggggaggagggtgtctaccttacagagggcctaccttacagggtgctgtggaggcgtaaaggatttaatttactcatttatccagcacatatttactgagcatctactgtgttcc

SEQ ID NO: 30951 - DNA, 1027 bp, Homo sapiens
ggctgaggcctcctcctgcctaggcgtctggcgtccgtttgtctgtccgaggcctcagcgcaggtaaagcgcggggctggggggcgcagagctccattgggctgggaaccagcgcgtctcgtgcccttgggggacccgcctgcccgagccgcctgctaagcctcccgctcccctccacgctggagcgcgcggagcccggtctgctcggaactccactctgcgggagcggaggccggcgccagcccgggaagccgcgcagggggcgggaggccgagcgcgaggcccttggcgccgggcctccgcggccaggccgggcaggtgagcagtctccgtgcctcccggttggcgttcccctcaacgcgtgcggtcccgccggggcccactgtctctccgtccgtctgtctctcaacttttcccatcctttagcttacgattcttcatcaactcgtaaaatgagatcgccgcggagctcgagcctatttggcgtctccggagactagcaagaccctctgaaagacaccgcgtccccagggataatcccccgtgtccggcaaagctgccccgctcgagcgcgaaccctgggacccagcgcgggaggcagaccagcagctggccgctgggctgtgaacgccaggaccgagcggaagcttcccgcccggccgcgatcggtgccgcggctctcagggaagtggctacgcgcgtccctcgggaaagcaggtaattcgcctttttctcccaccggcgcggtaaaaattaccctccccctccccgttccgtgtgtattcccagtttcagcgcagcgagctcggcgtctaacccctccgcggcagggtcccggccactgcggtagtggaggtggccagcctggctgagtcccctgcccaaacgtcagccctgtgctgccgcctgcctgacgcagagcggagcgagggaggggatttaattaccccgctcggcagctcagaaaatcgccgcacagaggggcttagcaggacggttaaggagtgcttgagcaggggcctcggga

SEQ ID NO: 30952 - DNA, 2745 bp, Homo sapiens
tcgttaggcacaatttgtctgcaatttgtcagcccggctgggaaacgctccccagacgcctcggctgccgcacgggccctacctggttctcgaatcctgcctgctcataaacgaatcctagcacggggtgcctgcgtagacctggagctcaccaccagatgttcccgacctcgggagaggaggctttttccaaaacaacgaatttccttccttgttttccggtaaaggagcgttcgccacacacggggtccctgaacgcggggcctttcccctcgtggttggagcaacgcggagttcaagcctggccgccacagaataattttaaatgccccgttttcagacagatccagaacgccgtctacgcctaccggcggcagatcttcaagcccgcggcggccccattcttattgaaatcccactaaacggattccgactccggcttggggcggggggagacttccagacccggcgctctcccccacacgcaccccagtcacacaggataaagggctgcggggcgcagcgcgcgggggcgcaagcaggagcgagctgggttaagccgcgaaaagccggcgcacgggaccagccggcaggtgcagccgccgctcggcggcccggctcggacgcatccgccgcggtggcctggggattgggggcggccgagacaaaggccccagttcgggggccgggaggcgggggtgctttgcgaggctctgggaatgccagggtctcgtggcctgtggctccgagaaatgggaagacaagaggcccgaggcgggcctgctgtgcccaggtaaccaaatactccctctggttaaagtccctataaccagggtttccggtctctggcagggccaaggcgagccccaaaggtaggggccacagggcaaacggaccaagcgattcgggtgccaggcgggccgggccgggggcgggaagggccgggcccagggaaggtggaagtggaagaaactcaccgagcgaggcgcggtgggcggcgcccccgggcggacggggcctggagtagagctgggagcagggcgaggtgcgcggcaggcgggctcgcgggacctgggcgcggggtggcggcgctcaccagcagagcctgggcggcacgccgagcggccgcatggtgttcagcggaccgcttttgtccgcctggtgggcgacggggccctgctaggatggatgtggcggcaggcaatagacagacttgagcagcgagtcccggggcgacgctggcctcgctaccttcctggcgctcacgctgcctctctctcccccaccggccgcaacgcggctttttatttcgacatcactttgcgggggggcagggggtggcgacgggggcgggagcgccgcagggggcaggagggtacccggggctctgcacccggcctaccaggtccagccgcctggccggccaagggccgctaggcactcagggcgcgcacaccctgtgcatccacactccaggccgctcccaccctctccggagcgcacacgcgcgcccctgacctcagggatgcttgctcagaaagcttgggacacgtctttactgagactctccccggggaccctcaggagctgtgagcacacgcactcactgataatggtacacagacgcccgctcctctgtcttcaacccacttccaggagtgctcacacggacacgcacacatccctgcacatgtgcacacagctgtggccgcgaggacatcctcagacagacggcctgggtcacaccgacacacatggccatacaatcagatgcaactcggcactcgggctcacactcaggacgccctcactgccaggcttgtttagctaagtgcaggcgcagcccctctccctgtcccaccccccctccagttcctaacgctgggggaccccctgagcactttagaagtccactgtctggtgtccccctggcccatctccttggggcagactctcacaatgggggaagcaaggaagtgtgcagagggcttgttcacagaagtgggagtcaggagggggggagaaagtgagtgtgggagtcctcatccccagaaggcccctgggtttgtgggcaaagacagtccagtccttgtgctgccaaagttcttactaagggattcaaccagtcagcgtccccccacccccacccctgattcccattccagcagatcagggagagtgaaagtggcctggggaccttgagcccagagggaaagtgcttgggcttggaaggactgggaaatctgtgctcccgtgcccaggtgtgccccagaggagtgtttctgtcccctggtctttgtgacccctgctgtccataggtctttctccaaatctggtggtgactattgcattgtgtgtgtgttctatgcatgtggctcagagtctatgtcctgtgtgcccaggtgtgtctgtgtgcacttaggagcacacaggagtgtctgcaaaactgggtgtatgagtatgttcatttcttcttgtgggttcctgagagtttgtgtattgggcagtaggtcacagtgtggctatttcatgaccctggaatttggcacaagagagtgtgtctgtggaaatggttgtgcgtccctttggctctgtgtctgtggggtcatcatgtcagagactcatgtaatgaggggtggggatttccaggtgtttgcccatgtgtctgtagcagtgtgtggcatgtctatgaatgggtgtgttttggagtgtgtgtttgcgtgtgtatgtgcatgtatctaggca

SEQ ID NO: 30953 - DNA, 1050 bp, Homo sapiens
aaaaaaattttgacctcaagtgatctgcccatttcagcctcccaaagtgctgggattacaggcatgaaccaccgcacccagcctccatcaaaaatgtattaggcatttccctgtctttatttttaaatatatatatattgtagtctgggcatggtggttcacacctgtaatcctagcactttgggaggctgaagagggaggcttgcttgagcccaggagttcaagaccagcctgggcaacatagcaagagctcttctctactaaaaataaaaattaaaaaaaattagccaggctatgtggtacatgcctgtagtcctagctactcaggaggctgaggcaggaggattgcttgagcccaagagttcaagattgcagtgagctatgagtacaccactgcactccagtctgggcaacagagccaaacactgtctcaaaaaaaaattacatatatatatatatatatatatatatatatagagagagagagagagagagagagagagagatgtgtgtgtatatacatatatatacttcaggcacacaaaaaattagatcgaataatataaaaaacacctatatacccaacacctagcttatatattaagtattaaaatgtcaccaatacagttgaagcaggaatacagttgaaattgaaaatgtagttaaaatacaattatagttgtagttgaaatgtactacatgctagatagaatgtacaactttcttatgactttggggtgggaggtgattttctgagcattgcacagaaagcagaagctgtaaaaagtgaatgcttccttggattccttggactatataaaaatttcaacttctgcctggtgaagatactgtaaacaagtttaaaagataaacaaatagatcgagagaatatttgcaatgtatacagtgaatcaatatctacaatatgcaaagtgttcccaaaaaaaataagaaaaagaaaaaaaaaccagtagcaaaataggcaattcacacaggaagaaatatagtggtcaattaagttatgaaaagtatgcccttattcataatcaa

SEQ ID NO: 30954 - DNA, 1072 bp, Homo sapiens
agaggctttcctgtccctgggagacgcggtgatgtgacgcagcggttgcagcgaaggtttcttgtaaaagatggccgctgcggagttgctaggtgtctcctggcaggcggcggccgcaccacaagatggcggcccgccccagggtcccacacgcggggctgcggaggcggcggccccgagggtccccgccccttgctggccctgtccccgcgtgcggggctgcgacctgcctttgtgtgcgggtggaagtgcgggccgccttggggccgagttgcaacttcgcgacactccactggagtgcgatgagacgatgagatgttacctcctaacacttcgggaggtgggcagcatggcaattcctagtaacctcaacgcgattcactcagacttcctttttcccatcctgagccgcaaaaccaggaactggtgaaataaatcaggccatctttcagaggaatggcctgccaccgttaaaaagagcaaagctgcagtttatgtactaatgtggaaccagctctgagataaattaagtgaaagaaagcaaagcacaggaaaatgtgtatagatatgcctttgtgtttttaaacaagaagacccacataaatgaagatatgaatgtgtaagcatagtatagcggtaatggtaatagcgatcgcccagcctaaggaagggaatggagagatacggaacaaggatgggaggagacagttttcatctaagaccgttgggttttctgagctttgtaccatggacaggtgttaattttaaattttttgtaaatatttaaattatggcttaaagacaagttcttttgtaagggtataagggcagactagcacatagaaaaaaaaagacttttttaacctggaaccaagacatttgataaacattcatgaaactcaattttcaaggataaaaatttcaaggtcaatactgtagtacttacagcaaagaatgccaatcattgtgacagcctgagccctcttgaaagctagtttttgttggcggggggtcagaaaatttggcctgggaagcaggaggcactcgacctatttgctgatgctgaatgcct

SEQ ID NO: 30955 - DNA, 1031 bp, Homo sapiens
ctaggcatgttacggtaaatcctgagagaagtttttcaacttaatcgaggaaagatggtagttggatgtagagttgtgtttccattccgaccgtgtttggggcctctttctgcattcattttaggcttgatacctaatggggtcataaggggaatattgagaatattgacagcaaatatttgagcgtttattgtatgctaggcagcgtggcaagaccttttaacagatcattatgtttagttctttgaacaaccctctgaagtaccactgttgtgcccacttaacacagtgggaagttgaacagagaggctaagccatttggccaaggtcacacagctaataagttacgaagcagagatgcaagcccaggcagtcagactccagagcactgtattaaatttctaggttgtactgctttcacgtacccctgaagcttgctggtttatcttttgctacctggtatctgtacctcagtgcctcccaccacctcctttctttctattgatgtcatttgaaagtctttctggtagcatcagttctcccttaaagccataagaaatgccgtttgcgacttatcacacatattgtggtgtagtgtcaccgaattaggagctcttgaataccggcagggtacttaactgaggtttgaaaaattttgcaggtaggcctggcaaacctgcctagtgaacctttcttacaaccttagttgatggctgtccagccggctggttcttccctattcaaaatactgcatctttggtttcctaaagaacggactcttgtctctttcttgtgacttaagcagctgatgaagcacatgatttctcatccatggatgaataaagtctcctcttagtgtgtttctctcttcaaacttgggaaggtttgttcagatttgagtttaaggactggaaggtgagttaggagtacttcttctgaagaagggaccggctaagttaaagcttagcgttcacaatcctgttgtattcatatttgtcttttttttttttaactttgctacctagcctaaa

SEQ ID NO: 30956 - DNA, 1052 bp, Homo sapiens
tcctatgataaagtatttatctccccattcatttaattcaacaaatacagctgagatagatttgaccagatgttggacttggagctgtaggcaggcttttcctggggaggtaaggattagaagtcctcctgaataaggctaaacagaggttccccttggcattaaatgtcttcttctgaaggcgactgaaactcgagaaatgaactccccgcctccccccttattttttggctattggcttgctgttgatgattcttacctctcatgtaaggaaggctaccattgtattctcaggcatccattcctttgtgttaccacatgcttatctgttaatattatctaatagttctctatgcttctctgtctgcagtttgctgcagaaacatttttgcaatatgctgatcttttcagttatttgctcttaaatcttctattctgtttttccccacactccatatggcattaaagacagaaaaatagtttgtgttttaaaactttttttttttttttagacggaatcttgctttgtagcccaggctggagtgcagtggtgccatctcagctcactgcaagctccaccttccagattcatgccattctcctgcctcagcctcccgagtagctgggactacaggcacccaccaccacgcccggctaatttttgtatttttagtagagacggggtttcaccgtgttagccagattggtcttgatctcctgacctcgtgatccacccgcctcggcctcccaaagtgctggaattacaggcgtgagccaccatgcccagcctaaaacttatttttaaaacatttcttaatggtggtggtcactgcgatttgtgaatcagaggtaaaagtgatgtggcgagtgaaatcaaaacaagttttttagcagtgtctgttaccagtttcaattttagtatcccaggctgtgattacaaaaacatatttaagaatagctacttgcaaaatatctccttgtgggaggaagaaagcttgggagttggttccaatgctgacctacagcattggccttgttcatttgcttgaaga

SEQ ID NO: 30957 - DNA, 1071 bp, Homo sapiens
actttcactttctgcttttgtatatttatagtcttttgtgaattggcttttgttctctaaagcccatgtgaggttcttgtacctcacctctctcccagtttataaactttatatggcaagaattttgatccttttcgtgttgcaaacattattcctggcttgtatctcttggtcttgtttggctgatggcatgtttttgtaacatagagacttttctgtagtcacatctgtcaattcattttctgtgtttcatattatgcttaggcctttcccacccccaggacaataaaaacaatgttttcttctagtaattctagcacttagccaggtataatatgtcggaatcttttcccaaatgtatagttttcccagtattttattgtattatcttttctctttgactagaaattttttttatcacacagtatatttcctacttccatgtctttttttatttttattttaaatagatttatttacgaaatagagatggtgtctcactatgttgcctaggctggtctcgaactcctgcactcaagcaatcctcccacctccacttcccaaagtgctgggattacaggcatgagccaccatgcctggctgtgtcttttgttttttaactcttctgtttcattctttgtctgtgggacagtactgctgtcttatttgcgtctgttttgttttatacgtatatacacagatacatacacgcatacatatacatacacacaaacattttttttttccttggagacagggcattgctctgtcacccaggctggagtatagtagtgcgatcatgactcatcgactcattgcagccttggcctcccaggctcaggcgatcctcccacctcagccttctgagtagctagtatgtccggaattggtgggttcttggtctcactgacttcaagaatgaagccgcagaccctagcggtgagtgttacagttcttaaagatagcgtgtccagagtttcttccttctgatgttcggacatgttcagagtttattccttctggtgggttcgtggtctcgctggcttcaggagtgaagctgcagacctccac

SEQ ID NO: 30958 - DNA, 2055 bp, Homo sapiens
agggacccggtgggaggtaattgaatcatgggggcaggtctttcctgtgctgttctcatgatagtggataaatctcatgagatctgatggctattgagagtttccctgcacaagcgctcctctctttgcctgccgccatccatgtgagatgtgacttgctcctccttgccttctgccgtgattgtgaggcttccccagccacgtggaactataaatccagttaaacctcttggttttgtaaattgcccagtcatgggtatgtctttatcagcagcatgaaaaaggactaatatggtaaatgggtaccagtagagtggggtgctgctgaaaagataaccaataatgtggaagccactttggaactgggtaacaggcagagatttgaagggtttggagggttcagaagaggacaggaaaatgtgggaaagtttggaacttcctagagacttgttgaatggctctgaccaaaagcctgatagcaatatggacaataaggcccaggctgaggtggtctcagatggagatgaagaacttgttgggaactagagcaaaggtggctcttgttatgttttagcaaaaagactggtggcattttgcccctgacctagaaatttgtagaacttttaacttgagagagatgatttagggtatctggaggaagaaatttctttttctttttttgagacagagtctcactgttgttgcccaggctggagtgccatgatgcgatgtcagctcactgcagcctctgcctcccgggttcaagtgattgtcctgcttcagcctcctgagtagctgggattacaggtgcccgccaccacgcccagctaatttttgtatttttagtagagacgggttttcaccatgttggccaggctggtctcgaactcctgacttcaggtgattcacctgcctcagcctcccaaagtgctggggttacaggtgtgagccaccgagcctggccagccaaagaaatttctaagcagcaaagcattcaagaggtgatttgggtactattaaaggcattcagttttataagggaagcagagcataaaagttaggaaaatttgcagcctgacattgaaatagaaagtaaaaacttattttctgaggagaaattcaagcccttacagaaattacaagtagctgaatgttaactcccaagacaatggggaaaatgtctccagggcatgtcagaggtcctcatggcagcccttcccatcacaggcctggaggcctaggagaagatggtttcatgggccgggcctagggtccccgtggtttgtgcaaactggggacttggtgccctgcgtctcagcagctccagccgtggctgaaaggagccaatgtagagctcaggctgtggcttcagaggatgcaagccccaagctgtggcagcttccacgtggtgctgagtctgcgagtgcacagaagtcaagaattgaggtttgggaacctctgcctagatttcagaggatgcattgaaatgcctggatgtccaggcagaagtttactgcaggggcaggactctcatggagaacctctgctagggcattgtggaagggaaatgttgggatggagcccccacacagagctctccacagggagactgcctagtggagctgtgagaagagggccaccatccttcagaccccagaatagtagatgcaccaacagcttgcaccatccacttggaaaagctacagatactcaacaccagcctgtgaaagcagccaggagggaggctgtaccctgcaaagcctcaggggtggagctgcccaagaccatgggaacccacctcttgcttcagtgtgacgtggatgtgagacatggagtcaaaggagatcattttggagatttaagatttaaatgccctgctggattttggacttggatggggcctgtagcctctttgttttgaccaatttctaccattcagaacagctgtatttacccaatgcctttacctccattgtagcttagaagtaactaacttgcttttggttttacaggcttataagcagaagggacttgccttgtctcagatgagacatt

SEQ ID NO: 30959 - DNA, 1033 bp, Homo sapiens
gtgtgagccaccaccccagtgtttgtttttttgttttttttttttttttgagacagagtctggctctgtcgcccaggctggagtgcagtggcgctatctcggctcactgcaagctccgccttccaggttcacgccattctccagcgtcagactcccgagtaggtgggactacaggcgcccgccactacgcccagctaatttttttttgtatttttagtagagacggggtttcatcgtgttagccaggatggtctcggtctcctgacctcgtgatccgcccgcctcggcctcccaaagtgctgggaattacaggcgtgagccactggcccagcctcctgcgtttggttttttaattctgcttgtttgtagtgacattcatcaagaatgaatgactttaaaacaacaacgaaaaatctttagggatttttactcttgggcaagcatgcttctgtctctgagcattagttttctcatatatcagataaaagggtttggagtatatcaatgatattctggttgtggacagaactcttgagggttccttgaacatgatcctttggtagcattggattgctctcggccatcccacgaatagctgtgttttatctgttttttgcttaagatttaacatatgagttcatttgaaatgtttctgttgccacaaagaaacaaaatccctggctcagagttttaaggggacttactgttctaatgctactcactcaggctttggttgagtagtaaacagactacagcttgtttttaagttcagtgatcttcaacttacagcccctgtgttttacaaatgagttaaattaagatcagtatcttctgttcaaattctttttccaaagaaatccaaatgtgccataagctgataggtctctggccatgaaatatggtttcatagttacattgagattgttgagtagctacagggaaactgagaatttacattctgaggcaaatggtttaacctaagaggaataagattaagtaaactgtgtattagctcctcataatgtggcaggaa

SEQ ID NO: 30960 - DNA, 1054 bp, Homo sapiens
agggcatttttgccctatgtaaaaattggtattggccaattaggacttcacaaaggtctccatatcttcctcaaatgacaagggtcttatgctaaatgtgactctctactgccctgtttgttaacatatgatgcagtacaccaatgcagatcacactgcagttttaggtagtatatagctgaatgcataatttgtattagaaatacaacaaggacattagactcatgtctgcattgacatggatacagcaaaaatcttgaagttagtgtgagagattacagtagtgagatttggaagatggaataatacttgttgattaagtgcatatttttcatttaagttagaaaagccctcataacaaagccacccatatttcatgtgtcaaatggaatgctaggagctttctgtgcattatctcatttgtggaggattctcatttttcacatggaagcagaggggcatttaagttcacacagctgccacttggggtagcttatccctgtaatcccagcactttgggaggccaaggtgggaaagaatgtgtgaacccaggagtttgagaccagcctgggcaatgtagagagacctcatctctaccaaaaaatttttcaaaaaagaaaagctgggcatggtggcgtgtgcctgtagtcccatctgttcaagaggccaagggtgggaggatctcttgagccccggcggtcgaggctgcagtgatcatgctctactgcactccagtctgggaaggagggagagaccttgtctgaaaaaacaaaaaacagttcacacagctgaatgtatctgaggtgagattgaaacccatggttgtggccgggcacggtggcttactgtaatcccagcactttgggaggccgaggcgctgaattacctgaggccaggagttcgagaccaacctgggcaacatggtgaaaccctgtctctaccaaaaatacaaaaatcagttgggtgcggtggcacgtgcctgtaatcccagctcctcaggtggctgagacaggagaatcccttgaacttgggaggcagaagttgcagtgagcca

SEQ ID NO: 30961 - DNA, 1072 bp, Homo sapiens
cacatgccagaaccgttctccctcatggtccatccaggctgatgcccgcatgggtggagatgcttgctgtcttcctccctgtgcccttttcccagcctcacaagcagcgtgtgaggtcacctttgatggtgccacataagctccatgggctggctctaagggacagcactgtgttcatggcacaaaggcctgctgtgaccagtagtaacagcaaaagtgactgtaccttctgatacttagccaccccttcttgtgacacacatcagcatgcctctgttgtccatagtaggctctagtaggatgcagggctgtcagcagaatttattgaaacctggaaatggcggggtggggggtgggggaagtgcccaggcattctttatgtcttgtataatctctctagattttgtttactctcttcaactatttattaccaaaggatcacaggtcaccaagcatgaggaagtactgtctatacgttttaagtaagagtccaggtaacacttattgttgttgctgcttcagagaattctccttggccagaattgtcagcccaccttttcttgcttagtggtatatatgaggtgtcataatgggcaagaggttcaaagtcttcatttgagtaagagagtgtcttgtgctaagcatctgcagccctcaggggaacctaaaagaaggcactctcacagaggcagtgacccaaaaatgtatatctaaacaaagacagattggcattctccatcatctcttacttggcctctgggcatgtccactgtccctgcacaattgtttaccaagcccttgcaccacaggcactactgggattaggaatttggggatgaaggagagaataccttcaaggagaatttatcccccgcccccccgccccccacaaacacacacctcccacctgctctatcctcctcctgccctacccccacttagatgagaggcagagacccaggtagtcatgattcaagtatgcttttcaaaaaggtgtctgggccccaggtgctcttgcgtttgagggagtagtatccaggaagacaggctctcaacactgcctagacctcac

SEQ ID NO: 30962 - DNA, 1117 bp, Homo sapiens
gcatacctatagtcccagccactcaggaggctgaggcaggaggtcacttgagccacaggagttctgggttttagggcattataccaattgggtgtctgcattaacttcggcatcagtagagtgacccctcagaagcaggtgaccaccaggttgcccagggagggtgaaccggcccaggttgcgaatagagcagatgaaacatctctcctatgctgatcagtagtgggattgcacctgtaaaaagccactgcactccaacctggacaacacagtgaaacccgtctcttgaaaataaaaaattaaaagaattttttaggctgggcacagtggcttatgcctgcaatcccagcactttgggaggctgagccaggcagatcagttgaattcaggagtttgagaccagcctggccaaaatggtgaaaccccatctctactaaaaatacaaaaaggcgtggtggctcgcacctgcagtcctagctattcgggaggctgagacagagttgcctgaaccctggagggggaagttgcagtgaacagagatcgcgccactgtactccaacctgggcgacagagcaagactgtctcaaaaaaaaaaaaaaaaaaaattctttaaggtatttggtcagctccttgatgtgcttctctcactagatattttcattgtaatgaaagtgtttatcctgcccccctagatccttaatgtttcttttcaaaggcttctgtcttttcctactgagtttcttcctagaggtggtaattctaaatggaacaacagactgacggcctacttcccgagtgcccccaaatgacttcataattccacaaaagtggcttggccagagccatccactcatccccttccttcttccttgtcagactactggtctttctattcttgccccctccccagaatgaatatttttagaaaccaagtgactcctgatgagcttctttttcttcatctgttaaatgggaattctcattgtatccctataggcttggtttgttggaggagtaaacaaattgccccaggaaagtctgtagtacagtccccggcacaaagtgcattctgtaagtggtagtgatgtcttgctgtttcagggggtcttcactattc

SEQ ID NO: 30963 - DNA, 1084 bp, Homo sapiens
atgctcctagaggatcaggactcttaattgactcacacttctaggacagagctggtatgaatctctcatcctcacctcacctacacacatacacctagagatcttcaaaatgtaactacagtttaagcaagtcaagcttgagagtagaactggaaaaccttggcccaagaaattggcaaagcttgtgtctgcagttgttggagattctcagtcccactctccacatgtacagaaatctttgtctcaaaggatttaacataaatccctgtcattcctggcaaaaacaagggtaagaccactctgtagggacatttagtaccgcaggagagaagatgagttcataaccacatgaggaaataatgtaccacaagagatgttcacaatgactagagatgttctaaaaagaaatagaaaccataatggaaagggatactataaaaaaatgaggatatggaaaacttagaacttcaagaagtgaaaacatagtattgaaataagctaaaggaacagttaaactgtagattaaatggagctgaaaaaagcagtaagccgtaagagctgagcaaattttctaaaagaagacttaaaattgtagaagaccgaaaagcaaaatcttaagagcaactatagaaaaaaaagacatgacttataaaggaacaacagactgacaaattctcaacagaaggcagaagggagtagaattacttcagggagctggggtaaaggcccatctgaagattctccatgtgtcacagcaagactcagactgccttttgctgagggaaaatagaacttctccagctgagctgtggttttggtagccatgtgggccagcgaattcagaaatcagagttcggcccctgctgggtcgggggttgtcataacagtcccgtctgtactactaagctgggaccttggggcgctgcactcttgaagtaaaccccatcaggagatccacagcgcactgtgggcttctcaagaagcccaaattccaggaaggataaataaaaagaattctgtgtaagtcataatgaaactaaaaaagaaaaaggcttaaaaatagactgaggaaaacctgacaagc

SEQ ID NO: 30964 - DNA, 1031 bp, Homo sapiens
attttttttgagacaggagtctcactgtcgcccaggctggagtgcagtggcctgatctcagctcactgcaacctctgcctccccgattcaggcaattctcctgcctcggcctcccaagtagctgggattacaggcgcctgccaccacgcttggctaattttttgtatttatttttagtagaaacggggtttcaccatgttggccaggctggtctcgaactgccgacctcaggtgatccacctaccttggcctcccaaagtcctgggattacaggcatgagccactgcgctcagccagtagggtaaataagtgggaccaggacagggctttacattctagcttgggggaaccagaggattcaagacctgaaggtggaaaaaatacaaagtgaaaacttaaaaaatgaaaatagtgaatacttttcacctttggcatttgaaaatacagaaagtacaaatcataaaatgttgaagattgattaatagattacattaaacatgtaaataacaagattcccagactaacaagaacaaaccacacaagcaggtgacaaagatgataatgcctaatagtatccaagcagtaggtaacctggtggatgctagaatatagggagtggaacagcctctggttgatggtaggagtgtagtaatgagtacaaccttttcagtagaaactgccactctgctccccagtgttgaacatagacatatgcagcaatccagagttctgagtctgagtgtatggcctagagaaacttatctctggacattatgagagagttgtaatgagagttatcattgcagccttgcatggggagtgaaaaactgcaaataactcaaatgatctggggaactaagtgagtctattaaagcagtggaatattatataactgttaacttttgggaatgaaaaaagacaagttgcaaaaagctgtacaggatgataatgtttatgtaaggcatctcttcaggagcatttacttgtggtgaagaaggaagaaaatgcaatgagggaagggttaactcttg

SEQ ID NO: 30965 - DNA, 1032 bp, Homo sapiens
acaaatgaaatataacatgctaatcttttttgttgtttaggcaaacttttctcttttttttgagacagagtttcgctcttatcacccaggctggagggcaatggcacgatcttggctcaccgcaacctgcgcctcccaggttcaagcaattctcctgcctcagcctcccaagtagctaggattacaggcatgcaccaccatgcctggctaattttgtatttatagtagagacagggtttctccatgttggtcaggctggtctcaaactcctgacctccggtgatccactgtgcctggctaggcaaacttttcatacagtaaaatgcatagattgaactatatcactcgtgagtcatcacctcacttccctattgaactgtatcattcgtgagtcatcacctcacttccctatatttccattgctctcagaaagttcccagagtacctaagttttatttatagttcaaattttacacacttacctacatgtgaccactacttggatcaagatataagaaatttctagcaccctggagattggactcaatgtcactcgcttatagacagacacatacttaatcacaatatttgtgaggattgtttcagatactctggtgctgaaatttgcttcctgaagtctggtgtcatttgtctttgtgggtggccccacaatctagcctatttcttctggcaccccttgcatacatgctcctggtgctctgcctagcattctcccaaggaatgaatgttttgtctctcacagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtaagtaccaacgatgatagatattgtcacagacacctgctccccagggg

SEQ ID NO: 30966 - DNA, 1051 bp, Homo sapiens
gccacgcttacccccaaataataatgtttgtgtttttcttaatgttcatataagggaatggaaatccaaatatgtgtaggaaagtgtttcccacctgttccctgttgcctggcatcactgtctgagtttttctcttccatcactactgtccctgttgtctttatgcttttatttttagagctagcccttaagaagttagattgttaaatcggagggtgtatcttattgtaagtcagggtgccaggttgctttccccaaggggaataacatttcagcaatgtgggcttgctttcttctacctccttgccagcaagcaataggtgtcacctgtcactgctgacattgccgatctttgggtgtgtaaattgccaccatcgtgactactggtccctctgagttcccctccctggggcttagccatttggattttctctgctgcacacagccggcacacagcacatggttgggcctctctcagttctcatgagctgttggtgaattgaagttaactctacttgcatcttaagtgacttttccaactctgtggtctttttaagtcctttgaacatagggaaaaagtaattttttatttggttatgtcattttaagtttctatgtttcctgtgtctacctcagatttttctgtaattcagctggaatttgttttggcttatggcagaaaagagagacttgcctttcctctcaagagagctcagccagttgtttgaaatcattcagctatgttacacaagccgtttccctccctgaatagaccgtggcctgtgctaaatgctcgtatgtgctgggatctgtttctggtctctccagtctgttctggtgatgtccatgccatgttcccttatctggactgtgttgatttgactgcctgatgaggcaagtttcctcttgccacagtcttttttttttttttttttttttttttttttgagacggagtcttgctctgttccccaggctggaatgcaatggcgtgatctcggctcactgcaacctccgcctcccaggttcaagcggttctcctgcctcagcct

SEQ ID NO: 30967 - DNA, 1131 bp, Homo sapiens
aggctgagagggcagctcacactcagctccagccacttcacctcgtgcacacactggctgagggttgccagatgtttgagaaaagctagaaatccagaccattgttaaccattggcaactatagggaacatacagaaagcatctgaactggatgtggtagagctcccagatcatgatctgattgagaatgtccatgaacttctgtcctgattgctcagtgcagactgctgcttcttctggcaagactcctctcttcacattgacctggagttgtcacaaaatctgtttttctcttgctactcccctgagcatggcaccttctgccagagcgctcccttaactgtgtgggcaggctctgcttcacagctccccgcccactctgcccaagcagaagtgagcccctcctgggcagaaagtgcccgcaatgagggctgaaatgtttctattccctgagtaaccaacctttctctgtttccttgtccaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgc

SEQ ID NO: 30968 - DNA, 1445 bp, Homo sapiens
aggctgcagaagtaatgacagacccgagacaggccgagctcacttcagtgtctgttcggactggggatttgttgatgacattacccagactgcagcgttaggagatgccacctagcagagatctgagtcacgaactaacataagaaaaggctactatgaacactgacaagacatgtggtagaaaattataataatgatgacagtgatgatgacagccatcatctactaatatccctggtttaaaaaaaaatttttttagagataaagtcttgctatgttgcccaggctgaccactgtggctattcacaggcttaatcatatcacactgcagcctcaaactcctgggctcaagaaatcctcctgcctcagcctcctgagtagctgggacaacaggtacccaccagcatgcctgctttaatatccctgtttgggtatttttttgaaactggatttaactcccaaccttgatatctatttttgacagccctgtgaaatgtagtattatcctcatgtgaaactgtagcctcggagaggtaaaatgacctgcccagggtgacaaagcctgtgagtagctaactaagaacatgacctcaggcccacctgaccccaaagtccatgctcccatgggaagtgagagctgcctgagaaagaagcagcccttggctttgttcttgacttgacccacctccccttggcattgttcttgacttcacccaccgctctcacaccccgtgacttccatccccagcaaagacctgacaagccttagccataagccatctgctgcacagcttggctctcaggctaatgcagctacattttcagttttttgttttttttttttttgagacggagtctcactctgttgtccaggctggaggacagtggcacgatctcggctcactgcaacctccacctcccaggttcaagagattctcctgtctcagcctcccaaatagctgggattacaggcgcccgccaccacgtccagctaatttttgtatttttagtagagacagggtttcgccatgttggccaggctggtctcgaactcctgacctcaagtgatccacctggctcggcctcccaaagtgctggggttacagatatgagccactgcgactggctcattttcactttcaaagtttcatgtagcagcccacttagaacttttcttatgttgagcaaagaacatgtatgcacatgcatacatacacacacagaaatctgtttaacatcccacaccgaactggccaaggggccaatttttcttatgacatctatcagtatcctgaggacccagcattctctaggacacatgctggaacgcactgccttagcccactcgctgccctaatcaggagctgacctaggtaacaatctctgcctccctctagaaatccacagaagcagcatctctaacaaatcttccaccttctgatgac

SEQ ID NO: 30969 - DNA, 1989 bp, Homo sapiens
cccgcggcccagggcctacaatttcctccggccagctcctttggccgcgcaagcgcagtggggccggcgggaagcgtaggcgtgtgacgtcatcaggcggcgcgggccagccaggtgcacgtgactaaggccttgggcgcggcaggtggtagccttcccgcccttctggcctctccatcccctgctgcgggggaccgcgcaagcgcagtgagtactgcacgttgtcgcgggccagtaacgtcatcagacgtgtgtgtgtccctgcggcgctaagaaggggagactgaggctgaggctggggaacatcgggcagcatgagcggctgcgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcaagaaggtaacgcgagccctgggcgaacccttgctgtctggctcccgcttttcaccctcagctgcaagactggtgttgaactttgtgagattccccaaacctgccagagagatacaccctgcggccgaggcgtgttaacactccggattcctgagttccaggaaaaccttcccagagaaagggtgagacatttccaagacgggggacccttggaaatgtggtggtgacgtgttccagctaaattttgtcaggggaattcggaaaactctaggctaggtaattaacaaagcagccttcatctcagctggtctggtctggaaatgtgcggggcttcctctctgattcctaaacagcttacaccatgtccctcctcagtcaccttccagcgccctggggcttccttccccaggtgagcccagcgcctctccctgccattgaggttcctcagaaatctggctccaagatgcttcccaagggtggcacaacccagccaatagtaacagtttggttataaaacactcattgtcttcttagagttggaagacttgggtttggtcttggctcgttgactttgaaactcagttgttttttttgagacagagtcgcgctcttgtcgcccaggctggagtgctcactgcaacctccctcctgggttcaagcgattctcctgcctcagcctccggagtagctgggattacaggcgcctgcccggctttttttttttttgtatttttagcagagacggggtttcaccatgttggccaagctggtctagaactgacctcgggtgatccgcccacctcggcctcccacagtgctgggattacaggggtgagccaccgcgcccggccaagactcagttctttcagccttaaaatggagatagtgttgtgtctccttcacagatgtgttgtagagccccagtgagataaacggtgcatggagagtcttcttaaactgtagagtactgtgcagcagaagagagagctggcttcaacacttagtcttgtgaccttggagctgacggctgcacctccctgtgcctcagtgcattcatctacaaaataggaataaacacatttcttgctctttcctttgtatttcattttatcttctaaggaaaccaacagtatacttgctatttcgtcgaggtgccctactttgaacttggctgaatgttggctgatcctgtatcacagaagttattccctggcttctctttggaacgttcctctgaggttgtcaggctgatacctttatagcaagcaactttacagatgaagaagctaagactcagactaaaagcagtttgcccagctagaaagtgcggagctatgtcttgaacatattggaaaaccttttacccaggacctggggcagtgtggtgctctatcctgggacttcctgctatccagcagcatggtgaagaaagaacacagatctttcagatctgtttccatctttaaacctctggcactacctgccctgccctgcctttactctcagctgtcagctttgcttcccattccac

SEQ ID NO: 30970 - DNA, 1026 bp, Homo sapiens
cagagaggagaaagcagtgcgagcatattgatagagtagagaaatctgttggctgattagctgtacaaggtctgaggagaaggttgaggtctccccaagacttctctagaacacttggtgagaggcgccatgaggacaggtgatgcttgggcttatagctctgactcaggacatcactgctcaacagcctgaagcccacatccaaagctcatgtcatgctggcaattgaaggggtagcagagcccaaaagtccagaggggctcagcacagggagcagatgtctgtgagcaggagagacagcggctgtagggatcgatgagacttggtaagcatgatgtgctcttgtcagcatagcatctttgagctcacacaataattgatgtagaattgtccatttcagtaaggagtttccacatccactatcttccacgattctcacaagggccttgagtaaatattacctgcatgttatgggtgagaaaggggtagtttagagagctgaagggatttggtgaaggccacataatgagtaagcctgaaatcaaggaccagacccccaggcttctaaatgttagtcttgggctccttgtttcatgggactattatcatcccttgtactgagaaggaaaactgatgaaaatcgggaagaacctatttgaacaggggagggagatggatgtgggtggtggagcctgcacatagtttctgtatctcaggaaccttgtgaggtttgctttccagttccttcagtacgtcatgtcccgctggccagggtggagtggagcacatgtttttccttcccttttaactgatatttccgtgatgggagtgtgctaaaaattaaattttttagaaaatatttactatttttagaaagaagttttcccatttccagaagttagccaagatgaacttaatgaaatcaatcagttcttgggacccgtggaaaaattcttcactgaagagggtatgtatggttttctttaccattgccgatttccattgtaagggctatttggttgatat

SEQ ID NO: 30971 - DNA, 2055 bp, Homo sapiens
atgtcactcttgggcccttagagctcagcactttgtcacagccacacgcctggaagccccagcctgagtattcaagccaggcggccccacctgctttggtcactgcacggggtgtgagcctgcaccacctctgtctggggcctctgtgcctggctttgtgcgaggcgccctcccccttccacctggttgcatcttcacagcgactctgaggtgggggtggtgttcagggaggtgtcgcactcggcctgaggcacagcctgtaagaaccattgccaggattcaagtctgtatctgatgccaaactctgtgtgtgggtgccatgaggaggggtggttctcctctgacccacgggtgctggcaagtgggggtgccagcttctggggtatttgacctcagcagacacgcttctcacagtgcccacctgtgggaagggtaaggatgatggccataggaaatcatgtttgaaccacagaaatattccagttcattctaataactctgctcttcctcagaaatgactgctgagtacgcctgcacaaggaaacagtttaacaagaggctcagtgaatttggattgattcaggtaccaatggttgagtactgtatttgtgcatttcactgtgtgacatgaacggtgtgttcttttgatgtctctgtactggtgacttctgtggtgatttgggaagaagactagttaaggctttatttgacacgggtcactgggcttgcttctcttgggcattgaggcttctgacttaattactttctctcctgtttcacagatttggctctcagcacatgcaaattgtttcttgtgttttttctgaacactccaggagaaatttgcactgatggctcagaaggcttacgtcatggagagtatgacctacctcacagcagggatgctggaccaacctggctttcccgactgctccatcgaggcagccatggtgaaggtaaccctggcatagccagagagctggcgctggagggaggcttgggaaatctccctcactgtgacctttcaagcccatgctgttgcctgtcatcttcctcctgtcattgatccagtatttatgatgcacttgccctgtgtagcactccagggataggcaggcagcggggagcagcagtagggaagtgtccagtgggccagtggatcagtagtttatagcagaaggagaccgttatgataatatccttttagagtaataacattgcatctggcttgtgtgagaaagacttcttttttccttagtttatggccttcctactttctggtatcaaaactttatcttaaaaactaagcatatggcagggcgcggtggctcacacctgtaatcccagcactttggggggccgaggtggatggatcacctgaggtctggagttcgagaccagcctggccaacatggtaaaaccccatctctactaaaaacacaaaaaattagccgggcatagtggcgggcacctgtaaccccagctacttgggaagctgaggcaagagaatcacttgaacccggtgggggcggaggttgcagtgagccgaggttgtgccattgcacaccagcctaggcaacaagagcaaaactccatctcaaaaaaaaacaaaaaacaaaaaacatgtatgagcctgggcaacatggcgaaaccccatctctacaaaaaatacaaaaattagctggcatggtggcacacgcctatagtccctgctacctgggaggctgaggtgggaagagcatcttatttggttaaggtagatactagaatttgcttttgttttgttgagggtggagggtgtcattttttagctgtaataaaaaagatggccacacttggggggaccctactttgtgccccccacaattgtttttaagctggtctctggaattgagctcttgagagaaatagtgagaggtatggcagcttacagaagcaaacatcctggtgtcggcaggagagtctacctaaaaggttgggatcctgaagtggcaaggtccctaaaaaaataaaaaattaaaaacaaaaaggctgggcatcttggaccgtgtttga

SEQ ID NO: 30972 - DNA, 1028 bp, Homo sapiens
tagttgtccttagtgggggagttgatctgagtttctcagttagccattcctagaagtcccctgctccttccaaatcctagaattcgtgaattacaacctagggggacagattcttctttccatgctactcctttcttacaatttgaagttgaaattctgacctaatgcttattacagggaaagcaaactgttccgtagttcttctgggtgcctgagattctctgctgaggggtgacacctgcaggagaatttggactcagagcaaaagtaactagatgctggagaagtaaatacagtatttaaaaaaggccacagactgaacaactgaagctaaattattggaaaagatgggctaagaatttaacataagaaattgttttaaaataagagtgaagatagcaatatgaagcagaagtaaaactaaaagaaaaagtattgagtatgaaaatagttgaaatagaagacaagagaatgagatatattgcagaagtgatactgttgtagaacgaatgaatgaactggaatatccacttgagatatgctttcagaaagcagtcctgtataaaaaagataaaattagaaactgagtatagaggatggaaataacatccaaataacagaaatcccaaaaggaggggaaaagtgagaacaagaaaatttgaagcaataatgaatgtcagaaaagacaaaacttccaagcctgggtacactattattagtgggatttaagcaaacaaatacaaagataaactctcaaagcttctagaggaaaagagcaggccacctgtaaagaaaaactatcacttgtgatcagatccacaacagcaacaaggtaagttaacttcaacctacaatttcatatccaagcaaactaattgtgagggcttaggtttaaaggccttaggttttacataaaaccctcctttaaaaactcttggggccagatgtggtggctcatgcctgtaatcccagtactttgggaagcctaggcaggcagatcatctgaggtcagaagttcaagaccagct

SEQ ID NO: 30973 - DNA, 1035 bp, Homo sapiens
taaatgaaaatgagaatttcaccagacacctggaacctatagaaaaaataaatggaaatcatagaattgaagaaatcatcattaaagttacaatccagtggatgggtttaattgcagcttggacacagtgttggggaaaagctgagtgttgggaaaaaggctgaggcagggcttgcatgtctgacgtaacgtaaaagagtcttggaacatgtccggcgtccagggtctaaaaccccttgtggcctttggaacaccaagctctgttccaaagggtggaaggctgccctgccgcactacaatctaagcccagggcacaagccacaagggcgtggcttggacggaatccagggaacagcgcataaaacccctcgtggcctctggaatgtgtctcgacttgttggctccttgcttctagcactccaaggctcatagatcgattgtgtcttaaactagaagaatacgtttcccattatctcaagtagcagaacatgttccatatgcttcaaagaaaattctaaaccatcacagctgtagatcatgcacttgatacactgctttctttcaacccccacatcctcaccacctgcttctttgatcaccaataaatagtgtgggcttccagagctcggggccttcacagcctccatactagtgttggccccctggtcccactttatgcactcttgtctcatctgtttgactctgccggacttcatagtccccacagcctggagttgggtctgatcaccccaacattcctggcgcccaatatgaggcaacgaacaccccagtgaaggaacactagagtgtgtgaaagaggatgcatcatcagaggacacccgaggacgactgaaagaagctcagcaggaaagctgagcactcggaaggaccagggtaacaatggcacaaagtgaaagcaaacattctgctcaggatgttttaatacagcttcttacatacaataatgctaatgcagtgtcaaactgctattagacccctgacagggaaggttcagttagctgaatgtattaaggc

SEQ ID NO: 30974 - DNA, 1046 bp, Homo sapiens
gagctcaggtggtaatgctcacttgcccactctcacctcctgttgtgccacccagtttctaacaggcctcgaactgctactgttccatagcctgggggttggggacccctgcatcagaagatatattggttgaaaataatcaggttgaaggatgaaaaggagaaaaaaagactgtaaaataaaaagtatgagatgtataagtaatatcagatgcagatcatggtgaaaatatctaacattggagtcccaggaggagaggaagagaagatgaatataagtaatatctgaagagaaatactgtcctagaacttttaaaacttaaaaaaaatcaagctacagatttaacaagttctagaaacccatggcaagttaaatacaaagaaaaacacacctacaaacatcatcataaaactgccgaaaaccaaagaaaataaaaacaaaaaatttaagcagccagagacaaccaaattatcttcaaaagaacaagactggcagctgaccaacagaaacaatggaagtcagaggacaacggaatgatgtctttaaagtgttaataactgccaagctagaattctaaacccaggaaaaatacccaaaaaatctaatcacagaaaaattaactgatactcacaaacacttctcaatactgaaacaatgaaaagacgagtcacagactgggaaaagatacacatctaacaactcatttgaataaaagtaaaacactgtcaattagaaaaatacaactagatttattttaaatggagaaaataaataaatttgaacaagcactttataaaaggagatatccaaatagccaatcgtgaaaaggtgctcaacattattgagagagagacagacattaaagcctgaatgtggctgggcatggtggctcacgcctgtagcctgtaatcccagcacttttggaaggctgagacaggtgaatcacctgaggttaggagttcaagaccagcctggccaatatggtgaaaccctgtctctaaaaatacaaaaattagccaggcatggtggcacacacctgtagttcc

SEQ ID NO: 30975 - DNA, 1023 bp, Homo sapiens
ctttgggtgacagaattcaaagctagctctgaacaaaactgaaatggtggctaatacgatcctttctgtgcctcccttttctttccttttggatacttcaaatacacagctagtttccttgggacatcctagggcagtcagggtcatttccttctctctccaagactgacctgccacaatccatcagggactatgattttgttgtaaatatttagaaagatggtgcacaacaatagatttggcaaaaactgagctgatggcatgcaagtgtagccaagtgtgggaatccatacttggaataatctaaaggaatgtttaacggtggtaaaagagaagtgcaggagatggggcagcattttcagggcctctcacctaatgaaatattggcatcttacaggcttgagggtcacttgtctgatgatttgtgtgctaattctgttggaagagaagattctcaagaaatacactattgccattaaaagtaaaacacaagattgtttcctcccttgaatatagcaagaactctgtagagtaatcaatgctttggccagatatccttgagaattaatgttttttagattgcagggagaagaaaagaggacagaaacaagtttctgtttcatattccttctgtgtggtgttagagcagaagaaccctagggagtgcagggctggggcctgggacatgtgaatgtctgcacattggcagttcagcaagcttttcctgttggcctgctattcccaggagactgtctatagggctgcttggcagcaggtgaggaaggtgtgtatgtctgaaaaattcaggatagacagacaacatcccaagttttgaacaacaatccaactgtgtgtgtgtgtgtgtgtatgcacccgcatgttcacagctgcacacagcaccttgcacttcctttattaatagaaaactggaagaatgatgcagcaggattaagccccagggtattgactgggactcggggagacctaaggcacaactaaagggtggaatttttctttaatttc

SEQ ID NO: 30976 - DNA, 1046 bp, Homo sapiens
tcgatctcctgaccttgtgatctgcccgccttggcctcccaaagtgctgggattacaggcgtgagccaccgcgcccggcctttttttttttttagagacaaggtctcacttgagcccaagctggtcttgaagtcctgggctgaagtgatcctctggccttcagcctcccaaagcactgggattacaggcgtgagccactgcatctggccacttatatcttaaaagaaaaaacaacacaaaagaaataaaatgcatgatgcttatcagggaatccagaagctatggaagcaagcaaagatattcatatttgactacttaaaatgtttaaagttttgagacaaaagatactatgaagtcaaacgaacaaagcatagagcagaaaaaaagttggctgggcgtggtggctcacgcctgtaatcccagcactttgggaggccaacgcgggcggatcacgaggtcaggagatcaagaccatcctggctaacagggtgaaacccggtctctactaaaaatacaaaaaaattagtagggcgtcgtggcgggcacctgtagtctcagctgctcaggagactgaggcaggagaatggcgtgaacctggaaggtggagcttgcagtgagctgagatcgagccactgcactccagcctaggtgccagggcaagactctgtctcaaaaaaaaaaaaaaagttataatacctacaataaatgttaatattgttagcataccaagagtttctacaaattaaaatccaatagaaaaatgggtaaataatatgtacagataattcataaaaggaaatccaagaaacacaaccttagtcatcaaggaaatgcaaattcaggtaataatgagatggtaatattcttttgtgagattggcataaacttaaaagctaaataaaatccagtacttgcaaagattcagggaaaaaaacccagcactttgagaggcttaggcaggcggattacctgaggtcaggagtttgaggccagcctggacaacatggtgaaaccccctgtttctactaaaaatacaaaaaaattag

SEQ ID NO: 30977 - DNA, 1030 bp, Homo sapiens
ttgcatacccagaaagccctgtttagacaagtcagtttaccctgagacttctcagacattgaatatacttgaagggaaatgaactaggctagaaggtaacatctttggtcatttcttcttaggcccgtgtatttaatgaaactcccatcaaccctcggaaatgtgcccacatcctcaccaagattctttatctcataaaccaggtaacagggtgaagcttgcgggtagggagaatggtgctgggggattggaggggagtggacaaatcatgatcactcttaggctattggacagcctctgtgtggctgtagacaacagctcagctctgggtcccctcagcatccaagtctcatatgttgcccttgagcctctttagggtctggggatctggtgtgggctgatcctgaaagaactgctgtctgaccctctgtcccaagctgagacttctttcttgattaacacagggggagcacctggggaccacggaagcgaccgaggccttctttgccatgaccaagctctttcagtccaatgatgtaagtgcctcaacccagctttccttgagaggtggcagctgtaacaaggtggtgggagggccaaagagagctggccccaccagtcagtgtgggctgcctttgtggagacaggaggtatcttctcccaactctggcccttggtgagcccgggctgatagggcttttcccacctatctcccagcccacactccgtcggatgtgctacttgaccatcaaggagatgtcttgcattgcagaggatgtcatcattgtcaccagcaggcaagtcatggggttgtgggtggctcttctgatgggttccattgacagaccatttttttcttgtgtgtaccagacagtgagacttggttgcatattgccagctgcccaccccgtggcagcttccctgttaccactgcccaccccatggcagcctccaggtgtgctgtttctattttaattctctgaccttgacttggacacaaatgcttccttttcttgatttctcttagtca

SEQ ID NO: 30978 - DNA, 1005 bp, Homo sapiens
tctgtcaaatccagaggacacagctggggtaggaggtttctgctagtttctgctgaactagaaacagctgctggtcctgaagagctcatcatcccctaggagggacaggcataggaagcagacctctgagaatgctatgtaattccctgcatgccaggtcctggaagcactgacactaggcaggcttagaagagatgtgatctcacagcaggcggctctaggctgaattagtagattggtacttgggattagggcgttttctgttgaagggataccatttgcctttgggcacctcaaggataggtacctggtcaagttgctctatgtccccagagtctagcacagtcctcagtgccgagcaagcacctgtggaaagagttgcaggaagggatgtgtggatgagttcagagcagaggcccgtaggtgtgtagatgggtgcctgatttctacctccatctctccagctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaaggtaaaatcctgggaatgccatctctggcctaattactgttcaagatctttggctactattgaagtgctcatcccttttctctccaaggatccagggccatgtctggagcacatatgtcaaatgccacttcattaaaagcccttcagaacatgggggagtggtggtggcacaaagggcagataagatggcttaacaatattgggatttctcattacagaggctgtgggtaatattgtgaagttcttgggaatgcacccttgtgagaggtcagacaaagtgccggataacaagaacacccacacgttgctcctggctggtaagtggcatttctagatggggagggcctggatagcttacagcctggatgccactggatcctgggctaaggactccactgtaaat

SEQ ID NO: 30979 - DNA, 1031 bp, Homo sapiens
attttacacatttatttctgatttcacagctcccttccaaggcttcatagcctcaagtgtaaccctcgtgctccccagcagcctctcccattgggtcctacctggagtggagtcccctacctcccgtcttcatcctcactgctgcgtgcaccacatggtgtccaggggccacaaacatcagcaagaagggtattccagagagtgactcacccatccctcctactccattgaggtcacattagatgacacaagatcatgcttctctgtcctctgggctctcttaccctccctgggctctatggagttcgagaccatcaatgaggcgttgctgacaattgtaaaccatcaagtgagaaggtctcctttcctcctctcacttccccatttttgctgcaatgttacagctctcgctacagacttacctacctggaattctaaccgtgatggaaacattgtgaggtagatgagctcattcaacagacctgggctgggctcagaacagctacccaagtgttctgtgcagagggaaatgctctctgtgctgttgagtgctatggtcagtggcaaataactcctagggacacatgaaatgtggctgttgaacacagtgttttcttgcactctaattaattgaatggattaattaagttagtaataaggagcacctcccggtagtgactgccacacagaagagcgcagcttcagagatataaagatgaagaagacatgattcttctaccctggtgtttccttgcagagtaggtgtctgctctgatccaatcatccatttatgggagcttcctgggcacaggtacaggggccaggccctctgtgaggcctggggatgctgcaacggggaggacagcatccaggtcgagggttcccagcaggggctgcacttgtacacagaggtgaaaagcacggaccagcaaaccctgtccagacaggatcagagcagcagggacagaggggatggggacaacttactgtcttcaggagcccacgctcatctcctctgaccctggatcaga

SEQ ID NO: 30980 - DNA, 1090 bp, Homo sapiens
agatgaaggcattgaggctcagagaacagtgacttgcccaaggtcaccttccacttgccctgtgaataaagtctaaaagtccttaagatgtacagaatgtggcacatacttacctcttaatcctcgtctctcaccagagtaggtgaagaccccgttatttgctgccatggtaccgtgatcctcttccaaatgcttataaatgtggaacagtgtaattaataacaaattacttgttatatgttgcctctctccagtctgttccttcataaagcccaagtagtatgaaaatgcgaatctgatctatcactctttgcttaaaacctttctttggcttcccattgctttaggataaagagcaaggcctctgctgtgtccctgaggtcccaagagatccttccacaacccacctcacccttccctccgttccatgatgactccgctcattccctcagacatgccaggcttttcctgcttcagggcctttgcacatctgttccatccatgtggatgggtctgtctcctctctacatctggctaagctctgctcatcctttaggtctccactgaaggatctcatccttagagaaatgttccctcatctaaattaggtcccccaggagatgttgaccaaagggtagtttcagtcagacaaaaggagtacatttttgagatctattgcacagcatggtgaccatagttaataatagcgtatatttcaaaactggcacaggaatagtttttttttttttttttttttgagatggagtctcgctctgttgcccaggctggagtgcagtggcgtgatctcggctcactgcaagccccacctcctgggttcactccattttcccacctcagcctccagagtagctgggactacaggcgcccgtcaccaggccggctaattttgtttttgtatttttagtagagacggggtttcaccgtgttggccaggatggtctcgatctcctgacctcgtgatccacccgcctcagccctccaaagtgctgggattacaggtgtgagccactgttcccggccaggaatagattttaaatgttctcactataaaaaaataagtatctgcagt

SEQ ID NO: 30981 - DNA, 1064 bp, Homo sapiens
gagcaagacccatgtcaaaaaaaaataataaaatgcctggccttggtgccccagagctggtgtgagtgcagtttctttctgtgggatgacctggggaaaggctcttcggtttgccaaacctcccttcccttctcagatggtaatagcgacagctcagtttagtcatgagatttgcacagaataatgtataggaaagcgcattagaaatgccaacctgtagaaagattaggaagatgagaggggccacacgtgaccacagagtggattttcatacctctctccctggctggccccactcctgcccctgctctgaggcccctccttacactgtggtggacttcgtgtgcccacagcctcccaccagaactgcagcccatttacacactccatttgctccgtctctctatgaaggtaaatactctgggacttgtttttggttttagtttttgatcactattccaaggaggttggttccttttcaatcccccctgcccccacctggtagtctgaatttgagaaatatgtacctacacattatgtggggggtgggggagatctagtcctgattaacgtggcatatttttgtttacttgaaaattgcttcccaagattcaatctggttttcagaaaattttaaaattacattcccacgtacaaataaattgtatgctttctggataagtgacatgtttatatggtgataaagggaattataatgctcttaactcttatgtagtatgttcttatcaaaatcaccaagcatgagaacactgtttagtctcattcatcactcagcacagcctctttctgtccacttcagggccaagtctttgccatggccccagataatgtgtaacttagcttcaggaaagcaaaaagcctttgaatttccagtttgctgagccttgaaggaagcttttagacccagcttcaatgaagtcacagctccctgagtgaccagctggcctaggcttatggctccctctcagcctctcacccttgccgtggtcacccctggtcccctgagcactcactgaagtccctttgaaggacatttctagtct

SEQ ID NO: 30982 - DNA, 1051 bp, Homo sapiens
acctgtgaaataactattcagggaaagaaatttaaaggtttggtagatacaggagcagacatttcagttatttctctacagcactggtcatcctcctggccaattcaactcgctcaatttaacatagttggagttggtaaagcccctgaagtatatcaaagtagttatattttgcactgtgaagggcccgatggacaacctgggactattcaaccaattgtaacttctgtacctataaatttatggaggagagatttattacaacaatggggagcacaagttctaattccagaacaattatatagccctcaaagtcaacatatgatgcatggaatggggtatgtccctggtatgggactaggaaaaaatttgcaatgtttgaaggaaccacttcaagcaggaagacaaagttcccaccaaggtttagggtatcatttttgatcgtggccattgttaagcctccagaacctatacctttaaaatggttgacagataagccaatttggatagaataatggccactaaataaagagaaactggaggctttagaggacttagttactgaataattagaaaaagaacacatagctccaacattttccccttggaattcttcagtctttattattaagaaaaaatcaggtaaatggagaatattaactgacttaagagccgttaattccgttatacaacctacaggggcattacagccaggattgtcttttcctgctatgattctgaaaaatcagcctttaatagccatagatttaaaagactgtttctttactatccccttagctgagcaagactgtgaacagtttgcatttacaattcctgcagtaaacaacctgcagcctgctaagcatttgcattggaaagtgttgccagaaggcatgttaaatagtccaacaatttgccagacttatgtagggcaagcaattgaacctacttgtaaaaattttcacagtgttacattattcattatgtggacgatatactttgtgctgccgcccctcgagaaatattactccaatgttatgatcacttgcaa

SEQ ID NO: 30983 - DNA, 1068 bp, Homo sapiens
cacatagcaaatattattaaatctacagagagagatagagtccaatacaatgatagttgagaacttcaatatcctactgtcagcattggacagttcatctagacataaaatcaacaaagaaacattagatttaagctgcactttagaccaaatggacctaacagatattttcagaatatttcatccagcagcagcagaatacacaatcatctcatcaacacatggaacattctccaggatagaccatatgttaggacacaaaacaaggctcaacaaaattttaaacattaaaatcatatcaagtatcttctcagaccacaatggaataaaacttgaaatcaataacaaaaaatttggaaactgtacaaatacatggacattaaatgtgctattgaatgatcattgagtcaatgaagaaattaagatgaaaatcaaaaaatttttttaaacagaaaatggaaacacatcatgcaaaacctatgggatacagcaaaagcaatactaggaggaaggtttatagcaataaatgcctacaccaaaaaagtagaaagatctcaaataaacaacctaatgttgcacctcaaggaactcaaaaagcaagaacaaaccaaacacacaattagtagaaagaaaaaaaaataacagcagaaccaaatgcaacagagacaaaaaagaaatgcaaagaatcaacaagataaaagttgtttttttgaaaagttaaacaaaactgataaaccactagtgaggctaaccaaaaaaaaaaaaaaaagagaaagaaaggagacccaaataaatacaatcagaaatgaaaaaggagatattacaactgttaccaaagaaataaaaaggatgattagaggctattatgaacaagcatatcctaacaaattggaaaacttagaggaaagggataaattcccagacatacacagcctaccaagattgaactaggaagaaacagaaaacctgaactgactcaaaatgaatagcaggtttgaatcagtaacaaaaagtctccccaaagagaaaagccctagagtaggcttttatgctgatttctacccagtt

SEQ ID NO: 30984 - DNA, 1074 bp, Homo sapiens
gccgaccggttgcaacgcggagttgagggtgtggtggtttgcttttaagttgtctttgtttttccacctttttattttcgtgagcttatttatttactgtgtatgtgaagtgtccaaggatttgcttacttagggtatccagcttttattttggtaacatggggcatttgagagattgaggttctgtgggtgactgagcttgattcagctttcttgaggaattcctgctctcttcagcttagggaatgagagggaagttttcatttcagatagcgtctgtgcatgtttaaatagctatttgaaaggaattactcgaggggaagtggaaatgggggacaaggggatggggctgcatctctgtatattggcgtttcaagcctcgatgtggtgtgtggcaggattcatttataagaaagcaagccatgttttattatgtctagcattggggaaaaaactcattatttttcaattcacaaaaaaaacccagtgaatttaatgaaatgttatgagatgagtgcttttcttaaagttccaccctatttcaaaacatcatttaggaggctgacagcggaacctgtttgttcactgtacactttggacacattagatcgtcattcacatgttacatgatccctttggcctcgttaaaatatttaatgcttttcctacacagcactgattatttttaaaattgttgaacaactgtgaataagtgattttttttccccctcctgaaacaacacttattctttggactgacttctgacttgtgcgtgatcatttttttttcttctgcctttaaccgggctgcaaaatactataaaagatacttaacaaatgacagttttttcctctggtataatttgttttaaaaaatatgtgtctggtataaaggagctgcagtcttgctggctgcttctaatttgtttttccattgttgagaatgtaagcttgattgtctgactaggactagtaattttgaaatgggtgtttcttatagatgcagtaatgtgttttgctctctgagacctctgggctatgtagggaatatgatgagaggcatgattatattga

SEQ ID NO: 30985 - DNA, 1050 bp, Homo sapiens
tcttatatttgccttttcctcagacaagcctactggaaataattttttaagacaagttgcatgaattttttttttttaaccatggttgtttctatttcgtgttacagtgtgcgtgaaggaaaattggagcatacacttgcccgagacttggttccaggtgatacagtttgcctttctgttggggatagagttcctgctgacttacgcttgtttgaggtaaatttgggatctgattgtaataagtgaaaatacgtggatgtagattaaaggataaacattactagttttaaggaattaacacatagttgatttgaaccatttggtattctactttaaaatgtgacatatataaacttttttttttccttaaaatgtatctgtctctactgtaacatcttttgaggtgtttgtttagtgaatcagcagatctttatagaaacctgcatattagggactgtgggagatacaaagatgatatgacagaatacttgtgactagggaacatactatgtgtacacaaattactcaccataaaatagaactcagtaattgagtaagagaagttcaaagaataggatatagacatttaaagaagggagaggttccacctgatttgaatgagatcagaatatgcctcagaccacatggctttggcagtgataattgaagagtagtactggacaaagatggggaagacaatgaagcaacaccattcaaatcactatgaacattccagtgtatgaaactctgttgggacatggtaagggtagaaaacgtgtgatggaatcagatttcagaggccttggatactaggcttaacttcagatttttttggttaggagttaccttttgaggctcctgtgcagttgctaaataatgttatccttaatctggctacagtgtgtagaatagattgaagaactggaaaatggagataggcacctagtttaacaggctttcaaaacccattagtatgcaggtcttatccaccattggaattaagctgtttgttaacacctgcagagcagtcagtctttaaatactatggcc

SEQ ID NO: 30986 - DNA, 1034 bp, Homo sapiens
tatttgttttgcctgttacttgctaccccaaacagacttttgcaactactttgactgcagattgaaataactttccttaaagagttggggatcttttatccatctaaatttaaatgtactgacttaggatatagactgataaagtcagtttctcttctggacacagaagctgctagttttttgaaagtaaattggcttattggagttttgttggctcagtttggctgtggtgatctttggataattttgtaaggctagctggtcatttgatactactgtatgaaataaactgtcattagggtttaaaggaaccagaaaactccttagtcagctttgggatatcactaatttcttccaaagcacatagatttcactttagagaaagcaagtctgtgaacttctgctatgtagttagttctcttacagactaggcctaaagccacagttgcaactttagtgtcatcattttgtaactgtcataaattttagtgctttcagagtttgactgtaaacttgcctgggtccttagcagcttcttgttagcacattcagtgacttgactgttgtacaacttttatctggtacaacttttatcttcataggttgtgtcttagcttgggttgctttaacaaaataccatgccatttatttttcacagttacggaggctggaagttcaaggtcaaggtctggcagggtttggtttctggtgaggactgttgctagcttgagatggctatcttcttgcagagtcctcacatggcggagacagcaatttctctctcttcctcttatacggccactaatggcatcattaggactagcctcatgaccgcatctaaccctgattacttcccagggccccatctccaaatactataacattgactgtagagctatatagcatgtgactttttgggatacatagttaagactgtaacaggttgagactgccattttgtttatactttttaaagactaatattaataacttaaggaattgtgtagtttttcccttgcctgtgtcaggttttc

SEQ ID NO: 30987 - DNA, 1104 bp, Homo sapiens
cacattgtatcaggcttcagggcttagaagtgaaaaagacagtttgagccctctccattggcagacaccagcttgcaaacaactgtgattcaaagaatgatatgtgtctgctcatgaaatgaattgaccatgtgagcctaggcaagccgcttgattttttcaggcctgttttgtcactgtgacacagagttgccctagagcaatgcattccaacttctaatgtgcctaggaatcagctgggctctgttttggtaggtgtagggtggggcctgagattacgcatacttaaccagctcttagaccatgccaaaagcactggtccatccaccacattaaaaaaaaaaattattaaaacagcttttttgagatataatgtgcatatcatacagttcacacatttaaggtgtatcgttcagtggttttcagtatattcacagttgtacacccatcactacagtctaattatagagcattttcatcactctcaaaggaaaacccttacctcttagcattcattctgtattttccctgcctctagcagccactaatctgcttgccactgaaatacatgtgcctattctggacatttcatataagtagaatcatacaatatgtagtcttttatgtctggcctctttcatttaatgtaatgtttttaggtacttcattcatgtatgtcattgttttttactgccaaataattttccattgtaaggatttatatcacatagttggtgaatttaatccatttacacttacagtgattactgataggaaaggacttctgttgttacttgttttctatttgtgttatctttttatgttcctcagtttctcctttgtgcccttctttgttttttttccacgcccctccaattgattttttttgatgtaccttttttattccctcaaattattttctgtgcatactgtttacttattttcttagtgattatatgtggattacaatgaacatcctaatcttataacaatctatttgaagtgatactaactttgcttcagtagcatacaaaatcgtacagcccacacctccctcatctttgttatttttgcaaatgacatctttatgcattctgtgcccat

SEQ ID NO: 30988 - DNA, 1068 bp, Homo sapiens
ttggaattctttatgtcttcatatggctttgagttactttctactttcttatttcagcctaaagggctgtctcttagcatttcttatgagtcaggtctgactagtgatgaactctttttgcttttgtttatttaggattttaaaaatttctccttcatttttaaaagataatgttgccagatagaaaattattggttgacagttttttttttctgaatattataaatgtctgctctttttggcctctgtggtttctgattaggattattaatcttaatgaaaattctgttatgtgataagttgtttctgtggctgttttcaagattctgtctttatctttcaatggtttgattataatgtgtttaattgtggatatctttgagtttattatatttggatttcattgagctccttggttgtgtagatttatgtctttcatcaagttggggaagttttcagccattttatcttcagctattctttctgtcgccttctcttttttccttctgagattgtactggcatacctcattttatcatgcttcaaagataatgcatttaaaaaaatatattaatagatttgtggcaaccctgtgtcaggcaagtctgttggcaccatttttccaacagcatggtgcttactttgtatctctgtgtcacattttggtaattctcacagtatttcgaactttttcaatattatgtctattatggtgatctgtgatcagtgatctttgctgttactgttaaaattgttttggggcatcattaacgatgttcatgtaagactataaatgtaatgagtaaatgttgcgtgttttctactgctgctctgcccgactgctctttccttctccttgggctttcctgttctctgagaaacagcaatatggaaattaagccaattaataaccctacagtggcctcttaagtgttcaagtgaaaggaaaaattgcatgtctttcactttaagtcaaaagctagaaatgattaagcttactgaggaatgcatgtcaaaagctaagataggctgaaggctaggcctcttgcctcaaacaattagccaagt

SEQ ID NO: 30989 - DNA, 1023 bp, Homo sapiens
ctctgttgtaggcatatgaaatatttcaaatattagaacaaaagtcaatgtctttcaaaaagaaaagtcaaatagattacaaggaatcagaatgaataagaagtaaaaagatatttgtgatatagtgaaagaatgtgtttttttttttctcaagggagggggtgaaaatgcaatttgaaactcttggtttaaatttgtgtttaaaaacgccatgggttaaatataaaatacatttaaaatggggaataagtttgagatattaaacattgacatattatccattggatcatttttagtttttgaggatttgggtttttttttttttgagttctgtttgtacagattgacatatcataacttctgttctttcttcaaggtcttccaaaggacaagatacttaaaaattttcaaatagaataaaactcattctattttgcaattctgttttgcagtatggatccattggaatcttttataagtataagctacattatgggacctttaatgatcctatttttcctctttcttgaagtattttacaatttcttcaccctaggaattattttaacaattatttgcaagagtgctgaagatgactaaaacaataagaaagcagaaaaatgatggaatcattgagaaggttgatgtaataataaagtaaataatcactattctcttattctttagttttcttattgtgttgcctaaagtattgcatcatttaagaaggtgtaaaagaagtctaaaggcacaatctttaggtttgtttgttacagctttcattgaacaaaaatgagaattcagaatttttcactttctactataatggcaaagagaataattgacagagaagacttttcacaattattagacaaatcagaagatcagtgcaaagagccaaatagaagcactgtaggccgtaatgatgtgggtgaaattaataatataagtgaaatctcaagactgagtctttggatgatgatactctagatcttctcaaacaccttaattttgatgagtgag

SEQ ID NO: 30990 - DNA, 1091 bp, Homo sapiens
tttccttggcagaaaagcacatttctgtatcatttggtctccttacaactaaaacagcatagtactcaaaacatgaatccgttatcaagtatttcctgtgttatgcttataaagatattagtttctttgagggataaagaatatgaaactatctttttatgggcagagacctcacattttaggtagggaatttatattgacattcttgagacaaaaggcagtccaagacagcagacactgaaatcttaaacactgagtcacatataagataagaacaatgcaaattcagagctgggatatgagggctttgaaggataggaagggtttagatgagataagctagggaatgaactaaagtagaagtagagaggaataaaagagcatagagttggttgtggctaatgagttggccaaactggatgaaatgaaacgtatttgcacgaccaggaggatttttatagacgctgtatgtggtgggtttctggagaacctttaaggccaagaagagcctgaacatgtttcagtagaaagtagaaagcaatacatggtagaattttgagtagtttaaacatttttgatatttggaagatattttttgatatttttgatatttagatatttgatattgatgcaaacgctattaggagggaaaacaacaacatgactggtagtattcaggatataaagtggcagagggtaagggactaggatgataacaggtgagccatttgagtccctaagaagtgagagatttaatctaaaacttctattgatcataaaaatacatgctcagaattggttgggtacttttatttatttatatcctgcttcctttcagaatttgagtgggtagagggattaatacagtgtgtatgggaggtttagtcagcgtacaatccagaaaacctgccttagactatatctacatacctgggctttcatgttgaaaatgtatgctgatgtgtagggaagtacagtatatatagatggagcatttactatttcactattaactgaaaaataatccagccaacctagttacaagtggtgacccttgttctttgttaaaggaaaaaataatcacatatagg

SEQ ID NO: 30991 - DNA, 1378 bp, Homo sapiens
tagaacccttgccagtattgaggtgttaagttttagttggttaattggccctcaaaagatggaaatttgagaatgtagcaaaatatgaatcactggttcttttagatctccagaggtctctgagtagctgatagaaattttattttaaacaagtttatcttatgagaagggaaatggatcgaggtaaaatggtgttactctctttttatcactttgttttaaagacaaaaatacttttctaaaaattgagtctgaagcctctaatatatcctttaaggtgattgctaacttgatctgttactgttcaccagggaggtaaagaagtccccagattctgcttacttatatgctgctgactgagcagtgatggggagagggtctgctggacacacacacattaggccacctctcctagggatgtcatgtgtaagactcgggggttggtggttggtgtcctaacctgattcttaccttctggatagtcatctggcttctgcagaatatatgtagttatgtagtctctcacagcagttggaagagttggcttccttaattttattattttaatgaaataggagtctaagcactacaatttctgggaggaagaaaaacaagttatgtgaaaaatgtttttatttgttgttcacttaagcaaaggctttttttgagttttaaacattttgatggatttatagggcttctgttcttaaaataaactaagtttggaaaggtactcttaccagcagagaacattgctcccagcctgctgccattgcccttctctctgaaccttctgtgctgctgaaccaagatcactcctcatacccctgcccccagagcctggtgcatctcatctgggatatgggctgtattgtgaccatcttaacacttcatcccctgtctccaaggaaatgggaggcagagactcatggctgagaagttattttgcaaatggatattttggatggaaaaaaatttaaaggaaaacaacttttccttccccctttccccttttaatgtaagaggctttgatgacaggttctagagtttctggggtttcatcccaaaggcctgaatctggaacatgccctggatccccccacctcagtcctcaagctttctggacccctgaagccaaggcagattctttctcccagcgtcatttctggggcaggaggaatctcttttctggtttacctgggccagacctaagaatagcaggatctctgaaaccacagggttttgatgtgtttttatcaagccaaatgtacaattgccaactgacactctggataattgagcacagggggtgccctcgtacattgtaccgtcactcccttctgaacagttggcagaccaaactgtttggaagctcaga

SEQ ID NO: 30992 - DNA, 1035 bp, Homo sapiens
ttgcttgttattaagtcatctgggaattctcagtgttttccatttatgactttttctagtgtgtcctacattttccattgatccattgatagaagtggtcatcctctttcattcttctttttctgatttttacagcattacttgcatttatatttctactgaatctattcaccaagtccccatattattatcacaattcatatagtctaatttttaataggttgtaaacctttatttcaatcacttgttttttcttcagtgcattagttttctttaatctgtcctagaagatttgaggatcttcggtaggttattctaatgcaagacacatcttttccattaatctctcctttaatattttcctttctttttttttgtaacttcctttccctagtacatcttgtctattaatttccatcaaaagaactgtgagtgctgaccacaaatgtgacactgaaaaggaggactcataagaagagaaaaataccccttgtagattgcttctgaaaatatgtggccttgttctactctctttgatgatttttatctcttcctccaaatctaaaatcaggccaaaatacccaactgtcacaactggatcaagccagctgcaccttttaccaccaagtacaaggctcactgcaacccacggatacccatctaacttcgggacagccatgatccccaataggcagggatgacacccacgaccagcaagaagcagctacagaaaattgatcctcagtgcctctgcctcccataaagatttatggggatcatgtctctcggagaaatgaggcagaatagggaattagggtaatcaagggttaaggcataagtaaaagaacagtagatgcagccagttctaggcaagattaggcagcatttaggccacatccttaatcctgtgataacaagacagtagtctccacttcagcctctgattggctggggaccaagtctccacttcagtctctgattggtcacaggctaatccttcatagggtgtaaccaattggaggcctctaaatggca

SEQ ID NO: 30993 - DNA, 1050 bp, Homo sapiens
aatttctgggttcagttttattatctaggttctactgtcagttttagagactttgggaaagtattagaggacctgagtgtcataacttttttaaaaaatttaataataatggggtagttgagtgatagatgtcatttggccactccagcaaatcatcccagttaaaacctctttatatgaaagatatttcaaaattcagtcggtaggtcatgtatttcacaccgtatttgaaataggtaaacttacatgtaaatgaattggatggttttttgaaagttgattatctatcccctatcaaattgtgccaaacaaataaagaggagagaaaaagtgacaaaatcagtggttatttttgcgtaatcagccagcgttttatgatgcaacattttgtttctataagaaagcatttagtttgccgaataattgaggttagtgaggttgtgaaagtaacaaatccagaccttaaaacttgaaagtaatttatttttctgtttgtttttaagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgaggtatattcactggccaagctgctatattaacatgaattctgtatatctgataggattcttagttattttgatgggttacccagaaggctgggaagttaagggagctcttttagtgaaaaatataagaacattttaaaagagtttgatttccatctttatggataaataaaattattgattcatgtattagaataaatctgcagagaagtatcagttacaataaaaatacatgaaaatttagagagaagttggaaaatctgagtcttaaaatcatagagccactttattatttttaaataataacagtattttaatatctaatacatagttcatgagaagttttttttttactttttattatgtagattacagctattcactaggtgatttataggaaat

SEQ ID NO: 30994 - DNA, 1044 bp, Homo sapiens
aagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcac

SEQ ID NO: 30995 - DNA, 1033 bp, Homo sapiens
tacagaaacttcatataatagagtatcacatggctaatgaacacatggaaatggaagattggaaagaacccaaatgctcataagctgtgtaatgaaaaaaaatgttcttaagtgtataatggtaatataccaaaatagaaaaatgttacagcaatgagaaatgaatgatcaactactcacagcaatgtgaatgaatctcatgtggaataaaagccagatgaaagaattcatttctaaagtaataattcagttaaaactattgtgttgttaaacaggagagtgattatagagagttgcagagcgagtgactggaaccagacactaggagaagcttctagggtggcgataatgattcatctggatcttctttgcatggatgtatagaccttgcaaaaatttatcatgctgtacgattatttgggcactttactgtgtttatactcaaggaagcatgaattgcaaaggaacaagatgaaactttaggggttatggatacattgattattttaattgtaggatgacttcacagatgtagacatctcaaaactcatcaaagtacacactttatgtgcactttactgtacactacttatttctcagtaaagccattacattttttttaaaaaactccccaacagcaccatttatgcttgagtagaaatgtaatttcagcaaaacattaataatgtagctagtttgaattttattggtgtgggtaaagttttaataaatcccttgtttgagactgacttacgctccactttctagttttgtacccctggaaatgtgctaaaggtagattgtcagttgtgttaccaagcattataaaaatgacttataaaattgcatctaagcttaaactatatataaatgaactataaacacctgatggggacaccatatcttggggcttccctgagtgcagtgtcttgtaagtaggatgtcccttgcagggacctagctatgtttatggaattattataagaaagactggatcctatagggaacggggcttttaagctactgaaacctt

SEQ ID NO: 30996 - DNA, 1075 bp, Homo sapiens
taacccaagctaacaaagatttacttctttgttttcttctaagagctgtatagctttaattgcgttaatttttgtatttggtgtgaagtagggttctaaattcattcctttgcatgtgaatatccagttgtgccagcatcatttgttgaaaaaactgttctttccacttgaattgtttcgacacccttgtcaaaaatcagtttaccatgactgtttagttttttcctggactcataattctgttctgttgatcctgtatgcctaaccttatgccagtaccatattgtcttgattattatagctttgtgctgttttgaaacttagaaatacgagtctctgaattttatttttcagtattattttgggtattcctggtctcttgcatttccatatgaattttagagtcagttgttaatttttttttaaaagacagctgcccggcctgaccagcatgatgaaatcctgtctctaccaaaaagtacaaaaattagttgggcatggcggcgctcccctttagtcctacctacttgggaagctgcagtgggagaattgcttgaaccctggaggcggagactgcagtgaacagagatcatgccactgtactccagcctgggcgacagagtaagaccgtgtctcaaaaaaaaaaaaaaaaaaggcagctgacagtttggtaggcattacattgaatctgtagatccattagtggagtattgccatcttaacagcattgtcttctgattcatgaacatgtgttttcatttatttacatcttttaaaatttctttcaacagtgttctgttgatttcagtgtatacaccttgaatcttaacttctccctgaaagagtttacattttccagatggtgatagttatcatttcattgggttatatacattattaaatggcactgagactttttattatacttacctattttatatggccaattctaatctaggtttaaagtactcatcagcagtgttaatgtaaaaaataaatggccaacattaaaattttctgttgtttcagaatagttaattgaaccttgtctctagaaacatgtctacgtacaaca

SEQ ID NO: 30997 - DNA, 1053 bp, Homo sapiens
taaaatactcgtcatgggagtaggattatgggtttataaaggcaagagtaacctgaacatttataagtaaacatattcaaagatattctggcctattttaattccaaattaggcatgtttcacaaactttttaacaaatttttaagtagtcataaaatttcacttcccagttcttatcactttttaattttaatttctttggattaatgtcatcattaaaataggaatacatattggatttttctgactaaaaacctttaaaagaattttttacagaattactgtaagacacaatttctagactctattttataaaattttgctgatttaatcagtgattatgaaattaaagtgacaaaaataagcattacattttactgtattatagtagcaccagtcaaaatttttttttttttaagtggccttatggagacatttgcagcatcagccctgttggaaaaggacaaggaacggagttcaacctcacatttcgtaaaggcagtggaaaaaagtcagaaactttaaaattttctacagagcacagaacagaacttcttacagaagcattggtaagaagattccatgttcataaataaaatttctttcttctctttttaaaatgaagtagttacatagaagtagagaaattaatgttctctgcccctgtacccactatgattatttttttcttactgacctttaacttgaccctgtgaaacgttcacttttctctaacaggctggaaaatcttttatatttgcaagtttattagttttttttaattgcatatgcaggagaaagcattgtatgtttatcttgttcttcaataaggtttcatactctttttattgaatattcttaaactataacttgaataacagtttttagtgtccaggttaccaagtcaggattttacttgctttgagtagaagggagtgagccaagttttccttaccagtctgttgtcataaactgtggttatgttttctctttcagagatttagaactgatttttcagagggaaaaatcacaggaagggtaaatatttaacat

SEQ ID NO: 30998 - DNA, 1706 bp, Homo sapiens
taagattcacattttaaattcaatttattgtgcgtacttaaattttgtaatatttgtttctcaaatcaaagttagatctaaaacagttttagtctcattcttcagcatgcagtgtgttctacagaacctgattcagtaatgcattcttctatctataatgggtttggcagtggttgagtatgaattgagatgtcctgtagaagcaatcttgatctcagtttttgttgatcacacatacattgtttctccttaatcttctccttacttatggtagctattgccatattcaaggaaaataactttaatatctttctaaaacaagtgggtttcttatggattaccagaatacgtaagcatagcagaacaaatattatagtcttgtgtatctatctgaaattgggatcaatgttcaattctttagagctccagaataatagattactgctaatttatataagtgatatattcaatataaagaatcattaggctttcaagtgactatgtagtatagtaaagagaatactgaactttgagttggttaacttctgagcctagtttcatcacttgttaatccaagttacggtttttagaaccttactttcctctttcataaatcggaataacaatacctcccttctctatcttatagggtttttttgatatacaagcaaaataatagtaaaggcactatatacatatatggtcaggataatactggtatagcatttgaacagttgaaaaatctacagatatgaatgattttcacagttattaaaaattacaagctcctggcttcaggtagttaaaccgatttctaaaataacagttctttcaagctgttgaatataattatcatactgtagataagtttttggcatcagacttcatatgtaacatttatccagcataagcatgaacacaaagctctagtcttagctaaaactatggataaaaatctgctattttaaaacaattgagagggaaaaggatatttttaatataaaagttttactggtttgttggtatcatttacatggggtattactaaagttttgagcaaataatgatgccagataaatgttggtcaagaagatcttttggttagcatcaatggcttatcccctttctgcgtgggtactatttttaacagtaatttctttagggaacagcaaataatctttgtgactattttattaatagaaacactaacatcaaagtttggaatgatcttatgctgtagttagagtctgaaaactaatcattgtcaagattaactggcgattcttgaaacaatctgcatttcttatatagtcaatgtttatgaagtcagttccatttgcagctgatgctctgtgctggattagtagtaacctttggctaatgtataaggttgctttttctttgttattttcagttaagggatttgtttagctagttagagctgttagcctgagtctccaattcagtcacttagtttatggagagctttttgtcctttttctgtatagcatttacatttttattactctggactgccagccttttgtcctggcggggaggagggattgaagaaagtacttcttaattagaaagtttaggaaaagatttgtcattaaaccaaattttgaattatttatatattttattcaagccactttgcattagttttcatgatagtgcacagaattaaaatttgtaggaaacat

SEQ ID NO: 30999 - DNA, 1050 bp, Homo sapiens
tgaaactgttgctttatgccacatgtatttttatgccatcaagttcaggaactataactgttaagattggggtgactagagatgctcctaaaattaaggcttttcatagagtgatagtctgaggaactaaaattacattaaagactttattaaggcttagagatgcttattttaaaaatacttcattacaggcttagaaataattgcatacttcctagatggaaatggagtcttaaaagaggcagatgataacataagacttgtgagaagtgagtgtccaagttagctgataggaggaccttccctcctatcaaatgtggtaacctcttccctctttttatctaccaatctcacccttaccctgcacccccttcctggacacacacatacacacacacaggacagggaaacagtcattttggggagtttgcaaagcttctttaagataactcacagtactcactctggaaactgacatttcaattataccttggccaataaagaaaaatatgtcctttgaaaactcccccacactacttttaaagtatacagtatgtacatagtatatccttaagtatatgccttggatttctctctcagttgtgttgcgccccatagaacttccttggaactctgaaatgagactttctaggaggattgcagacttgaaagtaagcatatgtgaaacccattcatccccagttagacttgtgcccaaatgttttacaataattactccaagcatatgaggaagatactttgaaaatgctcagtcatagcttggcagtttgcagtattctttcttgggtagtctgtaaagtcctaacatatatagattgttgctgattccatatgctttacccagaagtccagcagttcttatctccccaacctaaagttttgtatctgacaagagaattgtggtgtttttttttgtttgttttttgttttttgagatggagtctcaccctgtcgcccaggctggagtgcaatggcgtgattttggctcactgcaacctctgcctcccgagttcaagcgactctccagcc

SEQ ID NO: 31000 - DNA, 1029 bp, Homo sapiens
tctgcctttctagggagattagacaagttatataaagaatgtaattttcaggattcattaaggaattgcaataattgacagatttctatgatttttctccttaatgtttataaaatggcattacttcttatgggctgttggtttattttgtctagtaatagtaataccttaatttttatttctattcacttctgaccagattctcatttatttcaatagtgcacagataaacttgaacgagataggttgattctcttccttaacaagttgatccttaataaggtacagtagtttcgcatacatacattgttatttccaagtcatataagtatgtaagataaactcacagtttgagttgattatccagggagtgttcttttctgtcttctcctttttagacagaaagttctgtgtgctctaatctcctggagggagaggtttttgtcagtattccctgtatagtctgtcttaatattgtgggtgcagaatgaattaatgataataaaattctgaatgacgaataatggatgacttttaatacattaaaatgatttttaataataaaaattagcttatttttctttagggactctttagggttaaattttaagtaaaatatatgcttgacataaaatggaaagtctttatcagtgtacattttgttgataaaaagtaattggaagttataagattagtcattttactctgtattttctttttaaagacattttaataggttcatgctcatttcaaacaagaggaattcacagttgtaatatataacattaattcacaatttatgttgaagtgtaagcggattttcatttcttaaaactttgatactaataccaatttgcatagttttattcttaagtaatgcaaatgttttaaactgaagtgtaattataagtacaaagaaattttaattgaaattatagtctcttaacttctaagaaattaccagttaagtttatgaaaacaaactggaacattaaaagattttttaatatagcagactttatttctgat

SEQ ID NO: 31001 - DNA, 1047 bp, Homo sapiens
agtcatatttttcattgggaaaaaatatataagaatattaataaattagcaacacagttcttctgtgtaatatttttctcctgagattggcaaatataaggccccatctaaaagacgaattgctctatgtgctgataagtttctgcttagctgaggccagatcctagactacagtaagttaattgaaataaataccatctagcgagcttctttggataatagccagtttcagtttcctagctacaccctcatgcattcagatgctataccatttgcccttctaatggctgattttttaataggaaggactgggattatcagcccttttctctatgatcttctttacagatgagtatcatagataagttttttccatgtttgtacaataaaatgcccaaagtaccatatttaaaagctctcattttaggataatcattgagttattctatagatgattcatgtaactatcttacatgattatgtatctcaaccttctctttaaaataatacctcataaagcttgaatggaggtttttatgattgtaggcgcctgatgatagagaagattgctgcccatctcgcggatttcacacctcgtcttcagagtaacacaagagcactttatcagtattgccccattcctataatcaactatccacaactcgaaaatgaactattttgtaatatttattacctcaaacaactgtgtgatacactccggtttccagattggccaattaaagacccggtaagtcagcagtttaatttgtgccaccttaagccataaaaatagcctctaaacacttctgggtattttgtcctcctgcagtaagatggttaatagctttcttaagtattccttcttaagcactaagcactgtgtgactctgagtatagtttattatatttgggtagatctcacactgaaagataattttttaagggagtattaagagtattgcaatcttgatcttttgtggcaaagacaaaacaaatttcatgcagataacataattatatatatatagtattatatactataatacc

SEQ ID NO: 31002 - DNA, 1028 bp, Homo sapiens
cacaaagaccatgaattaggaattggccagctctttcaatatagcagccacatttaaattcacatatgcccctcgatcatttttttgccatgttcaaaagtgaagctctttagtatgtttatgaaccaaagttatagagatatctatattgagaggatgctatttctaacagttacagaagcctgaaaagaaggtttttactgtccatctctaatgaatatgtaattttaaggagaaacctgtgtgttcggtgttcctctgagagtgtgttctgtttgggcatgtgctgcactctactttgtgtatatggcagggataaccctagtcaaagaaattgacagaagagtagtaactatgtggttgaatcctgtatctgtggctgaggctgccaggaaagcaggagtgagtgaaaaggtaactttggtcttgggtttggcaagccaaataccgtgatagtatataagattttgtttttcaaagtcttttttgttttcagaaggtttaagattttgttgagattgaagacagttgacctacatgattgttgtttaaacaggctggctacagaataaggtgattaagagcctgagtggtgttatttgatggttccagccataccactgaccaggtctgtgaccttgggcagtacctcatgactctgcctcagttgctgcatttatagaatagtcatagcagctgcctctgaggcagaggttctgatgagttaatacatatatagaatgcttaacataatgtctggcacatttcaagtgcttagaaattagttactatcattagcttagtaaaacatatttttaaaacatgattagcttgctgagtatttaccagtgctactttccatagtcatattcctccaataggatttctactacatacatagtttgcttggaaaatgcagtcctcaaaagctaaaacttagggaaagcacatagcagtttcctcctatatcacctttctttttggacacattccaattttaatgttaatttaagatgcattttattatg

SEQ ID NO: 31003 - DNA, 2130 bp, Homo sapiens
aagataaacacatccccctaaattatcattagtatccttagatgagagaagatatggtacaaatgatacaggaacaaggtgcaaagtatttagatgatcaggaattcttgcaaatggagatggtaatagaaatgaaaatcttaatagaagtgttggaaaataaagttgaaagaaatcatccagagaatagagcagaaaactaaaatagtagataactggagaaagaagataaaggacaaatccagatggttcaacttccaaataataggagttccagatagtccaggaaaaacaaaccaaacaaggaagtaaccagattcttcaaggacatttcccagaactgaaaatgtgagttttcattttgaaagagtccactaaaaactcagcacaagggatgagaacagattcacattaaggcacactgtgaaattttacaagctaggagacactggagcaataccttaaaatgttgaaagacaattctaactttagacttctttaccaagttaaactatcgattaagagtatatgtgtagcttcccacaattatatgccctttgctttgtcatttttataaagaatataattttgataaggaacattttcagaaatgaaagttctcaaaatttacctttgccgtaccctttgcaaaactactggaagatgttcttctaaccacagcaagagagtaagtttaaaaataattgatgacagtgttttaaactgtcatgtgcatcagaattactggagggcttgttaaagcaaattgttggactccacattcaagatttctgattcagtgggtgattatagggtagggcctaagaaattgcatttctattaaattctcaggtggtcctgttgttgatccatagacactttagaactagtgagctatagcatacaggaaacagtggattaatacagaataaagaaattaagagactttgtagtataatgatgaaggaagagcctaggaagggagctgtatgtgcagtaagtctagagacaatcatgtcagattctaggagatacatctttaagaagatgaaattgatagaatacctcatgaatatgaatgtatctagaggaactttagataactagtggaaagttggcggttgaatttgtgaaaatacataggaaattaagcatcaggagaaacatacttattaacttcagggttgggagttagaggaaagggtaagttttaatatattgcatggcccagttgtgaagagttaacatctaaccaagatgactatctaacaatattgggaagttggtgggatggaagatgtctgcgtgcagtggggatgaatgctaagagcaaaatctgattcacgtaattgactaaaactgaaaagaaataacaatgttagcatgttgtttaggaatatgatggtaatggacttaaaagtgagggagaggaaaatgggggtggaggctgaatttcctaacaagcctggtggaactatttgactccttaaagtgaagatgaatgggaattaaccatagacttaaactgcagattaccagtaactagttaaagcacctcttagagtctttggcatacagtaggtgcttactaaaagtatacatcatctattgtgggcagaggcaacaagagaatggaattccagccatgaatttactctgatgatggagatctgagtgttaaaacattaaatatttacatattctaccaaagcatagaaaaatgttgaaatttaactttgacccttaacatttaagtagtagtcgcaatcttggctgcaaatcagaatacatagcttttaaaaaccaatcttgtttcatatgctacacttgggagagtttttttaaacggtgcctgggtaatttagtttcatctggtaaaaaccagcctgtaagcatcctcctctttgaaacgattagtaatgattatattttggtgtttattttctgtgatgatgtatgtctatttgtattactaatacctaaaagactgtaagctttaaaacatatttttctttgttttaagccgcttgatggcattgaaacgaatgggaattgtaagcgactatgaggtatgataaaccctttccaagtttttgtaagattaattcagtaaattaaaataacttctgg

SEQ ID NO: 31004 - DNA, 1031 bp, Homo sapiens
aacagggtttcactctgtcacccaggctggagtgcagaggcacaaaggcacaatctcggctaactgcagtcttccaggttcaagtgatcctcctacctcagcctcccaggtagctgtgactacaagcacccaccaccacgcccagctaatgtttttgtattttttgtagaaacaaagtctccttgttttccaggctggtcttgaactcctgggctcgagcagtctgcccatatcgaccttctaaagtgctaggagttacaggcatgagccactgcacacggcctatagtacacattttttaaagtagaatttctgaatttacgaaatatttactaaatttctcctgcaaaaggattatacatttgtatcatagtttaggagtacctggttcacccatacctttgataactttgagtatcatcaaactctgtaatctgtcattctggtgggtaaaaaacaggcatttaatttttctttttatttgtgaaaaaggttgaacacttacattcttctgtgaattatctgctaatagttgttgctcttttttgtcttgtatattaagaatgtgtatttgcaaatatttttgtcatttatcttttttatgtgattttctctgtatagaagcttttattatgttagtgcaaaggtaattgtggattttgccattacttttaacaaaaactgcaattacttttgcgccaacctaataaaagacatcagattggccgggtgcagtggctcacgcctgtaatcccaacaatttgggaggccaaggcaggcggattgcttgagcccaggaatttgagaccagcttgggcaacatggcaaagccccatctttacaaaaaaaaaatacaaaaattagccaagcgtggtggtgcttgcctgtagtcgcagctacttgggaggctgagatgggattgcttgagcctgggagggcgaggctacagtgagccatgatcacgccaccttactccagcctgggcaacagagtaaaaagtatcagatttgactgggaagagggcaggaggg

SEQ ID NO: 31005 - DNA, 1035 bp, Homo sapiens
gagctcctaaaatgcttgtaatttcctgagtaataggggtgcttattaacgctatttctttccccctctcttcttgctgtctcttgtttttttttaaattattattatttttatgataaaagattgttttgtttcaacagctttaggagtacaagtggtatttttggctacatggatgagctgtagagtggtgaagtcagtctggatttagtgtaactgtcacctgaatagtgtgcattgtactcagcaggtattttttcatccctcacccccatcccaacctccccgcttctgagtctgtagtatccattatactactctgtctgccttcgcatacccatcttgctgtcttttgaattgataagtctttcttcctcactccaagtcccccctacctgtttagaggttgtttgctctatgtctgtctgcttccttagtagctgctcctgctattttaacaggcatcctttaaaaaaaaaatctctatttgaatatgctccaaaattcaaagacatatctctctggcttttctatttttcctccacaaattacacatttttcttatagttttaaacaatgtttttcttttcccatctgtttatcaatatcttctctcattgttactttcttccatttcgaggttttcatctgctatcgtttttttttttttctttctttctgcagtacgtactttagaatttcctttagcgggtctttctctcttctaatagcaaactccgtaatagacatcagtgataacagagataaataaggctcactcccatacaatatgtaattgcaatgtaaactaagtacaaaattagaggttaggacaaagtgttgagagcacagagaggggagactaactctagagagtgaggagagcgtctcaggaacaataagtgtacattaaattatggaaggctatgagtatattcatggaacattcatcagctcagtgggctggagcttaggcgcgggttggtgccagatggagctagagaggtgaattagctagatggtgggctgtgacga

SEQ ID NO: 31006 - DNA, 1050 bp, Homo sapiens
tagctgataacttgctctttaggttttgctaattcaagttctgatcaacatttcttaaaatagtatgtaagaaagtcttgtttcttaagcagatatttcatgtttctgtagagaagaggcaagaaaaatcaagaggaagagagtttgagagtataatgaaaagtagagaaacaaaaaagaaaagatgaaggggtcaaggagttatgacattttgagaactaaatgagtagatttggagacttctctgaacctccgaacttctgatcacttatctgtaaagtgggaggcttagactaggtgatctccattcttgcatacagtgttcaaagaaacataaaacaccatatgtattttccatctgcagttgattgaatgtgcagatgtggaatctgtggatatggagggctgactgtactacccaattttatataaaagacttgagcattcataaattttgatatccaaggggaatcctggaaccaatcccttctaggtacagaaggccaactgtattatgtgttataagtaatcaagaaactatttgaagtatacaagaggatgtgtgtaggttacatgcaaatacaatggcattttattgcaaggaacttgagcatctgtggattttgttttcttcaggggtcctgggaccagtccctcaagtataccaagggttgactgtacagagaaacctattacagttgttgttttactcaagaaataccatataagacaagaagagtggtttggtggcagaaacatttgtctgagattcagaaaagatagattctaatactggctctcctaccaacttgttgatcatttcacctttctggacctcagtttacccatttataagaagtctcagtttactcacctatataaagtgcatcaagtgatctgtaaggttgtttcaactcttcctagtctctgattctagaattcttaaatggatgtatgtttttgccctaaaaaaacaacaaaaattagcccagaatgtcatcagatctgcacactggaatcatataacatgggaaaagcccaccaaaggcc

SEQ ID NO: 31007 - DNA, 1051 bp, Homo sapiens
ataagatatcttccctcctggagcatatagactagttagggaatctagacaatagtaaaaaaaaaaaaaaaaatttattatcagcatgagatccctactaagcagagaattaatggggttactatgatggcatgtgattagtagctagtttgggtggtcaagaaagcatctcagaatcgatgacattaggttgctttgtgaatgacacctgccaaggtgaatagaaaagaatttgcagatagaagaacagcagaggtaaaggccctgaagtagggacctgcctgagattgttgaggaatagaaagagggccaattgtggtcagagcatagtggtgagagagaaccagtggaatgagatgaggtatgcatgcagttgggcagcaaaagtaagaagtttgggttttatcttaagtgtaatgaggagcccattggaaaattctaaacagataaataacatgatattctttatgtcttgaaaagatacctgactgctttgtggagaattgattgtaggagtttaggagtggaagcagtgtttccagttaggagttgattacatagtcaggcaagaagagatggtgacaaattggactaaggtggtagtcatggatatggggcaatatgagaatcaggaaacatcttggaagtaaagtcaaaaggattcgttcatgaattggatgatatagagtgagagaggcaagttcagtcaacccagagagtcaacagagtaaaagatgtcctaaccagataggttttaggtccaaaattgctcattataaagaaagagataatgagctttttgtgacctcagtgctgatggcaacaacagcatcatatgtagatcctgttgtggttagaacacacggacagtgagaaatcacaaggacaaaaaactagggccatctctggaagtggtacctgtttcattcatttattcattcatcaaatatgtaatatctgctaggcatagataagtgttctgaatataaaaagataaatttctacctcagatgctcacactcttattccttatgggaattttcacaaacag

SEQ ID NO: 31008 - DNA, 1041 bp, Homo sapiens
tgtaattggagaggctgatgactcatatgcctacctggcaagtagtcagcatgaaatgaaacatcctgagagcattttgtgaactataaagccccttgtcaggttgagttgttattattgttatctagaaaggccctccttacttttcagaagagcagaagtgtgcagtgacttgcccaaaagcattatttggtaaaaccaggcttggaatccaagatgttccaacctccagtccagattcttcctgatcctgtgggacattgagagagccaggagggagatagtgagtgcaatgttaaggccaccactggcttctgggcaacttggttacattactttgccttgtaatttcatgggaaaacgtaattacaggccagaagttatgatgttggataagcaacatcagcattgcagctgggcccgctgaagaaaagaaaacccacatgttggtggggtacacagttcaccaaggccccctgaatgaaaataatttgttgccaaaaaacggtaacaggactgtctattggggaacaacctctcttactaacatgaaagagctggacggataactttaaaactgagaagggctcttgtccaaattgactattttccccccaaaaaaagtatccttgtcttgttttcattcctgctgtttctagcatgtctaatgtctgagtgcatatctacccttaatgtctagttcaaacattaggaaaagcacccccctttttttgttttggttttctcttagtcatgtttaagttttctaaagaattttcctatatatcaaaggcaggcaaaaaacaaagcagaagtaatagaagaatcgttaaagctgtcaaattggtggagccaagatttaaatctcggagtatctgcccccagagcccttgcttttttgagttcattaaatgcagaataacatttgcattcttaaaacaggaattacacacacaccagagtcaaggggcttagaaccctcatggggatttatatttatgcacaaagaaatcacatgtttttccctgtgttcccagaccc

SEQ ID NO: 31009 - DNA, 1024 bp, Homo sapiens
ttaatggggaaggaagatctacttagaagaaacttaaaattatgaaaaaaagataaaattctatttttatgaattttctgtgtaacaaatatgccttgtgtgtatataagcaattttaagagaaagtgtgtatgtatatgtgtgtatatataatttttgttatatatatatatatatatatacacacacacacatatataattttgtggtttttatatacataatttttattctaccaaacaatggagtgtatgagatgttaggattggggaagaggagagaattaaatcaggggcttccagtccttttattgtactactacaagctcccccggttacttgcaaaatgaatttaatttactgggttgttaaaagaacaccaaatatgtcatacagagccctggaatagagatagaaaaaaaacaagacagaagaaaagtcaagagaccaacaatagagaatcagttctccaaagatgtgaatcattgcttttgaatggcagagccccctggggagatgggtagagcagaacaataaatgaaagtagtcgagagcatagactctgcagccaagctgcctaggaacaaattgcagcttgccattccccagctatatgaccatgggcaagttcctgtacctctctgtgcttcttttcctcaattgcaacagggagctaataatactacctgcttcatgaggttgctgtgagaattaaatatgtcagtacaggcttagccctttgagcagtgtatagtacatattagccatttctcttttcatcaattcccttgttgcctttgccagatgcaaatgtcatgcccaatatggactgcaggcagccaaccaaataaacagaaggaggaggacctttccttcccttgggtcctgagctcatgtatgcattggaattttcagtaggaggagaccttcttgtgatgtctggacacccatcaatatgtagattccaccccacaacaattgtccatattcagacacgttttaaaaatcggttccacatttcaagc

SEQ ID NO: 31010 - DNA, 1056 bp, Homo sapiens
attggagcaaaaagaggttgattacagcggcctcagggttcaggcaatgcaaataaggtatagtctggttacaaatgtgtttagataacctttgggatagatattggatacaagttaggttttcctttggccccaaagcagcatcatagtagccttgtgctctagatatgcttattaggactcaaatgggttctgtctactctttctcactccatggaggcagcccttccgtgtgctcatgaaattagctgctgactctaaaatcctgtgagagcttgcctacttccagttctggttaggacttttcatttgagacagctaaagtggattttgtcgcttcaaaatttttacttttaacatcggtgattgtacttagttttggtttcaaaagtaatgtggatgtttttcacatcctctccaataagcaagtgaatatatgtttttgtaattgaagtatatcatacttacagagagatagaggttttatgtgttcacacagtgcaaccaacctgtgcaataagcaccaggtcaagaaactgagtattactgatacagaacaaggttcccctcctaacacatactcactgcattcaccttcaacataaccactattctaacaccataattttttctaaaacttcataggaatggaattatatttgtaaacatgttattttttaaagttcaaaaaaatagtaatttttaaaaattgggtagtttagaagatttgaaattaacattttgtcaagtccagtctatggcagtcaactttaaggttgatgttaagtaagtgctatattttggagggttcataaagtaggaaaaaacaaatgaagatatggttctgctgtaagatgaaaaaatcctttgctcccggtttaaagaaataaaggatcttgataaactgtctccagtttgaaggttgcattttataggcaatgccagtgagtgcgaggcacagtggaggaaatactttccttaactgaaaactgtcttttgacttctctggatgttagtatctatagctttagataacttactcaaaaagcagggtta

SEQ ID NO: 31011 - DNA, 1072 bp, Homo sapiens
caagaccagcctgtccaacatggtgacaccccatctctagccatttagaaaaatacaaaaattagccgggcatggtggcacacacctgtagtcccagctacttgggagtctgaggcaggagaacccaggaggcagaggttgcagtgagccaagattgtgccactacactccagcctgggcaacggagcgagactctgcgtcaaaataaataaataaataaaataacaaataaataaataaaatatagaagtctgtaacaagtgaataatatttattaacaaatgaaaacatatgctgtatttccagatggaaagactaaatatcacatacttgcataccctcccaaagttaactcataaatttagtaaaagtttaatcaaaatacagcctttttaaaagaatcaataaaatatttataaaattcttgagaaaaagtacatgcatgaaattttaaagttgtattatgaaaaagaaaagtagcaggggagtggctgagtcctacctaaaactataccatatttaaataacagtgatacacaggacaggatactggcacatatatagaagacccagaagagaacaaaattcagatacattgtcagctttctgtatatccattcaactacctaattatctacgtgatatgatatagatgcaaactgtgatagacattagggcacgagggtcctaggcttaataaatttaggtaagatacaagtagatttgttctttaaatcaaattaaattgaatttttatttgacaaataataattgtacatatttatggggtaaatgtagtgttttgatacatgtatactagatttagataagtataataaggcaaacttgccaaacaaatggctgagaaaggagtctttagttggacaactaggtagccattcagaaaaataatcaagtgagcttcttaatccattcaccaaaataaattcccagcttgactcaacttgattaaaagacatagacataactagataaattacaaaagtagacaaatttggaaatgtaaaaaattttaaaccatgacaaagaaatgtttttaaaaagccctaag

SEQ ID NO: 31012 - DNA, 1028 bp, Homo sapiens
cgtgtctttggccactgttacatccccagaacgttgactagtgttttatgagtagaagatgctttgtgaacatttgtttggttaattaggtaccagtttggtagccaatatatgatactaaaggtttatattgtgaacgtggaactgtattgaaacgttaatgttattgctgccatccccagggcaatagtctgaccttgattgaccttcccggccatgagagtttgaggcttcagttcttagagcggtttaagtcttcagccaggtaagaaggaaagaagtgaagtgggcttgtctaggtctgtatctgtatatcaaagccactcatgtgatttgctctggtggtgtttgggaggcagcatggtatcctgtggtagaccttgaggtgaccttggggtcagccagttctgggttgcaagtccaccttcacctggatgatgaggattttatgggattaaaatgcttaaaaagtgttttttagtgtttaggaaatgttaacccttcttgtcattgttactaaatgtttgcatttattctgaaggtgaatttaataatgtatatgactattaaaatctgaaaaaagaattttaaagctgggatgaatcctagcagtttttaaatgccaacatcatttatatatatagtgtttttttgttttttttttttgagatggagtctcactctgttgtcctggctggagtgcagtggtgtgatctcggctcactgcaacctccacctcctgggttcaagtgattctcctgcctcagcctcctgagtagctgggattacaggcacgcaccaccacaccctgctaatttttcataattttagtagagatggggtttcaccatgttggccaggcttgtctcgaactcctgacctcatgatccgctggcctcagcctcccaaagtgctggaattacaggcgtgagccactgcacctggcccatatatattctcaaattacgtaaaattgatgtttcaagaagtacagaacaatatttccatatttcttttagtgtgtgctc

SEQ ID NO: 31013 - DNA, 1374 bp, Homo sapiens
acttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagagaggatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactgggaagtgtgtggagatttaggtgctgctctgctgctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttgaagtgatgttttttgctgtcttcttaaacacaaggcttttttgaatgattagtatatttcatggtaaagaaaacagcctgtctggctcaaagcaattaaatagaatgtaatggtgagtacaaatgagtgcacatgtcaggactcaggtctaactccttgtctcctgagcctaaagattgcaacatacacaagaacacactcctattcctaccccacacactcagggacaagcccaactaaagcttacaaggagaccagggtggctctgtccaggggagaagccagttatggaacagtgcattgagagccatggtaggagaggcccacagttctctggagcatgcagcaggggcaccccacctggccttgaggatcagggggagtcaaaggataaagcatggggctgatgacgtctgagggagtgtgatc

SEQ ID NO: 31014 - DNA, 1048 bp, Homo sapiens
agcatgatcttggctcactgcaacctctgtcttctgggttcaagtgagtctcctgtctcagccttgcaagtagctgggattacaggcacacaccaccatgcccagctaatttttttgtatttttggtagagatgggatttcgccatgttggccaggctggtctcgaactcctgatctcaagtgatccccccgcctcagcctcccaaagtgctgggattacaggtgtgagccaccatgcctggcttattattcccatcttgatgtctgtgtgtactcaatgtttagcttccacttgcaaatgaaaacatgcagtatttggttctctgcttctgtgttaatttgcttaggataatagcctgcagctgcatccacattgctgcaaagaacattttgtttttcttttatggctgtgtagtattccatggtgtatatgtactacattttctttatccagtccaccatcaatgggtacataggttggtttcatgtctgctattgtgattggtgttgcgatgaacatgtgagcgcatgtgtctttttggtagaattatttattttccttcgagtatatacctggtaatggaattgctgaatcgattggtagtctcattctatttttagttatttgagaaatctccaaactgctttccacaggggttgaactaatttacattcccaccaacggtgttgccttttctccaccgcctcaccaacatctgttattttttgactttttaataatagccattctgactggtatgaggtggtatctcattttggttttgatttgcatttctctgatgattagtgatgttgaacatttttcaagttccttgtagtttatggatattagccctttgttggatgcatggtttgcaaatacgttctctcattctgtaagttgtcagttcgctctgtcggtagtttttttttctgtgcagaagctctttagttaggtcccaattgtcaatttttgtttttattgcatttgcttttgaggacatatctttttgagtcataaattctctgcctaggccagtgtccagaa

SEQ ID NO: 31015 - DNA, 1143 bp, Homo sapiens
ctttcagtgattcagtatataccagtgctgtatgatcatcatttttttaaacatctaaataaacttatctatatccattaagtagcattaatagttgtcatcatcttgtcaatctttattttaattatggtaaaatacacataaaatgttccaccttaaccatttttaaatgtatagtatagtaatgttaactatatgtacactgttgtgcaacagatctctagaacttttttatcttgtcaaactgaaactctataccattccctacttcttatttttgggtggaatattacagagcaaatcatagatatcatcttatttcccaacaggtaaggacttaaaaaataacaatatatcagtatcacattaatagaataataacttcttaatataatttaatatccagtctgttcacatttctccagttgtccagaaaactatctttttacaattgaatgtttgagtcagaatccagtcaaggttgatgtattgcatttggttgaaaggtgggtcaccattgaacaatgacagtagaaaacctgggaggctgagtaagtggatattaacctaccctccattaaaaaaaaatctctgtataatttttttcttatatgtttttaacatctaaaagtataattcggaaacaacttctccttctttgacatatgtttgcttgaattcatttcttttaatcagctattaaaattacataatacatgcttattttagaaaaatgagaaaatgcggataaaatgagaaataaataaatcacccataattctaccgttaagagatttacgatgaataaaattttggtgtaaatttcttctgactttgtgtatgcttacatacagtgtgcagtacattcatgtacttttgataggaaaaacctatatgcactgtgaatgggaaaggaggggtagttgcaaactttaaaaagtcctgagagtagcaaagtgttgataatttttgaagctgtgtgataggggttcatcatcttactctctctatatttgtgtatgcttgaaattttccatgaaacaataactttaaaatatatagaatgcttactaagtgacaggtactatgctaagcacgtcacagctttaaaatttttcctttttaaatatgacatgtcaacag

SEQ ID NO: 31016 - DNA, 1043 bp, Homo sapiens
cgtgctcggccaggaaggtatttttttatattatgtatgtgataaaatttacctacagtctgtgttcttagttggaagaatgtatatgaaggacttagcatatagtacatagtacctgacacttagtaagtatgcaatacatcctagatggtggtattattattattattattattgttaatgattattatgtttgttatctttttagaaagtatattgtctttaaaataatttaattttaattttatttctacaagatattcacataataaaatattttagaatcttttatatccaaggacttttagtaggtgctataatgaacacaggctgaataagatagcattcttgcctttaagagagattttggatcagctgcaattactcaaattactctagcctttaagagactagagtaatctagtagcaaggataagaaatgcatacaagcttctgtgaaaccagagagaacatgattagccaacagtgaattacagtatagatgctcttttaactgttttgttacaaaattcctataatttgcaaaatgactcatctattctgacccatcttttcttggtgtaggtcagatgtctgaaaattgtataaatgcttttttcctgcatttccagagagtattcctccaaaaagatatatggttccaacatgctccctgtttgctctgaaaaattctaatttcacaatccaggattgtggatactggggtggaagaacatgcaaaagactattatagagtaccttatttcaactggaaaaatgggggactatttttgtaatctttcagaagggtaagattctccaaacatcatgacgccatagaggattttacaacataaaaatgtgaagtttctggatggtaaaaggccctattaaaaaagactaatagggagaaaacagtttataatcagacaaaaggttaatgtaaattattaatatataaaaattccctacaaagataataaggaaaagataatctagtagaaaaataggcaaagaatgtagatagatacctcacagaatta

SEQ ID NO: 31017 - DNA, 1066 bp, Homo sapiens
ctaattaaaatattttgtcattagaaaaaaaatcacccagactaccattttttcaagtagtgtcttaccaggaaacacctagaattgaagagcaataaaatttatgataccagatcagaatagtaattcccactatatacttgaatcctgctttatcatgtccaaatttatatatgagtagataccaaagttgtagaaaagtgtttaagattagagattatttatttaaaagttgtccctgccagccagaagatttttctcacaactttttgttcaaatttctttccttgaactaggtctccgttttctttcattagtattctggggctattcaaccttcaccttcttgcagaagaaacatggctgctattttccttcttcttccctgtttctgattccctcttacagctttcctccatcctgattccatccttcctccaccttcttggaattccttgccacacaaggaagcccgttgtgcttctagtgttccactaccatttacttgaagaattctttatctctgttagtcttaggaggcctaaaaacaaagcttcattaaagccatagattaactacttacaactaaaaaacactgaattttccaaccagcagtatcacagatcacaggtattcttgtacagattaagtgactctagtattcttttttattaggcaaaagagatttcactagcagacctccaggagaattatattgaggcattaaataaattagtgtctgaaaatcaacaactacagaaagatttgatgaataccaaatctcagctggagatttctactcagatgtgcaaaaaacaaaatgacaggatctttaaaccaacacacagcagaacaactgagttcaagaatacagagttcaagtaaaattttttaaaagtttatttaaaatgtgtattggtacaatataattctcatttctttgagaataatttttgacttacagaaattaaatcttcatcaaaggactctatgtttaattctgaagtatagtgtgcacaagtaaagctatgatcatgttaaaaaatggctgggggaggtgtatagc

SEQ ID NO: 31018 - DNA, 1032 bp, Homo sapiens
ttacttattcatcacttcataccagtcagaatggctattattaaaatgtcaaaaaaaaaacatattggcaagggtgtggaggaaagggaatgcttatacactgctggtgggaatataaattatttcagccattatggaaagcaatttggtgatttctcaaagaacttaaaacagaaataccattcgacccagcaatctcattgttgggtatatccccaaagggatattaacttttctaccataaagacacatgcatgcgtatgttcattatagcactattcacaatagcaaaggcatggaatcaacctaaatactcatcaatggtagactgaataaagaaaatgtggtacatatacaccatggaatactatgaagccataaaaaagcatcaaatcatgtcttttcagaaacatggatggagctggaggctattatcctaagtgaactaacataggaacagaaaaccaaatatcacatgttatcacttatatgtgggagctaaagattgagcacaaagaagggaacaacagacactggggcctacttgaggatggagggtgggaggagggtgaggatcgaaacacctattgggtactatgcttatcacctgggcgacaaaataatctgtacattgccaaaccaccatgacactcaatttacctacataaaaaacctgtacatataccccttaacctaaaacagaagttgaaaaaaataattattcacaggcaacatgattgtgtgtgtagaaaatccaaaaggacctccctataaatgattagaattaattagtaaatttagtaagataattggatactaggtcaatgcatgacaatagttctatttctactcattagaaataagcaattagaaaattaaattaaaaatttatatcatttaccacattatcaaaaatatacctgcaaatacccagaaacatatctaataaaagatgttcaagactccacaaaaatctaccaagcattactaagagaaagcgggaatttgctcactctagagtggaagatggga

SEQ ID NO: 31019 - DNA, 1053 bp, Homo sapiens
ctggtgctgcccctggatctggggaaaggctactgcatgcaaggctcctcccaccccatccagttccctgaggccaggcttctggcccctggagtggctgttgcacaagcaaggtgggagcctggcctgtttcaaggttacccaaggcaggcgggcccagggctgggcttggacctggatcacagtggtgacagcaacctgtttgtgacagtacagtttgcactccccaggtggtcgctgaaaagccaccactgagggaggggcctccgtgatgaaaaggggcctctggccaaggcctgacagccatctgttcccggccgccagcccggagtcctccaggaagggtgaagacaggggaagagagagaggggaaacagaggacacacacacacacacacacacacacacacacacacacacacacacacacagagagagagagagagagagagacagggacagagcgagacagacagagacattgagagacagacaaacagacacagagacatagggacagacagaggaagaaagaacagcagaaaggcagagagacaaatatggaggaaagatagccagaggaagggaacaaagacactaagaatgaggatgagagaagtcgaggggcagaaagagacagagaccgagacatagggaaagaaacagaaggacaggaaagtcagagagagacaaagaaagacagagagaacaacagaaacagaatgaagggaaccaaagggatcaagagacagagagagtgagacagggagagatgagagagagacagagagacaaggaaattccctgagacagattgagagggtgcttgtgcgctggctggcatcaaagtgagggtagagagacaaagtcctgggcaagctctctgatggaaggaggaccctcatgagccaaatcccttccagcctcagcacgttcagaaggaagaagccacacgggatcacagcctctgggcccagggtcctgacagtggttttcagaccttagtagtcagcagactcacctgcggggcatgtgcaaatgcaggtgcctggg

SEQ ID NO: 31020 - DNA, 1008 bp, Homo sapiens
tgatatgttttcagaaagagagtcacagatctcagcattggaagagagtcctgtctttggacaggcagcgaattaggtccatttaatggatgtggcagctgaggttcactaaggaggaatgactaccacaagatcaggcaggcaattggaacatgccaaggagagatgagagctcagggcactgctgcttcctagtccttgctcacatactgcatcctgctaagagagacccatttgtcaactattgtgagctttcaacataatggaagttttaacataggtatgtgactctgttgatctgaggtcctaggagataaatcttctcacctaaccagagcacaagagtaactgcccaagtgagtatgcaaatatgtatatcacctggtttctctggtttttggcaattaacattctttccattcacgggcttgaagcgtgggtagcacaggaggagtgtgtgtgtgtgtgtgtgtgtgtgtgtgtgtgtatttatgcagatgatgtagacagacagtgacactggaccatttagcaaattagaatattctgccctgagtaggtggtgctgcttctttaacagcaccaggcctccaccaccagggctcactggcatagaacagcctggcaaatggaagacgctattcaggaaaggacaatgagaacaacgctcattctacaggaggactgacctttgcaactcccacttcacgttgttattaaatatctgggaaaagactgagagaacaattatagtattgtcataatgtatcagcgtacaaagcaagtgtttccaaggaggctctggttcagctgagcttgacaaagccggggactcagctatagcacttactaatttagaagttgtcttcattacttacaccagctgaaaactccgaatgttttgggtgcagttctgccatcgtggactccagataggaatggaaagataagatgttgggagcaaagggtgggagtctttgggtttctatgtgtctctctgctaggctt

SEQ ID NO: 31021 - DNA, 1030 bp, Homo sapiens
cccacagctgggcagacttaggaaccagcagatactctcgggccatggcctttcacactttctcatcctcactttctccagctttctttcctcaagttcacaaaatttagggacctttctgccctgtctgattccaaaaaagtaatagaagtttgcttctgcctatcccacccctcggatgcctcctccttcccttcaaacatctccatagaagttcccacaagctgccgccatgtcctcaaagaccttttctccactttggttaggctgactctcgatcccttcactctcctaaacattgcttctctgcacatggaaagacagctgctttccctgccttcaggccactgtggcttggcccagtagctttttgtcccgttttataacatttattgccttttcctctggttacagaagcaatacgtgcttctgagattttctgatttctcaaagaggagattctatattcttccttggttcaaccctattgagggagaactgaacctgtttggatatttctatgatacgcttgagagaatgtggggctgctactctgaaaaagaaaaatatcaatgatgctttcagaaattgtccaattgtgccaacgtcttgtgagagcggcattgttcagtgtcatggcagggtggggttgctggataaaatacaggattgccaactaaatctgaattccaagtaagcaatagatactttttagttttaggtattttaagcacaaaatattgtgtgggacacacattgacatattgcatgcggtatttgaggcatacttattctaagaaaattattcattgtttatcaggaattcaaatttaactgggtgtcctgttgtttgttggcttgctgaatttgacaacccaacatcaacatgcaagacagagctggtcaggctgtagagggccttcaacaggggtgcacaagggcatttgtgagtgtaaccaaaagcctcacagaatggagccaaagccaggctgggagcaaggcaatggcaaacagaactgagaagaaatct

SEQ ID NO: 31022 - DNA, 1103 bp, Homo sapiens
gattcccttgtgcttgtggcctgaacatcttgctgctctgagtgctattaaggatttgtaatttagactgggcttagaactgaattcaccccacccattccccaagtaagagaaaactcttctagtgtgtatctgacaaatttatatgacctagatggtttggggattcctgctggatttatcagcattctaatagctgacaactgtaattgtctttttacctagtctgcatctctgcagtaatagtgtatatatttattggggaaatatggctgcggggacttgttacacgctgttgttaatttacaaggttcttctttgagctgtctgtcatgcaccgagttgatggtcttctccttagtttgatttaactccaaaccctgcttgctgcccttctagagaagcagggtttgcacggtagtgccatgggccagagggccctggccacgcatctgtgttagcaggtggggtcagatggcatgtcctgtgatgatgttaagaagggaagttggtatgaggtttagggcaatggaggggtctccagtgtgggttggagaacaaaaaataaatgtgaacaagacgtgatctctcttctactcaacttcaggttctagttttggtggagtaatcctattgtgaggtcatggggcagtagtttgtcactcaggttagcaaggagagactgagaaaggagaatggggaattctcctctccacaaaaatgttgacataagcagaaattcagctgcttccttgggttggttcttggtggaaacttaaacatcagcagagctggacagactgtgttcaccagggtggctgagtgggcctgtggccacaagatgatcacagaagcaaacagacagaactttggatattctttaatgtaatctcaaaatttgggttttttgtggaatactatgcagccataaaaaggaatgagatcatgtcctttgtagggacatggatgaagctgaaagccaacatccttagcaaactaacacaggaacagaaagccgaacaccgcatgttctcactcataagtgggagttgaacattgagaacacatggacacagagagggtaaaacaaacaccggggccta

SEQ ID NO: 31023 - DNA, 1060 bp, Homo sapiens
acatataagtatggcaaaaaggaataaagataataggcaaacagctgatatttgaaaagaatgctgatgctctgtttacctgggctaggagagcagcttatgcactcttcagtgtagccccacattccactgccactgatggttgtatgatggttataacctgggtatggagcacacttctggattggcttccatcttgtgtcgaaatgctaatacagtgtggctgtcatttataaagcagtgacggtgtgctagatgctctgccaaattctttttctgcattaactcttaaatcctcacagagctttatgaggtacatgtgattattagcctcatttttccattgaagataccgaggcaccgagaaggtaagtaattttctcaagatcatacaacacaggacttggaggttctgctggtaaccactattctctatgcctcccaagctaaagaagagccaagatttgtaatttttgatgggagttggcatcagcattccgtttggactaagatgtaagccttcactaacatgcacaaagaaaagtcatcagaatttgatctacatttggggacttcacggatagtgttcatttcccattggtaagggatgaaccaggaaattcatggagtgatcatattcaccagtgagagtgaactgaagtcactgtcactgcacctgtcacctgcatcatcatgcccagctcacattcccgttcctctactccctaagctcctcaggggcagtggccatgcctgatgcatctctgaatccctacttgctctgtgccatctgttaaatgaaaacagaacaaaacacactgaaaacaaaatttgtggaaggagaatatgagctgagaagggagagtctttgcattaggatgtataagaaaatatcccagcagcattgagtagagggacctccgaagaaactggggaggaatcgggcacaaggcatgcacttgtggaagtgatgatggcagaaccagatggaggcagtaaccagtgatggcagaggccttgtctgtctgttgtccaatatagtgacacattgtgcacaaac

SEQ ID NO: 31024 - DNA, 1043 bp, Homo sapiens
atttccctccagtgtttgaggctgactgatggactccccactgccagctccaccagccctggcccatcctcatgtgtcacctgccttgtgagcttttctgaaagcttctcctgagagtgcacttgttcccaacaggcatctcaaagtccagaatgatgtcctgcctggttggaaggggtcctgttccccagtaatccccattaagaggttgctagtctgcagttcttgctctgtctgtttctaagccaaaacagcacaggcagttggctgccctgctgccaaagcaaggcctgggaagcaatccagcctcatcctgatgttagacgagcaagtcctggggaaacagatagatctcatcctggcctcagaggggacagctaaattgtcaaacagcacactaatgggggctgctgactgcacaggtatctctgggttataaatgcccagcaccagagagcctcctaagtcaccagaggacaactttatgatccagaaagtaaagaactggaacaagatcagcttgtgacagggatcaattgatcggggactggagagagcttggcccgggagttcagaactccataaaacttccaagctcagcactttcttgggggacctgcactggccccagtacaaggagcccagaaaactgactgagagctctggagggatgtacagtgttggcctgcagcatagatgagggctaggaaggagcttccctgaacttccccagttcattctgtcactactctcagcccagttgattatgagcctcctttttggaaaagatttcagtggctccccatcacccttaaatgtcagactagtctccttggcatggcaatcaggacttcgtgagatcttaggttgatgagcttgccagcttcattcacatcttacagggtttctacctctgtgttccagccacatttaaagtcttgggtttccccagttgtgatgtaaactgtcacctctgggctgtcatacaagctgttgatttctttagccttgaaggccattcttccccactttctattcatttg

SEQ ID NO: 31025 - DNA, 1034 bp, Homo sapiens
aatttaacaccgtaaaggttgagatacatgtacattctcatagtcaaagccaaaagccaactctacagacaaaagatgaggagcataccatggggaaacctaaaggttatatataactgccatttcaggactgaacagcagggacatgtttttgatccaaaggctatcggtcatattaatagatatataatacacagatcatgatagatattagttttattctaatctttgctgctcaaatagtggaaagagaattggattcacttccaagccccaagcctaaggagaatttagggaacatggtctcatttggaaaagagccatcttgggtggcatgtaatggtcatgggagaaatatttgactatttttttttcagcaggaatagctcaaggaagatctaactagtttccttagatatttgacaagacattttgtgggagggggaacatcctttcttacttcagttggtagaaaggaaaacagtgggaagaagataactttcaaataaagatcggaagatatgtaaattggtgagacttacctaagtatagaacagcagctcctggaggcaagaagtctcccctctctgggggtacagcaggagcttggcagcaaattcccaacagggaagttgtagggggaatcaaaactacattaattcagaccctccatgaagcagacacaaagatgggattagatgtatgaaagatttactggggaaatgagatgggagtcagaggaggctgggaaagccatcagaccataagaaaggtctgatctctgtaaaggagagagggaaggaaggaggattgggtagggtaggaagagctttagcttgctgtgggggttataaggtagtgttggaaaggccactggggagtctctgattggaagttgcccatcagagtagtcccatatatcgcaggaatgggtctgccatggcatccctgctgctctcattcattggctgggagcagcctgtgggaatcagggcctctgtgtgaatatggtgatggactgcagagtgcaggaa

SEQ ID NO: 31026 - DNA, 1085 bp, Homo sapiens
tacagagaaatatttagtaacatgagaaaaatgtccagggcatattgtcaagtgaaaatcacaagatacaaaatagtttgtacagtaatataacataggtaaaaaataaatataaacatggaaaagcaactagaaggaaatgcattaaaacattcacaataattactgtctctttgaatagtgagactagggtgatttttcattcttttttttgttgtattttctaattctctgcaacaaacatttatgtttgtaagtaggaaatgtaaggacagtagttataacacttaaggaaagaatgaaagcacctcctgggaattcccaagatgtttgggactgttcaaaatggccacacagacaaagcgcaggaagaaatgagtgagaaaaagacaggggagaggagtatagatatctcttgagttcttctcctttacctctgaggaagaaacacaagaccagagaagatagacagccaaatcgcttacacttgggtatccgtagcaaggttctcaacttgaaaaagttgagcctttcctaaactcttgaacagcataggaagtgttcagcagagaactacatagactcaaaagcctggagatgctctactaaataagttcctttgcaaagagggacagtcttggagtagctcctccaggaccaatgcctgtacattagaaaagggctctgtttgcagggctgcacagtaggaatcgtgcaacctgagccacaggtgactgctggctgcctgtgatgttacgtctgcatctctggctgattcacccttgcctcagagccaggccagcattagaaaatccctttatcctgcctgttcccagttggcaggtccagcagaaaaattaatgcaggattcattcaattttttatcaagatgcttatatagtgtactaataattaaaagggtgggcaattcttttaagtgtcaagaacttcaaagagagagtggaaacgatgtcagaatgtgagaatcaggcacaaccatgagccaggagcaatgaaaatggctcaaaggcataactgggccctccactgcactgctctgcagagggttggtggccctgtgttcc

SEQ ID NO: 31027 - DNA, 1048 bp, Homo sapiens
tctttatattgaagaagagtcagatggaaagaaagcattagataaaggacaaaagacagagaatggacctagtcatgagttattaaaggtaaatgaacatagagcagaatttccagaacatgctactcatcttaaaaaatgccccaccccaatgcaaaatgaaattggtaagatatttgagaaatcatttgttaatctacctaaggaagactgtaaatcaaaagtttctaaatttgaagagggagaccagagagattttacaaattccagtagccaggaagagatagataaattgttaatggatttggaatctttttcacagaagatggagacctctctaagagagccacttgcgaagggtaaaaactctaattttttaaatagtcacagtcagttgaccggtcagacccttgtagatcttgagcctaaatctaaagtctcttcacccatagaaaaagtctcaccttcctgtctaacaaggattattgaaaccaatggacacaaaatagaggaagaggatcgagccctcttactgcgaatcctggaaagcattgaagactttgctcaagaactagttgaatgcaaatcaagcagagggagcctatcacaagaaaaggaaatgatgcaaattctacaggaaaccttgacaacttcctcccaggccaatttatcagtctgtagaagtcctgttggtgataaagccaaagatactacttcagcagttttgattcagcagactccagaggtgatcaaggtaagacccaacaattttgagtcctaggaactctttaaaaaatgtttagtgtttgaaaattttataaagaaaaacttttttgttagccattttttgttctactaaagctctgccctacactaggaatgatctcactcagctcagagtcagtaaaaagcaaagattatacaagatgatagaggaaaaaaaaaaagcaaagactttagactcagactggttcctactgccctccccatacccttcatcttcttcccagctctgtgaccaaagaaaaattacttacctttaatatcc

SEQ ID NO: 31028 - DNA, 1059 bp, Homo sapiens
aatagaaagtaaattgagtatccaaaagctcaaaataaatgcattattttaatgttattttccttttaaatattaacatcagttttattaaatatggaattgaccagtggattaatagttgcctatcagtgaattgctctgtgttaagtacactaagaaaagcagaacagaatattttataatcagatattttcccattcaaataaaatctttggcagccagtgttctgaatatcacttatttctgtcaaagcaaaagcatagagttaacattgaagaccttgctgtaaacctttcccactagtatgtattcatgagactctcaggtttcatccctgctggcaccagtggtcttaattctatgggcataactgccctagatgtgacaccacagaaaacattggtgattgtacacctgaacctcacaaatctctttcagcatagaataatggaaaaggaatgacactaatataaatggtctaggtaaagcccctgaagaattctgtgccttactttagaattttaagaacactttgaagaataataataatttattgacttacgggactgtgtaatatttacagatttagcattaaggcagagagaaatgtttattgaaaatggattgtcaatttgttaactcaaaagtggtttgtaaacttcaaattgctttacatatgcaaatgattattttattattgaatctgaaagattatgccaaattatgcttcatctaattttttgagaatctcatcctttggtcttgtcattcatcttcttacatgatagatggatctctgcccagcactgttctaaaccttttacctatattacatcttgtaatttcctttaatcctcacaacaaccttctaagaagtagacattgtaatttctgttttattattgaaattccaaaaggttaagtaaccattttgaggtcacagagtagtaagccatcagtgttttaagtttttcatatttcattggtatcacttccctttgttctgtttcttccttgactattgctttatatgggtgacatcctgatactgtagcaaag

SEQ ID NO: 31029 - DNA, 1045 bp, Homo sapiens
gtcttgatagaagacttcctaggacagaagtgtttaaagtttctccttgactattagtgtagcaacttttttttttttttttttttttgagatgcagtctcgctttgtctgccaggctggagtacaatggtgtgatctcagctcactgcaacctccgcctcctgggttcaagtgattctcctgcctcagcctcccaagtagctgggactacaggcaaccaccaccatgcccagctaatttttgtatttttagtagagatggggtttcaccatgttggccaggctggtctcgaactcctgacctcaggtgatccacccacctcggtctcccaaagtgctggggttacaggcgtgagtcaccatgcccaggcttagtgtagcaattgatggcaagtctgctatttaagaaataggattttacaccaggcacagtggtgtatgcctgtagtccctgctactaaggatgctgaggtgggaggattgcattatgattgttcctgtgagtagccactgcactccagcctaggcaacacagcgagactgtatctcttttttaaaaagaaaatgaaagcggggtttgggggatgaaagaagatttttccttagacacagaaagcacatgaggagagatgggagggactgcttgatgggcacagagtttccttttggggtgatgatattattacagaactagatagtggtaatggttgtacaacattgtgagtgtactaaaagccactgaattatgcactttaaaattgtttaaatggtgaactttattagtgaattttacctcaataaaagaaatgggtttgagaaattgatacccttgaaaaaagaaatgagatttaaatttttttattctgaaaataggacttttataataaacatatacctatacttttagatgtcagggaaagttttttcctcttgccaaaacagctcttgatgaaatttaccagatttgtttatttttatgtaggcaaaataactctaagagatctgaagaggtgcagaatggctcacatcttctatgacactttctt

SEQ ID NO: 31030 - DNA, 1074 bp, Homo sapiens
aaccaacagcagatctctgcagaaaccctacaagccagaagaagaaagtggggactgatattcaacattcttaacgaattttcaacccagaatttcatatccagccaaactgagcttcacaagcgaaagagaaataaaatcctttacagacaagcaaatgctgagagattttgtcaccaccaggcctgccctaaaagagctcctgaaggaagcactaaacatggagaggaacaaccggtaccagccactgcaaaaacataccaaattgtaaagaccatcgacactacaaagaaactgcatcaactaacggacaaaataactagctagcatcataatgacaggatcagattcacacataacaatattaaccttaaatgtaaatgggctaaatgccccagttaaaagacacagactggcaaattggatagagtcaagacccattggtatgctgtattcaggagacccatctcatgtgcaaagacacatataggctcaaaagtaaaaggatggaggaatatttaccaagcaaatggaaagcagaaagaagcaggagttccaatcctagtctctgataaaacagactttaaaccaacaaagatcaaaagagacaaagaaggtcattacatgatggtaaagggatcagtgcaacaagaagagctgactgtcgtaaatatatatgcacccaatacaggagcacccagattcattaagcaagttctcagagacctacaaagagacttagactcccacacaataatagtgggacactttaacaccccaatgtcagtattagatcaacaagaccaaaaattaacaaggatattcaggacttgaactcagctctggaccaagtggacctaagcaacatctacggaactctccaccccaaatcaacagaatatacattctcctcaacaccacatcgcacttattctacaattgaccacataattggaagtaaagcactcctcagcaaatgtaaaagaacagaaatcacaacaaactatctctcagaccacagtgcaatcaaattagaactcgggattaagaaactcactcaaacctcacaactac

SEQ ID NO: 31031 - DNA, 1116 bp, Homo sapiens
ttcaagttgtggtagcactgagagaacgtgccagtggaaggaagaaagaggaggcagggggttgcagacagaagcacaggtgaggaggggtcacaagaggagacgcagagaccagctggagtgaaattcaaccgttgtatatgagaggctcttgctgcttgctggataccccacttctgttgtgggagataagataaggcctacacagaacacatgtgggttatgaggtcccaaggggcaaggaggcttacaacagccacagtctatagagcaagcactagaatgtgaacaaaggaaaggaaaggaaaaagcccgtttacaggaataacaactgaccaactcgtgcaaaagcaaggccagacctaaattcccaaggctaaatcaactagggtttcatctcaagaaagaatcacagatatgtcagggagagtctaattgtcaaacagaaattgccagactcaggtatcagaaagggaggaatgttagtaccacagaaagaccagaggcttaggagccagacagatctggtccactcaccagctgggcaggttacttgactcctgaggctcagtttcagaaggcatcagcatccacttcctgaggtggttgtgagaatctaagatattatatgtaaacacctggcacatggctcatgataaatagtagctattactactccatataggagaaatacaatgtaacatcatgggcccactgcagtggctcacgcctgtaatctcaacactttgggaggccgaggcaggcagatgaggccaggagttcgagacctgcctggccaacatggcaaaaccccatctctactaaaagttagctgggcgtggtgatgtgtgcctataatcccagctacttgggaggctggggcgggaggatcatttgaatgaacctaggaaggaggtggaggttgcagtgagctgtgatcatgccattgcactccagcctgggcaacagagcaagactccgtctcaaaaaaaaaaaaaaaaaaaaaaaaaaaattatatatatatatatatataaaaaacatcatggttaagagcatgaaatttgaagttagacgaacctaacttcaaatccttgctttatcacacaagctgtgta

SEQ ID NO: 31032 - DNA, 1025 bp, Homo sapiens
cgcatatctacacatatacatacatgcatatctacacgtgtatatatgtatatctacacatgtgttcacatacatatatacacatatgtatatgtgtatatatgtatgacaagtaaaaagggaggactttattagcagatggggctacccttagttttctttccagcgtagagctttttgcgaagttgggcttgatggacacatggcctgacccaaggccaaacctcagcccaggagtacgtctcagggtcactgtagcccctggctgcccacactgggaaggagggaatgaaagcctattggagagaagaggttggagaggggcaagttgctgggtcctcctgtagagtgggagtgggctctggcttagtttttctgctgagacacttggatgcaggaggaaggagagagtccatgagcctgcatgtgacaggttctgtggtgattttgcccagagggcctgcagttttgctttttgaaggagctttagcagattaacctaacagggaatgtgaacccacagtggtttatgcagagctctgcctttgcatttccaagtccttgttcttttaatgttccaggaagttgggctgggctctcccagggctgtgtcttgttcactataatgtccttcagtgccctacacggtacctagaatgtaggaggtattcagagaagataaatgaaagaataacgtttagaggaataaactcattttttcctctaaaagagaaccagaagatcttttggattgatacttgtcccaggttcagttaatatggtggttaaaaaggaatgactctttggtgactgctttgtaagcccagcagggacagaactggcccagtccctatgacgtgtcaccccatttcctttcccaccccattcccacaaaaggtaactggctcttcctatgttgactatacctgccttttttctgcctaaagtgaccgtctggttcctgagcttgacacaattgtccctttggaatcaaccaaagcctacaacatggtggacatcataca

SEQ ID NO: 31033 - DNA, 1021 bp, Homo sapiens
actacatacaaagaaaatccaataaaattaatgattaattcttatcacctggctcacaatggaggccagaaggtagtgggatcacatggtcaaagtgttgaaagtaaaaaactatcaaacgagaatcttacatcgctcactgtaacctcaaactgctgggctcaagcaatcttcctgcttcagcctcccaaaatgctgggtttacaggcataagccacccctgagagaatctgttgctatcagacctgcctactaaaggaagttagtcaagttgaaagcaaatgtcaccacagggtaatttgaatttacatgaaaaaacaaagagtgccagtaaaggtaatttgtaggtagttacaaaagtataattacatatttacttatcccttctctcttaactgatttaaaaagcaaatatataaaacaatatgtatgttactgtattgttgggtcaataacatagaaatgtaatatatttgacaataaacacaaaaaagtgagtgaaagagaagctgtatttgaatataggaatgataccagatggcaattcgaatccacaggaagaaatgaagagaaccagaaaaatggtaaataggaagattaatataacaaactctataaatacatactggctttcctttcttttctcagtttctataaaagattatctcaagtataattataacaatttattattgggtttctaatatatatagatggactaggtataacaagaatagccaaaaaaggaggaaggaaatggatttatatagaattaaagtttctgtatttccttagaataaatcaggatagaccttaggtaaattttgttttgttgaggcggaatcgcactctatcgtccagggtggagtgcagtggcacgatattggcttactgcgacctctgcccctggggcccctggggttcaagcaattctcccaccttcgccttccaagtagcttggattacaggcatgtgccaccatgcccggctaatttttgtattgttattagagatggggttt

SEQ ID NO: 31034 - DNA, 1035 bp, Homo sapiens
aactaggtcatcattattaagggttgcataatattgatctgtgtggatagaatgtaagttttttaaacaatcccataatgaacatttatgtccaattttttagacttaaaaaaattattgtggaaagaatatgtaacatgagatctatcctctgaacaaaaaaaaaatttttttttgagacattgtcttgcttgttgcccagactggagtgcagtgacgtgctctccgctcactgcaacctctgcctcccgggttcaagggattctcctgcctcagcctcttgagtagctggccaccgcacccagctagtttttatatttttagtagagacagggttttaccatgttggccaggctggtcttgaactcctgtcctcaggttatctgcctgccttggcttcccaaagtgccaggattacaggcgtatgccactgcacccgggcctgccttcttaacaaaattttacgtgtataatacattattgttgatatgtattgttgataggtgcaatgctgtatagcagatctttagagcttatgcatcttgcttgactgagactttatgcctgttgattaataactcctgattttcccctgccctccagtccctggaaaccaccattctactcctcgattctatgactttgactacttcatttttatttctatttatattaatttttaatttttgttggtacataggtatatatatatttacggggtacatgagatgttttgatatagggatgcaacatgtttaataatcatatcatggtaaatggggtatccatccccttgagcatttatcctttgtttttataaacaatccagctgtactcttctaatgattttaaaatgtaccattaaattattattgactatagtcatccttttgtgctatcaaatactaggtgttattcattctttctactttttgtatccattaaccatccccagttttccccacacccccaactctctctcactacccttcccagctctggtaaccaccatccttctactctttttcttttttt

SEQ ID NO: 31035 - DNA, 1051 bp, Homo sapiens
ggagtagaattgtgctgtctttatctagcagtttttgaatctgcttgatctggccctctatggctgatacatagtagtttcctggcatttcttcctttctgataaaactagcgactccctttgtctttctcctgtgttaaatcttttttttccctttccatgaatcatatagtgtttttgtttgttttgttttttgtttaacctctccatttgatggagtatatcatacaatagattcctgtggaagactgaaatcttgcattaatgaaaactttttttcatgttcatgcttgatttggttggctaaggattctaggttggaaataatttgccttcagaattctgaaggccttgctgcattgttttctagcttgtcatccttttgagaagtctgaagacattctgattcttgattgtaaaaatgttttgcttttctggaattttgtgtttcctatattctgaaatttcataaggttgtagcttggtgttacgtctatttttaacaatttttcttggatatttgtgtaccttctgaatctgtaaaattcattagttctgggacattttctttaattattttattgacagatgtattagtctttgaggactgtcataacaataccacagtctgctctctgtttgtctgttattggtgtataagaatgcttgtgatttttgcccattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaaatggaaaacaaaaaaaggcagggattgcaatcctagtctctgataaaacagactttaaaccaacaaagatcaaaagagacaaagaaggccattatgtaatggtaaagggatcaattca

SEQ ID NO: 31036 - DNA, 1081 bp, Homo sapiens
ttatagccttcaaatctatacatgagaaagaatgaaggctaaaaataattgaaaggacttctaaataaagatggctgagtgaaagacacatttacttttactccctttgatagcccagcaaggtgacagtaaaggatacttttagaagatttgaactacacaggtaaagagaataaagaaaagacggcaacaataaaatctggaaactggaaagcgagtgaactgatgggaaacttcttagtggacttaaaaatgttcaatcctaagtggcgggagcaaaagtagaaaatacttcttaggctcaggaattggcagcatcaggtatttttggcagggaggaggtgagggtggtgctaaaaacaggaggatttcttgaaaatctgtttaagaagcagctcagtcataatagccccaaagtagaagcaactcagatgtccatcagctgataaatggttacatgtaatgtatatccacacaattaaatactatttggcagtaaaaaggaatatagaactgatacatgttataacatgatgaaccttgaaagcattatgctgtgaaagaagccagtcacaaacgaccacagtattgtatgatacatgctataacacagataaacctttaaaacatgctaagtaggccggacatggtggctcacacctgtaatcccagcactttgggaggccaagacgggcagatcacttgaggtcaggagtttgagaccagcctggccaacatggtgaaaccccatctcaactataaacacacaaattagccggatgtggtggcaggcacctataatcccagttacatgggaggctgaagcaggagagtcgtttgaactggggaggtggaggttacagtgagccaagatagcaacacagcactctagccagggcgacagagtgggattctgtctcaaaaacaaacaaacaaatgtgctaagtatactaaagaccacattgtatgattccatttgtatgaagtatccagaaattgtgtatttgtagagatagagtggttgcataggactgggagtaggggaggttagagggaaatgggaagtgactctagggtatgg

SEQ ID NO: 31037 - DNA, 1063 bp, Homo sapiens
acttccaaataacagaagtactagtagacatcagagaaaagaaggaattatcagtaaaatattcaagaaaaattcccagaatcaaggaacgtgattttgcagaatgagaggctctatgggtatcctggaaaaatgaaagaaaatagatatacgctttcaattaaagcctagtcaggaaaatggagaccacaccaattactgtaacagaatctaaaataaagagttgtttagccagatattatgggttgagttatatcttcctcaaaaagatattttgaattcttaatccctagtacttaagaatgtgaccttatgtgcactattcacaatagcaaagacttggaaccaacccaaatgtccatcaacaatagtctggataaagaaaatgtggcacatgtacaccatggaatactatgcagccataaaaaagaatgagttcatgtcctttgcagggacatggatgaagctggaagccaccattctcagcaaaatatcacaaggacggaaaaccaaacactgcatgagttgaacaatgagaacacatggacacagggaggggaacatcacacattggggcctgttggcgggtgaggggctgggggagggatagcattaggagaaatacttaatgtaaatgacaagttgatgggtgcagcaaaccaacgtggcacgtgtatacctctaacaaacctgcacgttgtgcacatgtaccctagaacttaaagaatattaaaaaaaaaaaaaggctgggcacagtggctcacgcctgtaatcccagcactttgggaggctgagatgggtggatcacgaggtcaggagaatgagaccatcctggctaacacggtgaaaccccgactctactaaaaatacaaaaaaattagccgggtgtggtggtgggcgcctgtagtcccagctagttaggaggctgaggcaggagaatggcgtgaacccgggaggtggagcttgcagtgagccgagatcatgccactgcactccagccggggtgacagagcgagactccgtctcaaaaaaaaaaaaagaatgtgaccttatttcgaagtgg

SEQ ID NO: 31038 - DNA, 1014 bp, Homo sapiens
cagagtttggaactgtcctgtagttacatgatcagtcttttttttttttttttttcctatctttctttttctttttttctgagacggagttttgctcttattgcccaggctggaatgcaatggcacaatctcatctcactgcaacctccgcctcccaggttcaagcgattcttatgcctcagcctcccaagtagctgggactacaggcaggtgccaccatgcccggctaatttttgtgttattagtagagacggggtttcattatgttggccaggctggtctcgaactcctgacctcaggtgatccacctgctttggcctcccaaagtgctgggattacaggtgtgagccactgcacccagcccctatcttttatattgtgttttatttctttagaaatgaggtttcactgtgttttccagactggagtacagtggctgttcacaggcaccatcataatgctgtgtggcctccaactcttggcctcaaacgatcttcccaccttatcctcttgagtagcggggactacaggagtgcaccgccatgctcagcattttttttctatcttaacataaaatggaaaagttactgttgccttttctcctgataaatagcagcctaagtaagactggtagtttggaataaaggataagttaaaagggcaggaaggtgaggaaagaagtgtttaaaaatgaaggcgagaaggagaaaaagaagttgagagataaagtttatattttcctgtgccttagtatcgacttgcagtgaattagttgaaagttgccttgccagttacatataattggtgacttttaagttatttgtcacctggaacagacataacttctttagcatacaattcagatacaactgtcattgaatttatgtttccataaaattggtggtagaatttttagcattaggtaggagaagaggacagggaaagacagctgtgtctcaggcactgtactgttttacctattttgttaaatcctcacagcaaccctgtaggtag

SEQ ID NO: 31039 - DNA, 1119 bp, Homo sapiens
acttttgggttttgtgattaagaccattatttttagtttttcaatggaagacaaatcagaaagagattttccttcagtagcagaagagaccagggttagaatcagcaatactggttttgtaaatactggaatttatttaaagcatgatgattagagatattgggagaaattaaggtaatttctgtcaagaaagtatgcctcatagtgatacgtgcacagggtactaagacatacccagttagacttttttgttccattttaagaggacactggtatcttgggattagagtgaatgtgacagtaattaacaaaatatagtgaaaaaactattatcatagagcaaaggggggaagtagtccagtattaggtattactgtatgtaaatctaaaatcccatttaaatataatttttatttgttaatactccaggatgcattccgtactacagtattctgatgttattgagacagttttatcaagattttatctctatttaagtcttaggaaatctctgttaactttattactgtattacagttattgctacctttattccagggtgcttggaaacattgttttgagttagtgatctgtagttaacctgtaaagagatataagtccagcttttacattagataaacttttcccttttctcataatttctgtatccctttttggtaacttaaatatccggtgtaattaatggatttgtttcgcaatggttgtgctggtggagacattgtttgaaagttgagaaggaaaaggggaaaacaaaaggattaattcatgaatatattttaactataaaaaatatatatgctttaaagcatcttccaaaataagtctgaataataaggtcatatttttggccatgattatttacttgttatacaggctgtgttataatttagaggaaaaaaaagttttggaaagagaagcctcagaaaaattttctattgcctgggtgtgggccaggtcacatggattgggtgtgggaagtttcagtgttgcagaacagacgaggaagctcactgagaattatcctgagctgtgttaacaaactgacagaacacagaatttttactcaaaatggattggttaaacgtctttaaagatttt

SEQ ID NO: 31040 - DNA, 1033 bp, Homo sapiens
ctgtggctttgtagtaagttttgaaatcagaaagggagagtcctcccacttgattttcctttttcaagattgttttggttgcttagggtccaccttgcagttctgtgtgaatattagaatcagccttttcatttctgtggaaaaaacaaaatggttgaactttagtaagaattgcattgaatctgtggattgttttggatactgttgccatcttacacagaatatctttccgtttatttaagtcttctttaatttctttcagcggtgttttgcagtgtttagtatatgagtctgatacttggttaaaattattcctatgtatcttattcttcttaatgctgttataaatggattattttcttaattttgtctttgaattgttcattgttaacgtatagaaatacaactgattttgtgtgttgatcttgcagctttgctgaatttttttattctcactctgtgtgagtgtgtgggtgtgtgtgtattctttaggattttctatttataagatcatgtcatctgtggatactttttcccctccctaattgctttgactagcacttccaatacaatgttaaataaaagtggtggaaggagagcatccttgttcttgtcttgttcctgttcttacggtggaaaactttgtctttcaccattgagtgtgatgtcagctccacagttttttgcagatgccctttattatattgaggaaattcccttctaatcctagtttgctgagcattgttatcatgaaacggttttggattttgtccaatactttttctgcatcaattgagatagtcatttgttttttcccctttgttttactaatatgaggtgtcttatattgattttcatatgttgaaccacccttgcataaatcccacttactcatatacagtccttttaatatgcttgctggatttggttttcctagtacaaatgatccttatttttcacagattctgtatttgtgaattcacttattggctaaaatttatttataagcccaaagttgataattgcagtgttt

SEQ ID NO: 31041 - DNA, 1050 bp, Homo sapiens
tacagagcattgtttctggttttcagatttttaatttgactaaaatggtattttatcgaaatgtggaacatttaactacagaaggctattctgaataaaccctgattctccattttaagaggagttttttggggggatgtcaggtagaaaaagataactacaggaagaggacagtttggccgacttaagggttctaattgagcacactctaaggaaaccctggaggttaaattcctgatgaccagacaaacatttgggaggaaattgaaaaactgaagtatttcagaagtgaaaaaggaatgcaggagccctgaaaattagattctaaaaacgtgtagaaattctacctggggccgggcacagtgactcaggcctgtaatcccagcactttgggaggccgaggcggggggatcacatgaggtcgggagttcaagaccagcctgaccaatgtggagaaacaccgtctgtactaaaaatacaaaattagccaggcgtggtggcacatgcttgtaatcccagctactggggaggctgaggcaggagaatcgcttgaacccgggaggtggaggttgcggtgagccaagatcacgccattgcactccagcctgggcaacaagagcgaaactccatctaaaaaaaaaaaaaaaaattccacccggaacagtcttggtggaagcatgaattagaagagtctaagacaagtggaattccgctatttaaattccctgtgttacttctaaaaagaaaaaatagagacacagtgaaatccaactaaatgtcagaagtgctacaagacagaacatagatatctaagaatcttaatgcaaagggaaggaactattttgtgttaagtaggggaaaggaagattactggactgtaataattgaccacatagttcattcaaggacacagggcctatcctggacttgcacaaccctaagagtgagtgcctcagattttgcgccctaggtgcttcccttaattttagtcctggccctgcagggcacagagagcttagggttctcttccttggccacaaaacttcccat

SEQ ID NO: 31042 - DNA, 1034 bp, Homo sapiens
tcaaatatctttagtttttctgaagtgggtacatattagaaaaaagagctagtcagtacccagcttgaatgaactcacagagagaaacttggaagaggacagctatttaatgagggagggagataatcctgcctgctcattggcttttagggaggtgcagagtcctttaggacagagcctgtggtccgggtattgctcataggcagattctcaagctccccaaagttacattttctctggaactctcctaggccactccctgctgatgcaacatctgggtttgggcagaaaggagggtgcttcggagcccgccctttctgagcttcctgggccggctctagaacaattcaggcttcgctgcgactcagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacaggtaagtatgaattagaatacatccaatagtttgggccttgaatataggttaagaaggcaaaaaatactttcccagggcctggggttgaaatatgtgtatagaatatcgtatatctgttttacaaaagatttatcacctcctaaacctctattcccacatcccaaagaaaaggcctgcattctgtttggaaatctctcttcttaatgtccacacaacaatctagaaagagaaatcatcaaaataaataaaagcagagctctgtgcactttgttacttatctcatcgtctggttttatatagtgcaatgtagttctttcagacttactgtgtgtgtcttggagatgttaactgtaagaacaaattaaaacaaagattctagcaaaatacacatgaataaaaagacaatttgtgagcttaacattggatacgagacttataaaaattggatttctctactggtcattgaagaaaaggta

SEQ ID NO: 31043 - DNA, 1058 bp, Homo sapiens
caaaaaaaatttttttttaagtcatttaaaatcattttggaatggtaaagattgtagcaataaggtattaaaactcatgtgagctattatgtgtgggaattgtttctgaagagctacaattttttacccagagtatgccagtaatctcctagaaggtgtactttgttcacagaaagggcattgtgtagcaggcctgggatgcaaagctaggttatctggagatccaaacaaactacaaagtaaggtgattgtgggtctggacacaggcaaagtggaatagacagattcgaagtggcctgcgatattgccgtgattgtcacaggccacaatgtgggtgacaggtcaggtctgacagatcttgagtggtactgtaataggaaagtgaatgcaccagctgctgcaaatgatgggctgagtctgaggcaagcaccatggatagctccaaggcagggctattactgcctgtaagaatctgaagcaaataaagcccttttttatcaggaaggcgcctggcctgtctgaacaatactacttcgaaggtgtgccatgaaagatggtacccaggatctctaagtaattacatgacagcaattttgaataataatttcaactattcttatgggccaggacaacacctcacccatatctgaatagcctcactttgttatgtgaggattgagaagttggcatttaaatacatcctagtggacttcttgggtcatcttatcaccttgggaggcatataaatgaacctcaaccaatccagaggatatctcagtctttgtgaaactcctgatcatttttgtaaccttgcatgtgctttccagagatagttcttgctcccttggactttcagattatgctgtctcacacagtgggttcttatctcatttgctctatccagaggtatcttttattgaccctccgtttaagcattctcatctacagtgaagagtaaatgaattgaatttaatagtgagaagaaaccttaaagatcttctagagccagatagctctttatgatttataccatattttaaaagggaaaacatcatagt

SEQ ID NO: 31044 - DNA, 1026 bp, Homo sapiens
aaggaaacaagtgaagttgattttaatgttatttaaacaagtaaagcaaaatattatttcaatatatctgtgtaataagttattactgaaatttgttgcaaaaatagcaagtcttcagtatctgatgtatagtttatacaatttggatgctaaatttttattggaaatacttgattcatatttaggtgtcataaagtttatagttgaaaatgtaaactcatatacccaagtagttccaaatcattcttaaaagttttaaaataactgaatccagtattggttttttaattttaattaaagtttaaaatataaacaaaattcacttcctagccacatttcaaatttcaattgccatatgaggctagaggctggcttactggacagtgcagctctttaccatctggcgcctgttctctgcctcatctcctgctgctttctcctttgctcattctgctccagctataatggcctcctattctttgattatggcagatacttctcattttagggcatttgaatttgctgttctttttgcctaaaaaaagctctacccctaggtaggtgcacagtctgctccttcaccttctttaggacttcgctcaaatgtcacctttttagacgttctttctcttatcaacccatttaatatctgtacaaattgccttctctccctacctcttatatttctaggctgccttctgaaagaagagagaagaggactgggaggggagaggtgacctgatctacaaggagcagtgaaatatcagaattgtcctatacagataaatgaatacattagacaaaagcgtagagtaagataaggttgaataagtgatcataccccttcagcttgcttgctgtctgagcaacttatatgattatttttgcgtatacataacaatttcagatactaagcttcttaaatgcaaggctctgccttaatgtcctcttataccttctttggcatctagcatgtaactttgaccaaaaggcagtgtgaaatctccaattgtggtccacctattg

SEQ ID NO: 31045 - DNA, 1048 bp, Homo sapiens
tcatgttttaatctgccacatattttaattttgaaaatacagggttataccttttttctttcatttggcttctttctagaaagactgcttgacattcatgacgtttaatattttaccataaagaattgtcttttgaatagttgttaactgacatggttagcttcattttttgtagaatacttgtttcacattaaaaaaatgttttctttggagaatgcttttgcttctttaatatccacaaaagcaggagaataagattgatggtctttcataattggaatgcagtgaaagaatagaccagtagggttttttgttttgctttgttttgtttttggttaactcattaactgtcaccaagattgagtctcctgttgatgttttaaatttcgaatttagaaagctgtcagaaaatttaaactcttaataaccataatgcctttttttctccaaaatttcatgtttaatgagaggaaacatttttaagcaacataccagaggtaattatgctcttaaaaaattaagagaagcaagtaggataagatttcagatttattccctttcctttgagtttcagattatcatactcttagcgcattagttctaaggaggaaggtctagactaaggcttatcatggggttgggaaatgtgaaggatccacaggcctgaactgtgtctatgggaagaaagacacaaaaaagggtcaagatacatttgggtaatgatgagggcgcccatgagggaggcctctttctttttctctaatcccataagcattgtcagccaaatagtactttaacttgtgcttagccatggcaaggctgggatgctttgtttatacaagtttcttcggactgcagttcttaaagcctctctccccaaaggcattgtaggctttggagttgtgaatttataaagggaggtaaaataaaagtgctgtaaaactgcttggctattcaaattgagctggaagggaaggtgggaagctggttaggatccaccgagatacttgacgcttattttcacggcttctcagtttacaaaaaacgg

SEQ ID NO: 31046 - DNA, 1043 bp, Homo sapiens
cacgcccagctgatttttgtggttttagtagagacggggtttcaccatgttggccaggatggtctggatctcctgacctcatgatctgcccgcctcggcctcccaaagtgctgggattacaggcgtgtgagccactgcgcccggcctcttctagctatttttcaatatacaatagattattgtaaattacagtcactttacatggggctttcttactgacagttaggccaatatttttaaacactcttattcacagttcacagcaagaagcatattttccattgcctcactatacatgtcagtttgtgtatgtgtgtgtatatatgtgtatgtatgtatgtgtatgtgaaagaatcctgagacaagtttcatgacattgttccacagatgtaatgccctctggtttctatgctatcatttttcattctttaaaaaaatggtggttgtaattatctgagctaacacaacgaatcatattgtcaaattgtacacacaggagtcagagatcttatccagaatcaggctttataaatatttcaagactgtaagtaatcgaggaataggcaaagcaagcatggagaggagacatgtcacatggctccctagtctgtccttcctacatcagacacatactcctctggcacttaatgatacataaggtggtcagtaggtgagatttatgggtcacctcacacagtagggagcacctaaattatgaaacattttattttcttttatttatttttaagatggagtcttgctctgttgcccagcctggagtgcagtggcttgatctcgactcactgcaacctccacctcccaggtttaagcaattctcctgccttagcctcccaagtagctgggattacaggtgtgcaccaccatgaccggctaattttttttgtatttttagtagagacaaggtttcaccatattggccaggctggtctcgaactcctgacctcgtgatccacccgcctcggcctcccaaagtgttgggattacaggcgtgagccactgcgcccagcctaacatctttattt

SEQ ID NO: 31047 - DNA, 1047 bp, Homo sapiens
ggactgtagatctacttccctcaatccctacttctccccctcaaaaaccaacaaaaagtttgtttgtttcaggagaaaaacatgaaatgttcagttggtctgccatttaaattaaaaatgagaacataattcaatacattcggtaaataacatgtattctagtgccctattatggccagttaaggaaaggaggcagaatgaagaagagaaaataagcaaagtagagacaatgagaggtatacacagtagtaaaggagaaggacgctggcctctcttcatataattgtgtctcttttactgcttctaaagacttctaaaggtctgctgtgttttcatttcttgataccttctctttgggccagagaatattaagctgaagatggaatgtgacttgtagatcagagatttaccacccctgctttgaagcagtgttggtgtattcccactaaaataaaccaactgtataacattccctggaacttaataagcactcaataaatatttgttgaataaatatagaaatgaaaatgcagaaatcgtacacagagtgactttttctttaatttgtttggacctttatcctgcatggagcaaaattggtattctaattccgagtgttgcatcctttattactctatggcatacttgaaaatttcttaatttattgtggtgtcctgtcagctagagtgaaggaggatggtgctggtggaaagagttgtgcaggtgagagtgaaaaatactaccattgactgtgacatgaagagggagaagaagccccagaaaagatggaggatcactgagcctggcaacagttgtggcctggccgtgttaaacttagaagaattcaagctacctgtaataattgatcctgactctgaatggattttggttagagagagtaagagcataggcaggaattgagagctcagtggaagaagggtccagaacacattagcagtaactgcaatgacagcaatgccaagtaaaaattagctctcatctctgccaaaaggaaaatctagtttctaatgatagcctttaccatat

SEQ ID NO: 31048 - DNA, 1024 bp, Homo sapiens
tagataatagatgtcttaagaaaagtaaggaggccaaaatctacctaactttgatgacctaattgttactgcttatggttgtcatggatgtcatttcttcagagtcatcattcatacaaaaccatatcccaaaaatatatgttcacattttgaaccaatgtaattttttctgtattttcaatgctgtaagattttaaagcatatttgtaaatttaggtcaatctttcttaatatctttctgctgtctctaaagattgctggctgggcatggtggctcacgcctgtaattctagcactttgggaggcttaggtgggaggattgctttagctcaggagttcgataccagcttggggcaacatagcgaaactccgtctctacaaaaaaaaatacaaaaattatccaggcccggtggcatgcacctgtggtcccagctatttgggaggctgaggtgggaggttcacttgagcccagaaggtcgaggctgcagtgagccgtgatcacactgtcacaccactgtactactgcactacagcctaggtgacagagtgaaaccctgtctcaaaaaaaaaaaaagattgctgagcatgcattcactttgaacatttttatttattactagttgatcttctgggtaacagtataaatgtaccgtgaatttatattgttaaatattttgcaaagtttaatgattctaaatgggcatttaaagggcacagcatcaaaattttgtatttttgtctaccgtgaaatcaggcagatgcaagggattatttctaagccttagcctgcatattgaaacaaacaccttgtacattttgaaggttttccatggtaccacagaagtagcacccttcaggacttggctctgctactgaatagcagcaaattcattcggatttcataattccttgcctcaaactgtggttaagttgttagttaccttcttaaagcaaatccaccaaagaattttatgtgaaccttgcaacattcattcacaatggtaagtatttttaaagaaataac

SEQ ID NO: 31049 - DNA, 1045 bp, Homo sapiens
tagcttgggattaagctgggttaacccatgatacaaattagagaaaaaggagcaaaatagctactagccacccgggattactggtagctcagacacacctcctaccctctggagagcttcctgtgtgatacagcccagccatgccaacacctaccatagtattgtgaacacaagagatgttttcatgccagtaaagttaagaaaacccactgcttattttcttccgtgagtactttgaaatcattctcaaaaggcatggcacagtataagcattaatagtcatttcgtgtacagcaggcaacttgataaccataaagatattctcaaaagtgataaatgagttttgtatttatttgagaagtcttaagacattcaaatgtctgtacctaaaagtggtcacattcctcatgtagaagtatatctaagagtaacagttacgtttctcttgacggacagaaatataggtgattaacaagaatcaagaaaatagattgatttatccttaaagattttctgcagattctgtttgtactttgaaaattatcagagttggccaagcctggtggctcacacctgtaatctcagcactttggaaggccaaagcaagtggatcacgaggtcaggagttcaagaccagcctggccaacatggtgaaaccccatctctactaaagatacaaaaattagccaggcgtggtggctcgcgcctgtactcccagctactcaggagactgaggcagaattgcttgaacccgggaggcagaggttgcagtgagccgttattgtgccactgcacaccagcctgggcgacagagcaagactctgtctcaaaaaaataaaaaaaaattaccagagttactattaaaatataatttaataaagtaaatgtagacatgattcttgcaacttctttaatcctttcagaatatggcatttcaggctgaacaaaaaataaaagcagatattttacgaagcttgagtactgaacagctattccggttattatcagattcagatttgaatgtgctgatgaagacattgggact

SEQ ID NO: 31050 - DNA, 1027 bp, Homo sapiens
agtagagacagagaacaaatcaaaggtatccaagccttaaaggttgggggcaggatttgactataaagggatagcacaggacaatttagggagggaggcagtgatagaactgctctgtaaatgctgactgtactggtggttttaagattctatatatacatttggtaggccaggcacggtggctcacaccgtgatcccagcactttgggaggctgaggcaggcggatcacttgaggtcagaagttcaggaccagcctagcaacatggtgaagccctgtctttactaaaaatacaaaaattagccaggtatggtcacgcacctgtagtcccagctactcgggaggctgaggcaggagaatcgcttgaacctgggaagcagaggttgcagtaagccgagatcacaccactgcactccagcctgggtgacacagcaagactccatctcaaaaaaaaaaagattctatacatttggtaaataaaattactaccaaaagagtgaattttactgtatttcataattctgttctcatttctacaaatgaaatgccacttgggatttcgatcgtattgtatttataaataaatttgggaggacgtgacatcttaacaatattgagtcttccaattcatgaatatatcttcccaattatttaggtcttctttaattcttcttatagcagtgttttgtagtttttgatatataggtcttgcactcttggtcagatttattcctatttcatatgtttgatgtttttgtaaattttatttttaaaatttcgatttccagttgttcattgttagtatatggtaataaaattttcgtatgtcagtcttgtatcctgcattcttgccaaagtcactttaagttattttgcgtgaattacttaaaattttcaacaaatgatcacatctgtaaataaaaatagctttatttcttactttccaatctatatgctattttgtttttcttgtttcattgtctagctagaacttgcagtgtaatgagatgaggatgaacatatttgtt

SEQ ID NO: 31051 - DNA, 1033 bp, Homo sapiens
ttacaggcgcctgccaccacgcccagctaatttttttgtatttttagtagagacagggttttaccatgttggccaggctggtctcaaacttctgacctcagatcatccacccacctcggcttcccaaagtgctgggatgacaggcgtgagccaccacgccgggccctgatttgaatttttaaaagatcactctggtgacttacagagaaccatctgtaggagggcaagaatggaggcacagagaccagttaaaggccattgtaataatgtcggtaagggagtggggggattagtattggaagtattgagaagtggttggattcaggatttaatctgaagataagcaccaacgggacttactcacagattcagtacaggatgttaaagagaggaaaggaaaatgtctagggttttagcctgagcaactggacagagggtgttgccatataccaagatggtgaggaatatagaagtgggttgcggtagggagcatcaagagttcttgtttgggtatgccagcgttaagatgcatattagatatccaagggacttggaagagcagggctataaatctgaatggtatttaaagccatggagctggatgaagtctcttagagcaagtaaaaagagagaaaggaggactaaggaccaagatctagagtccctccagcatttaggcagtgatgagaaagatgcagcaaaggagcagaaggaacagctagtgaggcaggcagagactcaggcgcataaggtgtccagaaaacaaaggaaaaagatgcctggacggtggccgtttatccttcaaaactcatatcaggttgctatgtcctccaaaaagccttgcctgacccactctccaccctcccctccaggctttgccagggatgccttttgtgctcctgtagcatctgtagaacacgtcacactgtgtcttggctgtcaggttgtctgctccactgaaggggagaggaacttaactaactcctctgaagtaaatggctcttccagattgtgaagcacacaggacaggcta

SEQ ID NO: 31052 - DNA, 1029 bp, Homo sapiens
gcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagag

SEQ ID NO: 31053 - DNA, 1008 bp, Homo sapiens
gtttacaggcatgagccgccacgcccggccttctctccgttttaaagctgaatgatattccactgtatggatgtaccatgttttcattatctgttcatctgtggatggacacttgggtggtttccacctttttgctgttatgaataacgctgctatgagcatggtatataaatatctgagtccctgctttccttctttcgtcttagagttcttgtgtgcctattttttctgttggttagggatggaaggctgctaagcccctcactttacaattgtggaaactgaggtacagatggagaggtcactagtctagggtgagacctagctagctggagagccaggttttgggcttcttgactctgccgagcgtgtcctccaccctgtcccactacctcctgctttggcccaggccttgggcctttaaggtgggatgctgaccaaatcctctcctcacttacaacagggcagatgtctctgggcctccccaccctctggctcccagccccgccctctgcccagccagcctctggaactttgcatctttcttccatcggtggagaacagcagtgggccctgagtctccagacactgcttcctaccttggggttcttgggcccagctccgcaacctctctgtctccgactccccagcaagtgcccagtgttttcaaagagcaaaagcctggctcttctcctgcaccatcagaagctgggacatttccaccctggcttctgcccaaacctcagacacaagtgctgttgtcttctcagaggggcctgaacctggcttttcccccacacacttgaatccacattctttctggggacgaggaggagaggaggacatttgaagggcagggagaggaaaaggaacgtttactgagtttttttttcctgaaccaggggctttaccagggggctttatgctcagcaggccttaggccagcttcagagtgggcactctccataggccccaactaagaatggggtgcaggcagagctggcctgt

SEQ ID NO: 31054 - DNA, 1048 bp, Homo sapiens
ccacacccagctaattttttttggtgttactctgttgaccaggctggtctcgagttcctggcttcaaatgattctcctgtctcagcctctcaaagtgcggggattacagggatgagccaccatgcacactccaaggagtaattataacagtattttataattattaaccatttataaaaagatttttttagtgttttgcttaaaataatggatagcatgaacaagaaaattgaaatattactttgtattaaaacaacattttatttaatcagagaaaaactggcaaagagagtaacaaattttatattgatttgttacttggtttaagaagaaacatcaattttgatatatagttatataagtagaattagaatgcttcaaatttgccagataattgcttcagtacttactcttatctttgtttataatcctctcctgtcatgtacacttttaattattggagaattaaaaattgctattttttaagtagtccttaaataattgttgaatgcctgaatgattgttcatagtttagagaagaaaaaatgttttaatgtgatcatgatttctaatctttcttataattggtggtattgccttttatacttctccatgaaaaggtattataattaagatgttgtatcttagtgtgatttagtagtatttggaattccttataatagaaaacagagcaattgttttaggtttgaatacctacattactgaactttctagagtctctgaaaattgaagagcaaaacttgaatagcacccctaaatacattctgatttacaaaggatgccttatcaaagtttatattatgctgtttggcttattttttatattatatgtatgtataatatgtatatattatatataatatgtatatataataaatataatatgtatataaatatatatatagtatttatatgtactccagactgggcaacagagtgagaccctgtctcaaaacagatatgtatatctatatatatctctctctatctacctatctacctatctgtctatctatatctgtcaccc

SEQ ID NO: 31055 - DNA, 1030 bp, Homo sapiens
acttcaaaatgatataaaatccatttaccatcttcagtttagagcgtacagaggagattagggcgaacaaagaggaagatgtagttaagagaacaggctttggagccagaatcctaggtttaaatcctacctctgccacttaatgtcattgtgaccttaggtaaacccttagcctctctaagcctcatctgtaaaataaggatactaatagtagccatctcatggtgattctatgagttaatatatttaaagctcttagaacaatgactgatacatagttatcacttaatagctgttagctatgattattattactgtaataaatgatacttctgtcaaagctaaaaagatacaccaatatcaaaatattaattagatattatgtattatgtcattcacataggatatattaacatcaaaaatatatgttgaagtatatgccagaaatctctgacaaaccaaaatcctttatttatttcttatttttgagacagtctcactctttcacccgggctggaacgtggtggtgcaatcatggctcactgcagcctcaacctcctgggctaagatggctctcttacctcagcatcccaagtagctgggactccaggcatgcgccatcacgtgtgactaatatgtttgtagagacagggtttcaccatgttgtccaggctggtctggaactcctgggctcaagtaatctgcccacctcagtctcccaaagtgctaggattacaggcatgagcccctgcacccagcccaaagtcctttatttttttaaaataagatttcctgtaataatgccaagaatatttttcataacatttaaaaattatttttatctttattatagggcatttcttccatgacttttttctgtcttagtataataaattagaacctttttgttaaaacaaatccctagtgcgagtttaagtatgggaggtttggagagttcttgttttagagtgattagacctgaaaaagagaaataaaattaattaccatggtttttacatgggagctggtg

SEQ ID NO: 31056 - DNA, 1061 bp, Homo sapiens
cattttatatataagatatcttaagccaggttttatagtgatggatttgaggattataaatttaggttttaaaaaaatgtaatattgccaggcgcagtgactcatgcttgtaatcccagcactttggtaggctgaggcgggtggatcacctgaggtcaggagtttgagaccagcctggccaacatggtgaaaccccgtccctactaaaaatacaaaaattagcaggacatagtggcacatgcctgtaatcccagctactcgggaggctgaggcaggggaaatcacttgaatccaggaggcggagattgcaatgagccgagatcgcaccactgcattccagtctcaaaaaaagcaagactccatctcaaaaaaaaaaaaaaaagtaatattgatgtagattttggtattatttggtatttctctttataaatatatcttaaaggcagttggaaatttaggatttatcagtaagaaagcaatattttcctagataacaataggcttaggactgcatcagatcaaaattatcaaagtctaggactttttgaagagttttttttgtttgtttttctaggcttttctgtttgggtttctcttttcttatgggaagcagatatatatcttttctttgcccatattcctatgtcttttagcagttttactcgtgttctctattgcttggaattcttttcattcttttatgtttttgagacagagtctcactttgtcgcccaggctggaatgcagtggtgtgcatgaacatggctcactgcagccttgtcctcctgggctcaagtgatcctccagcctcagcctcccgagtagctgggaccacaggtccatgtcaccatgccaggctaactttaaaaaaattttttgtagagacagggtcttgccatgttggccaggctaatctagagctcctgggctcaagtgatcctcctgcctcagcctccaaaagtgctgggattacaggtgtgagcagctgtgcccacccttcttttcattcttaacaacaatattcttggaagtctgttgccctcctgttctaagtatccaag

SEQ ID NO: 31057 - DNA, 1050 bp, Homo sapiens
caatgctctacaaacctgaggctcctggggctcaggacaaggaggctggtaggcatgaggggacaaggaatacaggccaagtgtgcctggtatgtagaggtcccaggtgaacattctctcaaccaatgtttaactttctttctaggaaaaagatttcacaaagttttatataagcaagtagataggtttagagtaattatgtttcattaagaattatgtccttggaaatgacagtgctgcatataaataaatgaataataatgatgaatagcctgaatatctggcatatagcagttacctttaaattaattgaaaaaaaatttaatgtaaaagtgaaatatctggagtgacaaggcactgcacagtgtgattttcatcaaattgctttattcctctttcttctgaagcatttgtcagttcaagttgatctaagggcattactgaatttgaattcaaatgtactccaagtcccaaggtttaaaaatgaattcctggggttctgaactcatgatatgcttttgtatctgaagatgatcatccaaaacatattgagtagcactacgacaggatttttcatttgatgtcaaagcaacttcacattgatagtgtttgatatagtcactaaaatccaaataaagctattgtctctaggaagaagaaattgtttctttagctaaatatggccatactttggtgcatctgacactgacaatgaatatagatataactttatcctaaaagggtttatatataaagtgtaacattcactttatatacatacatatagatagacgaatagacataaataaagtcaatatctgaaagaagtagaagattataagtgattttatttgtattttctatttttctattatatagtgtgtaataaaaaaacaaagttatttattttttgagatgaagtctcgctctatcactcaggctggagtgcagtggcgcgatcttggctcactacaacctctgcctcccaggttcaagcaattctcctccctcagcctcccgagtagctggttctgcaggcgtgtgcctcca

SEQ ID NO: 31058 - DNA, 1123 bp, Homo sapiens
gaaaaaatgcaaagatacagagaatatttgaaaatgcaaaaaaaaaaaaaaaaaagacaacaaatgcaaaaatacagagaacgagaaactcttatatattgttggtgggaatgtacattatgaaaaacagtatggaggttgccaaaaaaaaaaaaaacctaaaaatagagctaccacatgatccagcaatcccactactgggtatatattcaaaggaaaggagatcagtgtgttaaggagacatctgcactccatgtttattgcagcattatttataatggccaagatgtggaatcaaccaaactgtccatcaacagatgaatagatgaagaaaaagtggtatatatacacaatgaaatactaatcagccataaaaaagaagaaaattctataattcgtggcaacatgggtgaatttggaggacattatgtaaagtgaaataagccaggcagagaaagacaaataatacatgttctcacccgtatgtagaagctaaaaatgtttatcttaaaaatgtagagaggagaatggtagttactagagacgaggaaagatgaggtagtgggagatagccagaggttggttaatggatacaaaattacagctagatcagaggaataaattatagtgttccatagcactgtaaagtgatcataattaacaacatttactgtatattttcaaatagctagaagagcagattttgaatgctcccaacacaaagaaatgataaatgtttgagatgatggatatgctaattactgtgatttgataattacacattgtatacatgtattgaaatatcacactgtacctcataaatatgtacacttattaaatattaattaaaaaaataaaagtagaaaaatgggccagatttcagaaggcagagataataatagcagttggccatatttcacagagtttgatgcttttcattcagcaaccctgaaaatattcccactttattactttttctttttaatttttgtgggtacattgtaggtgtatatatttatgagatacatgagatgttttgatataggcatacaatatataataatcacatcatgggccaggcgtggtggttcaagcctgtaatcccagcactttgggaggctga

SEQ ID NO: 31059 - DNA, 1938 bp, Homo sapiens
gagccgagatcacgctactgcactccagcctgggtgacagagcaaggctccatctcaaaaaaaaaaaaaaatcacataatgaagaatggagtgttcatcccctcaagcatttatccttgtgttacaaacagtccgattatactctttagttattttcaaatgtacaattaaaatttttaaacttttaggttcagaggcatatgtgaagggttgttatataggtaaacttatgtcatgggggtttgttgtatagattatttcatcatgcagatattaatcttagttcccaggggttatcttttctgctcctctccctcctcccaccctccatcctcacgtagacctcagtgtcttttgttcccttttttgcattcatgggttctcatcatttagctctcacttataagtgagaacatgtggcatttggttttctgttcctacatgagtttgctaaggataatagcctccagctacatccatgttcccacaaaagacacaatttcattcttttttatggctgcatagtattccatggtgtatatataccacattttctttatccaatctgtcattgatgggcatttaggttgtttccatgtctttgctattgttaatagtgctgcaataaacattcacgtgcatgtgtctttatggtagaatgatttatattcctctgggtatatacccagtaatgggattgctgggttgaatggttgttctgtttttagctctttgaggaaccaccatatggctttccacaatgattgaactaacttacactcccacaaacagtttatgagtattccctttattccacaacttctccatcatctgttattttttgactttttaataatggccattctgactggtgtgagatggtacctcactgtggttttgatttgcatttctctaatgatcagtgatgttgagcttttattcatatgatttttggccgcatgaatgtgttcttttgagaagtgtctgtttgtgtcctttgcccactttttcatggttttttttcttgtaaatttgtttaagttccttgtagattctggatatttgacctttgtcagatggatagatagcaaaaattttctcccactctgtaggttgcctgtttgctctgtagcagtaccatgctgttttggttactgtagccctgtagtgtactttgaagtcaagtaatgtgatgcctccaggtttgttctttttgcttaggattgccttggctattgggctcttattttgttccatataaattttaaaatagttttttctagtcctgtgaggaatgttgttggtagtttgataggattaacattgaatctctaaatagctttgggtactatggccgttttaatgatattcattctttctatccatgagcatgggatgattttccccatttgtttgtgtcttctctgatttctttgagcagtgttttgtaatttttattgtagagatcttttacctccctggttagctatattcctaggtattttttctttttgtagcaattgtgaatgggattgccttcctgatttggctcttggcttggctgttgttggtgtataggcatactagttatttttgttttttttatttttaatttttttctatttcaaaagtttttggggaacaggtggttttttattacatggataagttctttaatggtaatttctgagatttttggtgcacctgtcacatgaacagtgtacactgtacccaatgtgtagtcttttatcccgtactcccctccccaccttccccccaagtccccaaagtccatcatattattattattattttgcatcctcatagcttagctcccacttataagtgagaacatgtgatgtttggttttccattcctgagttacttcacttagaataatggtatccagctgcatccaggttgctgcaaatgccatta

SEQ ID NO: 31060 - DNA, 1063 bp, Homo sapiens
aacaccccactgtcaatattagacagatcaacgagacagaaggttaacaaggatatccaggacctgaactcagctctgcaacaagcagacctaatagacatctacagaattctccaccccaagtcaatagaatatacattcttctcagtaccacatcgcacttattctaaaattgaccacataattggaagtaaagcactcctcagcaaatgtaaaagaacagaaatcacaacaaactatctctcagatcacagtgcaattaaattagaactcaggactaagaaactcactcaaaactgcacaactgcatggaaactgaacaacttgctcctgaatgactactgggtaaataacaaaatgaaggcagaaataaagatgttctttgaaaccaatgagaacaaagacacaacataccagaatctctgggacacatttaaagcagtgtatagagggacatttatagcactaaatgcccacaagagaaagcaggaaagatctaaaattgacaccctaacataacaattaaaagaactagagaagaaagagcaaacaaattcaaaagctagcagaaggcaagaaataactaagatcagaacagaactgaaagatatagagatgcaaaaaaaatccttcaaaaaaatcaatgaatctgggagctggttttttgaaaagatcaacaaaattgatagacctctagcaagactaataaagaagaaaagagagaagaatcaaatagacgcaataaaaaatgacaaaggggatatcaccactgatcccacagaaatacaaactaccatcatagaatactataaacacctctagtcaaataaactagaaaatccagaagaaatggataaattctgggacacatacaccctcccaagactaaaccaggaagaagttgaatctctgaatagaccaataacaggctctgaaattgaggcaataattaatagcttgccaaccaaaaaatgtctaggaccagatggattcacagccaaattctaccagaggtacaaagaggagctggtaccatcccttctgaaactattccaatcaatag

SEQ ID NO: 31061 - DNA, 1067 bp, Homo sapiens
caaatgttattagttaagatgaggttgtaatgaggtagggtggacccctaatctactatgactggtgtccttatacagattgacaaagtgtcaatctctgatgggatcctgcttcttttcaaaaagtcattttagagacaatcaaggatatttgaatttaaactggatattataaactaggaattattaattttcttaagtattactttattattagtagtattattattgtagtagtatttaataattagtattattaaagtatttagtatgactaaagtatgtaagtattgccctttcttaggtattaccattctgtaggagaatatccttgcttttaggagatacgtgtttaagtgtttaggggtgaggtgtactgatgtctgcaacttattctcaaataattctgaaaaatgtgtagtctactgagtacagtaaatgtggcaaaatgttaacagttattaaatctagatgtatgatataagtgttcctctttcagcattctgtatctttgaaattttttaaaatgaaaagcctgaggaaaaattattcctataatcttattttatatcctctatttattgaggaaaacctcccttcttttatttccataaaaatgacaaaggccagttccatccaactgaaatggtcacacaacccagagttcaggaactcacaggagcagtataatgggtattaagcctggatctgtagaagatggtcaggtgtggacagtagggctccagcccctgcatagctgggcttaagtcccagcttctttactttttcctcatttagtggtcttgggcaaagcacttaaaacttctgggcctagtttcctcaactgtaaaataaggatagtaatatgttatttgttgtgagaatcatatgttacatttgtacatgttatgtaatatttttgtgtgtaacacctacatgtaaagcaataggcccaccacaagcagtagctgttgtgttaagtaccaagggccatcttgtgagcccctgcaggcaattcagccctattggagaatgcagagaaagttacctcaaggaagcagagttgg

SEQ ID NO: 31062 - DNA, 1050 bp, Homo sapiens
gtattgacctatctctagttagcatctgctcaccaggacccctgagactgtggagggggtaactcagcagaaggaccagggctaacagggactgaatccttaccacataccagggcccgttccaaacactttgcatgttttaaattgcttaatcctcacaatgacccagtggaggagatgatagttttgtctcttcttcatattatgatagaggaaaatgaggacagagaggccaaatgacaggcccatggtcaaccagctaagaagtgaaggggcaggacttgaattcaggcctcctggccccagagtttgcagcacctggcatgtggcagtagttgagaagttacactgagtctgagtagacctgtagttagtgaccccctccacagcacagggctgatggacagtgggctggcttgggccaagagcagctggcactgcagatctgttggaatagctctgcccaggctgcccagggcaagttgcagactgggaggcatatgtatcctaaaatagaacttttgagaaataatgtgcatccaaaggaatgagtctcagacgaggatgttcaagaatcagtagcagatgctgtgcgggccacagaatgtttctaggtaaaatgccctcctccccaccccccatgtcccccacaaccaacaaacaagctaagaaaaaagaaacaaaataaaataaattgaaacaaattaataaacatgcaaaaaccacacagacagtcatctcttctgtctgtgggtaaaactgacagctctagaaataaacggagatccatataaagggtttcaaaatatgggagtaatttttgtttttccatttaatgctaggtttcaaaggaggggaatatgtctatcactgctacataggcattctgtttaaaacccacccagatgccttaatggggctctgtcaagagtgggaaggtccccacagctgtttctcaaagccagtagaccactcagtgtgggcagtggggagcttgtgcttggcaggcctcccacgtcgccatcatttctttttgaacacttgacggca

SEQ ID NO: 31063 - DNA, 1066 bp, Homo sapiens
tctttctgcagggctaactgctgactggagaggggagaaaatggaacacggagagacagaagaaaggtaggagtgtgttaacacgtggaattcattaagggctggaagggtgatttattttaggaagaacaagttctctaccatcaaaggtcacaaaggatcaagtcagagaggacaggcctgcttttcaagagcccacaaccaaaacagaaaggtgagggaaaatgaatcattttgcactgattgggttggaacagcagagtgatgcaagaaattctgagatcaattttcctagcaattctggtgtccaatgaattggcttttcagccagatggttcacaggttcagaaaaggcttgttgatccattatcccctcagggaggggttccataagtggacattccagggcccagaatcataagttctcatgccaagagtgctctggtggaaaaatttccatcatgctttatatttccctacttttctttagcaaagaacactaaatataattcaaccttgacttgatggctgagattatcaatgctacaggacaacttgactgagaaataaagtgtgtccagctctcttggcttttaattgtcaccaaataataataacagcttttcctccccaccccaggagaggagtcagagcttgtgcccattgctttcggggagagttgagacctctgacttctaatgaactcctggaaggacagtgtgagagtctctgggtagtggcctgaccttgggaagatcaggactcatggtgaggggggcagggcagggcagagggtgttgcttgctttgttgtggcacttgaagggctggccctttgccgggggtgggaaggtgacagcacagataccttgggtcagagtactcagctctgtcctccctcagtttgggagataggacagaggttccagtggctgaattggcccagagggaaaggatgctttgaatattcatactgcccagccttgtataaaatgcatgggcatagacagtgaacagtcaattgcaaccatgaaaaatgacaagccgggaaccttcccaaatctctt

SEQ ID NO: 31064 - DNA, 1082 bp, Homo sapiens
gcctgtaatcctagctactcgggaggctgaggcgggagaatcacttgaacccgggaggcggaggttgcagtaagccaagattgtgccattgcactcctcgcaatagagcgagactccatctcaaaaaaaaaaatccttctttggtcactattactccccttttccccaaaatcaaggagaggccgagttgaacctcactttgggtcagcaatctgaatccacaacagaatcacagctgcatgagaaagggccctgggtacctttagactctaacttgtataaagtcagatttgagcctgacagaacaattttaagtaatattagctagccagaaggtaaaaagattacatacctgtatcctaagttgaaaagagaagtaagttcaagttggcatgagctgctgcacaaatgccagtgccttgctcacctctcattctctactatttgttgagtaccttccatgtctaggaaccagtgggtcccaaagctagtttcctttctggatcacctgaaacaatgaaaaaaatgcagatttctgggtcctatcccagacctagaatctctgggtggtagagctcagtgatttcagattttgaactttgtccataggaggctgtttggaaaaagacttctatggtttaaaaattttgaaagctacttactgttaaagtgcctacttttcatgtcagagatgatgaagtaagacctagagaggtcagtctacttgtctaaatatacatggctgatacagcaattgtagtggcttggtaattggatagatgtgtagagagattgagttggaaggaagaaacagttgttctgagcttggatgatcaagatgagagccagggaataaaagagggaactagttttatggggatacatagtgaactgaattttaggtaaggtgaatctgcgagccatgctgtgtggactcttggtaatatttggggtggcaattaagacacgctttgtgtctagggatggtgtccctttgtgtctagggatagtgtctagggatggtggctcagggtgtaacctcccttgggaaaccttcctcattttattcttcaaataaaccc

SEQ ID NO: 31065 - DNA, 1036 bp, Homo sapiens
agttatgtttaaccatccttattttacagatgagaaaggatcatggaggttaaatcacatgtctaatcacaacttgtaagtggttgagccaggattcaaactcagatctgttgggctccaaatccttttcttcaacagtgtgctaggtcagctttgaaagaggtttggagcctgacttaagagaccaaatctctcttgcttccctgtggaagcaaggtgccctgtggacttcctagcagcagggtgagacatgagaaaagtgttttctgggaacatgattctgctaaaagcaagctgagcctggagggagtccagatggaggcagaggggtagtggaatgttgttttaagatccaaggggaaagctgaggatcacctggatcaaagtgggggcatagctggacaaggacccttggttcaggaatgttctccaaatgggctgtcccaatggaaatgggtttagtttattgctctgacactctattccaagatgtggtgtctgagaagtgactgtgaagaatggaggtgtggcctgagacagatataccatgagttcccaaagtgagacctattttgatgatgacactgcagctctcatatatgtatccttgtgctgtgaaatctaagtaaatgactctgtgtgtggtacgagggatataaaacagcacatttatctttcagtaaatacactggagttaggaagacagagtgaaaaatggcccagctgttgtcaaaaggccaatggggaaaggtaaggggtgagaaagaaataactttaccacaaatggaaaatgagtggaggaaggagtagacagataagaaaccttggagattcatcctgtgaagtccagccagaagctgctgtagactgagcattcagcctcctgggctggagaagtagatagtccctcccaggtcaaattccagggcctccaccgtccctcctgcctgcaactgaggcctcctaccccgtaggcctctcctgtaagaatgtgtaatgagaagctggcctggtaggggaaggggctgggggcaag

SEQ ID NO: 31066 - DNA, 1035 bp, Homo sapiens
tccaagctgtgctgtccctctacacctctgggcgcaccactggcattgccatggattctggagatggggtcgcccacacggtacccatctatgagggctacaccctcccccatgccatcctgcatctggacctggctggctgggacctgactgactacttcatgaagatcctcatggagtgcagctaccgtttcaccaccatggctgagcaggagattgtgtgtgacatcaaggagaagctgtgcaatattgccctggacttcgagcacaagatggccactggcgcatcctcctcctctctggagaagagctacgaggtgcctgatggccaggtcatcaccatcggcaacgagtggttctggtaccggaggcactgtttcagccttccagggcatggaatcttgtggcatccaagagaccaccttcaactccatcatgaagtgtgatgtggacatctgcaaagaactgtatgccaaaatggtgctgtccagtggcaccaccatgtatctgggaattgccgacaggatgcagaaggagatcaccgccctggcacccagctccatgaagatcaagatcatcatgcccccagagtgcaagtactcagtgtggattggtggctccatcctggcctcactgtccaccttccagcagatgtggattagcaagcaggagtatgatgagttgggcccctccgtcgtccaccacaaatgcttctaaatggactgtgaacagatgtgtagcatttgctgcatgggttaattcagaagtataaatttgcccttggcaaatgcatacacctcatgctaccctcacaaaactggaatagccttcacaaagaaattgtccttgaaggttgtgtctgatataagcactggattgtagaacttgttgctgattttgaccttgtattcaagttaactgttccccttggtatttgtttaataccctgtacatatctttgatttcaacccttagtacatacatgtggtttggtcacttcatggctgaggtaagaacatgcttgtggaagacaag

SEQ ID NO: 31067 - DNA, 1040 bp, Homo sapiens
gtgtggagccaaggagggggactatcacttaaacacaaatgacagggaaaaggaaataagtaatgttggaaggtgaatgcctaacaaacaatgataattcattttcttgtgacacaaagtagaacttatgaaaacaactttccctaggacccaataacttattccatgacctccctctgaagtcagcagccagctgtctttgctagatcaggagcagtgaacattcggggacaaggattcagccagatctgaaagggtcgttaaatggtcatttaatctggtttcctagattaatccaattaatcagggtctaatggaagaatttcaggtaggaagatattcctgatgcttttcaagtcccacagaaaaggcaggtggctgtgggggtggggtgaacatgggtacaaaccaaaggggctagacaatgctgcttcccccaacccccacatgggctctgggaccgccttagaaatgaagcccagacaatccaagagcaaccaggagggatggccatcttcagctcacctcctcacaagaaattttcatcccacagaccacccaaaagtctgcaaatgggctggaactagggaagctggttggaaagtgaagccagtctaacttttctattaaaaactaataataacccccatcactttggccttgccggcagtttacccagagacatgtgccaacagatgaatgaagacatctttgtaccactatgacaagggactgttacttcagaagccattttccagctcctctgaccacttagaaaccccagccgtcactgctgcatgggagagtgacacaaaaagcccagctcccacaggcagcctgagtgagtgtctcccagggatgtttcaaggcccacttgccccacttaggtgacttatactaggagtgccagacaattcccactaaataagccatctcttggcagtgaccggtatgacctgcaaatggtaggaactctatttggtatcaagaaacttgtgacattcattaacactcccatgctaaaacaccactctcaagag

SEQ ID NO: 31068 - DNA, 1062 bp, Homo sapiens
ttttgatatctgcaggatctgtaatatctgccagtttgctcctcatgttgataacttatattttcactatttcatatttagtgcaggtttatcaagtttataaatcttttcaaagaaacagcttcttattttattgattttctttattgcttttctgtattatttccttcatcctacttgtatgggcttattttgcccttctttacctagatgtttaaggtgggagctttgattattgatttgagatgtttccttttttaatgttataaattttcttctcatcactgctttagctgtatcccacaaattttgatgtgttgtgtttgtattcagttatatgtactagcttatttccactgagacttctcttttggcccatgtgtttagaaatgtgttgcaaagttgctaaatgtttggagattgtcctgttatctctctattattgatttctagtttaattccattgtggttcagaaagcatattttgtatgatttcagtttttttgaggtttactttatattccagtatatagtctatctcagtagatattctgtgggcacttactacaaatgcatgttctgcttttgttcgggtctataaacgtagattacatcctgttatttgatgttgaacttttctgtatcctagctgattttcggactagttctatgaattattgaggaacggatgttgaaattttaaattacaataatagacttatttcttcttttagttctaccagtttttcttcccatattttgcagctctgttgtttagtacatacacattgagaattgctgtatcatatttgtgaagtggccctttaatcattatacaatgtcactctctgtctccagtaattttttttttactctgaagtttgctttatctgttattaatgtagtcacaccgctttcctctgattattgtttgcatgatatattcttttttttccatttttttttgttttactttcaaactgcctctgttgaagtaaattttttgttagcagcatgttgggtcatgtttttcaatctactctgctgagatctgccttttca

SEQ ID NO: 31069 - DNA, 1035 bp, Homo sapiens
cagtcatcgtggaggttgccgagaagggaaggggaaggaggagacagtgactcttcagagtagctcagtggctgagacattctgtggattgtagggaaatcattcagccagggtcttcgaccactatggtggcatccaccccatgaattggaaggcttgcttcatttcctaggaggttgacatcagagtagtggagtgctgaagatgcaatgcctttcctcctggggaagggaacatgggaggcttcattctaaagtaaaatagcaaaacacagcatcaattttaaaatgtgcatgcccagtatatccacttttaggaattcatcatcattttgtcattgggtacaggttaaatatgtttgccatatccgtaggatggaatattatgtagccaccaaaataaagcttgtagggtgtctttaataagctacgaaaatgatcttataatatgaaatgaagatgcagggtacagaattatacataatgtatgatctctactatttaatgaaagctcactgaaagaagactgtggaagtaaatatgcctaaaagttactaccaattgcctccaaaaaataggattaccattccttttttgcctttttatatttataaattttatctactgagcataaaaattgacaatgaaacaaaacccaccaagagatactactataagtgatactgaatccaaagacattgactttctggtggaatttcagacaacaccaggggaaattgttggaataagagccatctcatgcctgttgaatgaccccagccagacagtgatctgtagaatggaccattgagccagctctgacaacactgggcttgaggaatgcccaaaaatgtgtgaggggcagttgggagtgtgtgtctgtcacagagtcaggagaccccatcataatcaacccattgtggggccctggtggaaggggaggcagggcttctactatgggttagccctgttccctgagcaaaacaaatggtgccctcgtgtgtgatctaagactgtccagccaggtataaattgg

SEQ ID NO: 31070 - DNA, 1034 bp, Homo sapiens
caagaatactctttcttaggttttacagaatataaaatcaaaacatgtacatgtttattatagattttgggcctgtttgtgggttttatgttcaataaatttacaaagtaaatacactaaactgctaaaaagaaatcaggcaaagacaaattgaattatggtttgccataaatagatcactgttatagtgtgaatatggtatggactaacccacaggttcttctgagtcctacattgcatatactccaagtatactgtgtgatgatgactcatgtcttttaccacttagctctcaactcttatctaagtaaatttatggcttctatttaagattcctcttgtggcctcatatataatgaggttttaagactatttcatggctgtttgaaaatatcttttccttgtttattgagtattgaggtttctaagttctacttaattttgtttcagatttgctataatcctactactttttgtctaattttgttgaaatctgaccgtataattgtggtttcgacattttttggggggggggttaaattttttcaactgcctatttaaagctatgagtggaatttttttgaagtgttaagcttatttatgattgaatgtttcacataatatattcagccccaagtagttcatatattaagaattcttactggttttcacatatttttcaaatcagatttgtcaaggtatcgtttacatacagtaaaatctaccctttgttaaatgtatgctgtttattgacttttggcagatgtataaagtcatttaaacactaccatagtcaggatattggctgggcctagtggttcatgcttataatccccgtactttggaagcctgaagtgggaggattccttgaggctaggagttcaagaccagtttgtgcaacatagcaagaccctgtctcaacaaaaaaattttaaaaaatttaaaaaatttagctgtgcatggtggcatgtgcctgtagtcccagctgctagggaggctgaagcaggaggactgtttgaacccaggagttcaag

SEQ ID NO: 31071 - DNA, 1725 bp, Homo sapiens
ccaaaaggcatttaggatatctcgactttttctgcttttcatagctgtcctgctgtgcgctccacctgaagttagtgttcctttctcactttccacatagaaattaaacttcaaagaaacaagatagaaaatagaaccaaaggactaggaaggatgtcagggcttagaacagggttgaagaaagggacaaaaagtctaaaaacctgagaatttgtgtatcgttgaagggcagtaagtgatgtacatggcctttaccataataaaaaggaagctattcaaggaagatgctgaagaggtgtcaaggtgataaggataaagaactatggtgtgacaaacaggtatcagtaaccatctaaaaggatgggcatggcaccatgtgtaggtgcaaaggaccacatagtaagaccattgtgaagtagtttttaaaaaagtcaaaagacagagaacaagcaaaggaactaataactaaaggaacaaccaaaggaactagcagttagaaaggggaagatctggaactcttaaaactaagtcattgtttggcttatgggacaaaccaaacagatagaatggttgcagtccctattaagccaaaaggacatgaaaacataacttcgtcatttttctctgacaccattgcatcttagattgttaacctcttccatgatagaacactgtataaagttcatatttagagtgaaaatgctttctgtatccaaaccatgtaccagatccatgtcttgttatttattacgtttcaactttttatgggttcttttctctctttaagaaaatatccaaaattgcatcctaattataaaacaagttaaaagaaaaaaaacaccattaatagacagttcatgtatattcttccagtaatttttctcggttatcatatacataaaaacatgtatactttattgtgctttacataaactgaataatactaaatgtttaacctaatctaactgaagtttttccatgataatatgtggggtgatttttttaaaattgtatagcattctagcactaataaacatttccttattatacatttagattatttttagattttcattgtataaacaatggttcagtaaacatacctcaacctttatctttgaatactttaggaagtatatttttttaggatggtcacctaaaattagaatttctggataaaagggcatatgcatatttaagactagtgaatattgaccgggcagagtggctcacacctgtaatcccagcactttgggaggccaaggcgggtggatcacaaggtcaggagatcgagaccatcctggctaacacagtgaaaccccatctctactaaaaatataaaaaaattagccgggtgtggtggcggtcgcctgtagtcccagctgctcaggaggctgaggcaggagaatggcgtgaacccgggaggcggagcttgcagtgagccaatatagggccactgcactccggcctgggcaaaagagcgaggctccgtctcaaaaaaaaaaaaaaaaaaaaaaaaaaaaaaggcatactggatttttatcccttatccatagccttaccaatgctggctactgtccatcttttttaaatacttaccaaatggactaagagggatttttcactgttttaatatgatttatttaatttttggtgcagtcatactttcttgtaatttgtcatttgtatatctctcctgtgaattgcctatatatatttcatggc

SEQ ID NO: 31072 - DNA, 1071 bp, Homo sapiens
tcttctctcctcaatttctgttagtgccttttccctttttgctgcatgttttggcttctgtctgaaatgtgtcggcaattcttggtaaagtattcattttgtcctgtgctcaaatgctgaaatttttgtgagtgatgtattattattgacaattcagttactatgtgtattttttaaaattgtttattattctacataattcacactagacagcacctgaaatttagacactggctatgtgtacatgcttactatagaaatgtttccaggaactctctgtttctgtcatcactgataagtatatatgattctgaattaaaataactagttttaggtctttaccctgccataaagataaacagttggtttgaccaatctggttctggaatcatttgctgctatgcatgttagacaaagccacgaactttgattttccattgaaaattctccctaatatctgagatttattgtatatttactcatatctcacattttcaaattatgctgtaactttataaactgtagctgctttcatcagctattgatcaataaattgaatgtcaattatgtgcttaataatgagtgccttaaactgttaaacacttttggtttagaaataaagtgaatcaatttgacctatatacttcatgaagtaagtaagtttgaaatacaaatttctgaaaggtcaatagcccttatcgtattacaaattgtttttaaggctttttgtatttattaattgtcagttgattcactgaagctttaaaactggaagggacaatccaaaggtcaaaagagtgaaatacaatcatttaccaataaggaaaccttgggcaaattatgtaatttatgtgaacctctcttagcttacccatggaatgagtcaagtggtctacatagatttggattttgagaattagttctttcatttagtgttatagagattatcttgttacaactagaattatttttaatgtaatttttacagatgttgaatattagtagataggatttttcccctacgaatttggatgtaaggtaaaggttggtggccagtgacaaaccttataa

SEQ ID NO: 31073 - DNA, 1551 bp, Homo sapiens
tattctcaatttttaaaatactaataatgtaatcattgaatgtttcctacatacgtagtgggttttatttgctcacagcatacagttatttttcaatttatgtttttctattagacttaaatttcattataataaaggcttttactcattaaatacaggtattgtcttgcatttatgaaatattttttaaaaatattttatttgtccatggcagttaattcagccagatggatggttggacagatgttttgtgtgtttgtgtgtaaacattcttcctgttttttgttttgtagaacacaagaaattaaatacaaaataatgcaaaatatttcataagtatggatgtgcaatattactggccatagtgcaaaaggtgaaaggtactattgtagcaacgtattctttattttattaaaaatttatataaatagctccaaaatgaagttacttgaatattctgttggtttttttttttttaagatttattaagtaggctgattgttaaaggatagaaattgtgttttcatctccttaattataatagataatagtggtaggaaaatgggagatgatgatcccctctaaatattcccttttgacaaggttagcattttttctttaaggcagaattgatcttcttttaggtaagtatttagattctgaaactgctgcagatggcaggattttcagtactcggtacatttttttaaatggcccattttgatattcctttcttttttttaacttaaaattttcaaaaaagttagatctcacagtaaatatttctcaaatccttccaataggattcaatttgtacacatgtttctgatgaggtcactgcttgttgttatgatacagaaaagcctgtgtctattttaggcatttactgtacatttctcccgagaaaagagtgagatcgtgtcatctcatgctccccatccgcaggtcacttcctgtagaaatatggactaacttaaacctcgtgagtactgatctgagcatctcttgcagcctgtagtataagaaacccaccctgggattttatgatagctgtggaattagaaggcgggaaattaacttttatttcctgaatttgtgtgtgcattgctaagtctgattcctttataatattccttctagaaggaagaatgaggtatttttcagtcatcatgtaataaaagcctggggtcttcagcttggccataacagccttgacctccaaagaatgtaataacaatatatatatagctgtaaatggtattatactatcttaaaagttttagataaaatcatagttctctttgcttagcataacatatttaaaagcctaatacaatgctttccattcttttttgtctgttgatacttggctttcttagaactcttttgcaaaaaaaacaaaaattaattactttgcaaataaatgcaggataagaatatatgggatcttagctgttttagttttaattacttttaaaagtggtgttaatacatttaggaggttaggtgggctttgttcttacagaagttgaaataaaaagtactgaaaat

SEQ ID NO: 31074 - DNA, 1070 bp, Homo sapiens
ctagtacataatactttagttttaaagtaaactagagctgtcttctaccctgagtttattccatgtctataaaagagggaacttccaatttgtgactttttgaacttttgagtttttgtatgtgtttaagtaaatgacgataggcctgtcctattaaccctaacaaaaaccttactgtgatacggttattttaacagtattagtatgtatatatgtagaaagtattcatggggccaaacaacagtcttttccactatataatcaactaaagatcaaactattggtaaaatttgacatttgtgtagaattcattttgaatgtagtgatttgggatgctaatcaaaccccaggtaactgttttttttagctggttttaaggatcccaagtgcatgctttttagccgtagaatacacaaaatgtctatgtgtttgtagagatggatttctgaattcagcttagacagtagagagcaccctaaaggatattctaagtaggttgggaaagcaatttatattcattttgcttttaaaagaatctgttagttaaggacagaatttgagaattcatatagattggaagtgaagacaaatgtttgtcgtatgtgaaaagtgtaatatatacataaattagtagtttatttatatacattttcttgaatgtagatttatctaatttttaaaaccttaaagttaatagtgaattcttcatttttaccagagttcattttaaacatgtttgtttaggttttactgcaatcacagcaaccaaccccatttggcttataaagactcggttacagcttgatgcaaggtatgttaattccttaaaataaaattggttaaagtggatttaactaattttttttctacaaagtttttctttcctttgctgctgaatttgtttgttgttgtagtttaattttgaaacttgggtctgccatcagaaaaaagataatgtaagagttgacaatatgaacttttccaggtgaaaaaagtatattattaatatgtgttgttttgttttgttttgttttaaaaagagtggctagaaagataccatagagaaacag

SEQ ID NO: 31075 - DNA, 1165 bp, Homo sapiens
ggttttttgaacccattttaagctgaggaaccaatcggtgcaaacctcagaggttctaaagtgtagggcctttggtgttctgggaactgagagtaggccaaaagcagtgctgcgtagggtcttgccatctcaactctcctactggctttagaatagagactcttaagtaacgagatggtcctatcttatatgttacaataataatgttaatggttttaaactattttagactttcagtctggagtaggttctgtgtataacatgtttctactgtttttatattttggtgtttgggaaatagtgttatgtcctataggctttaggtaaaactgatctaataaatcattaacaattatgcctgcttaaatatctgttttccatcttctgttatgttgaactatatactatttggaaacttgaaaagaaatatctaattgtttcatctgaaatagatcttttaatgaaatcttaagtgttgtagcaaaactccaagtttatttcttaaagccacatatctgaaaagtagtggtagctaagacttattccaaagattagaaagtacaagatgctagtccacattattctattgtaaactaccagagttaggtttcactatgtttagcgttgctctatgaggaatccaggaaaagcatgacttaaaactctttaatattatttttttccacttataattgtaacacaagctggcacaattcttaggcttgtggggttggggaattggataggggtggggtaataatgaaaggttgacttgaggattctggtttataaggctgagggctgagcgcagtggatcatgcctgtaatcccagagctttgagaggccagggcaggaggattgcttgaggccaggagtttaagaacagcctgggcaacattgcaagacttaatctctataaaaaatgcatgcctataatcctagctacctgggaggctgaggtgggaggattgcttgagcccaggagtttgaggctgcagtgagccatgattgcaccatggagactccatctgttaaaaaagaaaaaaaagaaaaagaaaaaaattaataaaaaaataaaaatagggctgatatgtcacctttcaggatttgtatctcttttaactttcttgtgaggaaggatctttaatgaaactagttacagtt

SEQ ID NO: 31076 - DNA, 1063 bp, Homo sapiens
ccgccccccgcccctttgcccccctgggagcagccctcaatcactgtctggagggttggtgtacacattctccagccccctcaccctatcccttgtgttggctcaccctgtagctggctgaggacaagcctctcctgcctgtgcttcccttgtctccgagacctcatccattttctcagtggctgcactgctcctcccagagaacatgggagatttagaagtacctcagagaccactagggatgcattgtatcatatgagagaaaaggctccactggctggcggtgtattctgctgccaaacggggcgtgtctcgtcggtccctatttgagttagaggtggggaagaggccgaggcaggccaggggtaggggtgaagaccgcttcagccaccgtgcagaaaggtgcctgcgtcctaggtgtgcgggtgatgccgcagccctccgcagtccccggagagttgctgtgctgccgagactgcggagagcatgttcaggaagggatttccgggctactgcgaggcggaaaatttgagactataagctcctcaacagctgtgtcctctgtattgtttgggtcgctgcctggagcaccatggctacggaatgaatacaaatgcataatggaagaggctgtcctggggcgcagaacagacttattcattccccactcacccacctgctcccttcccggctcccctgagactttgctgggacttggtgttgtcaaaagtcatataaatcctaatgtcatctggctctgttgtcccccactgccccagacatcaggcagaagaagggagtttttacttttctctgtgagaaggatggatgaggagggcctgtgcccacccaaacttcctgggaagctgccaggacctggaccccttgtgtcctgtcccctcggaacattctggaaaatctatcccagtgctttctgcttatgaagctgggcctgaggctaaccagggtggagctggcactgtgggcagaggtactgtcccaggatgagggaggcccagggaggagatgtggcagagattattggagatcttggatccagact

SEQ ID NO: 31077 - DNA, 1067 bp, Homo sapiens
cccactatgtgtccatccagggcaaggacagtattggtgaagacatgtttcaacaatgccttcaactcagccctgaagaagaaaggtagtcccttaggtttctgagtttccttctgggagtctgtcttgcatgtgaatatcatcctgtaactattgggacagccttacatcccctctgctagtctctaaaattgacttgaagatttttatttgtgcccaggcacagtggctcaggcctgtaatcccagcactttgggaggccaagacaggtggatcacctgaggttaggagttcaagaccagcctgggcaacatggtgaacttttctctactaaaagtacaaaaattagccaggcatggtggctcaagcctgtaatcccagctacttgggaggctgaggcacgaacatcacttgaacgcaggaggtggaggttgcagtgaaccgagatcacaccactgcactccagcctgggcaacagagcgagactctgtcttaaaaaaaaaaataaaataaaagatttttatttgtctgcggtggcctctttcgctgttctgtcctgcttgggctaatgtttaaaattccagatagagtgtccaagtgggcagggccttagggactctggtgcaagccccttctgctgtgaatgggggccagcgagggtcagagtcttactgaattcacagagctagttaaatcaccgagctcaggagcctctgcctggcaaccccttctcgtgggagtctcgttaccacagggttcccaagcaggcagacagagaggcagccaaggtgaaggccccgatgacacctttgctatgaataacccacaaaatcaattactgcagtgggcagagcagcagccaggcccttcactgtgtgctgctgggcgcatgtactgagatcacttcttgctgcagggcttcccttcctaattgtattttgctcaaactaatgttaaaaattaactttcccagcattcagatgaggccaaagcaggaggtggaataagagaaaagacttaatttttagtggatagaccaccagggagccacctgggatagatgttct

SEQ ID NO: 31078 - DNA, 1048 bp, Homo sapiens
tctgctgtgatctttgttatttattttcttctgctgagtttgagtttagtttgttcttgtttctctagttccttgaggtatgaccttagattgtctattcatgttctttcagctttttgatgtaagcatttaatgctatgaactttcctcttagcactgctttgactgtatccaagaggtttttgtaagttgtgtcactattatcgttccattcaaagaaattttacatttccatcttgatttcattgttgacccaaagatcattcaagagcagattatttaatttccatgtatttgtatagttttgatggttccttttggagttaatttccaattttattccactgtggtctgagaggatacttgatataagtttgattttcttaaatttattgagacttgttttgtggcctatcatgttgtctatcttggagaatgtcccatgggctgaagaaaagaatgtatattctgcagttgttgggtagaatgttctgtaaatatttgttaagtccatttgttctagggtatagttgaactccattgtttctttgttgactctgtcttggtgaactgtctagtgctgtcagtggagcattgaagtcccccactattgtgtagttgtctatctcatttcttatgtctagtcataattgttttataaatttgggagctcctgtgttaggtacatatatatttaggattgtgatattttcctcttggagtgatcctttcattatgatataatgtccctctttgtctttttttttttttttttttttttttttttttgagacagagtctcgctctgtcacccagcctggagtgcagtggcatgatctcagctcattgcaagttccacctcccaggttcacaccattctcctgcctcagcctcccgagtagctgggactacaggcacccgccaccacgcccagctaattttttgtgtttttagtagaaatggggtttcaccgtgttagccaggatggtctccatctcctgactttgtgatctgcccaccttggccacccaaagtgctgggattacag

SEQ ID NO: 31079 - DNA, 1030 bp, Homo sapiens
tggtgatgtgtaaaatggtaaaaccactttaagaaattctttatgaatgtttaaaacttgaacattcatttaccatacaatccagccattccactcccagataatttcccaagagaaactaaaacctcttcacagaaagacatgtcacaaatatttatagcacctttacttaaaatttctccaaactggaaataacccaaatgtccatcaataagtgaatacataagcaaaatatggtgtatctatagaatggaattctactcagcaataaaaacaaatggaatactgataacatatagcaacatggatgaatttcaaaaataatatgcagaatgaagcaatcatactcaaaaaagtatatactatatcattccatttatgtaaaattctagaaaatataaactaatctataataacaaaaagcaggtcactgattgcctggggctaggatggaatgcaaaggggtatgaaggaactttgggtggtgatagaaatgttttgtatctggattgcagcactggcttcattggtgtgtatacatctgcaaaaagtgaaactgtacactttaagtggatgcacctcattatataaaaattatacctacatagagttgattaaggagactctaatatttgggagatttattttattttattttattttattttattttattttggttttcttgttttttgttttttgagacagggtatcactctgtcaccctagctggagtgcagtggcacactcgtagctcacacagcttcaacctcctgggcttaagtcatcctcccaccccagcctcctgagtagctgggactacaggcacacaccacaatgcctggctaatttttttttttgtagtgatggggtcccactatgttgcccaagctggtctaaaactaactcttggtctcaagcgatcctcctgccttggcctcccaaagtgctagggttataggcttgaaccaccatgtctgaccaggatttctgctttcacttaggacctagaaagttgcaagacaattcc

SEQ ID NO: 31080 - DNA, 1058 bp, Homo sapiens
tgctcctagggccaccatgcctccagaatgtctcttgactctcccttggcaagctaaagatattaacttctctccctactccttcctaccaacccaagatatggctttactttaagttttcttttcttttctttttctttttctttcttttttttttttttttttttttttttttttttttttttttgagacaggctgtcactctgtcacccatgctggagtgcagttctgtaatcttggctcaatgcaaactctgcctcctgggttcaagcaattctcctgccttgacctcccaagtagctgggattacaggcatgcaccaccatgcccgactaatttttgtatttttagaagagatggggtttcacaatgttggcctggttggtctcaaactcctgacctcaagtgcctcacctgcctcggcctcccaaagtgctgggattataggtgtgagccactgcatccagccttacattatgttttcaagattgatattctgttctacaactccaatcaaggtttatgttctttgtttacaggctgaatctaacaactgaaaatcaagaagcaacgtttacacattacgactaggcaaatattgatggcagttcagccgatacagtaaagtactatgagcacactgcttttcttgcaaactttttatttctcctggagtttctatttatctttcttttctcttgtcctatttgcttatatcacatcctcacttttttcaaactttccatcatatcaaatattctaagaagcaaggaattatactaaaaacatttaatcaccaaccaacccaatttaattccatttatggggatcacttatagcagagagcaatcagaatagacagagcccttgtcaccaaagcaccaaggaagggtgctgggagcccctggttgtgccagccatgaacttctcagaatccggatcatggcaaggtccaggagatcctaggaaggggctggccaatggaagaatggcggctcatgttagctgctatttacaaacccactcagaagcacttaaactggcacatcctggctagc

SEQ ID NO: 31081 - DNA, 1072 bp, Homo sapiens
ggatgcgactgcggtcgggcttggcagtaacttaccctcctcagaggtgttggtgcccaatcgggacatctgtgggaaggggatttatagcagatggatcaaaaggcctcgggcgcggtggctcacgcctgtaatcccagcactttgggaggccgaggcgggcggatcaccagaggtcgggagttcgagactagcctgaccaacataaaaaccccgtctctactaaaaatacaaaattagccaggcgtggtggtgcatacctgtaatcccagctactcaggaggctgagacaggagaatcgcttgcacctgggaggcagaggttgcagtgagctgagattgcgccattgcactccagcttgggcaataagagcaaaaccctgtcaaaaaaaaaaaaaaaaaaaaaaccctcgtggtccctggagagaggtgaagatgcacgggacagcctgaaagccagtgtatgaatctgccccatcccttctcctggctttcattaagtcttggattaaattaattgcttatctcagagaaaggatgtgtagggggaacttctctgttagggattggctcctggccagcccatcctcactgatgccttgggaggctgcgtttgggcaccaggaacagcgtgggccacctggcctttggagcacagcactccgagtgtttgtggaactgcagtatctgtaactcttttttctattgatcagcttgaatagttagctcaatattacttcactattgattagataagtagcccaaggacatactggggctcagtagggtctctctgtccagaaattcccgtgggcttctccttggccctccctacaccgctctgtgatgagtcgctgtcagatgccccactgtgcaggagcatcttcagggatgggtggaaggaaccacctctgtggccccaggtccctgcctggtcccccctgtctaccacataggggtactcagtgtttgtgaggaaaaaaaatggatgccccggtgaattagtctgagttcacaaccaatgttttctacactttgctacactgttcaaaatgttacccttaaattcaaca

SEQ ID NO: 31082 - DNA, 1049 bp, Homo sapiens
acacaattaactattttgcaatctccctcaactatcatgaagtgaaatttaaatataatgtaaccagccaggcatggtgcctcatgcctgtaatcccagcactttgggaggctgaggcaggataatcgtttgagcctgagggttcgagagcagtctgagcaacatagtggaaccccatctctacaaacaattttttaaaattagccaagtgtggtggcatgtgcctgtagtcccagctactcaggtggctgaggcgggaggaccacttgagcccgggaggtcaaggctgcagtgaaccatgatcatgccactgcactccagcctgagtgacaaagtgaggccctgtctcaatgaatgaatgaatgaatgaatgtaatctttctatgcagttaattacttaaaagttataccagggtccccagcgataacaaatgaaaagaaactaatttactacctaattatatgtgtctctgtataaatgcttaagaacagctacactagaaaatagaatgaaatcttcaaatgcttgtacctaaatgtgactctgacaactacaaatgcagatgattgatggatgctgtattgttgactcttaataccacatgtcaggacatggtttttctgaagttctgatcaaaacaaaatatagatgttccttagtttatattgtatttctggaaaattcagtgaacattaatattatacaaaaatggttttgtgttctagacacaaaaacagaattagattctacagtctaaagtattcaaatatgttttgcacgtgatggaatgtctcatgctgcattcaaaagttgtgtgggacagagacacgtgtcccttctggagaccagccccccagcccctacccactaggtgccaggaatgcctttccccatactattgtgataactccacccccaagccctctctgaaggcagtagcactcttgctgagaactgctgcttagattctctggttaaaaataacagaaaacacctcaagcaaaaaaaggaaatttattataagaattcaggaatgactcacagactc

SEQ ID NO: 31083 - DNA, 1029 bp, Homo sapiens
ccctggatttgctgcagtttgcgctaggaaaccatgacagttctgaattgtctgcttccttaaactttttcaagaggtgagtttggttgtttgatatcctaaggttgtcatatgaacccttgataaaggaaattaggggtgtactcgactccattcttcggtctgcactcctgtgtagcgagtagcaagtatgctagaacacctgaaacacatttgcatgctccctcctcccctcaaaaaaaaaaaaaaaaaaaaaaccgtattcaaacagaaaagagggattggggcttcctcctttatgtatcttcaggcttcatgctgttatttggtgacctcctttttgattagcacttgttaagtttcctcttatccaattacattagattgtaaaaatgttgcggagagcacccatgccaccatatgtgtgggcttatctactcaaggaataccagatcaataagagagccaaatgggaaaattttgtgtgaattttcagatgtgtggtacagtgcgagatctgtgggactatgtgttccaaaactcacttagtttctctggtgtcttcagaccaagaatagcctagggttatttgacagagtagggaagatctatagggtatggttaagtgcttgagcttagaggctgggtgaaaaagttagttacctgggtttgaatcttcacctaatttccaacttttgttaatgtctttgggccttcatattctcatatataaaatggggatagtaaaaatacctatctcacgggttgttatgaggtttaaataagcctccctccctactctgcccctcctcatctctgcctgctctttctcactccccaggatctgggtcatacaccgaccatctcttaggaaggagtaaagtaggagataaaaactaatcttcatctgatgttcttgtccaatgtatactggagtttccaggtgtacaaagctgattaaaatctgaagacctatattcttctttaaacgttgttaattaatcttcatatggcgttagccagctcact

SEQ ID NO: 31084 - DNA, 1023 bp, Homo sapiens
agaatcattatatacgttagagggagagaaacattataaaagttaacagtaggggaatgtgagtagaaaatatggaaatttttagtgtacggttcttgtaacttttctctgtttgaaattatttcaaaatacatctttttttcttttttccagcactaatggcttgggtgaattaaaatattttttaaattaaaaaaagtgtatggtgtggtgggggccttaatatattcacagagttgtgtaactgtcaccactaattccagagtgaaattttaagcatagtttgtgtttgttttcctgttccttccttttcacttgatatacaaaagttgacgtatcttgacagaaaaatttctttacaattttcttaaagttttcaaatgttgaactaaaagaccaaggtatatcataagtacaaggaaataaagtagaattagggcgtataaaatgaaaattcttacttgacaaaagaaagtgaactgcttttaactttatatatcctttgttgaaacttttgtgtagaatcctggaataaatcattagtcttatgcaaaactgtgtctacttcttaaaacttgaattgaggaaggaaatgctttgtaccaagatggcaaatattttattataagaacatttctgtttcttcctctcatactactatgttcattgtactgtatcttcctctgagagggtttaaactctttagagaactgccttaatttttgtatgtattggagcaacataatcagtgtttgcaatgttttgataaaagtaaattcttaataataaaattgttataatctcccataattttcaagtcagttttcactgttgttaatgatgtatgatattgtttttccttttctcttaattggaatttataaactcttactaaatgcagatacatctgctcaaaacttgtcatttgttcttagggtcaaaaaattgggaagattagtttgcactaccattgtaccttgctttttataatgagtgtactctgggtaaaaacatgaatctgaa

SEQ ID NO: 31085 - DNA, 1050 bp, Homo sapiens
agtcacagaactactaagtagtggagccttgattccaaaagagatctgtctgattctaaaactcctaaccacagtgcctttactacctttcaccattctgtactattagtcattaaaaaaaatagattaggagtatcacttaagtaacatctgagtgtaaggaagagaagcctgctcagatttgctcaaagaaaatgggagaggccattggaaagctcctaaagagtttcttggaatgtcatcataggaactttacattgccagtgtgagctagaaagttgtcaggcatttgcagaggagatgcatcttaagtggaggctagattcttagaacaacagacattaaaatttgcctaagttcatctgtaaaatgagtatacaaaatgaaaagttaaaaatttttgcgtaagttacaattatttttgaaaagagtttagtttcttataaaatacactaaggtatttgggtggtttgtttgtttttggttgactaccgcataaaataattggcttgcattctgggccatggtaaatgaaaactatatactgtatctttaaactgtagacctcccccctgccctgactcagtacagcaatagatactgcaagtggcacatggaaactgagacccactaatcatttcttatattcctatgttcactgtgcttattgagcataagttctcactgtttaaatattgttttttttctttccctttcatgaagtgaataatgttttctctcagtctttccctctcattttaataactatttgctttgcaaaatataaaggaaagaaaaaaacaccattttgagatgccattgtattctttttgtatgtatgatgagacatgtctcttcctctgcttctctgtaaatctactccagtctctttttgagacctaaaagacgccacaccaatttttgagtccatgtgaccatacagcttcctcacctccaacatctgactcagttttctgccacaatctagagagaaagtttggctaaacttgggtcagatgtctacttcaatctaatttgatatggttggag

SEQ ID NO: 31086 - DNA, 1039 bp, Homo sapiens
actctggcatatttctgaatatatttaaaactcaaaaacattcttttaagccattagcaaagatttgagtgtcccttgcttataaaatattatataaaagagaatcagagagttccctactcatttaaaaaatgatcttttcaagggatgggtaaaacaacaacatgttgtgaagtctttttttttttttttcaagtagacatagatgagatattttgtctatggggatttcttatcctgcaaagaaaatccaaggaaacaagtttagaaagtatggcaggagtgaacccttctggagttcttaagcatccaaaaacaatgtatgcataaaaatgagtaattggtatagcactaccctaattcctctacatagaacaatgctatgttaagactgtaggcctggtaattttcagttatatgagagtaaagagggatgtcatacccctccctcagttatttggagctaaaggaaataaagttgcgctctgagcaaaatttctgtagtaaaaaccaaaacagagtttgttttgactgtagagttcagagacactgtttaagatggatagggatggtcccagagaggcagaaccagttgtaactgagtaagcagtaatacaagtaatgttaatctactgtgcatggaaaacattagttcaataggaggaaaagattcatctagagtaataaaaaaggattccaaagaggtaggcatggtactgcctattcaagcacaattgagggggtaggggattctggtccagaagaattactgtttccttggcaagactgttgtcttagctgagagattcttaaggctgcataaaactccttgtcatgcctctgtactcaccacaacgccttttgataatttgcctttccaaatagcctaccaacaggtaaaaaaatacagtgaaagatatagatgaaaaccctatggtaaatggtgataattgttgtaaccaagtgacaagcacatgggggtggtggtaagaaagggtgttcattattactattatcactcttctccctacttttgtaa

SEQ ID NO: 31087 - DNA, 1049 bp, Homo sapiens
aattttgttttgttttgttttttaattttagattcaggggtataggtacaggtttgttacatgggtatattgtgtaatgctgaggtttaggcttattatcccttcacccaagtagcgaacaaagtaccggatggttttttcaatccctacccccctatctccctccccacttttggaacccccagtgtctattgttaccatctttgtgtttgtgcatacccagtgttcagctcccacttacaagtgagaacatagggtatttggttttctgtttctgcattaattcgcatagggtagtggcctccagcagcatccatgttagtgcaaaggacataatttttttctttctgtgactgcgaacaagattagtcttcagttgataattgtttaagctagataatgggtacatgagcgttcaatattctcttttgtttgtgtttttaaattcccatgataaaaagctttttttttttttttttaaactcttagatttctggttttggtcctgcaaatttctcttaagttcaaatttttggaaaaagaatttactttaaaacaaggttacttacgcattctgatatgtcttatctacttttttttttttgagacgaagtcttgctctgtcatccaggcaagcccagactggagtacagtggcgggatctcagctcactgcaactccgcctcctgagttcaagtgattctcctgcctcagcctcccaagcagctggattacaggcacctgccaccatgccggactgatttttgtatttttagtaaagacagggtttcaccatggtggccaggctggtctcgaactcctgacctcaagtgatctgcctgcgtcagcctcccaaagtgctgagattacagtcatgagccactgcacccggactgtcttaattttcagctaaatgcctctttcttaaatttagttggtaaaaatttatttttgataatacattggattttaaatgtttaccttttattatcattttttctaaacctgcaagctaatcaaactcttgttcaactcctttgagatcttaa

SEQ ID NO: 31088 - DNA, 1096 bp, Homo sapiens
aggtaatccaaggtgccatactgtacaaaacaacttatatataatattgataaaattatggcttttggctggtgccaaaaggctcatgcctgtaatcccagcacttcgggaggccaaggcaggcagatcacctgaggtcaagagttcgagaccagcctggccaacatggcaaaactctgtttctactgaaaatacaaaaattagccaggtgtggtgtcaggcacctgcaatcccagctacttaggagactgagacaggagaatcgcttgaacccagaaggtggaggttacagtgagctgcggttatgccactacactccagcctgggcaacagagtgagactccatctcaggaaaaaaaaaagaaaaaaaaaaaaaaaaatatatatatatatatatatatatatatatatgacttttaaaagcaccacatctttaataattactttgggaagaattgttaattatatatggtttctttagtctcttaattccttaggctggtgagttgtacccagccttagctagattttaactgtgtgtgttttgaacgtttttgagtcattgttttacagcaatgtagtccatttactctattctacttttttatacaaactattttcttgaaaacttagtagttttggtcttttttacattctttaggatgcacagacaattagaacattaactctcatctcaaaaactatacaaactttgggaagctgggggagtctgtccaaaagcaaggtaagtccttacatcttttattttgtttttacacttctaaatgttgttacatcctatgatcccttatccttgacttaccttcttccaaattaaaaacaaaacatacacacacacacacacacacacagacacaatagctgtcttttaagtagatactctcttagtcacctgttaaagaggacagtttcagaagctgggcatagtgacttgtgtctttaatcccaggaagccgaagcgggaagatgacttgaggccaggagttcaaggctgtggtgcacaatgatggcacctatgaatagccactgcactccagtcccagcaacatagcaagaccctgtctctagaagtttt

SEQ ID NO: 31089 - DNA, 1023 bp, Homo sapiens
tgagaccctgtctcagcaacaaacaaacaaaacatatgaggctttaaaagtatctagtttatttgccagcaatacagctgcccctacccccacttaggaatcataatttctagtttgggaagcatttttaactgatccaggagactctttttttttttttttaagacaagtttcgctaaacattttatctcctaaataaatttcctttagtttaaaggaaactaagctttcacttagttcctttccagtttaaaaataatgttcccaaagggtattttcaaaagatttgtctcccaaaaagctatttcctccccaaaggaaaaacatttaaagagtaagtggaaatgtataacctgaaataatgattgaaactttgcaacaaataaactttactgagagattttaatgtaggtcaaagtatagactataaatgacacatttcatcataaactttctaattatagcaagtattctgctactacaggatcagtcttgcatatttacaacagctgtactttgggttcaggaaattattctaggctagacctttgtattttgtttatgaggtgttaaaacccacttagaggtcaggtgacagcagaaggaaattttttttccagacttcctagtccttaccctagcatcattctaaaaggtgttattgtactccttagaaatgtgctgttttagattctaggaagatcattaaagcaattttttatcttttatctgaaactttaggaatttgtgtagatttgggtcagttttgataatctacatcagagctataagtgtaatttagagattcctaaattcagcaacaagaacccacttagttccctttccttagtatttggaatttgtctcacacacttgtgatttattatactttctgctcccaagacttgcctgtcagcccattctgatatggataacactctcttcgtttccactctcctcccttcattcagaaaggagtgatgattacacagtgagcaagtgctgatgaaaaggggaataggt

SEQ ID NO: 31090 - DNA, 1034 bp, Homo sapiens
caataccagcctcgatgacataaggagaccccatctctacaaaaaataattttaaaaaattagctggctgtgttagcacacatctttggttccagctactcaggaggttgaggctggacaatcacttgagcctgggaggtcaaggctgcagtgagccatgattgtgccactgcactccagcctggttgaccgagtgagaccatacctcaaaaaaaagaaaaaagacattgtatgagatagtttcaaatgtaactttgaaattacaaacaaagcctacctatataaatgctttagaatgggaggcagcaagattcaaaggaccacgttattgttggctttgctgaccacacggtgtttgttgcaactacctaactccattactgtagcttgaaattggccatagaactaacgggcatggctagcattttatttacaaaaatagcagcagccgtggtttgctttagaagttagagttggtgagtggtcagtgtagtctgactcaagaaatctgaactggtcttaaatgggatgtggactcttggctttgttcttttcttataacaaaagtaacaccattatttttacagtacagatgtgaatatcagtaagtccaacatcatcctcagcttcttccctgggtaacccccgttaagtgtgtaaatgctttttaaaaggtaatatgtggcatatccataaaggtccggcagtgtcttataaaggtaaatatatacccaccccctgagccagcagttctactcttaggtgtgtttatccaagagaaatgaaaacatacgttcacaaaatgctcttgtacaaaaatattcatagtagccctattcataatagttccaaactgggaacagttcaggtttttatcagctaggcgatagataaacttgcatgtctacacaatggaatactactcaatggtaaaaaggaatgaactacagatgtacaaaatgtgatgaatctcacaggttgactgcgaacgaaagccttaccaaagagagtacatactatatggttttatttat

SEQ ID NO: 31091 - DNA, 1055 bp, Homo sapiens
ggtctcgaactcctgatctcaagctatccacccgccttggcctcctaaagtgctaagattacagacgtgagccaccacacccagctctctttattcttgatgttctaaaattttacctttttatttctaggtataggatgttttccagtattttttaacatttccaatctagacacaagcttgttatttctttgagagttcttgccccaccctcttttcctgtggagttcctattagatttgtttgtatttctggttctctccccaatgtctcaacaatttttcatatactccttctctgttagcccactgtcatagaatacctgacttgatctttagctcactgaatttttcttcagcttgaccagttctcctgaggttaagtttttgtttgtctttaacagctttattgaggtataattaacatacaataaactgcacatatttgaagttttggtatacactcatgtatatgtgtgtgcatatgctgtattcatgaaactgtcactgtaatcaagataatgaacatttatcaccccaaacattccctcttggcactttgtaacccatctctgttcttaccttcccaggctccaagcaaaaatctgctttttgacagtctgtattaaatacagccatgccttctgagaaatgtgcttagctgtgttcattgatttcattgttgtgcagacattataaagtggacttacacaaatctagatggcatagccctctagacatataggccatatggtatagactgttgctcctagctgcaaacttgtacaacatgttactggatgaatactgttagcaattgtaacacaatggtaagtatttgtctgtaaacatatctcaacatagaaaaggtacagtaaaaataccatgtaaacataaaaaatggtatacctgtatagggcactgaccttgaatggagcttgcaggactacagttgcagtgagtgagtggtgagtgaatgtgaaggcctagaacattactgtaccctactgtagactttataaacactgtacacttaggctacactaaatttattaa

SEQ ID NO: 31092 - DNA, 1029 bp, Homo sapiens
tgtagtcctagctactggggaggctggggcaggaggattgcttgagcccaggagtttgaggctgcagggagctatgattgattgtgccactgcactccagcttgggcagcagaacgagaccctgtctctaaaataaaataagtaatatgttttgttgtaaaagttcttcatatattctagataggagtgagtcatttattttatgttttgcaaatattttttcccagtctttggtttgctttttcattttcataactgtctgggttcttcttcagttttgattcttcttcagttaagcttttctactaagttttttatttcaataatcagaatatgatatctaatttttaaaaattatccttcaccttctactgttttaattatgcttatttttctttgttctatttgctgatacagcccagtgttttcaggcattgctgtctttgttgagtttggtacttttctttatggattagttttattttgaatgtgtgataattattggttttgtgctcctcttctgtgtgtttagactttcctattacaacattcagggatggaggtagcctgtatagccaagagcagcctgggtgtggaggctgtctgctcctgtaacctttcaccaacccattcagaacatggcccacttttccagcccaagctccctgttcccacttcaagcagatgctgctgctactgttgctagttgcttggcaccaggggctcatgcatactgagagaagcaaagctgtgctcacctgactgctcctgctgtggtactccatctcatcacctagtctttgacccagagctccctcctcctctccatctttggtgagccaactaccttatttctgggtggccttctctgatgtcccttttcttcctcttcctgctagagaggattctttttgttttttttcctagcatccagtatctataattcattgtttacatatttgtcatttgtaataactgaactcttgtagagaagcagcagatattattcacatgtgaatttctatcacc

SEQ ID NO: 31093 - DNA, 1025 bp, Homo sapiens
gtctcccaggttcaagcagttctcctgcctcagtctcccaagtaactgggactacaggcatgcaccaccacacccacctaatttttgtatttttagaagaaatggggtttcactatattggccaggctggtctcgacctcctgacctcaagtgatccgccagcctcggcctcccaaagtgccaggattacaggtgtgaaccactgcacgcagctgatctaatgctttttaaacaaggaaaacttacattaaagttggaagcctgattgcttgccttatcttcattagtaagcttaagcaacatggtctgtattacatgggtgtcaacttctgataggaaattgttggtggttatactccaaattcagtatgtgaaaaccacattttaattacagagcaatatctgctattgaaggaagaatatttgccataaagtttaaaatgcatagacctttttcattgaaaaggagttagctgtcttatgaatgtttccatacaatttaaatgacaaaagtacgtaggctttgatttgctcaaatttttttccttgtattaatggcacattgacaaaacctaaaaatgttatttgattttttaaaaatgcatatagaaagttcaaagtaaaattgcatcttttaaaaaggaagattataattaactgtagataaccaaatttagggacagtttctaatcggtaatgtctgagatggttttgaaggtttgagttatttttaattttagatgtctatgccttcataattagaattgggaagttcttgatagtttcagcatactgtcaacacaattttccatgtaatttgctgagatctgctttttagagataagaggaaggaaaagaagagaaggaaatttgataatctctcccttttatgtctttataggactcatggtttttccaaaaccagtgaccgcattggaatatacattcagtaggtctgatccaacttcgtatgcagggtacattgaagaccttaagaagtttctaaaacgtgagtatgttttctt

SEQ ID NO: 31094 - DNA, 1091 bp, Homo sapiens
gcaatcaagatgagcaagcttcttctcagaaatacacttgtaatgataatatagttggagcagcattgtagtttctgcaaactgttcatgattgatattcctttaattataaacatagtttttacaaattctttttgtgacctaaagaggatttcttttgttttcaacttcagaatgaagatataccaaatgtagcagtttatcctcataatggaatgatagacttaaaatatttcccatattatgggaaaaaactgcatgtaagtattgagaagttcttatgtggtgattactcttttgggaagctggagcatgtgttgacgtaccacttgtctggggtaggtagacgccagccctgtttaatttgtgcgtcatctattcaggttttgttttattttaatggtgatggtaaatggagttcccacatttacaattcagaacacagaacccaagcagatacgttaaagttagatgattatttctaaaatatcattttctttttcattatagaggtagtagtaggtgcttatgtagagaaagtagaaaagtacttaaaaagaaaatcaaggccgggtgcggtggcttactcctgtaatcacagcactttgagaggccaaggcgggcgcattacctgaggtcaggagtttgagaccagcctggccaacttggcgaaaccccctctctactaaaaatacaaaaattagctgggcgtggtgacatgtgcctgtagtcccagctactcgggaggctgaggcaggagaatcgcttgaacccaggaggtggaggttgcagtgagccaagattgtaccaccacactccaggttgggtgacagaatgggattctgtttcccccaccaaaaaaataaatgaaaagaaaatcaaggccaggcgcagtggctcacctgtaatcccagcactttgggaggccgagtcgggcagatcacgaggtcaggagatcaagaccatcctggctaacacggtgaaaccccgtctctactaaaaattacaaaaaattagctgggcgtggtggcaggcacctgtagtcccagctgctcgagagggtgaggcaggagactggcatgaacctggga

SEQ ID NO: 31095 - DNA, 1075 bp, Homo sapiens
ccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctgttgtttattgttacttttctccttttttaaaaaaaaaaaaaggcagccgggcgcagtggctcacgcctgtagtcccagcactttgggaggccgaggcgggcggatcacaaggtcaagagatcgagaccatcctggccaacatggtggaatcccgtctctactaaaaatataaaaattagctgggcgtagtggtgcgtgcctgtagtcccagttactcgggaggctgaggcagaagaatcgcttgaacccaagaggcggaggttgcagtgagtcgagatcacaccactgcactccagcctggtgacagagcgagactctgtctgcaaaaaa

SEQ ID NO: 31096 - DNA, 1084 bp, Homo sapiens
aaagtaaaaaatgtctccagacattgccagatgtcctctggggatcatagtcatctcctgttgagaatcagagccctaaactcacttctgtgctggtcctgcctaatgaagcttaaaagcaagacctaagggtcaaactctttccaagtaatttaactgcatccaagaataaagatcaagaatggttatagggtttccccccacctacagaaacagaaaaaaaaatttaaaattttggcctggcaaggtggctcacacctgtaatcccagcactttgggaggccgaggcaggtagatcacttgaggccaggattttgagaccatcctggtctcatggtgaaaccccatctctactaaaaagacaaaaactatcggggcgtggtggcaggtgcctgtaataccagctgctcagggggctgaggcgggaggattgcttgagcccaggaggtggaggttgtagtaagctgagattgcaccagtgcactccagcctgggcaacacagtgagaccctgcctcaaaaaaaaaaaaaaaaaaaacaaacaaaacactctgaaatataaaatcctggctgggtgcagtggctcatgcctgtaatcccagcactttgggaggccgaggtgggcagatcatgatgtcaggagttcgagaccagcctggccaacatggtgaaactccatctctactaaaattacaaaaattagccggtcatggtggtgagtgtctgtaatcccagctactcaggaggctgaggtgggagaattgcttgaaaccagaaggtggaggttgcagtgagccaagatcatgccactgctctccagtctgggcaacaacagcaaaactctgtctcaaaaaagaaaaaaaagaaaatctcaagcaaccttgaatatccaaagcaatcttgaaaaaaatagagagtgtacagttcctgctttcaaaatatactacaaagcagcagtctgatatcaagatggtatagtactggcataaagacatatatatagaccaatggaacagaatagagagcatgtaaataaacacacacacacacacacacacacacacacacacatagagggagagtca

SEQ ID NO: 31097 - DNA, 1032 bp, Homo sapiens
cttgttctgtcacccaggctggagtgctgtggcatgatcccaactcaatataacatctacctcctgggttccagcgattctcctgtcttggcttcctgagtagcttggattacaggtacatgccaccatacccggctaatttttatatttttagtagaaatggggttttaccatgttggccgggctggtctcaaactcctgacctcaggtgatccacttgccttggccttccaaagtgctgggattacaggcatgagccaccgtgcccagcctagagcaggatcttaaacagatatttgcatatccatgttcattgcatcattagtcacaacagtaagacgtggaagcaaactacatgtccacttgcaagtgactatatgaaggaaatgtggtatagaaatacaatggaatatcaggcagcctttaaaagaaggaaatcttgtcatatgctacaacatggacgaacctcaaggacgttttactaagcaaaataaaccagtgacaaaagtacaaagactgtatgattccactcatgtgaaccatgtagagtagtcgaaatcacagaaacaaattagaagggattgccagaggctgggagaggagagaggggaaattagtgtttaatgggtatagagtttcagattggcaagatgacaaagttatagagaactgttgcatgacaatgcaatataatcaacactactgaaatgtatacttaaaaatggttaagaaggctgggagcagtagttcacacctgtaatctagtttcacaactgtaaagcactttgggaggccgagacagatggatcacctgaggtcaggagttcgagatcagcctggccaatatggtgaaactctgtctctactaaaaatacaaaaattagctgggagtggtggcaggcacctgtaatcccagctactcggggggctgaggcaagagaatcacttgaacctgggaggtggaggttgcagtgagctgagattgcgccattgcactccagcctgggcgagaagagcgaaactccatctcaa

SEQ ID NO: 31098 - DNA, 1053 bp, Homo sapiens
cagattatgagtggtctgttgggaagaccagtaaggtttttctcccttagctggggtttgcatcttttgtagtctgcctgttcatttttctttttctttttcttttcttttttttttttttcttgagacggagtctcgcactgttgccctggctggagtgcaacggcacaatgttggctcactgcaacctctgcctcccgggttcatgcgattcttctgcctcagcctcccaagtagctgggattacaggtgcacaccaccatacccggctaattttttgtatttttagtagagacggggtttcgttatgttgaccagactggtctcgaactcctgacctcatgcctgttcatttttcaattcattttttcagccaattggtacctattctagaaagccttccttgaatcttctagtcagatgattctttctttcctacttatttcattctagactgtacaggggttctagttcattttgagagctgactctctagtaggggctgtgtggaggactgtgttgaaaagggatcctgaaccactcaaggctcagtgagaaagaactgcaattggtgagggatgtctgcagtggataagggagtcatgtgtttgccattgctgtcatctttggttcattgactcccttactaagttgtaaactctttgagtcaggtctgtgtgtgagtcaccatttgattgcctccaacacttggcacaacacctagcaccttagatgttctcaataaatctgttctgaaatgaaatgagggcaatgaaggaaaaaattcatggtggaatttgagctttgctttgagtgggggtaaagaacggctgtgagagaatagagtttctagggacaggaaatggcatgaaggaaagttgtagaacaatacggaagaggcctcaggagaaagaggaggcctttttcaggatgtagtgggaaatcaagattgttgaaaggtttggagtctataggtaaaggtttaactaaaattgttgcggctgtgatctcatgaaggaaattgaagtatagtttaatggaacaaactaaaaa

SEQ ID NO: 31099 - DNA, 1026 bp, Homo sapiens
gtatggatatagagcaaaaatatgggttctacttgtatgaaagaagtaaagagtgtgtagattctgggtaggcaagcagtggtggccactattcaagctgagagagaaaacaaataatttgttcaagtactgataagtggtaaaaatcagttcagaccaggatgtctgatttcatctgcagtgcgctattcactataatttagttgtccatttttagcttgccttggtggtaacttaaaaatggagagactcttgggcattttagagtcagactgtcatgggttctgtatttactggttgtgtaaacaagtcatttgagctatcttaactttatattcttcatctttttttaaaaaagaattcctttactatcaagatgctagggtttaaaaggtggattaaataaactaaaacatgtaaaacaacaagacaatgtctttgtaagtgttagttccctttcactatttcatttttctttctgaaaaatattaagggaaggcttttggattcatggtctaagaaatatgtgagtagaatttataaaattgttaattaaaaattcatctattccctttcaaaagttttgtattttttacagaatggacactatagttagcatacttaggagctatcatgtccacaaaccttattcagatatggtgacaactctatattatatataaagattcaaggaaaagtatattttaaagggtttatttatgtgtgctggttgcagaaaagctgaacgttaggttaagtacaaagaatttgtagattgccttcagttatatgatcagaagagtctgaaaataatgaaaattaaaggtcagatgtttatgaatgttcatctatgctttattttctaggataaatctataagcacaagtttacctgtcctagatttaatagatgccattgcaccaaatgcagttcgtcaagaaatgatcaggagagaaaacttatctgatgaggacaagctgaacaatgctaagtaagcctttatggtttatattacaatacatggcc

SEQ ID NO: 31100 - DNA, 1048 bp, Homo sapiens
tttgtttgtatgtgtgaatgtgtaattaataaatgacagccttcctaacctctcctcctgcttttgaaataggattttatttacatgattttttgaaaacaattgacatataaacaaagtccacctatgtctgtggttgagccatttttatgttcttatgtaatagtattaaataatattatgaaagcaatattaataatattgttaaagtacaccatggacacaactttgagcagtctttgagatgtaaagaaacagaatatacatctacaacgtcacaaaaatagggtctgtggattatgtaaaattatttagtattgctggagtgggttgcctgagttctcttccctcaaaagttctgagagaggaaggggagaagattgtgttgtactaaaatgagtaagtgctggctccatgtattccagctcactgtgcaatggttattttaaagcaaacagaaagtatgtcaagaaaggaaatttgatattcctgtcaaactgaggacagaaaaatatcagtggaatatggttgagcaagtatttgtgcattgtgtatatttaggattattgcatgacatatctcaaacaaaagagagttttaatttatgatagttgtatagcctatttagtagtaccaggtgaaataccttgatattctttgtcagttttttattttataacataattgagatgagagacttggctttgggggggtagggtggaaattaaatatgcatattttccccatatataaattagaaatttttaaaacaagtgagctaaaatgggaattttctgtttcaggtatgtctaaacaacttcttgagttagatttggaaaaatagcataattcttacgcatacttatggggtacatttacatttaaaaagtaactttgagttataggaatattcttttgattacgtgtttgtattcgctaatattgttagactttttaaaatgttacctaaaccagtctaaaagtgaacaatttcctgaagtagctatgacttccaccattacactggagccttcctcagaccaaatgt

SEQ ID NO: 31101 - DNA, 1039 bp, Homo sapiens
gtcctctctcattgagaattagtgtcataatgagcctcttttatttgtaggcacctatggtgtccctcaggtctgttaacaggagaaagggtaaataagtttatttagaaaacacctaaactaagtgtagttcatgttaattttcctctaaaaaaaaaaaacttgttgagtagatggtagcttttagtatatatttgtaaatataaacctgcataaactgtttgatttgctgatgatcattaatcagttcatgtggaggaaagaaagtatgaaatgattcagtccctgccaactctccatggagagtattttcaggaaatctgatgtgcggtaaatgagttagaagccccttcttgaaatttcagcatggggttagggggagggatggagagagcaggttttcacctttatcagtgggctcagcctagtctcagtgtcctgtgtcacctttgtggtaagatttgctgtgttgtaaggaaaaatgttttgatgactgtatttctttttttttttttttgagatggagtttctcttgttgcacaggctggagtgcagtgcaacctccgcctcccgggttccagcgattctccggcctcagcctcagcctcctgagtggctgggattacaggtgcccaccaccacgcccggctaatttttttgtatttttagtagagacagggtttcaccatgttggccaggctggtctcaaactcccgacctcgagtgatccacccgcctcggcttcccaaagtgctgggattataggcgtgggccaccgtgcctggcctgatgactgactttctccataagctttgtgtacctttgggctaaggatgctttaaaaatgtgcaacaactccagagagaagccagagtcagaagaaaaaagtgcagcatttctgagagaagtaatattaagctgctgttttttaaacaccttatttatatataatgggcctttaaaatttttttacttatttgagaagagattttgaagtctggtattagagaggatggtggtgggaagaaacaaaaaatgc

SEQ ID NO: 31102 - DNA, 1060 bp, Homo sapiens
atatttccagatccagcaactgaacttgatcatgtctttttattttttcacatcatcattctttttcctcttaataaaactttctgttttaagcatcattggtaatatttcagttagaatgttgcaattgccacactcaggtttgttacagaaacttggtttgaaaagctttacaaattttttgacattaaattctctcacacttcacaactaacttcaaatttggttaatataaaattaaactgaacaacattgatactctctttgccataaaatcaaacgagatgctaatgaggaagaggtggaatcacctgttcttaatcagtattgtaacatttctccattgtatttctcaagggtttattacagttggccagagtaaatttgttgctaaggatctatgggatcactctggtattttgtatactagttcattttttttaaattgctggttaggactcactaaattgattttatgactgttaatgggttgcaacctgcagtttggaaaacattggtttggaatgatcattggctgagccgcagagaggcacaagatgaattcagaatgttaacaaggtctaactaagtcctatagggctttgtaggccacagtagaaatttggcctttattttaagtgtgatagaaaaatcacaaagtttgtaagcttgatatgttttgattttttttttttttttttttttttttttgagaccgagtctcgctctgtcgcccaggctagagtgcagtggcgtgatctcggttcactgcaagctccgcctcccacgttcacgccattctcctgcctcagcctcccaagtagctgggactacaggtgccccccaccatgcccggctaattttttgtatttttagtagaggcggggtttcactgtgttagccaagatggtctccatctcctgacctcatgatccgcctgcctcagcctcccaaagtgctgggattacaggcatgagccaccgcgcccggcttgtgttttgaatttttaaccgataactctagctgtggagtgcagagtggattgaaggggtggggctag

SEQ ID NO: 31103 - DNA, 1155 bp, Homo sapiens
ggttaaggagagaatcttggtcagcagctgtgttagttaagaggctattgcagagtccaggaggaagatcatgggggtttggactgtgggtagcagtatacatggagacaagtagatgattatgggagatattttagagagggggctaagaagacgtgctgttgaattggtatactccctgtggaattgattgaaaatggtttctttttccttgactgaaaaagactaccatctagccaaaaaagtaaacagattatgttgcacttccttctatgtgttatattttaaaagacaaaagatgtaactcttgaaagcaacttcgttataaaatgaatggcatttatatatttgtctgtcatacacaggcattttgaattgtaatccttgttctataactagctacttgctgtctattttaagttttctgacctctttttacatatatactcatcctaaaaattaagagtgttctggtctttttttttttttgacatagtgcattgttttaaatgaattgcaaatataaacttctctgaaatgcttagcaaccactctaggtttcctgtaggttctgtgactataatgtgatttttcatttgcatgactgtgttagctgtagcagggtggaaccttttatttttagggatgaaaattatttatttggttttgatttttagggattttctttctttcttgtatagctccttgactacaatagaaataatctttaaaaccttagggctgggcacggtggcttatgactgtaatctcagcactttgggaggccaaggcgggcagatcacttgaggtcaggagttcgagaccaggctagccaacatggtgaaaccacatctctactaaaaatacaaaaattagccgggcgtggtggcagctgcctgtaatcccagctactcaggaggctgaggcaggagaatcgcttgaacccaggaggcagaggttgcagtgagccaaatggtgccattgtactcctccagcctgggtgacagagtgagtctctgtcttaaaaacaaaacaaaaactttaaagctggaatatatgatatttgtaatgtactttcctttttaacagcaatctaaacttttaaacatgtagcagttatttttgtctatttgctatacctgaaatttataaaat

SEQ ID NO: 31104 - DNA, 1074 bp, Homo sapiens
cacatgtgatctctgagggagctgtatgttaggatgataattaaggcttataacaatggtgcagagtcagtaaggaagagttaaattatattcagtacctattgttttagaagaaagactgtatatatgtgtgtttgtgtatgtgcgtttgtgtgtttataagacacaaaagcagaagacttccatcaaaatagtttaaattttaaaattaaacacttaaaggcataagcttcagttacctagaaaataagggtagaaaaaaattcatacgctgattctggataaaagaattactatggtattataattttgtctttttacacatggttatatacatgtaatggttttgcagtatacatggtgctttcatatacttgatcacattcagacatcacagtcaacctatatagatgttacattttatagattagaaaactgaggctcatagactttaatgaatttctcaaagttctaaaattagtaaggacaagacaaagatttaaatataatcttctgattgcaaatctcatgctctttctagttcactgtgttctgtccaggttacctgtgtcttattttatcagtccacaaatgtccagggcctttggttgggtatgattgtggaaatgaataagtaaaacatgggttctgtgtgataggatctttaagacaaattggacaattaaagtatgtatgaattacaagtaaattaagtaatacaaaggtatatttggtaagtgttgagtggtaataatatttgaccattttatattgctttgcatttataagagctttcatgtatcttgtgctatatcagtggttctcaaccaaatgattttgtcaccataaggggacatttggcaatgtctgaagatactttggtttcacaattggagggcagtttactactgttatctagtgggtagaggctcctacaatacccaagacagtccccacaacaaaaaattatttggcccaaaatttcagtagtgctgctattgagaaaccctgttttatgtttaaacttttgtggtttgatatacattatttagaaatatagaataggttggggct

SEQ ID NO: 31105 - DNA, 1034 bp, Homo sapiens
aattgacaaatcttagtgaatattttgatttggagtgggaaattgaaaaggagtccaggatgatttggaaatcttaaacgtgggtgactaagagaaggaagaaaggaaaacattaagttcagaagctaagtaaagcttggggcaagggaatgtgaattctggttttatccttgttgatttggcagctatcaggcagtcctcatcagacaaacacagatgaacattatatttctagggagagatcaggctaaagagatacagtaagctgtcagggccatgggaatgcccatcaccattgtgagagtaggtgaaatcatggagaagagcaaagggctggtgcagattcattcttaaggaaacatctacatttaataaagagcattacatggaaagagtttcattaaagaccaaatgaattgttgaagatatcagaggcagttaggataatgcaacattgtgaaagccaaaagaatagtttttaacatattggcttagaaattaagaaaaattagaaggtagaaaaagtaattggacttggaaactggcatcagtagaattggagaaatgatacactttgatttgcaaagtttgacacaatgaaaggaagaagaaaacgagtggtaagagaaagatggaattaagtcaagttagcaaagagctagtaagcaagttagcaaagagtgatgaaggatttaaagttctgggaggtgggagattagactggtatttctgcaaatgaaggaccagggttctaaagattggagagcatcaaatagaatactaaggtggaaaatgtagctttggaaaggaaatacgtaacttttttactctgagcttaaaggaaagagtatgggaattgttgaaaagataaattctaaggtaggaaggaagataatgatctcataaatatgtaataagtatatattgaagagcttttaataaagaatcgtcaaatatctgagaaattggaaagcaaaactagtgaggattttttgtataactatgtatttttaaaataatttaaaacatttatt

SEQ ID NO: 31106 - DNA, 1938 bp, Homo sapiens
tgtattgtggtacacagaagtactcctaaggcaagcaaatgtactatttgtacagtcaaaatttttgaaaaattttgtattactgtatataatacagtttaaatttttaaaaagttttatttatgaattagtaaaaagaagtagtttacctttttatcttccattttcatttttaactttttttttttttgaagtctgcagatgcacttttggtggcaatcgactctgaagtagtgggagctgttgatatactacttaatcatcgaccaaaacgatcatcaagaccaactatagtagttagtactcttaaatatttattaatttggatttttaaaccaaaatagatctcttgccccattgccattttttccttccctcaaatttattttgttttttcaaaaaatagatattttttctcactctgtaaaatattaaaagtggacacttgcaggaataattagtatttctttcaggaaaactttttaaatttagttgatatttccataattttgtcactgtggaccagtatttaccatttgaaatattctgcaggtaatgttgaaaatatagattagtttgcagatagataagaattaaatgtaaacaatgaaaccaacaaactggaagaaaatgtaggtgaatgtttaactgatcgtgagtagaaagactttatgtgcataaaagcaatggacagaaatcacagtggcacagtttttgctgttaaaaaagttaaatttttggaatccagacatcagacaaaatttagaaagcagatgaataactggcaaaagatatttgcagcatatatcataaattaataatcttaatattggacaaattggtgaaaaacatattagaaaaggacatagaaatagcagaaaatacaaaatgttaaatcttaatgataatcaaatacagtaagatactaattttaaacttaccaaatttacttattaaagttgaaaatttaaaaaaaatcattgatagcaagggagtattacagtctcatgctactagtgaggcaggtattttggaaagtgttttggcaggatctgtcataagaaaggtgttcatatgctttaacttagtgctttctcctctgggaacttatcaaggaaatggtcagaaatgtggacaaaaatgttggttgtgatcttatttgtagtaatttttaaaagcccatgtgacataatctaaacattccaaaatagaagataggaaatataaatgattacatatatgtacaatggaatattatgcagtcattaaaacagtacttttaaaagaatagttaggaacatggaaaaatataacgtagtaagtggaatacttactatggttaaaatacttaccacggttaaaaatatgcgtagaaaagggactgtgtggaaatgcaacaaaatgttacctaacaatcatcatctctcattgactaaccaaattatggatttttttgtactctttttatttttctttattgcttttgtaattaggaggatagtcactactaaataaatgctaattttattgttttttaatcaaattttaaacatgataacattcattattggtgacgataccgtgaaacaagcagtttaaataactgctggcaatataggctggctataagcagaagaaaaatactgttttaagagagaattataaattggttgttgactctctgccatgtttgagaaatgtgagaggctctgctaaattgcatactttgttatatagtaactgaaaaatcttactcattcagactattacaaaagtgtgactttctccagaggatagtaccatctagtttaagtggtggtaagaaatcaacaggaataaggaacaaaaggctaagaatatagtccctatccaaagcatcagaaatatctaaaataccattcaattttctgccacttatcttgcagttattattatatt

SEQ ID NO: 31107 - DNA, 1031 bp, Homo sapiens
acctttgatggatttgagatagtgacagatctctaatttgggaaagtctcctgggaatcaatctgatgtttatttgcagaggtttacctggaaattttttctattttcaagtctattttacaaagagatctgtgtttctctttgataagatctggttgatagcgatggctacatcacttaactttttagttttaaaatgactagtttataaaatgacaagcagaaattatctttaaggctttttccagttttaaaatcctttattagtattaagtgaaggggtggcctgcccctccacacctgtgggtatttctagttgggtgggatgagagacggagaaaagaaataagacacagagacaaagtataaagaaacaacaatgggtccaggggactggcactcagcacaccaaggacctgcaccggcaccggcctctgagttccctcagtttttattgattattattttcattatttcagcaaaaaggaatgtagtaggagagcagggtgataataaggagaaggtcaacaaaatacatgtgagcaaaagaatctatatcatgattaagttcaagggaaagtactatgcctggacgtgcacgtaggccagatttatgtttctctccacccaaacatctcagtggagtaaagaataacaaggcaatattactgcaaacatgtctcccctcccgccacagggcagcttttctcctatctcagagttgaacaaatgtacaatcgggttttacaccgagacattcagttcccaggggcaagcaggagacagtggccttcctccatctcaactgcaagaggctttcctcttttactaatccacctcagcacagaccctttacgggtgtagggctgggggacagtcaggtctttctcatcccacgaggccatatttcagactatcacatggggagaaaccttggacaataccctgctttcaagggcagaggtccctgcagctttccacagtgcattgtgcccctggtttattgagactagagaatggcaatgaccttt

SEQ ID NO: 31108 - DNA, 1046 bp, Homo sapiens
ggtcttgaactcctgacctcaagtaatccgcccgcctcagcctcccaaattgctaggaatacaggcgtgagccgctgtgcccagccatatacatgttatatcttcctgatggattgaccctgttattcttagaaggtattcctctttagtaactttttaaagtctgatattaccatagccactaaaattttcctgttgttgctgtttgcagtatacatctttttccagcttttaattttaatctatttgtgtccttcaatctaaagtctgtcttctgtagacaacatataattgaatttttaaaaaatctagtctgacagctgctgccttttgattggattaagctgttcacatttaatgttattgatagttggatttatgccttccattttacttgttgttttctgtgtctgctttttgtttcttatgtgtttcatgtcttttttgtttctctgtttcttcattagtgctgtcttttgcattgagtatattttctaatatgatttataagactgtttgcattgttagaatacctgaggctacatagtttataaagaaaagaggtttatttggcttattgttctgcaggttgtacaagaaacatagtgccagcatctgcttctgttaaggaccttaggaagcctccaatcatggcagaaggctaagggagagcaaagatgtcacatagtaagggaaaaagagcaagagagagagaaggtggtgccaggttctttttaaaaatcagatattgtgggaatgaatacagcaagaactcacttattactgcaaggatggcaccaagctgatcatgagggatccacctccatgacccaaacatctccaacaaggccccacctccaacattgaggatcaaatttcaacatgaggtttggagggaacaaattccaaactatatcatgtagcatttttattaattattttttcactgaattttttgagttctttttttgactggtttctctaggacttgtcatatatattgtaacttgtcaaagtcagtgtcagattttttgtttgtttgtttg

SEQ ID NO: 31109 - DNA, 1861 bp, Homo sapiens
tgcttttttctcggttttggatctcactcacttccggcctccctcagtttccctccaaggaatgaataacctctagggtcgccagctgtgaggggaggaccactagggcaaagacacggagtgggaaatgcagaggcgggagcagctctcctttgcagtgctgcatagccaaggttaatgtacagtctacacgtggtctttaccttaacgggaagtaaaaagcacttttgagggtagaggactcgtggtctctttctttatgttgaagaaacagtgaaaagagaagctccgtagacttgtaagctacatacgattagtaaattgcatttgtgtttacagggaaccctgggcacgtattgtgaaaccagtgagctgtggtagtagttaagcattagtacggttgggttcttagttgccatcttgggcgggacatttaatcgttttttggtttgggtttctggtctcgaatatattaaaagtaattggtactgccacgaggtagttaaactttccgatgctgatgcaagaagctgtgtaacactttcaggtgctagggactgttaaatcttaaagagtgtgtgactgtaaatcggctattagaaagttaaatttacggtaggagagaagcttgcgtttacagttctgagaaacatcataactcgttttctacttgctttctctaatccgactgtttatgccatttggtgaacgatgtacaccaaaataattaattcataattagtaatggtcttaacagacatcgtttagttacatagaaactttggtgaggggccagtttcggcttctttacaaggtattgtgtcagttttttttccccctcctcagtacattttctcgtctccctctctttgggggcgagctctaccaactcttctcaacagactcctgacaagaacataccgttagggagctattactaaagctagctacgttcataacaagtcgtgcataagcctcacaatttttgtttcttctcaaagtaatattttaagtattccctacttgaggtcttggatacattgaaaacatttcaatgtctgtgttcaggcttccttctaaaatagtgcttctcatgactgaatgtatggctgttctcaataaataaattattggattatccagtaatcttttctgtttatattgccttagattataatctcttgatgctattagcagatttcttactgatgtctgtgaaaggaatcagaatatcttaactaatttggaggctgcataatgtagtgggaagattatgaattttgttaacaagagatttgggttcaaatcctgacttggtaattaattatatttgcgataataaggcagattgcttaaactctggagcctcaattccctcatttgtaatgtagatataattctttttttacatggttgatataaggatcaaatgagataatgtctatgaagtacataataaatcttaatttctttcccctctttttgtttttagaggaaatcaaaagttcttagctttcaaaatgtcaggataaattttaatcctgtgatttggaatctaagtcatcagctgtcataatgactgcccagatagctgctttttatttattttatttcttttttttttttttttttttttttgtgaaagagtttcgctctgtcgcccaggctggagtgctggagtgcagtggcacaatctcggctcattgcaacctccgcctcccgggttcaagtgattctcctgcctcagcctccctagtagctgggactacaggcgcccgccagtacgcccggctaattttttgtattttagtagagacggggtttcaccatgttggccaggatggtctcgatctcttgacct

SEQ ID NO: 31110 - DNA, 1793 bp, Homo sapiens
tattaacatttcttaattataaaaagattaaattagataacctctacaggtcttctagttggggtgttttttttttttttttttttttttttttgagagggagtcttgccttgtcgcccaggctggagtgcagtggtgcaatctcagctcactgcaacctctgcctcctgggttcaagcaattcttctgcctcagcctcccgagtagctgggactacaggcgcctggccaatttttgtatttttagtagagatggggtttcatctgttggcctcttgaccttgtgaccccccccccccgcctcggcctcccaaagtgcggggattataggcgtgagccaccgtgcctggcttctagttttaaaatgatactttatgtatgtgtatgtacttgaatgacttacctttattcataattgtccctaatgaagagacccctgtgcactttaattttctgtgtaattttgttgtgctttgcattttagagcctggcagatgtagacatttaacaaatgttctagaaatgagctaaaattttcctgtgcatttgtttgtttatcactagtctaaaatattgcttggttggggaggggtgttgatgttatgtagtagctttcattttgagaggagagagagagagcctgtaattgtttacttataaaattgttaagcatatttccttagaatttaatttataaaaaaattactgtttttgactgtcaattgtttgcttactcagcaaaattaggatatgaagaaaatgtagtattttctttccttctgccatctcctgtgctggtaatattgctaatgtaatgtaattgtgtgccctgctatttcactctgtgactatggctttttttttttttttcttttttgccgtatcgccaaaaattgagttaggtgaatggataaaacaaaatactacaggcttccttggacatccagtgctgaattgctttgggaactgttttgattgactgcctttgctgattaacaaaaagtatcacttttaagaaataagtaaactgaggacctgttcaaggcttgtgaaccttaggtatttattactgccagttttcattttttgtggtacctgaaagtttatgaaaaagtccaaacaaaatacaaaccttgaaaatcaggctttcaaacagtttgccaattttaaactgaatctttattatggtttatggttgtaaccttatcttaaaatgtaaggtagtttttttggtagaaggttttgttttggtctggaaggtagaactgaacttccttccattttctcgattgataactttttcgaaacttgaacctgcagcacgggtgctagaatatgcctgttggtatggttttaaaaataattcctatctttctggattgaattgttttctgaaagtccagtttttattttcactttttgttttttatttctgaagctttgttttccttggaaagtaaacctaagaaagatacccatttgccttactgggtatcattgagagaagagctcatttagtatgccggttgaagtatctacccctctaccctccaccctttttttcaaggagccatcatttttggaataaaaagaaaaacttgctacaagatattaaaatcaaaaatagtaatattacaaactatttgcctcattctagtataggtggttttaacattttattgcacatcagctgtgagctggatattttgctgaaataacgtttttgaaagcaagatacatttgtcagtagcacttgaggctaacggtagtgttagacatatattccttgagtta

SEQ ID NO: 31111 - DNA, 1086 bp, Homo sapiens
tatggagtctctgtcgcctaggcggtagtgcagtggcgcgatctcagctcactgcaagctctgcctcccgggttcacaccattctcctgcctcagcgagtagctgggactacaggcgcctggctaatttttgtatttttagtagagatggggtttcaccaggtttggccaggatggtctccatctcttgatccacccgcctcggcctcccaaagtgctcggattacaggcgtgagccactgcacctggcccaggcagttgatttttttcagtcccttcagcctcttgcctgaacttgtttttcttttgtaagagtagttatttattcttttggatttttaaatttctagatatttgtaaatttatgcatttcaagatatgtttcagggtgtgtttcatagttaataaatactaaaaattttcttttataccaccttgacatttaagaaagattagccgctagaagaaaatcagggtggacacaaaagttggggacagaaaaaccatggacagaaagagtgagatggggccgggtgcggtcgctcatgtctgtaatcctagcactttcagaggctgaggtggacagatcacctgaggtcaggagttcgagaccagcctggccaacgtggtaaaactccgtctctactaaaaatacaaaaattagccaggcatggtggtgcgtgcctgtactcctagctacccaggaggctgagggaggagaattactggaacccgggaggcggaggctgcagtgagccgaggtcgcgccactgtactccagcctgggagacagagtaagactctgtctcaagaaaaaaaaaaaatgaaagaaagaatgagatgggaggggtcccagtgcttggttgtcctgttgtcctgggctgatttttgcctatgctaatgcgcaatacagtggagttcagaggagtaaattgattcagtgtaaaaatcttaccagctgttcttagccttatgtctggacaatgtaaataaaacaatactgtatggatctttgctcttttttaaataacatgaatcttcagtttttctcttaaactaatattttatcttgtactttatatgacat

SEQ ID NO: 31112 - DNA, 1048 bp, Homo sapiens
gtctatttcccactgatttgagatgctccttttattgaacactaaatttccacatgctattcaattttattctgtattttctgttatgttccattggcctttcttctgttcatacatgttttggggacatttagaataattgaaaatatcaagattcttctgagctttctttatatcaagattcttctgagctttccttaatgccacttgtcagtagatattgctgcttcaacttctaatactcatgtttttggtgatttgaaaaatatttatattcactgaattaaatcatcatgccttggaaacttggtaaacattactagcaaaatatgttttcatatagtcagttgtcatataatttgatgcttgagttgtctctagacaaatttactaattaatctatacttaggggttcttttctagttctgcaaattgccggtagaggagcaaagcctctcttggtttcattaattaatacttaatatcttctaaagattagacgttattacttgttaggactgcttaacctgggaagggagggttttcgtccatattattccttgatgaatttagccttgtgtacattaacaatttttgtattgtgtaatattaatattttcatgtgtatttaggaggatgaaaaggcagctgctgagatttatgaggagtttcttgctgcttttgaaggaagtgatggtaataaagtgaaaacatttgtgcgagggggtgttgttaatgcagctaaaggtaagtttataaagtataactgctaataaagcataactgtattacagtttttgagcgagccccatcttggttgaatgactgcaggtagataattatgaaaggaagtttggttgcttttgaattttacattttctatcagcaccctctagtggttattattaattagcaagataaatggccaagtgtcaattaatgagatgctgaagacagatagcttttaaacatatttagttcctttcaagttttaagacagcagagcacttgtcacaaattttaatatgtgtcatagttttgctatgaa

SEQ ID NO: 31113 - DNA, 1052 bp, Homo sapiens
tatatactgttacctgttttctctgcatttgattacatgggtagttgattgttagaacagatgattagatactttttttcttcattgtcaatacatatttcctctttaatttaaatgtactaaccatgcctgcttgaaaaatgttactaaatgcctaaacaaaccatcactataaaacatcttacttagatccaggaccttaaaacaaaggaagatagagagtaaaaatgattttgatttcttcatccactgaacttccccaccctggcatcttaaataaaccagaatatttatagtatgaaatgatttatgaatgccccacgcgggattttacttgtgtggcgttcctggtacttaaatggaaaattgaagcacgttgctatgttgctttttattttgtaaaaactactttgttttctgaaaataattttttcttttcccttttttgcataataaaaatcttttaccctttttaatagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggtaagaacatttttattatccatttatacaattcagatatttctttggtttggaaaagtatttataaaaactaggaaggattggacctgaaatggagaggttaaaatgaaaattatttcaactcaccagaaaaattttgtttggaaacttttgagagttaacaaaatgacctttcatttctttcttgtaggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaaggtaat

SEQ ID NO: 31114 - DNA, 2047 bp, Homo sapiens
cttgactgagcaatggttccttcccagtactttttgcggggggatgtgtgaaatttaactaacttttgtatactttgcaattttatgtcagtatctttttttgtttttattgttatcactgtagggaatgtttatagtttgactagttagagtgtatttattagctctgatttggagtcagacaatagactattgtcatgggaaaatagatgttttaagtgtgtcgtaaatttcagataacgttacagtttgacccaatctgttgttatttttttcttgttttctgaattatctgcatttaatatataaccttggtttgagttctccttactgaaggcatagctttgttttttgttttttcaattgattttaagaagaaattcctattattgtcatgaacactggacatactagaaactttcttttcatggtaacaaaggtatttggaattcttttattttcctttcttcctttttttctctttcaacacactattaaagcagaagaattcatgctgtaggtatgctcttgctcagtcaagctaagccttttcccaaacacaggaacacaacactggttgaataataaatgaacacaaaagaataccaaattctctttgacattggccttggtgagcaacaccagctgaactgtctgcggcagcgggggaccaggaaaacatcatgggatggattgggaaagtatacagtttttgaccagacattggtacgatcgactccaataaatgtggttttattataactgagagacaattttttgtttttgttttttttttggttattgttgcccagaataagataattaccattttaaaattaaataatgcactttaaatatatcatctttttgtactacactgttttattctaatagaaaagtcaccatttttaaaataaacacaatccttaaggaagaagaatgtgattacagttctttagtaatcttgacatcaagttaataacaattaattgtcagattttgattttaaataatcatgaaacattttaaaaatacttataaacttttaattttctaaaaatagatttatcagttacaagcctgtttaaaactatagtgggtttttcaccactgataaaagcattcacaggatagtatttttgtagcattcaaaaaaagcacatatctagtggtagctttacatgtatgtggctcagcttatttctaaacaaaattttgagtgtgcgttttgccgaaagtcttcactcaccattaggatgaatcctttgtttttaaacttgctaaacaattttcctctatcttaaatgctaaagtcaagttgcttttgacttaattcacacaagtttctggatgtataacatttgtccacctagtaattagtcttatacataaaatttcccttagctttaatttggctcctatcagtggggagttttggaattgaatcataactttacattatcgcccttccttcaaaataatgtcattaaccatatgaatgctgaagaactgcatatttgcagagcaattacttctgtgaaagagaaataatttttaaatagaaaattaagcaatgtttttagttttttgttttgacaatttgaggttgaattagtagttttaaatgcatgatttcccctttgtaaagatttaaactgtgatgcaattttttttacttcctttaggcttaaatttttttcactatggagagatttcattttaagtaggtttgtttgaaagctatgagaaaataattatagtcaccttgagatagattattttattgttcatgtactctgaaatagggcattatagagccacaaaagtctgtcttgttctataactatatatttatttacattctagcagttatatgaacgtaatttgagctgggaatgctaaaggtgtaatttagtgtgtgctttgtaccaagagccaatatccttttgcttttcccaattgttatttgccagctgtgtatggatggggactggtgaaatgaggaatcaaaagcagcttataaataacctgagtcatttttgcccga

SEQ ID NO: 31115 - DNA, 1048 bp, Homo sapiens
gttttttttcttttttacctcctaaataattactgaatccttaatgtttaattctgccatgctagtcaagctattatgttttcactttcactcctgcaggatcttcctaattggccttactgttgcaacccacgtggtccttgtttcagtttcttaaatgtgtgtttccacctaccattggactttgtacatgtccttccctctttctgggacttatcttcacctgagatccttcagatctcagctcaaacataaccttagccttctctgacctctttaagtgaaacttagtatgctaatagtatgatacgcccttttgctgtagcagttaccatagttacagataagtatatattgttgtgatgatctgatttcctggttcccccacccctgcaaaacaacagcaaaaacctttaccaggctctataacagggggaccaaacttgtttttgctcatcattgcctcacaaggtacctggcaccagtgagcacttggtaaatattagataaatgcacaactgactgcttctttagcaaactggatgatagaatatgttcttacattgtacctcagattgtgggtatccagttatgttggcttgtactggattacaaattaatcttacaagcaatgtgacttcagcaagcaaaggaaaatgttataatagtacacatttccataggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgccttgtaagttcagatttcaaactgattaaatctagctaatacatttggtgaccaaaactctaatttccatacatgctgatatggaaaaaggttatagtttctcatgaacgtatcaagttattaacttttctatttctgatttttttcaaaattcatatacccagtaatacatttatttgtatgctatgtatataaaaggccaagaagaagc

SEQ ID NO: 31116 - DNA, 1050 bp, Homo sapiens
acggggcggctggccgggcggggggctgaccccccccaacctccctcccggacggggtcagaagccagttcttaatctttcacataccactgagagcagtgcctaggctggagtttccttttcttattctactattgtccccatttctaccaacaaggttggaagagtagaatagtgggtggggaaccaagtggagggtcttctgtcttgttggaagagagagatcactttctgtcctggtccctgaggaaagagtgaacagttgagttggaaggtgatacctgtctgttgcctgaaggcaataagggctggatagttaagaagccattgcatgggccacttccttttgtgttgagacccttgatcatctgttttctgtgtgtcttggacttgtgcttgagcctcagttagactgtatcagcaggaactataagtagggattgtatagtgatttttaaaatgattatcttaggaatcccttctctcccctaagtaacatttgggtctgttgtttgactctttctaacgcaaactgatttactacaaatacattctgtggaagagtcatcttggtcacgagaggcttcacacagcgatgaacttagctatttatgttgcccaccccacccccttgctttctcagccttacatcttatctttttaaatgcagtcatgattaaaacacacgaaaaatgtagacttttagagagctttgaaagaagagaaggagagaacatcaaagctctgattataaaagaccctgattatggaagtgaaaatatgtctgaaatcccaccactttgggaggccgaggtgggcggatcacttgaagtcaggagtttgagaccagcctggccaacatggtgaaaccctgtctgtactaaaaatacaaaaattagtcaggcatggaggctgaggcaggagaattgcttgaacctgggagactgtctgggaggcggaggttgcagtgtgccaaggttgcagtgcacctgggtgacagcgtgagacaccgtctcaaaaaataattaattaaaaagtgaaaatagatgg

SEQ ID NO: 31117 - DNA, 1822 bp, Homo sapiens
atgcccttgaatgatactgcagtagttgtttgcttcaggatgataaacttcaaagctgctgtgttttttaaattttgtgcatgatcttaggtgcaactttgaactttatcttgtagattaaaggttcaaatttgggggttatcagtcacttatggagcttgttaaaaatgcaaattcttagttccatcctccagagattttgattcagtagagcagtgataaggcacagaaatctgtctttataaacaagcgctctactgatgatcattgatgcagtgcatagtaagtacaaaataatctgtgtgtgtgtgtgtacaatagagtttaaattttagaagttcatagtcttattgcagtgatttttcactgtgccctgttaaagatcattttcgatcgtttaaggataaacagttttgatcacatgagtactttatcaattgggatttttttgtttgtttccttagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgatcgttgaccttttataatcttctgtaggctatctttcaaacactggcatcagaatattttttataagtttgtgtttaaacagcttagttggtccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatc

SEQ ID NO: 31118 - DNA, 1087 bp, Homo sapiens
gataaggattaagaagtaaaaggcaaatagtttctttttttctctgtaaatcattattatagtttagtaattctatttagtacattggtaaatggtagtacaaaaaaacaggttaagtctagaccttagactctgagacagaatcttaaaagatttgtaatctgaagtaagtatgatgcttcagtgtcttcgtattttttctttctaatgcttttttgggggttaactctgaaatgaaaagatctgacagtaattatgtggaattggtcaatagtgccaggaactgatctgtatatacccctgggacacagtaagggtcagttgagactagtaaacttatgcatatttaaaacttgtgaacaagtgaagtgttttttgttttgtgtttttttttggtgggggcagcatttcttaagcaatttattctaaaagataatctatttctattaaatttagtttttaaaatgtgttttgacatcagtttccaattttagatacagctgttggacatgatattcagtaaaataacacaaccttactattttcaaggcattgtttaatattgttggaatttgaggtgggtggaaaatggcattcagaaaattatttcatgaaataaatgggacatatgctaggacttaaaaatcttgaaattgttaagcttctacagtatttgcaatggattttggctgctatttagcagtataaattaagaagctaagatcttagagaaattttagcaaaaattcagtaaccattaaatcatccccgtaattttactatatctcccctccagacagttcaccaaactgtgaacacattagtctgtcaccagtacagttgactaatctttatgaacagctgttataacatgcgttactacaatgggatttcattcaaatttgggctttaaaaaataattttaaaacttaagttagctctttctttcttttctttcttatgtgtctgtctgtctttattttgatggagtctctgtcatccaggccggagtgcagtggcgtgatctcagttcactgtaacctctgcctcccgggttcaagcaattctcctgcctcagcctcccgag

SEQ ID NO: 31119 - DNA, 1050 bp, Homo sapiens
gtgtgccaacccaaagaagcgctatggcagattccaggctgcaaaagaactgcgtgaatacctagcacaattaagtaacaacgtgaggtagtctatggtgaacttttctttttttctccatttaaacagcactggctaaaactaaaccaccaaaaaacgatctgaaaaaatgaaatttggaagtgttacattcagaggatgataaacttgcactgatagatcttaatgttaacatccatcaaaataagacattacttcaaaaatcacatgatgcttctgcaaataagtatgttcttatactttggaggcttgagctgtcatcagctgctccccactaccccggaatgcttgagtggattaatgaatattgttaagctattggaaatgagtctgatagtacattggcttgtgtatcaaagggtacttggtacttagtttgcatttactatcatgattttgtgaatctcttgcatttactttgaatgtcaagtcagattggtctgttttataggccgctttttccttctgatgtgtagggttttttccccctttttttttttaattaaattttgaaaattcaggttactgtaggtgttcatttaaatttttaatagttgtcattcagtgctatttggtacatatttactgttagggcaggattcccaggtttactgtgttttttttttttttttttaaagaaagctaaatattacattatgtaaatacttcttttcaccaacttctgtagtttcaccattgcatggtgtcatttcaggttatttaacagttatatccctctatgccaataattagaagtgtacactaaacatgaagtttggcatatgttgcaaaatgtcattttatcttttctaaaggctttaagaagaatatactagaatctatatattgatgttaattttgattcagaaaaaaaatacaacccagtatctaaaaagtgttaactagtccaagatagtaatgcatatgccaaagaaatattacacctaatctcatgtttagaatttaaaatagaattggtcagctacttat

SEQ ID NO: 31120 - DNA, 1021 bp, Homo sapiens
aagctgagtaatattgacaattatagcaaagttgatggcagataatttggtataaataggtttactgcaatgtcgaatctagatgcaattgcattttaagaccaggcttattaacaggtatttttaaaaggatggaatatgttatgaaattgtggagatagaatcacattgatattttccgtggtgtgaaaacaacctgtcttgatttttcaatatacaagtaatttccagcgtacaggagacggcacacattccctaattatcctgaattgactttagcctgctttgaattttacttgtcaatcttcttaatgggaataggattagaatatcattgatgtagaatcaatgtaatacgtcattcatgatgaaataagtatatatctgttgaataaataaaagaataaattaattaatgaagattatattcaaccctatttcaatgattacttaagctactatttaaggagcatctagatagttaagatggtagattctacaaaccgctcatgaaactcttcacatttctttattttcgacttcactctacactttatttctgagttcatctttccaggtacttatagaacattttcatatgcatgccccacaatcagcgcaaacgtaaatatcccaaattaaacctacttgtcattgtgatcttcttcccatctcttcactccacttttcagttggtggtataactttctcccagtcaccaaggaatacgttcttcatcgtcattgactttttcacctttaccatgtgtcttagccatggagtcctacttattcttctttacagtgctcctccttcctagtctcatggctatagctatcagctcactcgttgtagacatgtaacccttttttcagattctatttacccccaatttaaaccaccctacatattttcccatactttaatctttctaaaacattgttttcactattgctttctttggcttgaggactcacagtaattggatattgcttgaagtttgaaatccagttgtattaga

SEQ ID NO: 31121 - DNA, 1036 bp, Homo sapiens
attctcctgcctcagcttcccgagtagctgggactacaggcatgcgccaccatccctggctaatttttatgtatttagtagagatggggtttcatcatgttggccaggctggtgttgaactcctgacctcgtgatccacccacctcggcctcccaaaatgccgggattacaggcgtgagccactgcgccgggctgggagctgatattttctatcaggttccctgctagatgttagtgataataatatgaccttgtcctgctctccagttattcaagtgaagacaattaaccatagtacaagccagcctgtggtaagtaccataatgaagaagcatgcttttttatttttaacatcctgaacctcccaagaaaattttgctctttatcaaaggaaacaaaagagtgaaaatggacaaggagaatagaggtagttgaggagtggaggtgggggctgttttggccttgtggtacttgagatatgtaatttggaaactggcaatgcacctgtcagtatttggccctcttttgaggcctacaagaactctctggtttgctacccaatgcctataaacaatttagcttgcaaaaaacaccagctctactattaaaattcctctttagctttgaatccttgttgtgtcttggttgccaacacttggtggtggtttagtgatatgattcttaaatgtttaaatgtggtgcatactgttcaattttaacatgattgatgaaaataaaagttaacaactctccccctgtacagtacttagttgattaattgattgagccctattaaactaaattaccaatagaagtaggtgtttgagagctggagtggcctctggcaactttaagaaataaacaaactttgcagcctcatccctattacttgggatgcttaagaagcctctgagtcctcaaagcctcccgagttcaggtattagcatgaaaaatccctgattattgcttcctttacatctagactttctcatgctataatccactgtagttttctcaatctggctctctccatctc

SEQ ID NO: 31122 - DNA, 1048 bp, Homo sapiens
aactccaaaataagtgggagtaggtgggagcgaactgaaatctcaggcacagatatcatactgtccttaaattttctcttttgagaatttacattttatttaaatatcctttcagtgttaatgagtgttgggtgtgcatgtattcttgtttttaaaagggtagtttcttatagtttagtacagtttgcaggggtgagatctcaaacctggttttaataacaggacttataaaaacatttacattgaactgcagagggatgatttgaataatctaggaaattaacactatatatgaatctttctaggttttttttaaattataacaattttatttttattttcattcccatagcaacacactaaaagactctatagaaagtctttgaaactagaaaataatcgttttaaaaaaaatttacttcaaagagtttagctctttctatagataactttaaaaaataaaattctcactcattattaaaatgtttattgcagaaattctggaaaatttagaaaaatataatggagtaaacagaaaataacctgcagttctattactaaaagttcaacattcatttctctgttattatctctttagttttttttctctttttatatataaatgtagttaaaaatatttgagacagccttaaaattctgattttccttttcttcctcttaatattatacaaagtttctttttatattaatagtcagtattcctctacaatatgaaaagtgtacggaaccaaggccaagccattaataggttatacaaaaccatagaaacttggaaaacaactgtagccaagaagtattcaatttcaattggtctatggatcattatatgtataggtgctcaaaaatatttgctcaacgaatgttgaatttcaatgtaaaataataaaatatgctaatgagaaaaaagcataattttttcctctttttccccatttattattttgggtcctctgagaagcagatatcaacatgggagaagactgaaagaaatctatttgagggaacacttgtaagggaaaaatgggag

SEQ ID NO: 31123 - DNA, 1029 bp, Homo sapiens
gtgaggaaaaaggggtgagcaggcattaatatcagaatggaaagagccatttcttagtgaaaggtcactagattgtaggtacaggttagaattattcttactagaacatacactttttgtcctcacttcagttttgtttttatttaggaaaagccattgctgtagctaagacaatgacattaatctttcctcctgttgtagcttctttggatgaactagcttagaaatgacaatctttggagcctatgactaatcatgaggtgtggcaattagattttatagaaagatgttgtaaagaatgaaatcaaagatatgaaaacataaaattgtaaggagaatcctattactatagtaggtttctttataaatctgagtacctcacttttcctggttttaaactttatgaatatacctgattagtgaaggaactgtggatttgtttttagagaaaaaacgttgtgttcaattttaaatattaaaaaatgctcatgatataaagtcaagttaatagtaggggttactcttgtgtaagataacaagagtacctggaagaatttatatcttattccaccattgctgaggtgaaaatcaaactggaacatcagcagtttcttcacgtattaatgtggtatagtcagctttggtgtaaacgaaactctgccatttgccagctgtctggttttgcaagtcatttaaattttctgggcctcaatttcctcagctttttaaaaaaggataataattatctgctatggtttgaatgttttccctctccaaacctcatgtggaaacttaatccccatgtagcagtattgagaggtaggatctttaagaggtggttgggtcatgagggctctggattggaattgattaatatacattcatgggttaatggattaatgcattatcattggaatgggactggtggctttataagaaaaggaagagagacttgagctagcacattcagcccccttgccatgtgatgccctgtgccacctcaggactctgcagagtcctcacagcaag

SEQ ID NO: 31124 - DNA, 1025 bp, Homo sapiens
tccccagattataacctaaactgttattgttttcccaaaatagcttgctgtaactaaaatcagagaagttttcttgttgtctggtattcaaaataaatattatgtgtacttgcctaaattgtgatattgatttccatctttaagaaaaaaaacaaactccataatgatatgaagctttgagctgatctttatcgtgggtctaatcatattttgctggtttgtgccagatgaaccaggaaattgggaaatgtattggctcctttcctgacctgaaggtgcttcttgtgagtggacgacatggctgcctcagccaaatatagggcactaaaattttatttctatacataatcagtttccagatgcacactgttgtgagccaatatcatcaccccctatgcatcataattagggatagtcaataattagtgagcaaaaactgtcaaaaatctacttgtacattcttaaaaattgtttaaggtgtttttttcctggatagaaatatatatgtagattttttcaactgatgattaatgttacattttatgagatagatattgaagcaacctgtttattttatgtcatctattataacaatgtaaatttgcctttaactttgaatgagcaatacattcatatagttaaatacttaaaatgtagaagaatttacagtgaaaaaaaaatctttcttccaactctgaccccagttttcaagtttcctttccgactaggaatcaatataattagtttttaaggcatccttcatgagatattttatgcaaatatgggaaatgttagtatatatatttttgcttttcttgagcaaatagtatcatattatgtgcgtttgtttagactgtgcttttttgagatatttttacgtcactacatatatgagcagctcagtctttcctttttctttgcttttcctcagatttatattatttatctatatgaattcagtacactattttttaaccaatattttgttgatgaacacttagacatctatagtcttttgttttaaa

SEQ ID NO: 31125 - DNA, 1029 bp, Homo sapiens
tcatctcagaagccaatttgccttaacaaaaagcttcactaacttccagtaatggttcacttccaccctggaatgtttggcctgtctatatatttggagtcagcaatccacttatgacaggagagagaagtaggagaaaggggaattagtaattccttccatcctacattttttttttttgactaagagtatcaccatttttctccacatttctggaaagcatgaggagtaataataatgatcataatagtgataatgataaatatgtattaaacccttaatgattctttgccaagaactttacatgcctaactttatttaacccttacaaaaccttataaattaaaattgttatctccattttatagatgagaaaactggtttagatgagtaagaggcttattcttaggtgctgcaaattcaatcctaggtttaaatctagagaccacatccttggccaccaaaacttcttccctatccaaaaaacaacttgttatcccttttgagaggaaaattcacctcctaaaattaagatttactggcttcctggtggaaaacacctaactaagcagctgtgactacatccaccctgagtctctctctccttgggagtgatggctgccaccacaggctgcttttggttgggggagtcctcttttctctggaaagtttcaccctgggttaggctggcatgcaaaacaaaaaatataatttagtcaatactgagggagaacatgagaaaagcaaactaagaaaaaacacaaaacacagaaaccatccagctggcagttttatgatccaccctttgcttgctttcccctgggcttgtgagcctggcccccttctccatcctgcagggcgttaacaaaggaataggacatatttctgctcaccttataggtgccttttaggaagttgatttttccagtccatgaagttcctcttcctccagcagttggcaagattttctggtgattaacagaatgttctgtccctgcacgtatagacacttgtcctgagcctgaaggc

SEQ ID NO: 31126 - DNA, 1064 bp, Homo sapiens
atatctgatttctaaatttatgtagtctatggaatagtctctatttttatattaatattttagggagaatagcctgagaaagtcccaaagcatttcccttgtatcagaacaataggtttcgcttcatggtattggcagtgttgaataggaagatcttgaacttgtatgtgtgtatggcctaccttgataaattacaggaaacctctccaaggagctaagtgattttcttttttgccctttttttgcattatttaatgaaaaatacttattgatcacaaactctagaaactgacatttcctgcagagaaagtctgtaaggaaccctgactccaggctgtttctcgttaaggtgctgtgcttcctgttttgttcattatagttttgaaagattcatattatagccaattttcccagaaaagtttagtttataataacctagaatcagcaatttatttctagttaaaatgttactgccttccacagtctcactgggagagggtctggatcatttctcctcaggaaatcactgccttgagctgaaatatactggaatcctgctacttcccttaattccagccttccaacccagtatagttgttttgactttttgccttccatcactgagtacttgaggatggttcttgctgttttggggtataaactagtgcattgagtatgatatttttgaaagctttctaatttaggtcttcttttttggtaaattctcttctaccttgtccaccatttgtggcacaaccatcaaagctaagtctgataaggatttcatacaagggaaggaagacaggaagaaaaagtaaagaaaagctccttatagcagcttcagtaggattggggaaggaggaagagtgagaggtaagagagacaagagtggacagaggaagccccatttcctttctctggcttggcctgtgcatggtaattatgcaaaccgaagggaatgctgtggacagagttctcctttgatttttttttttttttttggatgctatgagaagactatcttgcagcctgccctcctgttaacctggaacaagtcacaactg

SEQ ID NO: 31127 - DNA, 1702 bp, Homo sapiens
cctgggggaggccctttcatttctctgtgtacccgaagtactaaggcaggcccaatgcttggggcatactctacagagattgttgtctgaataaatgaataccgagtcacttgcatttactcaggggggctttatgaaagcctgaccagtgtctagctttgattctctctcttcctctctttctatttatctatctgtcttacagctactgacataatcttgctgagggcatgaaagacattagttaattcctgggacatggcttgaaaatgggaaccatcagcacataaccagtaattaaatggatgaccttaaatctttatttgtttgttttgtttgagacagggtctcactctgtcacccaggctggagttcagtggcaaaatcttggctcactgcagcctcgacttcccaggttcaagtgatcctcctgcctcagcccccaaagtagctgcaactacaggcgtgcgccaccacactgggcaattttttgtatttttagtagagttggggttttgccatgttgcccaggctggtctcaaatttctgagctcaagtgatctaccttcctttgcctccagagtgctagcattacaggcatgatccactgtgccctgcacaccttaaacctttaagtctcttgagacaaacttattcttcaagattttaatgagattgttttgaactccaagcctgttgcttttctcaacatctccagagatctcggagcttagtttttcttgaatcactttagttttgagtccccacttctgaactgtcccttttctgctgtaaatttcacgtgcagtctgtttgcactcaacatcatcacgctgaacattatctccagccctttattttccaaagcagaaggaagtatgccttaagtagcagccttcctgtggggaaactgaggtacaaagtgatgaaatcatttgcccaaattcacacactagtaagttagaagactacaatgtgtgccatgttatcagagaccttgcagtctgtgacaaggcaaactatgaccatgcaaactgatgaaaagtgctgcaatgatggagaatggagggtggtggcaagtcactctccctggcagagcaagaacgccttctggcagggaagatcatttcacatttgattcaagatttgaaggacaaaccggtacttaaatgttggcgggtggaggtggtactggaacatggtggtatcctgaagcaccaaatatggaaagagggaatgataaatagaaggccacttagataaaagtgtgctatgctgaggagtttgggttttattctatgggcatcaggagaccatggaaggattttgaatgggggtgtggcatgattcgacttgcaggttgtactattttatgagtcccctgctctgtggtagtattcttccttctgcagcctgttactgatgcaaatatataacctggttctatgcactcaggaactgtttagcgcaaggtgaatcactgtgaagtaagcactgtatctagcatgccatcatttcctcctcaattataaggaaaccactttcttctccttcagatctctgggtgtttggctattccaacccacagaagacagcttcagagcattgagccacattctttccaactttatccccaatcttcctttggaaacagaatcacagctcatggaaaagaaagatcacctcatccaaaccacaggcc

SEQ ID NO: 31128 - DNA, 1044 bp, Homo sapiens
tgtaatatttacaaggtttataaaatggaaataaaattatcttagtagtcttaacattcatactgaatttctgaagtcacagttctcttccaagattggtgtgaagcaaaatgatatcgtaggaaatatttactcataccgttttcaaaatttctatctcccttgatgtttgctttgggattttatatcttttggtgactgtacagacatgcattacctctcccagagtcattttcattttgaaactaattgctacttcacagggttcagatttaccctgagacctggatgaacacaagcgggtgggtttgggtgaactctgctcttctttaatgaatatccataggtattcattaattaacctagggagtgataaataaatagggaaataaagtcctgatctgtgtttgtgatttacttttggacttctatagacattctcaatggatgtgggggccagggagcctgacatgaataatcgtaggattctatatgtatatgattatttgatttctgtttacctttcccataggactgttagctacatgagggtgaggactatgtctgtttttttctcattatatttccaaacacagcataggggacatatgtataaatcaatatttgtggggagaataaaatggcctagaaaccacttcacacacacagacacccccctgccccccacaacacacatacacacacacattgatctaaagggaagagtagagttcagagaccgaaaatctgtggcaaattaataatttagttatcatccatatagtcttagatagtttaaaggttctaagacttagcttccttatatgaaaatgaagataataatacctgtccgcaggctcataagactaattaatataaacacaacaattgacacagagcttgcccatagcaggagctcaataaacaatcagctctctttattgtcctgtggtgctatcttgggactgtcttcagatgagactgagacacatctgataaacactggttgggtgggatgctcagaaggttcttctccatgggagc

SEQ ID NO: 31129 - DNA, 1048 bp, Homo sapiens
gttacttctgcttgatcatttctgctgtttaagataattatgcattttcagtatgtcaattccatttttcagctccagaatttctgcttgacccttttcaattatttcatctctttgttaaatttatttaataagattctgaatttcttctctgtgttatcttggattttattgagctttctcaaaaaagttatttcaaattctctgtctgaatttatatctctgtctttgggattggtcactgctgccttatttagttcatttggtgatgtcatgttttcctgaaagatcttgatgcttgtggatgtccttggtgtctgagcattgaagagttagatatttattacagacttcacagtctaggtttgtttgtacttctccttcttgggaaggctttccagatattcaaagaaacttgggtattgtgatctagtatttggtcattgcagccttgctgccttaggaggcaccctaagcccagtaaggctatggattttgcagactggctgaagcacctcctaggtggtcttggataagacccaggagaattccctggattaccaggcagactcttattctcttctcttacttttccacagacaaatggagtctctctttctgtgctgaactctctggagctagaggaggattgatataagcacccctgtggctaccatgactaatactgcactgggttaggactgaagccagcacagcaatgggtttcacccaaagcccactttgacaactgcctggctaccacttatgttcactcaaggcccaagggctctacaatcagctgagtgtcctccactttaaggcaagttcttcttggcctcgggcaggtctggagatgttgtctaggagccagagcctagagtccgaaaccttagtaatgtacctggtactctgttctactgcaactgagctggtacccaagccacagaaaagtctttcctactttttcctccttttattctaagcagaggagtctctacccatggctaccacccaccctaggctcatggtgtgtacttcctggctacca

SEQ ID NO: 31130 - DNA, 1045 bp, Homo sapiens
aagataattatatcacaggatatttaaatagtttagaagtatatcatcacaaaatattagttagaaaggaatttcacagtggagaaagatgggtggtaggtctcatgttaatctagtgatcaaagtgaatgccattatcaatgagacaaattaaaattatgtcccaattttaataccagaaatgtataagatcaggtaaatccagattggagaacattacaaaataactggcctatgattggcaaagcatcaaggtcctcaaagtcaaggagaaagtgaaaacctcttgcagcctaaaggggactagaaattcataaaagtaaacacaacacgtgaatctgaatgcttagatcactttgctataaggacactactaggacaactggagaaacttactgttgtctacagattagagaattttattagtgttaatttcctgatgttgatagttatatgattatataaaataatgtcctttttttgctggaaacagaaaatttgggattgagggacaatgggacatgatatcagcaatttattctcaagtggtttaggaaaataaaagattttgtgctgtacttctacattttttcttagtttatgattatttttaaaatattacaagaaatgcctcttgaattcagtgtaagaaagtgtgaacaaattacttaaaataaatttcagaagttattcctatcattttatctaatgattaattaatgcatctacaagtgttgtcttcatacaaattttattaagttatcctcttgtataaacctagaaagagcaaattggaaatgttcctcttgaatatttttagaactggcaagaatatttcttcaggtgatagagaatcagaactatctgaaattctctggaagcacatttttaaaaatgtttacatcacattttgattggccatattttaaataagaattctcattagtattcttattttctgatcataattgatcccactcttgattagttaatataattcttttaaacatcaactatttttctgtgctgtgataacaagtgatag

SEQ ID NO: 31131 - DNA, 1030 bp, Homo sapiens
ttgggtctctgttgccaacatgttggacattcaggagggaaaatagctagacaagccttggtgagctgggctccatgctgttgggcctatccataacttcctttcttgccactctgacttactgaacatatttttttgagctatgtctgtacacttatcatcccagaggcaggcacttttcagttgaccaaaccattccgtctgttttgttatttattgcctcttccaaggaggttaattttgatgagcactagcatgtaatacaaaaatataaggatcttcacataggctcattcacattcctttttcctagaattacttgtctttgatacttcagtatttctctttttcagacttctgaccaaccaactgagctgtttgcctctttcagtgaatttgtaaatattctgaccttggcacattcatttttcaataaaagtagataatcactaaatgcactgtcctaattctgtactttaggaagatttacgccactgctgtctggctagcctgatgaggactgatgtgtagttacagtttatgaaaatactctacatgtctacatgatggttcacctattgggaattgctacaatctctaaattggttcttttcccattacagatatttttagtatcatagggcactccagattgtgtggtccaattgataaagccactggtagcatcacctacaagtcttttcctgctccgagccccattaaaggctggcagccttcatttcaactggtaaatggatcagaggtgcttccaggtgtagattatgttgcctccagaatgtgaagatttctatcagatgttgtggggtttttttttggtgggagttgaaagatgttataatttattcttactttgtaagaaacatcacagaatatcccagagcacaggaaacaaaaactttattaatgaggcagagttctgcaactttgtacagtccatctccaatcttctggacgatgtgtgtcttactaaggccaccaattcagttgctatttcctgctcattagtcta

SEQ ID NO: 31132 - DNA, 1026 bp, Homo sapiens
ggaaaataaataatattatcttattatgtgacaaataagattaaatactcattccagattaaaaaacaaaaacaacaaacatcaatctcctgggaatagaaagaaatctttttcatctggtgtagagtataaatctacaaaaagttagaaagaggacaaagatgcctgctattaattgctaatatttgaaattatgtaacaatttgtaattaatgtaaaaagttaattgttgttattgaaaagagagaaaaaactgtcactacttacagtgattatgatcattagactagaaaattcaagagaatcaactgaagcacttagattaaaaatgcaataagtttactgagtcaatttacaacaatcattcattttcttatacaccagtgacaacaactgaaagctataagaaaataaaatgcagctaagaacagcaaaataacaataataaaaattctaaaataccaagaaacaaatcttttaaaatatatttaagaatacgattttccaaatgaaactttactgagttatataaaaggaaatcttaattaataagtaatatatacataagtagaaaaattaaaataatattgcagaattttgaaaggatatggaaagctagaaaaaagtctctctcatcctaagaacaagaaaaagccagaaaatctacaaaatcataatttttctcaaaaccatgagttcaagaatgagactcaaatgagattcaggacagctagcaagccagaaatctaaggaaagaaaggcatctccaggaaacatgaagatgtcaccactgtctcacttgtagaacaaggaaaacaggtccaccataaaaaataggtaagatgttttcagctaagctttcaaaaaattcccacgcattaagtatgagtttgcatgcatttggaggctcttcttagattatttcacagggttttcaagaggaacagtacttctagggtaggagactagagaaagcttactttagcgggggcaggtttgtataaaggtagtggctgctgctgtgag

SEQ ID NO: 31133 - DNA, 1084 bp, Homo sapiens
tagtgattcttaatatttctgtggtatcagttgtaatgtttccattttaatctttgattttatttgagtcttctcattttttcttaatctggctaaatgtctgatgattttgttaaacccaactttttgttatatcttttttgtattattgtagtctttattttatttatttctgctctgaacattatttctttacttttactatttctattttactattttatattgcttatttccttaggttcaacattaggctgtttatttgagctctttctacttcttttttttaaatttagccatttattgccataaacttttcccttagaactgcttatgctgtatcccataggttttggtatgttgtatttccatttttacttgtcttgagatatttaaaatatttaaaacttttcttctctttttttttaatggcctatttgttgtttcaaagcatgttgcttaatttatatgtatttttacagtttacaaagtttcttttattattgatttctaattttaggccattgtcagaaaacgtacttgatataattttgattttaaaaatttgttacaacttgttttgtagcctcacatatggtctgtcctgaagaatgttccctgtgctgttgaaaaaaaaagtgtattcttcagatgttgaaaagacttttctgtaggtaactgttaggaccatttgatccagagtgcagtttaactccaatgtttctttgttgattttctatttggatgatctgtatgttgctgaaagtgggatgttaaaatcacttacgattataatatcgcagtctatctctccctttaggtctatttctatttgctttatatgtttaggtgctccagtgttgagtacatatataattgttataccttcttgctgtattacctccttaattattatattatggccttctttgactcttctaacagtttttagacgtcctcacttggtctaattttgtttttacaggtgaagtgagtttcttgtagacagcatatagttgcatcttgcttttcttttttttcattcagccattttatgaattttactggacaatttaatccattt

SEQ ID NO: 31134 - DNA, 1044 bp, Homo sapiens
caaatgggagtgccccttcaagcatgtttctgcacaggcaagataggtctctgactgtagcatgaagggctggagctatgactggccccccttgagaactgctctgggacagaggttaatgaacccatcccctctctcaaatgggtacacatctctcagtatgtccctgcacaggtggggcaggtctctgactgcagtaagactggccagagctgagattggatcccctaaggatatgctgtggaatggagatatgtgagcctgtcacagaggttcagaccctcaggcattgagatatggtcaagtttacctatgggtcctttggcaagcagttctaagctaggacctcaactgagaggtctggagccatgctacaggaaaactttcaggcctctgctgagacaaatgtcagtaggcacctgaaattctccactgaggcactagtgtttgtgattactgctggacctcttggcagatggttttgattataggcttgaggacaaatggggttgtagccaagctattttagaaatgggactgtttctgggtttgagcctggaagaatgatcagtgggtctgctagttggatgctgctcttgcattccaaatgtccttcataggtcttgggtgtcactggaatttcacaacttcctacctgaatcctgaaactcccacagagagacttttgtctgtggatgggtacagaattcttgttgtggggaaataaccaggttgcctcccatttcaacttgctggcatcattccagctttattctttatgctcacgatttttctgctacttgggatcttttgtgagcttttatggttttatacaaattaaaaaatgttttttctatttctgtgaaaaatgctatgggaattttggtggagattactttgactctatatattgctttgggtagtatggatttcttaataatattctgatatctttccatttgtgtcatcttcagtttctttcatcagtgttttatagttttcagtgtgtagacattttacctccttgattaaattttctttagt

SEQ ID NO: 31135 - DNA, 1060 bp, Homo sapiens
gttattccatttgatctaatgagtaatagaaacaagcaaatcaaagtggaaatgagaatttcaagttggtgtaattagtgttatgaaagatgtttcacagactaatgtgggaacatatttttttttgaaattgcagtccataaaagcttcttgtgcccaggcatggtggctcatgcctgaaatcccaagactttggaaggccaaggcaagataatcacttgagcacaggagttcaagaccagcctgggtaacatagtgagaccctgttccttaaaaaaaaaaaaaaaaaaatagctgactgtggtggcacatgcttgtagtcacagctacttgggtgactgaggtgggaggatcacttgatccagggaagtcaagcttgcagtgagccataatcatgccactgcactacacccaaggtaacagagcagagtgtgactctctgactttaaaaaaaaaagaaaagcttcttgaggaagtgacaggctgatatgtaacccatctcttgaagggtagatacaaggtgaacaggtgaagaagaagaaggaaaatgtttcccaggcagatggaagagtatatgaaaagttcaaaatttgaacgaaagtatattttcagtagatatttaggatagttgaatcacaaggagtgaaggtgatagagaggaggatagaaaggtaagtgtgagatgaggctaaaattttattttataatcagaacaatgggaagccattgatcagttttgagaaattaatatgatcagagttccagtttaagaagtaccttaaggttacagagaaggaaagactaaaagcactgctagaatgtctgtatattacattacaatattttagagtaatcaatgtaatattatatatataccagttagtttaggcttcagatctgggcctgggtatctaacatacatcatgattgcacagccaaagaaggtggtcaactagcctcaaatcaaacacagccacatcccaggggctaccactgaaagcctttctctagtcctatctccaacaacaaccaattctttgataaatagcatactgaatgt

SEQ ID NO: 31136 - DNA, 1028 bp, Homo sapiens
tgtagctttgtggtaaggttttgaaattgggaaatgtgagttctccagctttgttcttctttttaaaaattgtttggcctgtttagggccccttgcaattccatatgaatttgagaatcagcttttccatttctgcataaaaggccatagaaattttgataggtaatatattgaatctgtagattgctttgggtagtattgccatcttaataatgttaagtctttgagtacctggatgtgtgtttgatatccttcagcattgtttttgtgttttatagttttcggtgtacaagtctctcacctcctttgttatatttattcctgggtattgtattcatttggatactattatacatggaagtttttcttaatttaatttttggatagttcattgctggtatgtagaaacacaatggattttgtgtgtaacatttattgcctttaacagtcatttactttcttttttccatgtgcaagctgaatcacgtgggtaaataagaaagtggaaagtggaacactaaagaacttgatctgtaagatgtctgatttccctgaatgtgaaaactatgaaatatgtttttagcatagtgttgaactattatcttactatacttgggctattccatttctggtatcacgttacatatatttggtcattattaaagaaggtagatcatttcattttctttaggtttggagagaagtgtcaatacgtaattcattttcaaagttacaattattttgcaacttaattttgatgttacacagaaagcctcagggataaaccatatttatcgcagagtctggtacagagatccatgaataataaagataaaattagaacagaagctaatttgaatatgtaaattaccattaatatacattagtttttctgttttttcttgaagtttccaaatagccttaaaatttcattatgaatagaaatgtgaacaatttcaacctcataagtaattaaagaaatgcaaatttatgcaatacttggatgatttgggaagggcagtatttca

SEQ ID NO: 31137 - DNA, 1026 bp, Homo sapiens
attcatttattaaatgaagcaggaatatagcatttcatttgatttagaaaataattgtttcatcatggcaaattatcacttagagaagaggggagataaagacacacacacacagaggaagtcaaaggaggctcaggtttttgatttcataaatcaacacactcccttcattttctcattgcattactgggcatcttttttgttcacttagtagtttttactagattttcttagtggctttctcagttcaatatagctaattttttattcttctgctcatgaaaaaatatttttctcattagaagagtgatacatgctcaccattaaaattaagatgatatagatatgaaaaagaatatggctcatggagtagaactggtataattaaaatgaccatactgcctaaagcagtctacagattcaatgaaatttctttcaaaatgtcaatgtcatttttcacagaaatagaaaaaactatcttaaaatttatatggaaccagaaaagacctcaaataaccaaagaaatcctgaacaaaaagaacaaagctggagacatcacactacctgacatcaaaatatattacaaggcaaccaggtgtggtggctcacacctgtaatcccagcacttggggagcccgaggcaggtggagcatttgaggtcaggagttcaagaccagcctgaccaacatggtgaaaccccatctctactaaaaatacaaaattagccgggcatggtggtgggcacctgtagtcccagctactcaggaggctgaggagaatcattgaacggagatgcaggttgcagtgagctgagatcatgccactgcaccccagcctgggcaacagagagagactccatctaaaaaaaaaaaaaaatatatatatatatatatatatatatatataacgtgtatatataatgtatttatacataatgtatacacacatatatacatattatgcacacacatacatataacaaggctgtaagaaccaaaacagtatggtactgatataaaaacaggc

SEQ ID NO: 31138 - DNA, 1055 bp, Homo sapiens
ttctcacttctgactgtccaacaataaacactagtagcaatggcaataaacataactcttagtatgtgccaggtaatgtttaagcactgttttaagtgtttttcatatattaaattatttaatcctcagattaaacaataataaatgtgtatattgtaatactagtaatgtagacattaaatcacttgcatgtctaataaaagtaggatttgagcccaggtcgtctagttcccagagtctgtacttttaactaatctgccattctgcctttcagtaacactcttctttaagtcaagtcactatgttttttgttttgttttgttttaaatgtgtcttttaagataccatttgccctgttgtagctctcttcttcccatatgaaaaaatatccccaccttttcccactgttaaccagaatttcctgtttttattgaggtgtaattcaagtcttataaaatctgtcataggtatttcatcccacagcctttttccctctaagtttctatcagctcttcacacaatattttaacacatttcttcttggcttgtgttgttttgtttataggttttattttgcccacaagattttaagattaatgttatctgcatcttgatgctttctcagttcaattcctctttctagacatttgtaaaatgttacataaggttaatgatcctgagcctcatcctgatccattgggcaaccccatgcttctctatctaacctgacaaagcagtgtttaaatctcagctctgcctaagtgtgaccttagggtagttacacttacctatctttcctcatttctaaactatagaaaagaatatctacattgtggagttgtattgaatattagagataacatgtataaagcactagcacacagagatttctttttaaaaggtctctattcatgatcatctcaaaagcataatcatctctattataaggcatgttttattagtgtcagtattataaatttgttcaggctagaaataagatgaattattgtgttgttcccagggttccttttagaacctgtcttattgaagacttt

SEQ ID NO: 31139 - DNA, 1044 bp, Homo sapiens
cacattattttcatctataatagtgtgaataattttgataattatttgacctgacaaatttgtgaaaaccttatgagagaaggtatatgagaaaacccatgcaatggcagagtgagaggagcctagatgaggagtcagaagcctccagtttgagtccagactgtgcaaatatctaactgtataaccaggtcaagttgttaatatctctgggtcattttttttttcctttttttctttgatttctttcttcaacaaatgcattttgacagcctaccctgcactgttttaggcactgtgactataggaagtaatgatgcagtcagaggctctgccttcatatctttcattgaggtagtagagtgcagtacttaagagagtactttccgggtactgcttgttagggtttgaatcccagctttaccacctagtagctgtatgaccttgggtatattacctaatatctatatgcttcagtttttctgatctgtgaaattaggataataatagtacctaagttatttagttgcgatgaagattgaatgaattaaggcctgttaagtgtctagaggacttcctggttcttagcaatcatttaatgattgttcagatattattattgtgattattatcattttattgcattctagagtaggagagaagaaatgaacacataatcaaatagatgtgctataatgtcaagtagtgataaatgctatgaagaaaaatatcagcataaggggatatagaatgacagagatgaaaggaaggcagctattttagatagggtggtcagagaaagcttctgtgaggcattgcaatttgagcaccgatctaaagttagaggctgagtcatgcagatttctgaaggagggtattccaaggagacggaacaacaagtacaacaattcaaagataaagcatgcttggtgtttccaaagtgtggcataaagccacaatggctagagtagtgaacaagggagggagtggggggataaggttagagaaggagccaggggtcaaatatgatgggccttgtcagccatg

SEQ ID NO: 31140 - DNA, 1048 bp, Homo sapiens
aggtactaaagaaaattgacattccatctgtctttattggtgaatcatcagctaattctctgaaagatgaattcacatatgaaaaagggtaagtaatggatataaaaaatcatgttgcttaaaattcttctttatattaaggtagaattatataatattgtaatcaagattatgtttcagaatgaactctgtagtgctaaattatccctttttaaatcattatgcttttaagacgtagtattttaaagtattttactactttttctttgtatgattatgttgaaaatatattcatgctagtgagagtaagtcacccttgttgctaaaaagataacttttcattttgaagtttaatcaaactactggtattttaaaacaatgcaatttatgtttatatgacattttctattaagaaatgtttgtatattactaaaaagatattttatatattataaacacagaatccaaaacattgtgttaagggactaacatttacaaaggcaaaaagtcagttttcaagttttagaagcttgatttgaatgagaacttttatatgaaactcttctcccctacccccacaaaataatctcattacaaagataacatacagactgaaattaacttaaggcacagctgtctcagctaatatagaaaacagagaaaacggtacaataaacacttcagaacttcttccatgacacacagatccccaaaacgtagttgaccagaacagactttggtctaagaggaacaacaacaaaaataataataaaagcagctaatatttattgagcatttagcaaagctgggcactcatgaaagcaagacttctacattttgttatccatttaatcctcacaacaaccctctagtggttgttattattatcacttattatctacatttgccagaagaggtaactggcacaatgaaatccaattctaattatttagggggaaaagaaatccacgaatatttctgtttgaaaatgcataaaaagaagagggcaaggttttctgtttactgttattgttagttccccactaca

SEQ ID NO: 31141 - DNA, 1033 bp, Homo sapiens
gagggattgctggggtgtggcctttgggagggtatttaatcttcatggacatattttctcttgaaaatgaagagttagaacaaagaatattgaggttcctttaagatttctatattctctctgatggttagggattctattttttcacatttaatccctagcaccaggcccattgactgtatcacagtagacatttagtaaattctaatgaaattaaactgcttttatgttacctcagaattcctcaagaagacagagcagtgcactggcagtaaatggggacacagagcctgtttattaagtgatgtaagatgtttaatgaggcagctgtgagctttgtctgaaaggagcaagttcaaggaagtagtcagatgaaatagtggggatatccagcagttgggctgaatacaggttattgcctggaaagctgatctataggacagaaggctctgctgtgtggctgtaaatccactgaggcttagtagtttgattggtgggggttggatgtcagaaaagaacagacaagacttcatgtgtcaacagaaggatggggaaattagacaggttattattatcaagcttaagcctaggcagctggtttgaaattagcctgggaagtcacacaaaggaaaataagaccctattttctgggttgcttaggactctgcttcagtgatcaaatcttagctgcagagctcataagatgtgctgtatttaggcatggacatagaggcagtgtggtaggataattacctgtttaaataccttcttcctcaaatacagattaatctgggactagggcaaggatgaatctgcaagttcagctgtgggagacctgggctgacagaagaaatagaaatggagccagaggactgaaattccattgtagttctgttgtagttccctgtatcatcactatcaccacatccactgttagcaatttggttaagaaaaaaacagtatcttgagtgtacattgagcttttgattcaagatgctcaaaacctttttttttttttttgagacaaagcctc

SEQ ID NO: 31142 - DNA, 1056 bp, Homo sapiens
gcattttacatttacattattattatacagtgatttacattatcattatacagtgtggattagttaatagtttttttttgttttgtttttaagagatggggtctcactgtgttgctcaggctgaacttgaactcctgagctcaagtgatcatcccacctcagcttctcatgtagctaagactataggcatgtgccactgggcccagcctggattaaagatttccacatagaccagaactagtttgaagattaggaattacttttttaggcttcattttgtgtgtttaaaaatatgtttaaaatggccaggcacggtggctcacacctgtaatcccagcacttagggaggccaaggcagacagatcactaggtcaggagatcgagaccatcctggccaacatggtgaaaccccgtctctactaaaatacaaaaaaattagccgggtgtggtggtgcgtgcctgtagtaccagctactcaggaggctgaggcaggggaatcacttgaacccgggaggcagaggttgcagtgagccgagatcacacgactgcaatccagcctggtggcagagcaagactccatctcaaaaaaaaaaaaaaaaaaagaaaagtttaaaaaatggtgatactgtcctgggtttaaagggaaaacatgtcattggcttttcctctgagtaagatgggtagctgtagtaggatttggaacagaggagagagagaatgtctcagttaactgttaaaaggatccttctgctgacattaagaataggttattagatggcaaagggtataaacagagagaacagacaggaaagttattgtagtaattcaggtgtgatataaatgtggcttggggtgatatcagtggaggagaagaaatctttaaatactggctgtatctggagatggaatacacagaatttactgatggactagatattggaagaggagacaaggatgactccagattttttggtctgaacaacaaaatggatggtctatttaaggacagtccttaaatagcaataaggatggttaatgtatgagagagcaggtttt

SEQ ID NO: 31143 - DNA, 1045 bp, Homo sapiens
gagtatgtagaatacatatttctagaatcatccagttcaagagatagaacattactgccaccccaggagctgttatgttcccttctagataaataatcctttcttgtcctctggaggtaatcactatcctggtttatgataatttcactgcctttctcaagttgtaccacatacgaatgcatacctaaacagttggcttaattttgcctatttttgaattgtatttttcttacctctgattaattttttaatgaaatttatacacttagttgcatttaggtatagttcatttactttcattctgtcttttaaagattttacttacccactttactgttaattgacattctttttttttcagtttagggctattataaatcatacttttgagaatatacttgtacatatatcctggtgcatatgtccatgaatttctttagcatatatacctagaagtagattaatttgatcatagtatatagctattttcaattttattgggtaatgcaaaatcatttccaaagtgattgatggtaccaatttctactctcaccaacagtctataggagttcctgttgttctatgtatttatccaatactttgtactgatggacttttaaattttagcattctggtgggtttataactcgttgttttactttttatttcccttcttgcaatgaggttaaatatctgttcacattatttgccagttggattttcactttcacgaagtacctttcatgatatatgcccgtgtgtctgtttcatatatgggaggaattctttatatgttcctacaagcctccagagggaggcgtagagtatggcaatttagttcttcaataattcttgtgttttaactgtctttttctagtttatggaccagaattcttgcctttcatggtagtattcttctatttttgttttgttttgtcttgatttgtttttttgaggcggagtctcgctctgtcccctaggctggagtggagtggtgtgatctcagctcactgcaagctccgcctcccgagttcacactattctc

SEQ ID NO: 31144 - DNA, 1051 bp, Homo sapiens
acccgtggaatgtgcctcctactgctgctgatccactgtccctctgatttggcatctcctttggctgagatgaagagcagccccaagtttcctttgctggagttgctagccctacttccacgtttgtccatagctgtcttcagattttctcccaacaggcactagcaatgcttcctgtgggttgaggcaggaacagctttcctgcatagtaaccctagacggtagggaaactggctgtctaccttagtctcagtttctccaggataggaaccgtaagtcttgggagacttttttatccagtgcctaataacttaagggaggggcatcatggatagagaagtcgaggggcatcatggatagaaaagtccattctctcttaatttttcacttttttgtgacaccaaggattgtcacagcctcagttttgagttctggaatattgatggtgataatgttgtcactgtatagttgtttttcattttctgtacgggaaaatcaactcagattgcttctactctgccattttggtaacatcactgcattttacaaattttgatatgttgtatttttattttcacttagctcaaaatattttaaaatttctcttgagatttcttctttgacctgcttgttactcagaagtgtgttttttaatcttcacatgtttgggaatttgccagctatctgtatttatatattattatatatttctagtttaactccattgtgctctgcatggtaatattgtaagacttatttttaaaaaataaagtatactttatgtcccagaatgtggtctctccgtggatgaatgttccatgtgagctggaaaggaatgtatattctatttcttgttggatgatgaagtagtgtgtatatcaattaaatccagttgactggtgctgctgttgagttcaactgtgtccttactgattttctgcctgctggatctgtacatttcagatagaggggtgttgatgtctccaactataatagcagattcatctgtttctccttgcagttctatcaatttttgccttatatattttgg

SEQ ID NO: 31145 - DNA, 1075 bp, Homo sapiens
agacccagaaaagcaaaaacaaccattacagttcagctctcaggaagccacattcctaggggaagggggagaacaccacatcaagggagcaccccatgggacaaaagaatctgaagagcagcccttgaatcccaggtcttccctctgacatagtctacccaaatgagaaggaaccagaaacacacttctggtagtatgacaaaacacagttctttaacacgcccaaaagatcataccagctcaccagcaatggatccaaaccaagacagaatctctgaactgccaaaaaaagaattcagaattaagctaatacaggaggcaccagagaaagataaaatccaacttaaagaaatgaaaaacatgatacaggatatgaaaggaaaattcttcagtgaaacagatagcataaataaaaaacaatcgcaacttatgcaaatcaaggacacatttagagaaatgcaaagtgcactggaaagtctccgcaatacaatcgaacaagcagaagaaacaactccagagcttggagacaaggcttttgaattaacacaatccatcaaagacaaagagaaaggaattttttaaaataaacaaagcctccaagaagtttgggactatgttaaaccttccaaataattggtgagtaattggtgttccagaggaagaagagaaatctaaaagtctggaaaacatatttgcgctaataatcgatgaaaatttccctggctttgctagagatctagacatccaaatacaagaagctcaaagaacacctgggaaattcatcacaaaaagaacaccctctaggcacataatcatcaggttacctaaagtcaagacaaaggaaagaatcttaagagttgtgaggcaaaagcatcaggtaacctgcaaaggaaaacttaacagattagcagcagatttctcagcagaaaccctatgagctagaagggattggggacctattttttagcctccttaaacaaaacaattatcagccaagaattttgtatccagcaaaactgagcttcataaatgaaggaaagatacagtcttttccaaacaaacaaatgccgagaga

SEQ ID NO: 31146 - DNA, 1021 bp, Homo sapiens
tcactctgacccttggttcctccccaggcaaaatgaggggcagaactgagtaaattcctcccaacactaacatctatgattctattttcccctcccagtgaccacttcctctgaaagtacagctgactcacgaccccaggcagcttaagatgtgctccaagccctttctcatcagtaaagcctgactaatatcagcctgaatttaaggctgtttagcaattgtcctgcctgcagttgggggtgaaggaggtgagctccccatctgtgcaggctggaggctctgcatttacccactgtgatcattgccatggtctattgctgcttcgtctttaaacactgtttactctgcctttcctctctcccagcattcttctgaattgggctggatgatttctccttttccttttcagaagtttagtttacctttagctttagcttggagctttggtgatgaaagaaaagagatcgtatttcctctagtcagagctgtattttcagggcacagctgcctggacccactagaaatataacaagagtacatatgaggtcatggtcaaatcccatccggctccctcctaataggagaagaacgcaatgagagtttagtctccggaaagtcaagcttagccaggcttgtgggctggatgctgggtgctggtgtcatagtagatcagttgaagggacggtgtttttccaggttctggatggagctccaatcttttctctatttctaaattctcatgactgcctaagggctaggagaggccttaatctttgattcatggaatgttggaaccagaaggtctccaagtgctgtcgtgttgtgacactgaagcactgtttattgattccctggaaagccctaacaaatatgactggtgcagaatgcactttggaaggccatctagtcgaattaggagtcttgtaattccatgttcatgtcacctgtgcgtgtgaccagtgtacatatatgcacagatttgcgcatgaagcaggtgactggggaacgaatgacctattt

SEQ ID NO: 31147 - DNA, 1026 bp, Homo sapiens
aagagtagataggaaataccatatccatttaacttcagatacttcagcttatgtttcctaagaagattattctcttaccaacaatataattaccaaattcagggtatcttatattaatgtgctattatcaaatatgaatatacagtgcatattcagattttgtcagttattacaataatgtccttcataaccattttttaacctgttcgaagagccagtataggttcaccaattatacttaattaaacagttgtctttttcccttcctgtcttgtttgaatatgtaagtacttgtgttagtcacctaaaggattatttaaaatttaaatatttaataaaaaatgcagtattaatgtttttggataaaatactaggaaaaaaatgtacttgcttagctagtttgtactattgggagtattcgaaaggcaagggagtactgcctaaaatccagctgaaacgactactagagttggtgaagttttataaggggaggtcttttattgctcagagttgggtggtgggtggcaagagtaggagaacatttggatattaatgtgtcccttagaaattgaagtatattcatgtacttccctttctgtactgtgatttttatatgtatgtattaaattgggcttttaattattttgagttggaaaaaatagtgtaatttgaagacattttacatcaccacttgggtttgcaaattatgtattgctatcctgtatatactgttgtatcctcttagttttattctggtagttgtgttaggtggcttgtctgctgcgagatttttaaccacaaatctaaatctcattattcgaagtggtgtttcactggaccctaaacatctcttctcttagcttttctatggctagctgaagtgggacactaaacattctgacatctgttttcgacacattaccaggtttcagaattggcaaagagaaattatttcttaactgctcacccaccattatatatgctttccacccatatgtttaccaccttcctctttagtaaatttaa

SEQ ID NO: 31148 - DNA, 1033 bp, Homo sapiens
atgttccatttcttttatgttagctattattaagctcagagtcaaaaaataggagggttttttgttttttttttttttgggacagagtcttgctctgtcacccaggctggaatgcagtggcacaatgttggctcactgcaacctctgccttctaggtttaagtgattctcttgcctcccgagtagctgggattacaggcaccaccaccacgccctgctaatttttgtatttttcataaagacagggtttcagcacgctggccaggctggtctcaaactcctggcttcaagtgatccaccctgccctgacctctcaaagttctgggattacacatgtgagccactgtgtccaacccaaatattcagctttctgttaacaaagcatgcagttccttattatacatatatttgagtattatgtaactggcttccacttcctttgattttccgtttttagagggagctctacctttaatttcaatatctttttcctttgccttctttctaagctgtttctactcctttgaaaggatcaagtgtataaatcatttgagagtaaacatgttaaaaataccaatagcctgtcttcttagagctgtttttcaaaggtgtattaatgaaattctttaagctgtgtatttggtgtttcttctaccaataggtgcatttgctataatgcataacataccaaacactttatatatgtgtatatacatgtacttatgcttatatatgtatgtgtatatatgtacatatgcttatatatgtatacatatatatatttagtttctggcatagctaattgtgtcttaaattatatcttggctcaaccacagatatatgaagtttcttgtcattgtgtgttatgtgtctttttatatgtgtctttttatttatttatttattttgagatggagtcttgctctgtcacccaagctggagtgcaatagcacgatctcggctcactgcaacctctgcctcccgggttcaagcaattctcctacctcagcctcccgagtagctgggattacggg

SEQ ID NO: 31149 - DNA, 1079 bp, Homo sapiens
cttctaaggactgaatgttgtccacaagagtgtcatcaggtcataaattggtaagacttaatggcttagattttatgtattatacctgatgttattgtattgagatgaatatttatgaacaaaatgagcacattgtgtaagagtatagtattaaatataagttaaaacttggaattttaaatacttggagtatgtaagcctttcgaagtctcttgaggctgaaggccgtatctttgcagtggtgtttagtaaatacatcagtttaaaaaaagaaagtgaaatcctgtattatagtaagattattaaaatattgctattgcatctgctgtagatgcctacaatatagtgaagaacccaaatactttttaggtgttataccaggagatatttgagaaataatatattcatcttttctttaaaaaaaatccattttcttaataacatacagcttaattttattgctttggagattttatttcttaataaaagacatgtttcctctaaatgtctaaaataaagccaagaaaattttttcaattcttacattgagaatacctaagatgccaatatcatatgaaaatgatatattagaagtcattgcacattttttatattccccgaaaattaattttctctcagtattctgcttagaaaaaaactactttgttttgtgcagtttcttattttgctttgttttacacagctgtattttgtagggggaccattggaaggatagagtttagctcaggataagaccttatatcttttaatctcaagattatagtattttgcagatgaagaaaaggagtctggattatttgtccaaggtgatataattgtagaattcatattttcattaaagtgtggtatgcatatcctgcatgtcagtcaagaattatttgaaattatttattttccaaaaaagccagaaggcatgggttgatatcagctaaacaggccactatatatattccaactttatccttaaccagagatatgttattttatcctttgcccattctgccttttgaataatattctaaattgtttctgatatagtattccatgacttcattaca

SEQ ID NO: 31150 - DNA, 1418 bp, Homo sapiens
taaactgaaacgtagacaactttaattcttcagggcctgtatttagagtgttgcctttatatttgttgaaagtgaaaaatgtaatccttggctgggtacggtggcacacgcctataatcccaacattttgggaggccaaggcaggaggatcacttgagcccaggagtttgaaaccagcatgggcaacagagtgagatctgtctttacaaacaagtcaaaacatttttaaaaagaaagatgtaattctttgctcaaacccaagccactataattttaaaaaacattccaaatggaaaacattcattgatttattaaaaataaagactaggctttccccccacccccaatatgatatattctgttcatttcattaaggaatgatggccatgcttgtgctctccctttagtctaaatcagaatcaagcaactgtctctttaaaaaccccatgatattcttctgagtttagccctattttgaaacggtcccttgacaacctttatttattactgtacttggactttaggagacagattaggaaggagacttggtagcaaagaaaaattagttaataactttggagcaaattctagtcacgaaatcccagtgactagcctaatataattttactttgtcaaatatattgttcatagaattatgctttttctagaaagctattttaactaacatttctgcactttcaagaaataggcataaagaaaagaaataggcaaaatgaaaagatgagcaaaaattatgtgcttttcactggtatttggcttttggtatatacatataccaaaggggatagtctcatttttactttagtcaggcctcactgtagaaatgggattgagaagatatttaaacaaggcgtctaaacaagaatgactttaataaaaagaaataatatgttgaatgcttgagaaagaggaggcaaatgtgaggccattagatgaaaagaataagtagcattcctaagaatagtttcttcccaagcccatctttttccatgactctttacatgttagtgttctccagtgttttggccccacttgtcttttcattgtttatgcaagtttgttttctcctatggtttgagtcgcctactgcattcttacaactttcaaatctagacttctaggccagagattactctggagttctcaatacctatatccagcagccttctctctatatttctccaacaggattctacatttccatgtctccaaattcagtagtcccaagtgaaacttaaatttcttttctcgtctttatttgcagtgctttatttgcaccacctactccccaccccacttcatccccccaccaaatctagccacctttctgtgatacaccagccaactcctagttgctccaagaataaagccccaggcatccttagcattttctttgt

SEQ ID NO: 31151 - DNA, 1073 bp, Homo sapiens
aatctgttttggaaaatagtattacattatagttttaatttgtatttttattttatgattcagatgttgagtattttttcatgtctttcttgttaatgttcagtgtgaattctccccatttttctattgggcatctggtcttaacagattttaggaaaatttattagagactttttaactttaaaaaaaaattagacatgcagttacatagtcctttcccaccaaagtattaaagaaattctaattaaatgtgtttatttaaagttcttagtacagatgataagactgactctagacaaagggggtctaaggtaggagatggacttcatatagattgcatgctctttaatctacgctttactggctagccatttgactgaaattaacaagataaatataaaatatgctgagggcattggtgaacaaggtttttgtagaagatgctgacaataaatatcaatatataaatatttaactgagtttttaatagttccttggtaaaggcattcatcacaccattgcgggactggctacttgagaaaaagtaacacttaagttttgtaagtagaaattttacctgcttgctcaggatgaataatagctttaaaataacttattttgtgttactgctaataataatctctatggggcattttgggtttttttttaatcatgaaattaaacattatttgttttacattggtagaactgatggtcaataattagaataacataacattttgagttcttagtttaatttattattaacttcacccaagttttattcttaaccatagaggtttgcattcagccagaggttgtctatatgaattttatttatttaggcccttttgaaaggaaaattgttatttgttcttaaattaagctgtaaatattttttagtctcctcttacagaagagtggtggatttttaaaattatatttaacctcacaagtttactgaactgtagattgattagatttattcctttgtaatcagtgactcgcattttcttaattttctttctaaaaaaataaaacatgcatttgttagagaataggcaaaatgttac

SEQ ID NO: 31152 - DNA, 1072 bp, Homo sapiens
acgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggtttttttttgttgtttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacagg

SEQ ID NO: 31153 - DNA, 1033 bp, Homo sapiens
aattctagctagactagcagttagtcttctactttttggttactcccttttagaaattggaagctatgaagctatataccctgtccatttgaaaatgcacataagcaaagaactttacaaataggttataaagagaagctcaatctcagcaaaataagggaagtgcacattaaaacacaagaaaccatctcagatccaactaatatttagcgtgcatacaaatcaaaagctggaaagggtgtggaaaaacaggaatacattgctagtgagcatacaaattggcacagcctcttttaaagacaattgtgtatcacccattaaattttaaaagtcacataccctgtgacctaacaattccaacttttaatgtcctaaagaaacatacatgtgttcacaagatagcctgtacaatgatgtcaattgcacctttgcttgtacagtagacccccttatctgcattttcactttttgaggtttcagtcatccaaggtcaaccacaatacaaaaatattaaatggaaaattccagaaacgaacataagttttaaacttcaaacctttctgcatagtataataaaaatctctcactatccctctccatcctgcctgggacaggaatcatccctttgtccagtgtatccacaatgtatacactcattatatacccattttataatgcccattagtcatttctattatcagatcataaaaaaacatagtacatagagggtttggtattattcatggtttcaggcattcagtgagggtcttggaaaatatcctccatgatgggggagctactgtaatactatgaaattggaaaaaccaaaatactcatcaagaggatggactatggtacacatgatgaagtattaagtatcaatgaaaaagagagagtcctacatgtccggcatggaaggatctccaggagacaatgttaaaagtttgggggaaaaattgaaagacaatacctgtaatacatatgatactagtgatgttaaatcacatcacacacacacacacacacacacaca

SEQ ID NO: 31154 - DNA, 1216 bp, Homo sapiens
tttgtacatttctaaccattacacctagaactggctaatttttcaggaaaccctgtcgcctttttggtgtgctacttttgaatagctattgatctctgaaattgaacaaagaaaaagtattagctcttgatctcattgaaggaaacattaaaaggtaatagggtttcttgaaaaattggctgagtctagcaaaaaaaaaggtatttaggttctagagattcttatttgctgttgcattgatcattgtttctaggccttttttttctatttaaaagatgtaacaatcataattttatttaaattaaagttttatacgtatagttttatttaaattgaagactacaaggtttttatttaacttctatcttatttgtattgccttctgtcaccaccaagaatcttgttactctggaataccagggatgataatttgagaatatcacattcacataagtattcatttggtttgttccacattatccacaaggtattcttacaatcttaataccaaaaagtaacactgttactgaaaataattttttaaaaagggtttgcagttcttttgtctttagagcatcccattactgattgtacagttttgagtatatcatagttagaataggaattggtaactttgttcacacgtaccaaagatggcatgtaggctgattttgagcagcatccaatcagtatagttatgcattttattttcctgtgtttgaggcgcactgtcacctcactgtttctgggttagcttgctttcttgtcttattctcctctttgtgagcatgtcaaatgaagagggatcaccactttgacagtttggtgtgctgcttttgaaaagccattgatctctgaaattgaacaaagaaagtatattagctcttgatctaattaactagagtggcagttttattaataatagcatggctcagactgcctggaatagagtaagctcttaatatcagccattgttactgtggttgtgatcatcattatcatgcatctgtttatcacattaagttacagaatttccatatccacattctgcagtagcaggccaaggttgatcttttccttctaataggctctaagaccactttatttcagcgattgaagagaggataactgacatttatcaaatacctaccatgtgcctggcactcttctcttaaaaccaattactgagagttgggtggtataatcccattacttg

SEQ ID NO: 31155 - DNA, 1044 bp, Homo sapiens
ccgcgcggtgccctcctcccggcggcgtcccgggccccgaaccccagcggtgcgcagagccctggcccacccgcttctggaacagccgctgacgcaagccccgggggcgcgcgcggacgtgacgcctggacacgtgtgcggccgcccaggcgcgcggggactggcagagccaccctgcgccggggcgctggctccgcccggctccagctggcagcgcagggggccgcctagcgccggcgcttcctgctcgggctgcgggccgggcctgcgccagtgagcatgcctggctcgctgcagccccgcggggttgtcttttctgggttgaggaggggggctactctcggggaagcgtcgccgaagtcctctggccacaccccggggtgcctggctgacgcgtccctcagctcaaacgagaaaggcaacttcaggcggggcgggagcgtggacggtgggtgggaccggacgcgggcgggcaggggcggggcgcgggcgcccctgcactagtcggaaaaaaccgagaggtttctcttctcagggctgagtcaccagcacgcaggagaagagggcgaagcggccacccgcgttctgtgttcggagtcaggacgagaagcattgggtgggagcagggcgaggggctcgagttgggtctgcagcgggcacaggacctagttttgtacagttaacggtggggttgagtaaagaggggggcggtggggaggatgtaagctccctttattcctttcccagcggaccaggaggaagcttcgttgaattgagcgcccctggctcgtatagcaggccgaggagggagctcatgggcagcgttggctaagagttcgagatcatctagaaatgtcagaaacgtaggttgggtcgtgaggtctctgaagacagtgggtgaaactccagtgtaaggcgctgcgtccgcttggtagagagccggccgaagtccgagtctttgttgcgaggcgtagggccaccctgcgcgcccagcagaagcgctagagggcacggttgcccggggtgaaccgcatgtccaaatgt

SEQ ID NO: 31156 - DNA, 1024 bp, Homo sapiens
ggtctaaaaacagaggggctgcagttctctctggccaggccccgttggccagtgtgacaaagatgacccaacttacttgtgtaacatttactttccaatatcagatattatttataatgagattaacctgacacataattacatgtgctgttgtgctgtctagtaactagaaacagatggtaaatggtcctcataagtggctgccatgattattattaacataatcaagcatggtttatagtttttctctttgtgctttgctagtattctatatttgtgaagaattcctttctttcctggcactttgttccatttgattgctatgatgacagtgatggtgatcatcatttagacacacacattttatacacacattcaaagatagaggccctgaatcattctttccaacagggttaatgttcttaccctgactgccttgtactttgtcccgggtttagagcttccctgtgaccacctgcccacccctaacttgaggtagactaatcctctttaaagctccttccctaaatctcttcttgccttatgaattactagaccatcatggaatcagagattccaagatgttctaagaagacatttctatcctagaccaactaacagagtagtagactcttggttctatcatgtttgccatcaatttcttagcatctggcatagtgcctggtatgtagtaggctcaaaataggtatctgttgaagttttaaagttctaatttggctctttcattttacagtgaaaggactagaggcctaggtcagctaaatggcacatgtaaggtcatgtatatagtaaatggcagtgccaggacccaaatgcaagcctttcaacttgtaccagccagcgtcccagcaggaaacagatggcattctcaagtcagataattaatttgaggaacatttaagacagagactatttataaagatgtgggctcggtgtggggacaccacaatggctaatgcagtgtcccagcaacagtgggaagtcattatgacccctagacctg

SEQ ID NO: 31157 - DNA, 1034 bp, Homo sapiens
ctacatattgatgggttttattttatttgatcttgagctgcctacttgatccctaagtaatagtactttgcacggtgtcattgcacaataattaaaaccagagggaaatggctggtttaaaataacatagtaaaatgagtcatccagacaaaaacaggcactctgtatttgtccccagtgttctacaggtaattctgttagaggaaaactttttaaaagcaaaaatgtatttcagtaatgtatcacgctgtgtcatttccactgtgtaccaacagcccatccccacccctcctccttttctctcttttcctgctctccagccagagaacctgatttaactatctgatcattcagcagaacccagcagtctggccagtggtctgactctgctggtcttgtggcactgaggcagcagttttcatttgggctatttatccaggcagccaatcagtgcactgactacttttcattccccatgtgaacagtggctgagtatgggattttggattttctgtggctcattttatagggtacaactgattaacttttaaacccttttattatgggacatcaaacatgtacaaatatagaagtatataataacacccatttactcttcacccagctttaaccattgactcacagtcactcttgtttctaccccttatcctctctgtctccccccacctgtgaaattatatcatttcctagtgttttactttttatcagtatggagtaatcttttcttttacttcatgaagaaataatcttttacttcattttattggtagttaagtacttcaagaagacattttaaatatttgaatattaaaaaaccagctttattgatataattgaaatactatataattcatccatttaaagtctacggtcagtgttttttagcatgttcacagagctgtgaagctattaaccacattttagaacattttcgctacccctgaaaaaccccatgcccatgagcagtcactccccatttgccttcagtagccgcaggcaaccactaacctact

SEQ ID NO: 31158 - DNA, 1017 bp, Homo sapiens
ttgtacttaatttcatatttttgaaaaaaaatttgctgttgaatggcacaagagcataatggcttagatatacactttaaagctgttacagacctgattttaaacctcactctgccacttagtaacggtgaccttgagcctctgtttccccgtgtctggttggggagtaatgatagttcttacttcattgcctcatagggttaaggttatgatgacggaaagcttccaagatagtgttcagcgtagactaagtgtaattagcttaattaaatgtgagctataatgtttaatctatgtttaggaggcaggataacatagtggttctgagcatgtgtgctattaataaaatcaaacttgggttggttactaatctacgcggctcatagtcctctttggtaaaggtgggggataacactacctagatcatggggttattgtgacacataagcaagatggtcatataaagtacttctggttgagtgaagagtgtctgcaagtgtctagggcgagggagatctacaggctgtggatcaaattcggcccacaaggtaaaaataggttttatgtttttaatgcattattaaaacaaaaatgaagaatgtgtgacaaaaactgtaggtagcctgcaaagcttaaaacatttactatcaggcttcttatagaaaaagtttgacaaccccttgtccagggttactgcctgcccaccatttatgaagctactattacatgattatttgattttgtttttgtttttaaatacttctttttttttagcttttacagccttagaaattacatattataagttcatctcatgtttttaattgcatgaaaaattggtttaagtgacgatttttaagtgatgattactgcatttttattaagttccttcaggttcctgttggagtattagcttatgaattattccttaatttctcaacagctgtacttcctccctttcaacttaataatttttagttttgtcttctcaattgcgaagttgagaatggggtaaga

SEQ ID NO: 31159 - DNA, 1090 bp, Homo sapiens
ctgatagcttgagttggactcagatttgacctagtagctttgagacatttgacagttatttaacctttagactttagtttgctcaactgtaaaatgataggattgtcattaaaacatgagaacagggcatactgtataacaaacatatataccagcagtaatcactgttaattttggtccatatttggttcactttcaagagttatgttgtggcaagaggtccattacttgcctagggaaaaaatacgtttcaaatatcttttggaaatataagtatggaaactttcataaacatatatgaacacttaactataaaggttggaggacataaatgaaattgctctatgcataatattctacaggattttttttcttttactgcttaatattgttcatcatttttttcttgtttatttttttctggtcatggtgctccactcttttattacttctaataaagttttccagttaattatctgggtgggtgggggtggggcataatccttttatgcaaactgtagtgacacattgccatatcctttcagatatttattcctgtctcttctcattggttaacactttcaaaatgatgctaagtgatagtgttgaggccagcagcctgaacttattaaatgaggaatgggaatgcttctagtgtgtcacacttggtcaactgcggaattaagtcagttacttatattaattaagtgcatctgtaaactttctccccatctaccttgtttattcctttggtttaatgtaacacagtgtattacttttactctttgatttaaaaacagtcgaacctactctacaccaggcaccgtggaaggtgctgaaaataaaaccgtgaaaatgacagtaagtctagcatgtgttagaggcagaataaaggggattgtgctctaggtgatatcatatgagcatctggaaacagaataaagtctttggtaattcactcctgtggttttattttctgtgtatcaattagattagaagtccagcttgtccctagagaggcagaagtcagggctggaacagagggtggcaatggctggccggagtggtgctgggcagcagggatcctggg

SEQ ID NO: 31160 - DNA, 1026 bp, Homo sapiens
aaatcttgagattgctttggggcgcactttcttgtttgtttttttgtagctgattcacatgtaatatttatcacatacgtttactgcagagaaattaatacgacatttaatcattttgtacaagcagtactataaagtggttaaaacattttgaaaagtgacctgtgggaaagaaaaactacattttgttaaagtggtttttttgacgggcatgtcttgtcttgaaacggtaatccacatgccattagagtcttgtggaaaatagtgaacaaaaggaagtaatggcttttactgttgaagaccacacactaccaaacacacaaaccctcacagtgctgcttacccgaaagaaatcccgtgtcattttgggggagtgatctgttatatttgtaatttgtataatattatctcttgatgttacagatgttttttgtatttattgatgctttttctccagagttgaaagatacagatggcagcgatagggttaaggatagagcgcagaactaatgacacatacttgactaacatcatcaagcagaagtacagctttgtgtgagggtgttttctagaacttctgaactctttagattactctgttagataaagccagtgtatcacgagtttctcatttgtagttgccaaaagaaagaaagagaaaagaaaccaattaaaattgggcttattggctgtgggtatgtttttaggttaggactgatgcaggcactcagctttgtaaccaggactgggtttgtaccatgtcttcagtgtgccttccatggtgtcaatttcaactcatagggtgctttaggctctctttcctatggtagccagatgaaagaagtgcttctagatcttatatcttcatggcacacccatccagataattttttcagaagcctagaacttgctcttattaggtcaaattggatcatgttccatcccaacttgtggccagtggaatcagacatgctgattgcctagagtcagttatggctggccccttatgtgggggatggggtcagc

SEQ ID NO: 31161 - DNA, 1327 bp, Homo sapiens
tgaatgggtctcatgagatctgatggttttaaaaacgagagttgccctgcacaagctctcttctcttgtctgctgccatgtgagacatgcctgtcaccttctgccatgattgtgaggcctcccaccatgtggaactgtaagtccagtaaacctctttcttttgtaaactgtcctgtttctggtacatttttatcagcagtgtgaaaacggactaatacagtaaattggtgccagtagagtggcacattgctgaaaaggtatctgaaaatgtggaagcaactttggaactgggcaacaggcagagattggaacagtttggagggctcagaagaagacaggaaaatgtaggtaagtttggaacttcctagagacttgttgaatgcctttgcccaaaatgctgatagtgatatggacgataaagtccagggtgaggtggtctcagatggaaatgaggaacttgttgggaaatggagcaaaagtgattcttgttatgttttagcaaagagactggaggcattttgcccctaccctagagattcgtggaactttgaacttgagggagatgatttagggtatctagctgaagaaatttctaagcagcaaagcattaaagaggtgacttgggtgctgttaaaagcattcagttttataagggaagcagagcttaaaagttcagaaaatttgcagcctgacaatgcaatagaaaagaaaatcccatcttctgacgagaagttcaagccggctgcagaagtttgcataagcaacaaagagctgaatgttaatcaccaagaaaatggggaaaatgtatccagggcatgtcaaaggtctttactgcaagcccatcacatcgcaggcctggaggcctagaaggaaaaagtggtttcgtgggcccagcccagggtctctgtgctgtgtgcagcctggggaattggtgccctgcatcccagccactctagtgtggctgaaaggggcccttgtagagctcaggtcatggcttcagagggtgcaagcctcaagccttggcagcttccacctggtgtggagcctgcgagtgcacagaagtcaagaattggggtttgggaacctccgcctagatttcagaatatgtgtggaaatgcctggatgtccaggcagaagtttgctgcaggggcagggctctcatggagaacctctgctagggcagtatagaagggaaatgtgggattggagcccccacacagagtgcctactggggcaccatctaatggagctgtgagaggagggccaacatcctccacactccagaatagtagatcccctgacagcttgcaccgctggtctggaaaag

SEQ ID NO: 31162 - DNA, 1092 bp, Homo sapiens
acatagtcatgcagtcttcccgaatggcaaactgggggccaggaaaatggccacccactgttagcctttactctagggactgcatcttggtagtcaggatggacctgtaattttttgcctataatgattggaatagtccagggtttctcagccttggtactgttaactgtttttttcggtttcagttctttgtgggtaggctgtcttgtgtattgttgggtgtttagccgcatccctggcctgtatccactaggtggcagtagaacgccatggtttgtgcaaccagccacgtccccacacatttctaaattttcttgagaaccactggaatgaccccttaatggtaggtatgtttcagatgattttgatacaggaagagaatttagctttcttgttggggtcagaccttaactgtaattgaataactcatcagcagtaagtaatctgtatgctaaggtctaggaatgtgaagtgtgctttatttactgctctgttggaatagtggacagaggacagacagtgcagcataatgattacatgcatgcttgtgggatacagtgggccttggctacatgtatggcgctagaatattgcgataattattaactgcctttgtgtatcagtttttacatgtctaaaatgaggggagaagtagtagctacctcagctacatctagggttcctgttcccataagaatcaaatacctggtgtgaggcaggctgtgactcagtgggaacattgcgcgtacagggagtgactcagctgataacagaataaactatcaggctcctgacagtttcccctcttctttaagttgatttaagttgacgctcttctacactgaaattcagggctgcaggaggcacagtagaccctttgcagagtgctctgagcttcctccagtatgtggcccagcagtgcttgaacaagggacaaattgggagaggttttgcttctgatgatccctctattctagtcacaggaagtggcactcaacaacagagtgtatgtatgaagtccagagtgtttcagttctaatttaccagtccctacacaatgctaatctttcatgagagtggcacaaagctctg

SEQ ID NO: 31163 - DNA, 1849 bp, Homo sapiens
tttgttttggatatggagtctcgctctgttgcccaggctggagtgcagtggtgcgatctcagctcactgcaagcttcgcctgctgggttcacgccattctcccgcctctgcctcccaagtagctgggactacaggtgcccgccaccacgcctggctaatttttgtttttgcatttttagtagagacgggatttcaccgtgttagccaggattgtcttgatctcctgaccttgtgatccgcaagtctcggcctcctaaagtgctgggattacaggcgtgagccaccgcacccggccgggatctgttcttgaatatgcgtgtctgttttagaacattccacttgtgatatttcacctttcccatgaatttcaatagaagtcagtcaagtacagtgtaagaaaatagtcttatgtcttgccctgccccaggggagctgttagatgccatttcattattgcctcaggtataatacctgtatgtaaaaaaattctgataaacactcctttctcgttatactatacactacactttgatgctcattgacatccttggactgtgaaacgtgccaggactagttttgttttactccacgctttttttttttttttgaatgcacttccacttccttctaatgtttctttgaactctatgtgttattgcttttctcttttctattttcaacgtctctttctaagggctacttcccttcaaactttaaacctgctcaaagtccttaataaaaaaaagtaataaaatctgtatgtctgtaagtcatgacaccccaatagctgtaaacttgctcaagccatttttaaataacaaaagtgaaacccccctgccaatgcagaagtagtgacttcccactgtcagtgagctcatcttgtttggaactctcactagccactgaaaggaaacagggctccttaagagaaattactgatttccgatcaggtacaggaaaagtataagttgagttgtgacatcttttgatcagaaagcaaggaagtgctcagaccgattaggaaatgctaaaaaaggacacagaagccgacttgagggcactcctagatctgggacagtttgggcattaatgagaatgatagcaacaggtgaaaatacattgaaaaccaaaacaaattcaggagtttatggtgatattaaaagtacagattacaaaaaggtaggatgcaaatgagaaagctcttgtttacaggagaatgctggctagtaaaggtagaagaagggtagaatttaggacatcaccattttgcaacctcagtgtgataactgattcaggcaataagcttcaattgtggccaaaagccactgggtgaatgggtgtgggagaatagtatctttcagtctgaaaacatactcccccatcatttagagtaataaaaagtatacctctgaagcagagagatctggtggtcactgaatgatccaacttaccaaaagtgagataatctggcatcgtatgcctcctgatatgatttagttagatgtacacaacatacttttgtaataaactgtatcaaaaatcttcaatgagcaatcagacaaatttagaatatgaaacatttgataaagcaaccagccttggactctttaaaaaaatcaatgccacgagaaacaaacatgatgggctggaaggggacagtcgtagattaaaacaggccaaagagaaataacaccgttaatgagtggtgattgttggctggagggaatagccatacaaattgttttgagacagttgtataactctgaatacagattctagattaggtaatattactgagtaataatcttcccagaaatattgatggtgtggttaagcgagagagtattta

SEQ ID NO: 31164 - DNA, 1045 bp, Homo sapiens
gaaacccatctcacgtgcagagacacacataggctcaaaataaaaggatggaggaagatctaccaagcaaatggaaaacaaaaaaaggcaggggttgcaatactagtctctgataaaacagactttaaaccaacaaagatcaaaagagacaaagaaggccattacataatggtaaagggatcaattcaacaagaagagctaactctcccaaatatatatgcacccaatacaggagcaccaagattcataaagcaagtcctgagtgacctacaaagagacttagactcccacacattaataatgggagactttaacatcccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggatgtaaagatctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataacgaaatgaaggcagaaataaagatgttctttgaaaccagtgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcggagcagaactcaaggaaatagagtcacaaaaaacccttcaaaaaattaatgaatccaggagctggtttttttgaaaggatcaacaaaattgatagaccgctagcaagactaataaagaaaaaaagagagaagaatctaata

SEQ ID NO: 31165 - DNA, 1049 bp, Homo sapiens
tccctaatttcatctagtgaccaggggaaaccttgctgtcttggtctaatgagggcaggcttccctctgggttctgcctgcccatttgcccattttcccatttataattagttgagatatgtaaacatgctatataaatgttagctgttattatttcaatattataatttgaaccaaaccttatttaatctagttcttagctatacgtgtatgtgtaagcttaaaagtacttttgtgaacagctgcatttagagagaaatgtgaagtccaagtgcatgtttatgcatatgataaaactttcgcagcatagatgcttcttagcattacaactcaacaggcagaggagattcgtgttgacaaatgtgcttgttattaataactttgtgttacatttcaccggagagacctctagcttaccagttttaggccttttgcttttggcaggttgcaattattgctgtcttataaatgtcacatacatgatatatatacacacttccaaaactgtgtttttcattcttgtcggaatagttgagacttgtctgctaccaaaagtctgagtcagattctgatactttgccttgctgctcttttttttgtagttttcccagaaactttatattatacttaacaatataaatatagtattatactcataataagcgaggcctttgcttgtattcatttaaaaatgtagagaagcgcttaaaagataggaactttcgagtcacaaataggcaggctgaagattgacttatggaattgatgaagctgttgggagaccaatttcatgtaagaaggagcaatctgaggatagaactatcagccatataacaggggatgtgagagggatacagtgacttccatttgtttgtaaaaatgctgttttgggatttatactaatgggtacccttcatgtgtgacatgcagtgtgacttaaatatctaccttagcttttgccatagttcaaaagttgggggagggagtttctagataatgagcatccagtagagtagacggaaagtccacggcagttaaattgctcagca

SEQ ID NO: 31166 - DNA, 1046 bp, Homo sapiens
ggcaggcggtttgggtataaatgcccaccaactttggttctgccatggctggggaggagggtctgtgctgctatgggccttttcagacatctctaactgaacacacgcgatttttcctgcagcttcccttctatagtggagcttagaaagtcttgtcaaaactggcccctgagatgaaacctttggccatcttaagctagtgttttatccaggacaaatgaagaaaaaatacagcgaacttgtttactccagcatagagacaaagtcaggattagattaattgtgattctttgcagttaatgctacataacgtggcatatggagttaaatttggatatacaagccagcagcactgccttgtataaaccaggagacctcaggctggtaatgtaatctctctcaatctgtttccccatctgcaaaaagagtctagtactacctgcactattaaagttgttggaaagtttaaatcacgtaaggtgtattttcttactataatgcctagctctaaggtcagtaaatggtagggtctctttttactatgacaggctaattgttcctttacaatgctttcaaaactgcatggttcaacatatgctagatagaaatacagtgctatgctttgtgtttttaatgaatattaattgttatggaaagagccaaatttgagtaggtctttgacccagccactgtggttataggaaggctcttttagatacatagcaatacataactcatggaaagtattttcaaattataaatctaatacaagaggaaataagatctcatatgcagtaccctggtaaactcaaactattacggatggggcacacatgatggagtgcttctcggagctttacatttttgcctcaacatgcctaaggtaataggagatattctcatctgtgctttactctgtggtctcagtaaggaagggatggagacacatccaggatcaaccagagctggtggtctttcccttggtccccattgccagtcccaccctgtctccacagggagtgtgaatgaggatggctccatctttc

SEQ ID NO: 31167 - DNA, 1027 bp, Homo sapiens
ccttgaaattatttcccagaacatcaaatgggagttttaaattttttaagtgttatttgaaagaaacaatccaagaaaaaattaatttaacatgttcagtgaataaggactcatctctaagagattaatgtaatatagagattaagaatgcaggctacagggttggaattcctggattcccgtaccaccccccccacttatcagctctgtgactcttggtaaaatacctaactcatctgttaaatggtaataattctctttaccccatagggttgtggtaagagtgagacaatacaaagcagtgttgaagtcagtgcagggtaaagtgtggcacagccttcagttaatgttaggaattgtagaaaggcagataacgatggacagaggctgagatctcttaccaccactccttccctctcccctacccacttaacagtatatcatggtgacttttccatttcagtttttaaagttctgcctttttcttttgagtagttctacttcatttcactgaagaaaagaatcataaccatttttctgttactggacatttgggttatttcattgttcagtgtttaaagatctctgtacttgtatttccttgttccctcccacattcccctaaaatctttgaaggttgtgttttgaggttggtcttcagtacagctgctgtaattgatttcattattttgtaagcacttgtttgctgtgacatcaaaaagagtttgtgctcacttagcataaaattaagtaattattggacatgccatcttttaaatggaagaactgaactcttctcacgagggcagtaggagtgtattttgtcagttaggaaagaagaaactgcttaagagcttttattgaaaacgccttatggcctgtctcagaaattcaaacctgagcttattagttggtttatgattgtgtaaagcgcacatctctaagataaccataacccagtatggagagttttctcatttatagttgatggggtttctttctcctgaaattgtttccctcaaattgc

SEQ ID NO: 31168 - DNA, 1064 bp, Homo sapiens
gcatacatgcaggaaatagttagctgcctggtaagaagaaagactaaggtcagagcaaaaaagtgctgtagatgtcctacgaagggaaaacttccttctcctgggaaggaattggtatgctgtcatgcccagcatgttgtaggagtctgtaacttttataaacccccaccttcacatgaagtcaatccattctgtcctggagtgttttcagtatggtttaaaatggattttatgggatgtttggatttactttatacatagtgttgacaaattacatctatactgtaaagtacaaaagactttttcctaatttaaaattgtctgggcagctcattctagagttcatttcttgcgtgttagaactccttacattcttgaagtgaagtttattttgactgtttacaggaactatcaactaaacacttcatggaagatgtgacttatgacagtattccttactgggagatttttgctttctttattctttttgacctttggctgtgaaaaggattgtacattgtcatttagaaaggcataacaataatgaagtgctattaaggaaatggtagtcattgaaatacttcatgagaaaaggaatttaagtgtataatgtaatcaaatttaagtagctaatcacaaatccccttttctttttagaaagaaacaatatcaaggttatatgttactttctcttttttcaccctaaattctaagccactattgattatccctgaaatgttagcttgtgaatctgggtaattgttaaaaacagaaaagtgcaagctacaaatgagagcctcggtccttgcttagatgtaaatagttttcctatgaatttaaaacatttttttaaagccacctaaatcctataaaataatgccagtgtttcaggctatagaaaatgtctcttgagagtaatatcttgtaacatgtattacttatatatataagtcagttttcaacagagctgctgtgaattactgttttatggcctaattcattaaaaagaattgcctaattgtggtgtagaaacttaggcactaaggcagagtaataagaaagga

SEQ ID NO: 31169 - DNA, 1762 bp, Homo sapiens
accattcacatacatgcaagtcatttcatggaaaagctgttttcttacctgcgtctaggccttcatctgtgagagtcatgcttcactcattttgaaatacctctcattgtaggctccaaggtaacactgttacagagttcttgctcatcttcaactacggatgaaaatcaggaacttgacagaaaccacaagatagtgggtccctctgctgctgttgtcagatagaatttattgaagactgggacgtggaaacaaagaggaaggaagagacgttttaatctctgtgggtgttaggctgacttctgagctagttcctttcctccagtaatgcaaaaacagtcctgctttcttatttctcctcctacttttccccacatccctacatcatctgatgcacagccaggcaaaaacctgttttcttttctaacctttgccattgtcaaattcaacatgtggtatgaggtggagaactgatgtgtaagatatggttctttctgaagcaccctcagaaaattgtcagcagcttcacagtataacgtgcagagatgggtagttggagctacctggaaatgcggaattaacagaataaagaagtattttgacaccaatgtcgacatattctagataagaggtgttgcattgtcatttttcccacattaattttcccatatttgaacattactgataaatagatcacaagtaggacttcagataaactcctcgtgtgttaacattttggtgtttgtgctgtgttactattttgaaagtcttcatatttttagttcctttcaggctctgtaatataattggtgatgtcctgcagtgctccactgtctttcccattgactattagtgccattagatttggaagttttcagaagatggctacaaagtcctcttcaaagtgtataactcagaaccagaaagaaagaagacaaggggctgaaaagcttactttataaggttcctgcattttaagtgtatttacttaggctgttccattgccaaattatgggtaacaactagtaaagttcagcttgccttaaaaacatagctatacatttagttataataattataactggcttatgacatgcccgttactattctagttgctttatatgtacttgctacgtaggaggcagtgttctggacattggagatggagtagtgactgacacatacccaaacagttatttccctcatgaagagtattttcttactttctgtctcacagacttgctagtcactgttgatccttggcaaagacctgtgagacacagagcttgtttagagaagttcgccatttctccctgccagagggactcttcttcagacccccagcgggccccaatagtcctcactgatgctttgattgaggggctaagaatactgatgtgcatagagaggcttgttagcttcagctgcagtgagatctggtaggtaaataaacttaaggacaagtggatgtgaggaggagccgctagagcctggttattaccagggcacattgcagagtcctccagatgtaaacattttgctgattaaattgatgatttggcaggaaccgtatctctaaggtgcgactctcaagacttccctgatttattgcaggagatgctgtttactctgacagtctcaaaaacacccattaattgttccgggtcccttttgtgcttcttgacttccccgtggggtgtttcacatagatgttattgagtatgactggggagaacatgataatttgttgcttcttgacttc

SEQ ID NO: 31170 - DNA, 1726 bp, Homo sapiens
gctctcttggagacttgttcatgtgagccctgtatagaccttattctttttcgtagctttgtagtattccataatttgtttaatcagtacctattgatggattttcagataaatatgaacattttcaatgaatttattttaaccatagcagatatttgctgggttatataatttagtttttttttgtttttttttgtttgtttgtttgttttgctggcaagttatttataattgtgtgtgtgtgttttgtatgtgttggggggcatggctgccgaaaggattccactggttgttgagaaagatgttgacgtaagaatgtagaggattttagtaaaggcccggtgtaaacattttatgaaagtacagtgtacaaggatatttaaaggaagcatatttggaaattgtcctctataggatctctgaaggaactagcatccaaaatgcttcttgttggatggctcttttacttgtagaatgggggtgaaagtcaacttagtactgtattaaaagaatgatgtgagccaaggtttaatgttaggaaagccagcaaaggtggaggagcgcgtaatgtcggggatccaaaatgtcacgctcaggacttcctaatttagtgtgctgtaaagtttttgagctttgtagtaaaataattgaaaaagtgttttgaaaaaattgtaatctgataggaaaacattgaatgcagacatgcctttttatgtttccctatgtgaagcattcagttctaccagcttgttgatttagagtagtggagaaagggggcagaaattacatcattaagatgtgagataagtcaccacattataaaataatgcctttttgttaaacctcttgcaatgaatgacaggacatgggacttcattggcaattgtgcacttgccttcatctgagaattacaatggagaaacaaatgcctggtacaatatcacccccttctggtagattgaaagaagtaacagtttttaaaaaaattaataggtgcaatttgtacatgtattgtaggcagttcacaaaacctcactttggtgtggatactaacgttgagtcatggttgattgtctaatcccaattagttgaagtgtgcaaacagattttctgtattgctagcattagattgggtttaaatcttgaaaatcagaaggactgaatctcgactgatgttagcaaagaatcagaatttagaactttgttacaaaacaaaaacttttgtatgtgtattttctcttttcagtattttttttggaaagatgctgaggaagcagaggaaagcattttctttttcaccttgaggtctcacaaatgtgtcatctctgattatcttcctgttgttcccatttgcttgcaagactcaccacgtctttagacatgtccctaatacctcagtgttgtcattattcttctgatgtggcctgtgtttctgtatcatgcctagccgtccttgctggctttgttttgtacccgtgatgttcactaccatagtacatactcagaagtatttgttaattgaatatctgtaaccaaaatatggggaagacagagaatattctccaactccgtgctctggttctgcaagtaaagataaatgagataatggaaattatctgagaacaatgactatgaatattttaaataatattatcccaagtgtattaaatcatctaatcacttgtagttgtacacttttgaatcccttttgtagatgtctgaatcc

SEQ ID NO: 31171 - DNA, 1105 bp, Homo sapiens
ggtgaacttaaagatgtcatcaatgatttacagagtcaaggtagcacattgttaatgttttgagtggccaaagaattagtgaccttctctcactaccctgcctccctcatatcaggacccttgagtaaaaagtcccatttctgatcccctttgccagccttttgaaaataaacataccagtgtaaattattccgattcttactcccatgtttgatatcattacaaatagaatcaacaaaatgtggacagaaaattgaaattttctataacaagaaaatacaatagccaacacatggttattgtttcagtgtagtctttggcaccctctttgaatatatcttcccttcccttgcctcagttttaagctgtttaatcattaagaattaagaagctgtaaaactagtgggtcattttgaattttttgcctgtgactttcttatagtacttaagatattttagggatcattgataggaatagaaagaaaatgtcttggcattttttgtaaataaaaagaaaatctactgtcttctaaagtgaacagacaaaaaaagtcctggatacatacagatctgacttgctgattctctgaaatctgttttcaccttagtagaatttaagttgcaggctggtgtgaagttactgctgattattataaatatttacatgtcatctagtaaattcttcattaaaatgcatttgtatagtcaggagtatccacaaatgtgtttttgtatagtctaatgataaatgctgattttgttttctcattcttattaagttttgcagatttacagtttattaccaaagaggacaacttgttaaaagtaattgcaacctggtatattttttttgtttacaaggctaggttacgcctattgtatttattgtgggaatttttaaaccttttgcttctttggaatttttagtttctgttgttaaagacctgtaccatatcactgcatcatataatcagtgaaatgggtcatgagcatttgacttatgtggcagccatggacatgggcctctcatgtctcctactgtggggagcatgatggacaggtagctcctgctgtggatccaccaccacattcttgctgctgccac

SEQ ID NO: 31172 - DNA, 1032 bp, Homo sapiens
aatattgaccagtaaaagtgaatggctttcttcacccaggcagttttatcatgttgttcttccctgacagtaaagaacttggccaagttaggaaacatctttaattgacagtagcttggtcattcagttaagaaaaattagaagctgttttacagtgtaaaggctgttttctcgcaatatgtgcatgcaatgttggatattatcaaacatgatttccccatcccttcttcttgtttactagggtggtattctctggattgtatagtgcagggcttgacacagagcgataattgagagtaaaacctactttggtattctctctgactctcattccaattccttttaaattaacaaatgcagtgacataactcagtttactagttccatagtaaattattttgtgccatgtgtgagggtggtatttgtttgggacgtaagggaactttggctgtctttgccggggggaataggtttgtgcatgtgtgtgtacaggactgagtgtgtgtgttggggaatgcttgggctttgtagccagatatagcacaaaccacatgtggctttaaacttttaaatttaaattaaacataatttaaaaaattaatttcctcagtcatactagctacgttcaagtttcccggtaaccacatctggctactgtattggccagtgcagatacagggaattttcatcaatgcagaaagttctatttgacaatgctggtttagcctcttaataactgtaaaatggaatacatagctgtcttgctggatcttctgagagttaaatgctttgcaaacattttgactacagtatctagtacttagtaggtatgcattctataacataaagcttaattaccatttctcttgttaatagagtcacattatgaatgacagagtagggaagaatctgccacttttgcctttggtgaagctacatcattgttcactgggacgtgacacttggcacaaaatgtgaaagtctcaacatatgtcactgctctacctgccaggtgggaatgaaataataaaa

SEQ ID NO: 31173 - DNA, 1066 bp, Homo sapiens
caatagaaactgaaattgcagttctattatactgttgtggagtaaaagtgaagaatgattctggggggttattttagaggacaggaagtgggaggggggcagtattgggcagaggtaggagtctgttttctccatcaagcttgtgaaggaactgctaatcttccaaactagaggtctagttttatttggcctgaacaatgttgaaaacatcaggaaatttcacataagaatccagatttggaacccattttgaaagatgagaagatttgctagcatccagcatgaacaatccagcactattagttgcctcttcctgatggggaagtgagctctctccagttctctggctcacagcatacgcgttgacatccctgggccacctctttcaggagcattacctgccgggtcctacagtcagttgatttggcaatgattattccgcttatcatttaatcttatgtggctatacttaacctctatagatccccaattgttctactttgattataaatgtatctttcccttcttctgtgtctctcctccctgcaaacgcctgatttttcttgtattactgaccatcacttaaccatttcttttcaaatggtttttcttatacctcttagcaacccagaaaaaagtagtgacaggaggtcatgttgattagttcacacctgagaatgtgttaatagtcacagtggagcttttctctgtgcctgcccctctactggggcctttaagtgaaaaccctactgattgtgttataaaactgctttcggtggggaaaaactgaggtttctggtgttacgaaaagcttctgagtagtggaatagggacttgaccccagttgtgttggatgcccaaacatttgctctctccccagaagggctatgggaggacaacatccaggactactgaacagctactttggacacccagccttgtggtccacacagagccagcctgctgttgcagttcactggattggatcttggcatgggtggggagtcatttgtaccacgccgggggaaactctgtcagcaggaagagcaggccggtgtgccctgcc

SEQ ID NO: 31174 - DNA, 1027 bp, Homo sapiens
tctttacatgttaaatatcttcattggttttcacagtgcagagcagcagctctgcatcacttgggaacttgctagaaatgcacatttttgggcaccaatctagctgagtgaataaaaaactctggggtgccccaccctgcatctgtattttagtgagccttccattgatgcttggtacactcaaatgtgaggaccactgatttaaatggaataagaattttgttgccatttagaacttgaagctattaatatcagtcacttcagacacataataatccccaaatgttggtcatcttaaagggattagtttgatattaaactcttggaaagggttgtattgttatttttaaatatgactattgtaaacaaatcttagccttccttatttgttggagtctcaaaattttaaaaagagcttttatgctgtatgtacttcaaataataattgtcaatatttaatttcttacactgtcatggattaactcactttattaataatctcaactattctctgaagtacgcgtatcatcctcattctctggatgaggggaactgaagagcagagcagtgaagttagatggagaccccattctgacctgtgctgtctagttagccttagaatctgtatttgtgtatttctgtacctgagaatctttccctatcacaccctctcctcaacccctctcccactaagaggccccagtagtgagaagtgaatctcgtgtgggatggttgtacgtctttcaataaaataaggaccatactctcctttacagcaaattgtaaatgctaaaggatgtttatgatgctttttctaagaccatcaaatgaaacaaggcttattcaagaaaatgattatttttaacaaatcaatctgccatattactaattcagaatacttaagtcatactaccttattgagaatttatatttctaaacctctagaagggctaacagtagagatttgagggataaaagaagggcttcagttcttgatctaaattaactttatttttcctctgatttt

SEQ ID NO: 31175 - DNA, 1086 bp, Homo sapiens
tatttcattaaagatccttacagttttgactcatgtcttccaagacatgagtgtaacagtctttacgtgatagtgtgtttgcttcagtgttcttttttttcctcttcttttttaaaaattctctgaacatatctaacagagaaaactcttgattattgttaggaatgccttactacaatttgttgattggagcaataaaatgtgtgattgcaatactaattgtgcatggtgcacatgagagttttgttataacttagtttctaccttttccacctcaaagatatttggcaaaacaggattatgatagacttttttctgttcttgtttaattagatcccttagagtgtataactgtactgtctgttgtagtagctgccagccacctgtggctgtttaaatttagactatttaaaattaaattaataatatagttcctcagtcacactagtcacatttcaagtgttcagtggtagccaaatgtggccagcaggactagcttcaatggtgtgtgacgtgcactgtgtttagaagggcctgtgtttaaaaaggcttcatgcttagtttaatgctctgcagtttctctgtggaaattcttactaagttttgatcagggagccttgtgttttcgttattcactgagaccccaaaattatgcagttcgttcttgtggctagtagttatcttattggacagcgcagagagaaaacattgcagccatcatagaaagttctgttggatagtactgtcttagcagcatcatgtaaaacgtgtccatctagtggatagcagcacagctcccatctgttaccatcaatggctgcatgacgactccaagtaatcgctctttggaaagttagcaaggttgatggtaacacatttgagaaaatagatattttggataataatttggaaaatgtgcattgtatgtacaatttttataataaatagcagcatagcatggcccacaaacttgaatttcaaagcccaaaagttctgggttcaaatcccacctgtgccatttgctttcttaataagttacctctagctctgttttttcatttttaaagtagggataacgaaactgct

SEQ ID NO: 31176 - DNA, 1021 bp, Homo sapiens
taaacccagtggagaaacattctaccaaatgacagtcgtataatatctttaagaatgtcatggttctgaagtcaaggaaagactaaacaactgttccagaatgaaggagttcaaaataagacgacaactaaatgttgtacataattctgtactggttcttttcttataaagtaccatattgaaataaagtagcatattgaaactgctggaaaaacgtgaatggaatctagggcttagatggtagtaatgtattaatataaatttcctaaatgtggttatgtaatagaaagtctttgatctatgctaaagtatttaggggtgatgaggcattgtgatgttccttcactctcacatggctcaggaaagtgttatttaaattattcttgcaatttttataaggttgagatttttttcaaaataagagcattttttaaaacttaagtgacaaggacagaataattcagcaacacttagtgataacaagataagagtaagtattacaatgagaaattgaaggacctaaagtagagcctcttactctgctagtattattatattatcaacactagtttaggtcgtccccaggcaggcctttaattctcagtgtcaagaaattagaaattaatataagaccctaacatctagaatatggaatacacacacacatatttaaaataaatcttatgttttgtactttctacctaaaatatgtggtgtagtgattctaagtcaaccatattttgtctttgaaaatcctgagccctccatgaaatacctaggtatacatactaacagattatgtgtaaatgtgtattctaatataaattcctggacatacagaagtcccaagtaggcaaaaattaggtaagtagttctccatacagaattccctcatatacataatagttctcctagatgttctacctgtgagactatattttaaaatgctgagctaaattgaatgtgatataaatatttacataatgaaattcccaaattaggtctacaaaacttaattata

SEQ ID NO: 31177 - DNA, 1029 bp, Homo sapiens
ttcagcaatggttccatattttccatatgtttatagataacattcagatatcgaattttcatatatgttttaattcatttatttatttcttttatctaggagaaatataatggtttccaaatgtcctatactagattattgatagattttgtcattagttttactattgaataccatgaaatatcagctgttgcagccactaaatagttacaaactgttggtactacagtttactagtcaatccatggttatatgcttgtgctatgctaaatataaaggattcaagatgaggacttaagcagttcatatttgtatttagaatattatcaaagatattttcttaacttgtctcagtattagaatttacagcccattttcagcttattgtatccagaaatttcaatcatatccaataatttatcagcatttgttgatgacagtaaaagtgacacattagcattttatttgtttctgtgttgtttgattacaacagtgacattttagcactctttgtggacggataactcttctagtagaaagaaagcaggagggtggtcaagctaagtgacagatacaaagagttggaggacatagggctttctgtgggtaagaaatggatgagaaaagctttatgtcactgactaggcttgcaattcagtattcccctatcaaaggcccccttactgatgtttctgtttaccagatcttggtttcaagatgccaggttctgaagagatacaccacgagttcttataaacactatatctaaatttggtttgaaagtctaatgtttggctgtgtgcagtggctcacacctgtaatcccagcactttgggaggccgaggcaggcagatcacgaggtcaggagattgaggccgtcttggccaacatggtgaaaccccgtctctactaaaatacaaaaaattagctgggcatggtggcgcatgcctgtaatcccagttacttgggagctgaggcagggggattgcttgaactcgggaggcggaggttgcagtgagctgagatcat

SEQ ID NO: 31178 - DNA, 1111 bp, Homo sapiens
cagagtaaacggaaaaaaatttagaaaacttgtaataatcctgacttctttaataaaatgtgtcctgtgtattgcttaaatccatagtccagccttttctgagttcttgagccatgagatggaggtggcctgtgtaatctactatttttagaaagttaggaaagcaaaccaaatactctctgagaggaccctatgaaatggctgtacccttcagctgtgctgcttcagactttggccaggctcccaggtgacttacgttaatagcagacttctagttagaagaggagaatttatttcattaaaaaaaaaaaaaataagtcaaacagttcaagaaagtattcatttatgtaaaagaagtcaattggtatgttactaaagataataggaagaaaattagctcactattttagttgcatactgatgattttaaggtttaaataattagatttaaatataccgtatgtaaatgtagaagtctgtatcgtaataaatctgttgctaagtaaaatgggaatacatgacaacgaggaatgtaggtattaagaatgtcagaattagaacgagaacagtaaaagagcaaaagctgtaataatgtgtgctagtatataaacaatactctaaatacttagtttctctaattttccttttacaattgcagttttaatttataatagtctaagagcgtattcaagctgagacttaaattgcttacgtgctatagatttaggtgtattagctatttcagaaatccagaacatttgcaaaggtgcattattttatgccaaagaggattatgttcccctatggcttgtgaaagagataggaaaaaagaaaagaaaaatattaacactgcaagccaccattagaaaattatatttcaaaaatgatgtttcaaatcaatgacaaattgcctattcagtcatgagctctcaactaaaatttggggagtcaatgtaaagaaagcctacagaatgtattttaatatttgccaagttatttataccctcaaaaaaaaagcttttacgatatgatcaacagaaatagacttattgtttactgaattctatttcaaatacccattcatttttcaggtactagggatgggagaaag

SEQ ID NO: 31179 - DNA, 1099 bp, Homo sapiens
ttgctcaggtaacacacaagtaagcattaaatgccttcctgtgtatctgagaagtttgttatgaaatattttggaaaccgctgcatagtcagtgtaggaggagcagatgaattttagctgtggttatgtgtgctgtaaaagactatacgtgcttgtattagtcagaatgagtacaccactaatttttgtatggtaagagatttatactaagctcatcatcagtttctataattcagtgagataaaactgagtcagattgatttttaggtagcacatgtagaaacagctaattttattcccctgatttgatcctcatctattgattatataaactaaagaagctaagaacaattaacccttacgaggttacacagtcaggagatgctgaactgagattcagtgtagaaagtctgtcttcagagcctatgcttttagtctttatgctaagtttaacttgtttaaatagcaagattatgaagcactatacagtgacctcgtatagacaaaaatatagtatattgattattagagaaactacatattagactgttgtacatacgtgggcaagtatttgttaaatcatttcagttgcctaaatttaagcaactgtgctgtttaaaacatgctcattcacattttttcttaatctagaaagtcacttctgaataattgcttgtttagattttctcatttggtgtgggaaatttatattaaaattttaactaatattctaacaatacagagtctgaacctaaagtccagaagaattttaagtcatgccgcagacaggatgaacagtatagcaaatcagaataatagactgtttgggggggttggggggaacccatgagaatttcaggatttcaagataaagcttggaattgaggtaaaggcatcagataaggaagtgtttcatttcataactttttttttgcttgaaatataatatattttaaatcacaaaagtagtataactgttatttttctaatgcacagaaccatgagactttttttttttttttttttttttttgagacagagtcccactctgtcgctcaggctggagtgtggtggtgccatctcagcttactgcaacctc

SEQ ID NO: 31180 - DNA, 1053 bp, Homo sapiens
gaagacaattaaaattataataaaatatacaatgctcaacatttaaattctatatggccaattgattcttacagaatgcctttttgatttttgtccaactcttgcatctgtagtcaacctgtggtcgcaattgacagaagagtttaattctttctttgtgctcttactcctgggtccctcattgtacagtgatcatcaaatgcaacatccttcatgaaaatgaatagcttcactttttggcatttccttcctttttatgtgtcatagaatacactacattattcttgattttacagttaatttgtaaattgtttctaacccccactagtttataaactccttaagaatgagaagcttgcattaatcacttctatatatatagtgttttgaatatccttggcattcattaaatgtttagtgaattgaatgcgatgtttcttccagactatgaccaataattgtgagaagattttatgtgtttttaaattcaactttagagaatttctttttgtgtaataggacatttgttggacagcaacatgtaattactcataaaatgtttctctgcggagtccagcatccttcatttgtgataggactcatccagttaaattgctcaggcactataatggactatttatgttctgttgatgtaaatttctagaacaggcctttccctggactcatgccatgttttgtatgttatcttgtgcaggcagcacatggggacctagtcaggcttcctgatatgatagctgtatatacagcccatgtctcagaggggaatgataaattggcctgtgcagtgacacaatacacagttattttggtgacagtattaactctcttttcataagggtgctttgttggaaaactattcagcttaacacagaatatttagctttcaaaggttgcatagggagaaatgatactgccaggatagaaacattatcagttttttctttctttttttttttttttaatcttttttgactctaccgagaatattgaaaagagttttgattagtattggtgtttattacgagaggaaca

SEQ ID NO: 31181 - DNA, 1046 bp, Homo sapiens
cattttattcgttagtaattgagaagcaggtctaattttctaatcttgcaagttgggaaattattaaaatgctcaagagacagtagatcaagcctggtgtccctttctccatcaaattttaaaggatttttttttcctcagtaattctgcctttgtgtatttccaatcttgcttcctatttgcattgcacacagtggcatgtcaatttcaaaagaaaatgtattcagatctactttcaaactaactgaaagagatagtggtatttattttatcctgaggttttgttgttgttgttatggttgttctttgttttttaaatctggacatatcagtaatctcctaagagaatctattccaaacacagagactgtttattcttgttttagatactgttttaaaagccaggttatgttattatagtatagatattttaaaaaataatgaaaacagagtttttttaaccatatttttgtactgcataaaaatgcagtgacaagagaaaaacattagaactctgtcatactcctaatatagaccattgctgttaggtttctaactccatgttccctgtctggaagctttataaggccgtgccttagtcttcttaagcctaacacattgtagccttccaataaatattactttatttgtattaaatttaaaatggaatagaatgtggtacatcaccagcgttcatagctcctgacccatgccataactttccttgccccatccccaagattaaaaaaacacaaactattagactaattatagtcattacagttgtaaattaggtcatgcatttcattaaaaattgacgcagctccctttttgaaaggctatgtcacggaaatgcaaactagccttgtatatagaacactaaaatcatttaacttgaattattctaattacgataccacaaagattaaaaaatacatctatattatctcagtctgataactgggctgggaaaaaatgtcagttttgatatgtaacaagattggtatgagttattttacgtgacagttttattgattgattttttt

SEQ ID NO: 31182 - DNA, 1050 bp, Homo sapiens
ggccacataactgttttgcctctttgcttatgtagtttggagtatgaatcataataattatgtatcttactccatctctgcatttgattccacagcctacgacttacacctttgtgttcttaacctcttagtaagaaatgcctgacacgtagtagactgactagaagtgtacattgaatgtttgctggttaaaggaatggaacatggacttcactcatagagaccttactatttggttgaagagataatgcatacacatgtgacatgaaggtaaacacaaaatatattgaagatatctgtattttattttttttagtttatagttaatttttacatactatatatttttgtagtaggtaagtcaattattttcatgctacagatatggacatttatgtatttatgtacaaatacattgatttaggttatctaggccagattgtaagtagcaaagccctgtttgtaaaccaggttttgtgacttcaggttagaaatattaaaaaaaaaaaaaaatccttaattgctcttccagatatgaactcattctttttttttttcccctgtgatttctgtcttttttgtttgttaagtttaaaaaatttatggcaatttttaaatgtacataatattagagaaacaatataacaaccccctccatatatctatcagtcagcattttgtatgcatgtatccgtatgtgcatcagccaacattttgccctttttgttacctttcacactccttttacccctgtagcatgttaaaagaagtctcagacatcctatcatgtcacttatacttcttcagtagtatctctgacagttaagaacttattttaaatataactccatttccaaatctatgaaaattgacgacaattttattgtatcatttgatagccactttatgttcaacttttcctgattgtcacagcaatgtccttttttaataggtacgtttttccagttagcatctatggtgtcatttagcttgttcttccatcatccttattttctgtaaactgaaaattagagtcgagtttaactttaa

SEQ ID NO: 31183 - DNA, 2008 bp, Homo sapiens
cctcagatttatcagatataccctattaaatggcaatgtgtctaccttgttaggttattgtgactcttaaataagttaatacatgtaaagaacttgtggaatttcagggcacacaatgttaccttaccattgatattatttgctgttattaaatcttaattttatgtaaacattttaaaatgtctgtctcgttaacaataaatgtgcaatatacaaataaatgaaaatcaaaattagtggtggagttttaatgaaataatttagagctccagctctggaactgtataatcttcattcaaatcactgtgaccttgaagaagttatgtaacctaactaagcctcagtttccttgtttccaaaatgggagcagtactaatatctaatccttagaggagttgtgaaaattaaatgggataacacgtataaagcacagagaacagtgcttggcacttaatgagtctacagtgtgtgttagctattgttttattaattctgtcatgatgaagtgaacactgtgatgcaatacttttatacttagaatctgcctatatagggttttcagttttgctaatgaggagtgttattctctgctgtgtaaagaacacatgctttggtgtttataatttttctctaataggtaaatgattaggaaaagaataacctgttattttacttatcctttgttgagatatttaaattatacaaaaaaactgtagatggctttttatatctataggattttagctctggataaatcagttaggtaaatgcattattaatgttggaacctgcttaactctgttgtccagccacattgtagccactggttaagtcgaacgccactagaaagaaaagcaaataatcaaaaacatcaaaatggaaatgaaatatggagcaaggaagtcattacttctgtaaaataaaggtctgagacctaatattttcccattggttggaagtattgattatgaaaacattagaattttcagtaaaattgtttctgtgccaagatggcagatagaatattatgaaagaaatgaccaaaattgcatatgacatttattttatatggtaacattctttctttcattaacaggaaattttagggcaattatttgcttattgggaatgagaaggatgaatgaaaatttaaaaaggattcatcaagtcttccttataataaagtaaacttttaagagcatgtttttccatagaattagaaacttagaatttcatagtaacagtgtattcatcacctcgtttggggagcagattttcagtatgatcacaggaaaacacctgttttgacactctgaaaaaggtgcagacgtacgggcaaactctctgtaggtgtaaataagaatgctttggctagcatcctgcaaggagatgggtctaaatggtctgctccagcttctgctgctgctgctgctgctaatattgctgggaaggaaaagtggctgacctggcatatccattactcttggtgctgcagcagtcactcaggaaatgttgtttaaggggaaccttctggatccttttcatggcaccatggcaagaagaagctgtatcttatctatggaagataaagcatggagttggctaatggatgctggtgagtgaataaggcaattggggagccagtttgctaagataccatttgggtaggcctgctcgctcaaggcctgagatgacatccatgggaaatggcttttggtattctgtacattagaaactgttttagagaggaaccgtggttttcacattggtgatctgatctgtgattctgtatatgttccataaagttctcatttattctctgcttcactacttgaaatactaatattgaagtttgttcagtacttcagtagatggagcatagttttccatgtaacttcttagtcactaatctctactcttgtttttgacttgccctacagtgatttttaaaaataactctgtggtatatgaaagcagttgttcctcctttcaattctaattgagcacc

SEQ ID NO: 31184 - DNA, 1102 bp, Homo sapiens
aagatatttcaggaaaattgaggtgttgctttcaaaaaagtattaaaaagtgggcacagtaaattgtctgtgtgtgtgtgtgtatgtgtgtattttaatgctactgtttttatcattcatttctcatcatgtagataggaaggttagcagaaaattaccttgagatttatagttgggatgactaggcctggagcattgccctttgctaagataagaaatataggtgttaaaattgatgttttctctttctttttagggagaacatgtaattggtttgggagggttgaatttaaggaaaaacatctgaaaccctcttacacagactgatagtgctgtgataggaagaaaatacccagagagaatgtacagtaagaagaaggaatctaaagacaaaccttggcgcatctctctataaccagcagtcagaaaggagggaaatcaaaagaaagtgtcagagaatgagtaggttaatacatagcaggtaaatgaggatggtgctttgccaaggcaaaagagaaaaacattcagaaagtaactagttattctatagagaagacaagaaatgagaaaaaaatcactttggctgttaaaaggacagtagtaatctttgaaagcagatgagtagaattgggagagaggaggtagaattcagattgtaaaccagattccaagaagatgagtcactagtaaattgggaggtaatgcatgaggcctcaacacatgtagacaactctataaagaaattcaataataataagagaagtgggagtcagctgaaggattcagcacagaagaggttgttgtagagcagtgagggttattccactgcagaatagtggaagcatgtctttttcactaagggaaggggcagccgtcagtggagagtgaaagaatgaatgacaaatcgctaaaatagggaaatatcagagaagatgagaagggattaagaaaaagtgagttagagagattggccttgaatggaagattaaccaaaaacttcctgagagacagaaatgaaggtgcttagccagattccattccctaatactacctgcattttggtcatccttgtcatttgggtggttccatgccttgggtccac

SEQ ID NO: 31185 - DNA, 1036 bp, Homo sapiens
tggtttctcttcagatcgtgtaaatctttcgccttttactaaagaaatttttacctattttcagcagttttctcagtgtattgtaattatttcatcaaaagttgaatctccttaccaaacttgggtactactgaaaggcagaaatttctgttattcatcattattcctccagagcttggcatttttttttatgctcaatacattgagtgaaggaatgagcaaacaattaaaagaaagtatgacaaaaaaatcgtaagtgagatccagtctctgcccaaatgcctgagaggcaaaatagcaacatgattggtgctgggactccagagccaggcttcttaccagcttgacttcatactgtctcggtcaacttggcaattgatattatctatcttatagtgttgttatgagaattaaatgagttagtatacacaaatgcctagagcagtgcctgcgtccagtttaatttggctttacaaatttaaacctgcaaggattatgtaattagacatacataaattttacacaaataaaaatcagagtgaatgtaatttgacatcagttgaataaaatgaagcaaaatatcataatctttggtttattactgtgtatttggtaatcctggaaattgatacaatttgcattttagtttaagtgcatgttatttaagtaacatttaagttttataagatcatggaattaaccattttttcgtatttttcaattagaaaaattttgtatttttacaattagaaaagtgtaattttttattagtatgcaacagatatgacacagctaggctaaatcaaattattacatatagtccaaaatttagatgattatactgaatattagtattcacttactgtactactgaagagtcaacatttcaaagctaatgatgaaaattatctactaagtgtgtgactttttccccaagaatgatttcatctgcttccaccaatttcagtattctagttgatagagtcaaaatcatagcatgcggaagcagcacaagatatcatgtgcaacatgtgtt

SEQ ID NO: 31186 - DNA, 1050 bp, Homo sapiens
agaaaaaaaagagtaattttgttgatcacagtgtagctaaaaagttgttaactaggctggtaatcatagcccgagggtttgttgttgtttgaacattgagtaacaggtttctaaccttgagtttaattaccatcagaagtgtcttattctgatgttaaaggccaaatatctgtgatttcaggacataattctttgagaaagtacacacctttcatcacatgtaatttttaccagctgatttttatagcacttaatgttactccatttcaatccatttgtcttcttattttgctgtgtgagtcatcttgccgagttctgcagaggataatgtgataccctcagcacttaataagctggcagatacatttccagttgaatgttgatgctatggaaaatttaaccgaattaagctataatgcttcacttacttttaagtggtccatgttagaagattaatgaaggaatcttttcagttcattgttatattttggaaatataatactttgataggatactttggtaggataaattataacaggtgtaagactgcaatttaaatatgtaggcataaggaagaaacaatatcacagccaattaggaaagtgagtaagcttttgaatgtcattatgctttgttgtttttgttgtgaaaattaggggcatcaaattaattgattattaatgtcagttattttagatggtgaataaagacaaattttctttagatatcatctcatttattttcccttaattaacagtgaagggatagtttgcagaatattagacattaataattttatgtacaaaagagaaaataatacagtgttcataattctgtgattgaggatgtattatatatttacataaaacaaggctgtaaattctaaaggaacaatacattagacgtagtttacatttggctttttaaaattatattttaagttctgggatacatgtgcagaatgtgcaggtttgttacacgtgccatggtggtttgctgcacccatcaacccgtcatctacattaagtatttctcctaatgctatccctc

SEQ ID NO: 31187 - DNA, 1031 bp, Homo sapiens
atatacttcaggcaggagtagaaaaagcccatggcatattgagctagtatgtgtccttacttgctaaaaacaaacaaacaaacaaaaaaaagtaaaaacaaacgctgtccataagtgcacactattctgtaaagaaaaattcctatttacagttaaaatattttaaattttaaaacaacataaaaatgtgaatacattttggttactttttggaatattaaagcagaatagataaatgtgtctgtgtcgtttcctggaaaatcatttgttaaaaaactcattttggtaattatctagtaattctatagttagcaaaattttattttatatttctatattcatatttctatgaaaattgttcttaatttaacatgccaataattcttttcattcacatgttaatttccacacctgtttctatgaaatgtttgtttttaatttttctgattaaaaaatgttatctagtttagctttgtaacttagagtgagaaaaggctatggtttgttctctgaaatgcttaacttactttcaaactgattaaatcagccaaagaatttgaagggtttagctattagatgtcaaataattgcttgattaacctatacttcagtttttcaactgttcttttgacatattaacctgcttcagtgcagggaacaaatttttgaggctggggacatagtaggtgtttggcgtctttctcaattgatttagaaacaaacttagtgtaactaagtaggcgtaacatactctttagttacccctagaaaggtatatttagacttgtttagtaagcagaggtggtaatattcaaccaagtaagcaaatataagtatgaaatagttttcctttaaacccacttggcagtggaaaaagccaaatggaaaactagctgaccactctgatcctgtttgtcttacacagtagttaagctaaatgccactcagacaatgatttatttattaaagcaaagaaaatatttttctttcctaaaatcgtaatgtaaaataataaatataagagtacattt

SEQ ID NO: 31188 - DNA, 1050 bp, Homo sapiens
gaatggttttgtgcaaactgccttgctcttggctgcttagtggagccttatttcctgtagtctgtagcagctactgcaatgggtagaacttagaattccaccttaaaattgggattcttacaaagtccaccaaacccatgaggagtctatatttgagttttgaggatattcaaaagccctgaaatgttatgtaatttcacgtgtacagttttctggagagtgagtctgtagcatacagaggtgtttgtgtcatgcctcaccacagtttaagagctgtttatatgcattgtacagagcccaagggtattctggaaacaacaaagatatgaaaaccttggttatagagaattagagaattactgttccatgagtgtggaatacattatattagactagatgagctggtgtaaaggagtcattgtaacaaaatcaacaaaggtttcttatgcctgtggaatagcttccatggagctttttcccaagtgatccctccagagttgtttttgtagaatcatctgggcagctgtgcgttgtattcatgctgaggtgatagatgaatacttttcagaatggacatgttatgatacatttcaggatccttttaccttgaaaactatgttgctgccatgttggaaaaataacacctagcaaaaatgattaatgtggaagggtacgtctttaatctgtgatgaagagaaattaatttcatcttccctcacctcaaatccctgttctatgtaatggacattagcagatctatattgtactcatggcacctaaataaattcataccattaaagggagttttagatttattacctattagatatattatttattcaggttaaatgagaatttggctttgcaatgtgtattcgttatttgggtaatgaagtaacaaacattttaatgttacttttcaaaatgtaaaatgtaaatgatttatatttgaattattatagacttcatatgcttagtgtacaacagaagtttgtaatgttttatttttaaggaaagttacactttgggaagggtgatccatggaggcag

SEQ ID NO: 31189 - DNA, 1023 bp, Homo sapiens
ttgtatgaatttattgctagtagtctaagaaaaggatgagatggtattattaataacttagatgaagagtggtaagccagtttaccaaggcttttccataaattagtgagaaaggtaaaagtaaaaataaagattagatggcctacagctccctgtaaaataatccgttctcagaaccacaggccttttgcattgttttatgggccaacaggctttcactagacccttgacattcttgtagtttagatttctggtttttaacattcaggaactgtcccaaagattcattacatgtaatcgattgtttttggtccttgggaggaaattttcatcaggtgctctgagttgacttgaggactcagctggagaaggcatctagttggctaccctcttcaagatatctttgttgactgttcatataagccataactatggtgaggaggatggagtatttgtccatttgggaatttacaaaggtccgtggaacacataacattaaaatatcaggttcttttcataccagtgctttacaaacaggacttgagaaatgagaatagtataataaatgtcagtagttatggattttagcttttcagcttttattaaccctaccagtcccagtcccatagttgagtgaaacaataaatgtctgtcttctctttgctctcaatttctatgccaagtgcagttcccttgattgtgagtgcttcagactcccagctcttacctttacctacctaggtccaatctaaagtttccgactttgaggaggtatgactaggtactgtatgggaaaaggataggatagaaaggggcatagaattcctaggaaatgaccactgattctggttcagaggcctagcagttgaaagctagagctggaaatctggaagctttattaatggtatttagtaggtatctggcagcacatctggtagcctgcatgtgcattatttacacaggtattcaggtagatgaagtgactaaatgaagaaatatctttatcacacacaatgaatcatg

SEQ ID NO: 31190 - DNA, 1030 bp, Homo sapiens
aaatacaaaggaagatacaacaactatttctaataaaagccacctgttttcagcacaggtagagagtgtagaaatcacagatatattcctttactcacttaatgcacccgagcagagtgtttagcagatccaggctttcagcctaaatgttgttggtgtgatagcaagaaaaaaaaaaaaatcgtgtgacaaccttctgtgctttcccctctcacgttcacattctggtttgttaaaaaaaaaactgtgttgccatggctgacgctcctgtgaggcccaacatctccatacttttcatcttaactaagcacttaagaatatgcactacagcttctgattgccatttagaacagagcaccttgtgatgactaagctctttcaagtatctatgcttaacgtgatggcttcaatacccttttgctatatagactcatctgtagatacttggtacaagttccatagtttatagttgtcatctatttttatttgtatgtttattgttaatatggatctttttctgaaaaactattcaaggatactagacacatactgtatatgaaatgattctaaaaattctgagacttttctattttattctcagtggtaatttttaggtagtttgttgagtgttactttagctatttggggaactgccctagaaaaccagtggaattctctaggtatgggggtggagtgcagaggaggagacaggctcagataacctgtgttgtgatactgcttttttttgcctcaagagattttctttacccttactgcttatgctgttgcagtccatccaatagaaacatgttctgggctcatgagccaatttgtctttcccctcgctgctgcctcaagtctgggagagctgatggcagtgcacaattttagcaaatggtcataggcaggggggtggggcagggaggggagtgttttctccatggggacagagccagtgtcattgagcacattttgttcaagtacaaagttgatctgtctgaaggagactgtggtcagcagtggtgagaac

SEQ ID NO: 31191 - DNA, 1043 bp, Homo sapiens
aaagaccaatgaagaaatcaaaacagtagaagttgtgtttgatttaaagaatagtttcttgcctttaaagatggtaaaactatgaaataagtacaagggtgctatgatactaaacacagacaattatgtaataaaaaaatcctatttacttatttaggttaaagagtcatgaatatttgagaatttaaacattaatagaaaaattagtgttactacaatagcaaagacatggaattaacccaaatgcccatcaatgatagactggatagagaaaatgtgatatccctacaccatggaatactatgcagccataaaaagaaacatagttacatcctttgcagggacatgaatggagctggaaggcattttcctcagcaaactaatgtagaaacagaaaaacaaacaccacatgttcccacttataagtgggagctgaacaatgagaacacctggacacgaggggaacaacatacactggagtttgttggggagggcgaggcaagagattgagggggattgggatagcagtaggaaaaatagtgcatgctggggttaatacctaggtgatggattgataggtgcggcaaaccattcactgtggcacatgttttcctatgtaacaaaccttcacatcctgcacaggtaccccagaacttaaaacaaaaaacaatagtgttaatatgaaaatatatttcctccatagtttaacatatgatttaaacatagtagatacataatatttacttattaacaggatatatactatgtatatttactctgtggtatagtatactacttgtaaaacaaataacagcatcaaaacagtgaaatctccctagagacttttcaaagaaaaaaatgaatgtaatgtatctgttataactactctaaaaattttaggctttattttatagtgctataaaagctcttaagagtttattcaaataaaacatgaaatataaattatgtcatatatcctaagttttgaatttgtaacacaagcaaaatctgtttgtaatacatatgctgctgttagaaatagg

SEQ ID NO: 31192 - DNA, 1026 bp, Homo sapiens
taattggaagtaaaacactcctcaaaaggtgcaaaagaacagatatcataaacagtctctcagaccacagtgcaatcaagttagaactcaggattaagaaactcactcaaaaccacacaaccacatggaaactgaacaacctgctcctgaatgactactaggtaaataatgaaattgaggcagaaataaatcagttctttgaaaccagtgagaacaaagacacaatgtaccagaatctctgggacacagctaaagcagtgtttacagggaaatttgtagcactaaatgtccacaggagaaagcaggaaagatataaaattgacacctgaacatcacgattaaaataacgagagaagcaagggcaaacaaattcaaaagctagcagaagataaataagtaggatcagagcagggctgaaggatagagatacaaaaaacccttcaaaaaatcaatgaatccagcagctggttttttgaaaagattcacaaaatagatggatcactagccagactaataagagaagaatcaaatagacacaatataaatgacaaaggggatatcaccactgatcccacagaaatacaaactaccagcagagaatactataaacacctctatgcaaataaagtagaaaacctaaaagaaatagataaattcctggacacgtacagcctcccaagactcaaccaggaagaagtcgaatccctgaatagaacaataacaagtgctgaaattgaggcagtaattataatagcctatcaaccagaaaaagcccaggaccagacggattcacaggcgaattctaccagaggtacaaagaggagctggtaccattctttctgaaactattccaaacaatagaaaaagagggactcctccatcactcattttgtgaggccagcatcgtcctgataccaaaatctggtagagacacaagaaaaaaagaaaatttcaggccaatatccctggtgaacatcggtgcgaaaatccttaataaaatactggcaaaccaaatccagagtacat

SEQ ID NO: 31193 - DNA, 1051 bp, Homo sapiens
cattactgggtatatactcagttttgtaaatcattctactataaagacacatgcacacgtatgtttattgcagcacaattcacaatagcaatgacttggaaccaacccaaatgtccatcaatgatagactggataaagaaaatgtggcacatatacaccatggaatactatacagccataggaaagaatgagttcctgtcctttgcagggacatggatgaagctggaaaccatcattctcagcaaactaacaacaggaacagaaaaccaaacatctcatgttctcactcataagtgggagttgagcaatgagaacatgtgggcacggggggggaacatcacacactggggcctcctgggggttgtggggcaaggtgggggatagcattaggagaaatacctaatgtagatgatgggttgatgagtgcagcaaaccaccatgtccatgtcacatgtatgcccatgtaacaaacctgcacgttctgcacatgtatcccagaatttaaagtataataaaaatcaaaaataatcaaaaaaataaaacttctggattctttttccaaattattatttttactttgtcacatactgtctggtgcaaattttgtctgatgaaaaattggtacataatttaaccaaaaataggctgtatatcatggcttgcaacctggagacctctggtagatttctttagtgcatcccagccaagtgtccttcagaaattctgttgttgccaggctctcttcattgccctcaaagagctctacataagcagtggttataaagagctttgcatgatatctggagtttctctagtaatggtctcatgtgcctttacctgtgatcccaaagttaaccttggctatctataatttgtgatggcagctattctttgggtaaacaaattagctatctcagggtccataatttgtgtagaaatcctgtgcattacatgaactttgaaatagcctaggaatagagaaattcagtttctggttttagctaatgtcttgagagcttctttgctgcttctgtaacctagatagactttg

SEQ ID NO: 31194 - DNA, 1043 bp, Homo sapiens
tttaataagctatgtatacctatataatgtacgattatttaaccaataaaatgctttaaaggaatatttaataatatggactttaatatattcagattttaaagcaggtctaaagagtgggatttcatattgttctagattttaattatttgaaaggtaatttatcaaaacataaaggataattatctttaatgatagaattatgagttattttaatttctgtctgtgtacttatctgtagtttcagcatctgcaataaacataatgtagttagaaaaggaaacacaaggaaatgagaaacaagcagtaagaaatatgagcccagaataaaacaggggaggtcactggatatggctgacaaattcataattggttaaccttgaaataagtcattttatttaaagtatagactaaaattttactttaatttcagtcatttacaaaattcatttaaggttttattaaaaattttatctctgtcatagcttatcgtaaggggctattttgaacatttttgtctattttttatttaaaaaagaaaacagatacttttcatcctccattaaaagaaaaacaaagaaatatctgtattctttacatttttattttgttttcacttcaaatgcaatgctttaatatggatatctgcctttgtaataatttgatctctgttatatttcaactaggaatgttcagcttttacatgataactctgtctatatcataataacttacattacaaaagtgtttttgatttagtttgaaacactcatttcagatacagcctttttgaaattcaaagtactcagaagatttatttgcaaaggctatttcatgatgtaaggcctgcttgttgaacttcaagagtgacacccaagtgttggtaactacttaatgtattactcatgaaagagtttgcagtcccaagaaaatgcgaaataaaatcttgagtaaaataaatgatcagtgtctgaattagatattacagagtaagcatggtattgttaagtatgtcataaccagggctatcttcattgttttac

SEQ ID NO: 31195 - DNA, 1168 bp, Homo sapiens
agaacctgtttaatttttgccctgaagtaatggctgttgctatttttgttagcaaatgttattttcttactccatatatactcaagataaacttaccccagagtctttggtaaacaaagccattaccttattttcctgaatataacagagaaactttattctttctaaaatcaatttcttcaactgacagttgaaagacagtgacattcagaagccactctttatgtcactttttgactgtttctctatcctgagattaatgacaaagaagtttatttgaaattcacccgaagtattttcacaatacttcaaagtaagtctacgtgagtattctagtccatgttgttcagctcttatcaacaaccagtgtctggagtaatagtaaaagaaataggtagttgtttaggtattatttcaataaagaaagaaaaactagtgatgttttaatagatgcagtcctttggataagacctcaggaaagcagtgtgggatctgaagtctttgtacaattgaacaggaggccagttaaagatgactgattagagacatgcactgtattcattctcttctaaaaatcccagtaaaaatgatgggaaggtcaatacacaaggaaaaagaaaataagaatgagacaacagctacaatattttggaacctgaaaaacctgagatggttgtccagtaatgcaggaaagtttaaatctagactggtagtgaggaaaaccaaggatcaaccagattgaaatcccagaacctctgaaaggtggtgcattgattgattgattgattggttcttccttcacaaatctatggttacttggagtaatttatagataattgctgtgttaatagaaaaagacctataagtatgattaacttaattaatttggtctaggactaggttaaaggtaattcctaggtgcaggaattgatgatgaagttgggtaaaggtgtgactaaaactgcaagtttcatgcaaatctgtttgagaagtagtcagatcctagatcccctctttggctctacccagcaagatgatgaccctctttaccccagcagcagggcagcattggtgaatactggaccaggagacccaggaccacataagaaggggactgttgtacaggaaacgaaggtatagtggcagttggcacccacagccttctgcg

SEQ ID NO: 31196 - DNA, 1030 bp, Homo sapiens
tcaccaaaaattgggtaaataattgtcttacttgtttttacttctctttcttaaatgtatatctagcttacatttatttcagtgtttaatattagaagtgttttgagtgtttatttagaagtttggtgattttctttttgaccagaaatatcctgtaggaacttaacttttgtttatatcaatgagcctttggtaaaattagtttagttatacatcatttcacttagagtcacagcccccaaaacctatcaacaacattgtgtggacttactgtactaccatttcccttttgtgggtaaggagactgaggcccaaattagttacgtggatttgtttaaagtcattcacctaactggaattgtacctagtgagttttttgattcttcataatgtattggcatagactgtttgttcaaaaatacatatatattgtaagtgcagttaagggttcagtctacagaactaaattttaatttaaattttaatctgccagggattacacatctggaaaattatttgaacttgctcctgttggtgtacatcacccatggagctagtcagacggagtgatgagatttttatctcatatttgaatgtctttgacctcttagaatatggagacttaaaagcaaagagcatcttgttttctgtggcacagctctgtggcacatcataaaggtcattgtcttattttctcatggacattgttcccgaagtgaagaatattgtccatatctttagcataagcagtctgtgaatgtgtcccaatggtttggcattgcagtattctctagaaataacctaattgattataaaagtatcccataatctgaagtgtgtggagtttgtatttattaacttttgcatgtatgctgtctatgtactttcctcagattaaaaaaatacccaaataacatacactaccctccttaaactactttacagtgatttgaggaagaaaagaaaatgtatgtttggaaagtgccaacttaattcaggttgtaattttctgctttttggtctaaaaaat

SEQ ID NO: 31197 - DNA, 1042 bp, Homo sapiens
tcctactgggactacaggcacatgccaccatgcctggctaattttttgtatttttagtagagacggggtttcaccatgttagccagaatggtctcgatctcctgacctcatgatccgcccgccttggcctcccaaaatgctgggattacaggcatgagccactgtgcccagccagtatttatttttaatgtgggaaagagttgctagaggtagcaaacatatgaataacctgaggataggaaggtaacgtatgaaaatggttttctgagagggaacgttcatgctctgaaaaacagatggagcagaaagctttataaagaagctgccttttcctttcctctggaattgttgaacaacatctttgagggaaacatgacataatattttgataattttagtgagtgtatgtatttgagcaaggctggtattgagttgtaggctgtttggcatggtaaaagtttgaattctccagagctgcttttaatccatttgcaatgcctgtgttttttcttgtgagcagtgtgtatcctcatcaggggctgcctcaatgcttatccatctggaggaggctactcagctttaattaaagaaacagtggttgagagggtccgcctacaaccactgaaagtaataaatgtacatggtgtaaaattcaaatactgccaaaaagtatgcactgagaaacaagtccccctgtatgactggtttggggcgtagcttccagagatactctctgcacatacaagtacagtttttttaatacgatgattgcctaccatacacactgtatgcaccagtacctatttacttttagtccatcaaacagccagagtcttaagaataacaccgagtataattttttaaaatctttgtatgctccccaaataagcccaagttttctttatgtagtttcttctacttaggaactttaaatgaataggtccacatgagttatggactttattgtgaaaatagtcattgctctgaatatgggattcttattgagcattacatctgattccttgataaaatattttaggat

SEQ ID NO: 31198 - DNA, 1030 bp, Homo sapiens
atatatgtttatagatgatcggatataaaagacctagtctgtatactgatttatgacccatatattcaccattatgataccacagcttcttcatttgcttaccttccacttgtataaatttctagctcctacatgttttgccttattgttaatactgttatgtgaaatccacatcttattatattcagccttgaatataaaaggcagacaagccattcgtatttgccagtgtaattatgtgcttatgatattttcatacagtttaaaatagttgatgctatatggatttatcacagtattttgtaatacatttttacttgctgcttaatttgaggaggaaatattttgaagtttctcttttctttgttttccctcagagctaccaatccatcctttaaggaagtattgtcaaggattgagtcccatgaagactgtaggaacttacccatgatctcttttctcattctccccatgcagagggtgacccgccttcccctgctgatggatgtaagacatgacggtggctttttcctctgtggatagctgtgcttctctaaatctgatttagaaaattattattattccacttaaattgatgcatatttaaaggtctaaaaatcccccaattaagtgagaaggtgttgtttgttcagaaagtctcacctgtatctgatatctctggaaattatctttcatttaggcttctatggtcattctgaagaaattggatctcatcacccacttactcagcattttttgaaataggaagagttgtggcttctttatgtcaggaggcctggattccaattctagctaagccattaggcatgtgaccttgagcaactcagtctctttgggcctaagattcctcagactgatcactgagatcccttcatctataatgttccaaggtgccctgggccttccatttcatacaggaatgagagtctcttcagcatgacaaggcatagtactgcctgtattatgcattgtgcgaagtgagtgaggaaagcccagcttccttcttgtg

SEQ ID NO: 31199 - DNA, 1044 bp, Homo sapiens
gcttgaacatggagaatgtggctggagcagaataaaccagggagaggggtggcagtcaatgggcaacaaagtccagtttgtcttcagagctaccccagtgctgtctgtgggccatcagtcctcaagtagttaccagcctggtatgtaggaagcagtttgacatttctgaggcatcaaaacttgtgattattttaacaattaatttatttttactgtatttctaaaaatgcttggtctgcaatggattcaaggggtggagactggttctctaccagagatatctcgagaaacactgatttagaaccacataagccatagcaggaagttccaggaacaacaggggccctggggacagaagtttcagtggggcaaacaataagaaccctaaccctaatcctgttggagtagtcgaggggagtcccgatgttggcttggaccgtgatatgtaggaggagatagaaatgttatattttggagacaaaaacaacaggaccaactgatggattggatgagttgaggtggcagtaagtggaagagaggaatcgatgatatttagatttttggcgtgagctgctggcgtgagctgctagcttgagttgtttcttaatcaaggtaggggtacgtgcagtgagttgttagctagttgagttgtttcttaatcaaccttggcgtgacttcttcctctggcaccctgttgaggcctctccatcagattaacaggcttcctagtttcacacccagcagtccaatcttcctttctttacctctagtatcatttagttttattgaccatccagctctttcatgctaaccctttttttgagattatgtttttctcagcctcttatctatgctcttagtttgcctctcacacctatgaccattcctcttctctgtctcttcagaaatgcagcctgtccaaaaccaaacatcaacactgcccgtggctttccccgacacacacatttctgtaaatggtactattgacactcttttgcgttatccagtctggagacttggtgctgtttttgatgcttctgtgtc

SEQ ID NO: 31200 - DNA, 1389 bp, Homo sapiens
aaccatgacgttttcttttttccccagtccctcagtgacccagttcttatctctaaatattcgtcctttcaaaaatagcattcttcctgctatcctttacccaaagcatctcctttcccagctcagcccaggttcaaatactctcagccttctcacttcagggcctctgctcacgttctttccctgccatgtcattcattccccctcgaaagctttccctgtcccactttctcttctcaccgtagcacttagcctggggagggatgctgcctctcagctttttcatatccttggagcctggcacactccaaatacttgttgtttggtgtggactctgttctttttcacaggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactttaggatttttaaaaaaaaatccatctcaccccatattgttcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagt

SEQ ID NO: 31201 - DNA, 1024 bp, Homo sapiens
tcataggcagaatcagagacagacagaagaaagggtaccagagaggggccagcttgtcatcactcacttctgctccacatctagcttttcttgactactggtattgttgaccaacagagcctccaatccaccccagatgcttggctatgggcccacagaggtcgtggttattcagaggcaacagcttttcatagacctctccacaaatttcccctttgtggtcctactttgctggctagacatacttggtttctcaagctgactgagtggtaactctgtctctgatcctcaaacttctcttcaagtcctcttcttctccagctttctccacaattctaaacgaagtatcttatcccataacacccatagtgtttttgctccttggactaaaccttaatagatacaaattcctaatcaatggaagagaaaacctaactaaaataatgaagaaaaatatgatgattttaattaattaaaaaacccaaaaacatttatggatgaaggtggtggaaggtagtccaatcacagaatctctctcatccagtaagatgaagaaagacaacagtcacagattcaccaggagcaaccaaacaaggaaagtgtccagtctcatgcaaaacttctaagagtgctggccaccaaacagaaacaaaagattcatccacttctgtaagcagttgcccagaaagaagacgatttgaaaaaatctgagaattctggctatgaatgaattccattttggtaagagatggtttaaagtaatgattctcaaaatgagggctgcaagcagtttcaggggatctgtggtcaaaacccatcttacaaacagtttcagggggtctgtatggcccaagctattttaatgactatactaaggttttatttatcattttcaccatggtaacatttttactgaaggtactaaagcaatggtgggtaaaactgctggcagtttaacaagaatcaaggctgtggcaacacattttcttggtagccactgtatatctaatcactgcacatatag

SEQ ID NO: 31202 - DNA, 1035 bp, Homo sapiens
gtcaaaagagtttggtgaacacttcttgtaggaaggcttccctcatctcaccctaggctgggttacatgctcctagggtgtgattttattatcatacgtgggagttaatatttatttcactgcttatcattgctgtttacaataagctctttatggttgggggcaggggggcagaaaatactgcctagcattatatcctcagccctttataacatacctggcccttggtagacccttgaaatatattgagtgagtaaattgataaattaatttcccatcctggatatttataataacttatgattctaaccttataatctaacccatttttaattgtaagaagtcctgcaataaagaaacttgcttaatgtttttgcgacagcatttacccgaagtaattcacaataatttttttgtgtgtttactaccttatactttctgtagaatttgtatcctttagaacactctttaaggaaatgtcttacagtaaataaagtatcattaagtgggggctggattgtcatgactgatggcaaacctacaagaaaatgggtttggcctcagtgacttcagtgatacatatgaggcctgatccactgactggggaaatcctgggctcatgtgacagatttgtaataaaactgcatccatttgatgggaaaccatgtaactcagagatacaggctaaaccccccatgaaaaatttaaattaattaaattatttaagagtgatacgaagtggtaaaatcaaaagtcaagtatcattgagaaaatcaagagagaaataaaataaaaatagaaataacaagtagtaaacaagtgataatgaaataataaaataagtaaaataaaccattttaaaataattaaaaatgaactttagaagtagtgataaataggccaggtgcagtggctccctggtgtaatcccagcactttgggaggccgaggcaggcagattgcttgagcccaggagtttgagactagcctgggcaacgtggtgaaatgctgtctctacaaaaaatacaaaaattat

SEQ ID NO: 31203 - DNA, 1030 bp, Homo sapiens
gacaggagccaagtcaataaacatttattgagcagctagcttgtgcagagcactgtgctaaacaaaatagatgacaaagaggagaacaagatgttgccctttactcgggagtctatgatcttaaggggcagatgattaaaaattaaatctgatgaaaggcggggtttggttgctgctattaccaggaaacaaagtgctagaacagcacttttttcaaaccacaaagctttacttattagtaaaacacaatttttcaaaccacaattaaacctttacttattagtaaaacattctctggaatcaatatgtcagcatttaaattaatattgaggtgagcagaggattcacaaaaaacaaaacaaaaatgattggctcatttctgtctgccccttggttgcttcaagcatggtgttttttttctaatctggtgcaattggatggtggcacacctctgaaataagtggaacccctaaagctggcagctcaacatctgtgactccgtggtgcatatagaaagttcctgaaaggccagcaccaccaaaaatggcagagcagttggcaccctgggaagtgacactgtagttttgccactgcaatgagtgcctaatactcttttagtgttccagttctgccattcacaacctgtggccttttaaaagccctgtggtttccttatttataaaatgagtaggctgtgctagactgtagaatgtgtctgaggttctttctggcactaaaattctgtggaccttactgtgaagttttcataagagccaggaagttttcctccttggcttctccgcatcaaatgacccaagagaaaaaaacacattcttgagtggcagagaagtacctcgcttctttctaaaatatcccttctgatttttccacttcactaatgtttctagaaccaaccttctttctaactaagttctgtatagttcaacttgagtatcaaaggaaaaataattatgcagaaattatatgggtaaatatgatggcccagcagtggaaagttgatagtctctcg

SEQ ID NO: 31204 - DNA, 1057 bp, Homo sapiens
gcaaactagctcggattcggcttcggtttttctcctggccggcgccacaggcccctcctccggggcgggctcctcggtgcgagggcaggaggggcggagccggtggatgccgcgggctcctcctcccaagggcgggccgcgggagacccggccggctttgccggcggggaccgggctgggggcggggccgggcgccgcgagcccctcctctcgagggccggccggtttggcggcggctgcggagggtatctgaggctcggctgccaagccgaacgggctctggctcctcccagtggccggccggggcggaagcaggaggcgggggcagcgtgcgcgctgctggtcttctctcccgcggcgctggggcccgcgctccgctgctgttgctccattcggcgcttttctggcggctggctcctctccgctgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaaggtcagcgtgggggtccctgcagcaccgcatcccggcggaggcgaggctcccggaccggggagccaccccgcgaggcccttccccacccccttcccccagcccgtccgcgcagccctgcgccccgggcagccacgcgtcgtagagtccctggtcggggcctgtggcatgttttatctcgggagcggcgatgctttgttgatcttgtctgcgtgtcgaggtccgggcgtcggggagggcatcagctccccgcggccgcgtcgctggcccccgcctcccccgcgccgctgtggggcgcagagcccgcgagcgcggcgcgagggtgggggtagggcggcgagcgggcttgtgtgtctgcgtgtcggggtgggggcttcctcggctcccaccccgtccctctgggaggctgggggcccgttgtggcgatcccggggcccgccgaaggcagggcagggtcggggcctcctgtgcggcgttggagctggg

SEQ ID NO: 31205 - DNA, 1029 bp, Homo sapiens
tttttttttgagatggagtctagctctgtcgcccaggctggagtgcagtggtgtgatctcggctcactgcaagctctgcctcctaggttcacgcagttctcctgcctcagcctcccaagtagctggaactacaggcgcccgccaccatgcctagctaatttttttgtatttttagtagagacagggtttcactgtgttagccaggatggtcttgatctcctggcctcgtgatccacctgcctcagcctcccaaagtgctgggattacaggcgtgagccaccatgcccagccatgagcaaattctttagtggtgatttgtgagattttggtgcacccatcacccgaacggtatacacaacacccagtatgtagtcttttatccctcacccgcttcctaccctttccccctgagtctccaaagtccattgtgtcattcttatgcctttgcatcctcacagcataggtgatcagcttttctttaaaaactttttattatggcaggggtgtatttgacatagtaacttgagttttattaaggcagcattatcagagtaatgctttgggtgacttgtcaagtttcctactcttttcccctgtctaagggtgaaactcttggttggagtaaaggtggtacctgtcctatcattgagaggttatgactaggttatatcatacttggatgaaagatgttttataaactctcccttagtgattgcatgtgatacagaatctttaatggcatttaataatgttaattttaagtttggaatttccaaatttaagattttgaatggaatgggaatataacttgggatttttatctgggatgtactgagaattaaacaactatatcaccttttgtcacaacttagtaaatttttttcttagataaaagttagatttttcagattttattccgttaggatattcatttagagtggaagaactgctgcagacaaaaggaatggtttttagtgtagtgtgttcttagacctgaaaggttttgaaattcctccaggaatctcggat

SEQ ID NO: 31206 - DNA, 1136 bp, Homo sapiens
gtctgttggggccgctaaaacaaaataccagaaactgagtggcttatgaacaacaaaaatttctcacaattctgaacgctgagaagttcaaaatcaagggacctgcagattcagtgcctggtgagggcccacttcctgggtcatagaagtgcttgatgctgtgtcctcaccttggggccttttttttttttttttttgagacagagtctcgctagtacagtggcgcgatctcagctcactgcaacctccacctcctggattcaagccattcttcttcttcagcctcccgagtagctgggcatgcgccaccatgcccagctaatttttgtatttttagtagcaacggggttttgctatgttgaccaggctggtcatgagctcctgacctcaggtgatccgcctgccttggcctcccaaagtgttagaattacaggcatgagccaccgtgcccagcccctagggcctcttttataagggtactaatcctatccgtgtgggctctgccctcatgctctaaccacctcccaaagacctcacctcttaatattatcacattggtgattaggtttcaacatatgaattttagggggacacaaacattcagaccgtagcacctattttggacattttgtgactagaatcttaaaatatatggtgttttgtggctttcacttagcataatgctttcaaggttcatcttgtagcatgtataagtactttattcctttttattacctgctaatattccattgtatgtataccaccttatatttatccacttatcagttgatgaacattgggttgttttcactctgaatattatgaataatgctgccatggacatttctgtataagtttttatctagacaaaagttttcatgctcttgagtataaacctaggagtggaatttctgggtcatagagtgactccgtttaaccttttagtgaactgtcagactgttttccaaagcagctgcaacattttatatttttgtctgctgtgtggcagtttatgtcaggattctccagaaaaacagtaggctatagatagagaaatagataatagatatatatatagagagatatatgagaggaaatttgttaggggaattggctgacgcgattatggaggctga

SEQ ID NO: 31207 - DNA, 1115 bp, Homo sapiens
actgcaacctccacctcctgggttcaagcaattctcctgcctcagcctcctgagtagctgggatttcaggcgcctgccaccatgcccagctaattcttttgcccattttaaaattggattatttttcttttttattgagttttaagagttttttttttttaagtctagagatgtttcttatcaatatgatttgcgattattttctgccattctgtagattatctttttacactttcttaatggtgttctttgaagcaccaaaacctttaattttgaggcttaatttatttcttcttttgtcacttttgtttttggtgtcatctaaaaaactgttggcctcattcaatacatatcacaaagatttgtgtaattacctatgttttcttataaaagttttgtagtttttgctcttatttatgtctttgtttcattttgagataatttttgtatcttttctaaggtgggtttaatctgacttagggttttttaacagactggctcttagatttggatgattgttggccttgttattgaccatggcagagcttgaccatgagtgcccctgaaggctgagggtaacagttgctcattgtggtagtatctttttgtatcagttttgtatctttagtgtcagtttgtggagagaggtggtagtttaaaaaactcactaataggtgttttgttttgcttgtttttattgtggtaaaatgtacatgcagtgaagtgcatagatctttaagtatgtagttgagttttgacatatatatgtactcatgtaaccatcaccccaatcaagatatagaacatttctgtcactcacaacattcccttgaacaataaatagaatcagaagcactctggatttaacaaagttgtttttaaaaaatgcaaacttggtattggtgcagtatttttaagttaaaacttttttcagttattaagaaaatctctgtcggtttgtctgttaggcatattatcttgcctaaggtggtacatcttgggttaaccacgtctggctctctagaggttaatagtgcttctcagtggtttcttttctctgatgtctttccttcattagttaccctcttattaaaaagaaaaaaataagtgtgcgt

SEQ ID NO: 31208 - DNA, 1535 bp, Homo sapiens
tattgccacggtaatggtaattaacaatcacaaaatgtaagtggcatacaaacataagcacttattttttgttcgtgagtttgtgggtcagctgacattgctcagctccacttgatcttgtccttttcctgagactagtacactcatgatgttctcatggtggcagaagtctaagaggcaagtagaaacattaagactgcttaaagcagcagggcctggtggctcacacctgcaatcccagcactttgggaggctgaggtgggtatatcacttgagctcaggagtttagaacagcctgggcaacatgaggaaatcctgtctctactaaaaatacagaacattagccaggcatggtggtgcatgcatgggtggtcccagccacctgggagactgagctgggaggattgcttgagcctgggaagcagaggttgcagtgagctgaggtcgcaccaccgcactccaacctgggtgacagagtgagaccctgtctgaaaaaaaataaaaataaatgaagactgattaagacttggtgtactatgacttctgccctcattatattggccaaagcaagtcttgtgcttgagcccagtgacaaaggtgaggaagtatgttctatctataataggacaagctgcagacttaagtgataaaatcatggatacagggaatgatgaagaattagggccaacgatgttatatatggaaaattgaaaacatttgcataagtacagtgaagaatataatgatccctcaggtccctatccagttcagcagttatcaacatgtgaccagtctttcattcatgtttatgtagtgcatcacagtaagagagttacatatgtctggttgtctgtttttgtatgttaagctgcattagttgattcagatgttaccagcttatccgtcattatcaggtttctcattaaccttttacttaatggttttaatagccaccgttcagtgcttatcaaacatctgcaatgaagaccatttaaaaaacatttccagtactgaggactgctacttttgtaaaatacagtaaatttctagacaaatgaaaatttaaaatccaatatattttaaaagcccccaatttttattatagatgcaacagaaataaaattactttgtcaacttgttatgcaaatttatggatgcttatataaaacttatggattctttttttgtcatgaactggtaacagtttgcttaaaaacgttccttcactaactatgtggttaccctggtaaagtcagaatacatgcttgattcattctcattattaatactattttaccaattttgtaaatagttttttcagattttattcattatttccaatggtgcaattaatgtatgctgtataatagaaagggtcgtatgtagaaaagagactgggtttatgaagtacagaaacatcttgaaaaatagaccacatactaccacatactaaatacttgtgaaattgtgacactctattacttgaagtttaattttttttctttttctgtttgagacagagtctcactctgtcg

SEQ ID NO: 31209 - DNA, 1180 bp, Homo sapiens
atgattagggtatgtgtatggggttctggctgtctttaggtgggtgctagaactggtaactaagttgaagctaaattgctttttagttcattgatttagatagtacattcagctgttcattatattctgggaaggtgcccacatgaacttgaaaggagctattggccccttgtagatagggtagaagagagtctggactactttgaaaatctaagagatgtgtttggttagcaaaagaagatgaagctgcagtcagaggtacaaactggttcagttaaggaggaaaaataattgaatttgaaacaatatacgtaacacgtagaaactaaatagtctttaatgaatacctactagcttgaaatctcattagggaaaagagttttttcaatgtatgaagttattaaccaagagcagtgaaaagctgacataacatatgtcagtagagacttgtatttcccaaatctatcgaacattgaaaacttaaacatagtaatttattgaaggcactcccatagaatcctatctgttgtgtactcagattaaaggaggtagtgaaaatgaactcagatgaattaagtgattgaaatttttgtttatatttaatatctacacatttgttaatataagactaatggaacaaaagttagtgatcataatttaggcaacatgaaacagttggtaattggtaaacattgtttatatgaccaaatgtagatctaatattgtacattattgcatcagggtatgtcttgtgacttccagatttttctcaggtataaacacagttttctaaaggcattttatacatttgttacctaaaatgaacaactgtgtaactgtcagctatacctagaattttttatcagaagtattttagattttggattttggagtatttgtattatacttactgtttgagtgccactaatccaaaaatccaaaatgtttcagatttttggattaaggatgtttaacctgtatatagaaagagacttatttagacaaacttgaaagactcatgtactacttacacatagggttttgttttgttttgttctatgttttgagagaatctcgctctgtcacagcccaggctggagtgcagtggcatgatcttggctcactgcagcttccgcctcatgggttcaagtgattctagtgcctcagcctccggtgtagc

SEQ ID NO: 31210 - DNA, 1029 bp, Homo sapiens
tgatccacctacctaggtctcccatagtgctgggattaccggcgtgagccaccgtgcccggccagtgtcatgctttttaatgcttttttttttattgttgttttttcttagattaagactgttacgtagaagcaagcaactgtagtttatgtccttaattggctcttaaactctaatattagatgtactatgcttctcccaaaatttaaaattttatttttcttaaaagaattgtctttccagtgtgaaagtggttaaaagaacttttaaagacttcacagacatgtgtgcattatcctgtgttttgttggttctgaagtagagtgaattagaaattataaaaggcgggcttaaatttaactctgctctggtgttaggatacagataacaaatgactcttttaaactatggaattttagagtaataagggacccttgagtttatctaattcagctgattttatttaccagcaagaactagttttttagagggatcaaaaaactctgtgataaatctgaatgcctctctgtcaaatcagagctccatcattcccctcacccaaaacaaacaaaaaatccccagcaaactaacagactaaacagatactagaataggatagctgaatacttggcaagagaaatctaatggtgtttcatgtcacttgatcataaacagtgtctaggttcagcttgtacctagaatttcccttatgtagtaggagaatagaaactatactgctgtggcttttattactgtaatcctttctgtagaaataactatttgaccaccccttttctagaacattttgtgacatgagagacatcttaacctacctatttttattttttttttattatttttttgagatggagtctcactctgtcgctcaggctggaatgcagtggtgcgatcttggctcactgcagcctctgcctcgcaggttcaacctggcagattctcctgcctcagcctccggagtagctgggattacaggcatgtgctgccatgcctggttaatttttttatttt

SEQ ID NO: 31211 - DNA, 1059 bp, Homo sapiens
ggcctgatagggaatctattttcaaagtagtaagtacactgtttcatgtaacaaaacactatccatttaaaaaaaccttggacatgcaaatttacataaaattttcagaaatagtacatagagctcctgtatacctttacccagtactccagttgttgacatttttgaaccatttgaaagttgcacacgtgatgccctgttacttatatttcctaaatattaggacactcttactgcataaccacagtacaactatccaggtcagaaaagttaacatttactcattgttagaatctaatccacagactccttcacatttcacagtttgtctcattaatatcccttataggccacagatcagtcaggactatgtgttgtttttagttgttgtttctttagactctttcagtctgaaatagttcctcagtgtttccttctctttcatgagcttgaaagtatttttaaaaagtacgtgttaattattttgtagaacatttcccaactttggtttctgtgatgattcctcattgttagattcaggttatgaacttttggcaggagtatcacagaattggtgctgtgcttctcagagcatcttatcaggaggcacacggtgtggatttgtggcatgacaggtgatgttaacttggattatttgggtaagatggtatctgtcgggtgtctccattgtaacattaattaataagtatatgtgccttggttttatatcaaaagtaagaataggccaggcgtggtggctcatgtctgtaatcttagcactttgggaggccgaggcgggtggatcacctgaagtcaggagttcgagaccagcctgaccaacatggggaaaccctgtctctattaaaaataacaaaagtttggccaggcgcagtggctcacgcctgtgatcccagcactttgggaggccgaggcgggtggatcacctgaggtcgggagttcgagaccagcctgaccaacatggagaaacccccgtctctactaaaaatacaaaattagctgggcgtggtggcgcatgactgtaatcccagctccttggga

SEQ ID NO: 31212 - DNA, 1042 bp, Homo sapiens
ctcctgaccttgtgatctgcctgccttgcctcccaaagtgctgggattacaggcgtgagccaccacacctggccactaattttgtatatttagtagagatggtgtttcatcatgttggccaggctggtctcgaactcctggcctcaagtgatccaccccactcagcctcccaaagtgctgggattacaggcgtgagccactgtgtttggcctcatgtacctttttgaatcgtgttagaggacatgttcattaaggagtttattttggagattggtggattttattttctgatcagtatttctaaaggactctaagagatttagctgaaagtataaacttttgcttttaaaaaaagttatctcttacaaggctgttttactcctgttgattatagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggaggtaaaagtttatgaaaactttttcataaagtagatacatggaaagtcttccattcttccctcctcttccctctaatattcacagaattgcataaccatcaccacatctaattttagaacattttccttaccctaaaaaggaaccttatacccattagcagtcactcctcgttctacctgttgttgtcattgtcatcctgcccccaccccccagctcctcctttcctcctttcttgccagccctaggcaattaccaaccactaatttattttctgtctctatagatttgcttattttgggcattttatataaatggaatggtacaatatgtggtcttttatgactggcttcttttacttaccgtaatgttttcaaggttcatccatgttgctgcatgtatcagaactttattcctatttattgccagataatattccatcttatgggtataatgcattgtatttatcctttgatc

SEQ ID NO: 31213 - DNA, 1029 bp, Homo sapiens
ggtaattttttatagaatgtttagggagtgaatagttaatggaactaaatagtcaggctgagattttgtagttttggaacatctatgaactctaaccaaaggtaaatattgaaagcaaccctttcctatagggttggcatgcttacttctgccttgtagggcagggatcaagaggtcatttatcctaggtgtgaaatatactgtggttttagaagtctttaactgcaggaaggcctccagatgagtaagttacaccatttaggtgttgttctcagcttgtgtattccctgtactagggaacacattctactgatgttgtgtttattctgcctttctagttgtaaaagaacatgagaataatatagttctcaattataaaatgctacttgcaaaatgactaataactaataagatagtatgttaatttctcctcttttttctggagacagggtcttgccctgtcgcccaggctggagtgcagtgatgtgatcatggcgtactgtagccctgaattcctgggttcaagcgaccctactacctcagcttcccaagtagctgggactacaggcaagcaccatcatgcctggctaatttttaaatttttttgtagagatagggtctccctgtgttgctcaggctggctttgaaattctggcctcaagtgatccttcactttggcctcccaaagtgttaggattggaagcatgagacactgtacccggccttctttatatgatcctcaaatgagtttttggggagcaaaagtgtgggagggtagggaagagaaaggttattttcttctatttcaagtttgtggttaaatggagacactagaagaggtgtcagtagttcaactcgaaaatggtataagtgccagttattgggttaatgtgtttataatgtcctcttacagtaaaattatgtgtagaatatacatatgtaactaacctgcacattgtgcacatgtaccctaaaacttaaagtataataataaaaaaataaaaaataaaaaaaaagaaattctgtttc

SEQ ID NO: 31214 - DNA, 1022 bp, Homo sapiens
tctcatcttttgattcttttggaaaacaacttctattttatcatgagtagtagtgaggatataatagattgaactgcttatttatagtgcttattttgtttatgggagagtaccaagaattatgtatatcattactattaggtgttcaacgacctttttaaaattattgtgaaaatgctcaagcaggctgggcaaggtggctcacacctgtaatcccagcactttgggaggccgaggtgggtggatcacgaggtcaggagatcgagaccatcctggctaacccggtgaaaccccgtctctactaaaaatacaaaatattagccgggcgtggtggcgggcgcctgtagtcccagctacttgggaggctgaggcaggagaatggcgtgaaccccagggggcagagcctgcagtgagccgagatcgcgccactgcactccagcctgggcgacagaacgagactccatcttaaaaaaaaaaaaaaaagaaaatgctcaagcatacacaaaagtagaataatgcaattagcacaccccaatattcctattactcagactcaagaattagaataacatgatttcttagtgactgaattcgccatatagcacacggttgagatttccgaaaagttggcaataagtacccagggattttttgtttttttcagatggagtcttgctctgttgcccaggctggagtgcagtggtgtgatcctggctcactgcagcctccacctcccaggttcaagcgattctcctgcctcagtctcccaagtagctggaactacaggtgcacgccaccactccaggctaatttttgtatttttggtagagatggggtttcgccatgttggccaagctggtctcaaactcctggtctcaagtgatctacctgtctcagccttccaaagtgctgggattacaggcatgagccactgtgcctggccagtacccagagatttttttaaagaaatgagatggcttagataattcatttacttaatttaatgcttatgctgctgtcct

SEQ ID NO: 31215 - DNA, 1044 bp, Homo sapiens
gcatagtcctcagaagaattttttcttctgttgctgaatagagcttctagagggctttttgcaggagtgaagagaatgaaatagttgacttctctatcccagctcctggtttaataattagacattccgggaataactgctttggcagaagtcagctacattttattttgacagggagagtcttttgttttcccttttcttcctgttccgtcatactcatggaagaaagtattcagaaatttggagtttttgtaacatatttcactgcttagggctataatgtatggtaaaatattccttaaaggtcacagtgagaaatattttatggtggagagattattggaaagaccagcttccagtataacccagacagtatctacttgggatatcttaaaattaaagctatattataacttcttcagatttttattctatctttggaatggggagctaacactgcagagtttaaaaaaggcaggagggtgcagggcgtggtggctcctgcctgtaacctcagcactttgggaggctgagatgggtgaattgcttgagcccaggagtctgacaccagcctgggcaacatggcaaaaccctgcctctacaaaaaaaaaaaaatgcaaaaaattagccgggcgtggtggtgtatgccttgcctgcagccccagctactccagaggctgaggcaggaaagtcctttgagccctggaggtcgagctacagtgagccgtgatcatgccactgtaccccagcctgggtgacagagcaagaccctctttcaaaaacaaacaaacaaacaaatgtgggagggcattgaagcagagagaccaaggcatgcattccaccttagccattaaattgtccctggcaagttattaaaaatctgtgatcctcgccatccccatctggaaaatggcagtagtaagcccaactttgcagggtggtttggagaatgaggggacatttgtaaagctcacaatgtggcacatggtgattgctcaatacatttagataaatattaggtcccttccccagcctcctccagtg

SEQ ID NO: 31216 - DNA, 1072 bp, Homo sapiens
aggcaacctaacagcttcatactaatgaatggcctggtatagtactgagatgacccatattggaggggaaaatacactgaatataccatcccagaagtccaagagaaaacaattccttgagtcatctttgttcacagatatgttgatttacactacctatgtgtctagagagtcagcaaatggttgcagtaaaccatttccaagttgtctgattctggtagtcttcatgtcaaccttctgaattctgactggtgcccacagagcttgttcgcattacagaaacatggttttttttgtttgtttgttttttgttttttcatttatctcgttcccattcagtaatgggtaaatggttgtcttttaataattttaatatttcagttatatagtacataaatccatgtgtctttttagcaacttaattatcatgagactagaactttgcatcttgtgtttcaaaagggaagtgctgaacaagaagagaaacagtataaagcccaaattcaaaagtattacatagaagaccctatgagataaaagtaaggtcatatcaagagtgtagttttcctgactataaatgtattatcttgataatatattacactcaagattccaccttgcttcagtagtgaaaatcttataatacagctaagtacttttaacttatttttttaagccggcattggaagagaaaaatgtttttccattttatcttaaaaatctttttaataaggtattttccaaaatctctgttgcccatgagctagcaattctaattgctatgtcaagggtaattaattttatatactctcaaagccactctaatccttctatctccagattgcaaaactttgcagaacagcggctcccacttcaccttcatgaagcaaatttccagtctgctgagtacttcagcatcttggtacattaagtttctatctgtttgaattgatcaggaagaaactagcaggattattggccaacacatgacagtctgttaccatgagaacaaggcaagataatcattttgatcccagaaaatccaggaattcttaggtcaggagcatatggc

SEQ ID NO: 31217 - DNA, 1109 bp, Homo sapiens
aggttttgtgcttttgcacgacatgtgtgtctcacatcaattccactctgtggataatattatccccaaaccagggatgaaggatgaataactgtctcaggttggtaatctagttttgatagagtgagggattgactcttcacgtgcccagagcctgtgcccctttccctaccttggtagacgtcttctggattttccaacccctttgtctttcaggagcatctttgggaaggatttgttccaaaggatctatactctggtgctattctgaaacaagatgacagtttgtttttttcttggtttctcttctaaaaatttagattttgggaactggaaatccttattagggcatttaaaccatggtatttatttgtctgcaatgcactttgaattcagctcacattctctcaccttatctcacaattgtttcctaaagtgggtaatgcttccttaaacatgtaatccttatttatgtctgagaataagtcatcaccacaaacaggtctgtgggtacctatggaaagtaggtgagttggagatgacccagtaaatgccccttgacatcaccagctaaggattttctagaaagctcagtattagaaaagtattgaacatttgtttttaccaaactccaggttctcaagaagtagctagataagcttctcatacataaacatttatatttccaatgctatctgggagggaaaaagaataaaaattaaattaaaatgaaagccacttcaatttcggtccatgattataattttattcataccaacatttttaaaggtttaagcatgtttaggaaagtggtttcttcttagatcgggaagaaatggcagcccttttgggaaaggccggtctgtggtaaactcaccagcaaccagggtggaagtgccagaaatattcgcgggaagctgatgattctgagattcctagtgtgattctgaacccaggagaatttacttgcattggaattattgcatcatggaatgaaaccaaaaagttcattatttacacttcacacatttactttttttaagatctggctcaaaggcactgagaattatgttgtagattagaggcatccagttaattaaatcacaagg

SEQ ID NO: 31218 - DNA, 1040 bp, Homo sapiens
tgtatctactaaaaatacaaaaattagctgagtgtggtggcgcatgtctgtagtcccagctactcgggaggctgaggcaggagaatcgcttgaacccgggaggtggaggtagcagtgagcagagactgtgccactgcactccagcctggcgacagagcaagactctgtttcaaaaaaaaaaaaaaaaaaaggaccagtatagtaccagtatttcttttaaataggtgtatttgtggctgataaacaaatttcattcttagtgtacttacataggtcaatacaaaaaggattactctgcaatatgatggctagagctcttttaaaatatactaagtattttattttaaaaactgcacaaaattcttgaaatcaatgtcatcttatgcttgtatgatgatgaaactaatgtactcacattagtctgcctttccaaagcttctcctcatctatatattggcttgactcagcttgttctctatgtggaaaaggacacattactacgtatagtgatttgttagtggataatcacagaatgactgatgctttgttgcaagtatatggcctatctgacacttttcctctgtatcaagacaagattgttgacccaatatggaaaggcagaggagtaggaaagtgatgctggatgaaaaatagaagttaatccctgaggggtgttaggttactgatcttagcttgtttctcttcaagatttacaagttattagcatgtttactatgagctctttgcctatgtgtatattgtaacattttagcataatactaaaattcagtttccacaacatgttgaaaccttgtatacagcaatgttttcttctcatgaaagctaattttccaaaagatgctatttccaggtttcagttcagttagttgtttttaattttgagaaagagttagatttttaaaagttagattttcaagttgcatttcaaaacaaattcgattttttcccatgggtattctatcacttaagtgattaatgaatttctcaatcactcatctatttgccaaatgcttattaaa

SEQ ID NO: 31219 - DNA, 1065 bp, Homo sapiens
ttttgccacttttaggagagctaatgtctataatttttccgcagctatagcttttaggtatgaatacattgttatcagtacttgcttttgttttgttacaccacaaaagggacaaagtttcaaagttatacgaatttagaaacaatttcacattgagtcttgggttactctttgtaactactttctgatattatcagaggaaaataatcatacaactttagtcctttatgaaaatctgtttttaagattatttagcagaagggccagtaatagggagagctaagaggatacggtgctcaaggtgctctcaaactgaggtgttaaatacatattcacaaataactcaaaaataaccactgttagaagtcggttaaggaatcaggagacccaccagctacttgtttgcctttttaagtacatgacttttaggtttgaagtcatatttcatctactgagcttgagggaaagatgaccactttgaaggtaatcagggaagtcacagacacaactattgtgtaattcaaaccaataaattttcccatgatctcagctttttggctcattgcatatttaggaatagtagtgttgataacagatggagccatgagaaatctttagtgtctgaccacagatttccactggcctaagggaagttactttaaaaaatatttcaaggttttaaattcatacattaataaatgctcacaaagttccaatgatgttgtttcattaaacagcaaatatcttccagaaacagggcatttcaaaatacagtttttgtttaaaaaaaaaaaaaagcatttatggtaaagctcagctgacagtctgtggacagatgcacaggttccaataaaattcaggaccccaagggtttccccagctcttgaattatttaaaatatacacgtagtgttgtagtagttaagttttaaaacggtgcctcaaaactggctagttaaggtacattatttacgaaaaatatattgtggaggtgatttttcaccatctcaaatgtctgcggaaaactgtagcttggttatctagcagtggtgaatgagttgattct

SEQ ID NO: 31220 - DNA, 1066 bp, Homo sapiens
aattttctgttagaaaaaaaattcaactctaagatagtaaaatatattttgtcattagggaatgtgagaataaaggaatagttggttgattactaaagaaaatgtcatataattaatgagaaatataacttaaaatatcagataattgatataaagaactgctctcagtcttgtcaagaagccaggcacataaacaattttactttgaataagacttttaaaaattttacaaagttttataaaaagtagtacattgaggccagaaatggtggctcatgcctgtagtcccagcactttggaaggcttgggggaaggatcgctggagcccaggacttccaggttgcagtgagcaatgattgtaccactacactccagcctgggatacagagggagaccccatctctaaaataaataaataaatgaaataaaaaattaatatattgcatttcatccattgtgccaccatgttagaaataatattcttcaaatttatgcttatagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaaggtgatttttgtaatttttatttatatagtaatgaggataacattctttaaaattcatgtttttgtatttttaattttgctagataaaacatttttcttttactagctatatatttatgaaagtcccaacccagagtttttttgttccaccaggtccagtccgtgggtctagtgtcctcaacctttgtctgttcttagtaggcaaatagatagaaagtggtgtagtttccttttttaatttaatttaattttttttctagtgcatttatttatttatttttctaatgaattattttttattttattatactttaagttctagtacacaacatgcaggtttgttacatatgtatacatgtgccatgttggt

SEQ ID NO: 31221 - DNA, 1035 bp, Homo sapiens
tcacctggtacagtaatcgaaagcaggacattaacattgatacagttctagtaactagattataaatcttatcagttttctcataacgttctttttctgctccaggatccaatccaggattctatattgcatttagttgttaatctcttcttagtctcctccagtctacgagagttcctcatccaaagatgagtctgtgcttgtctttcatgactttggcacttttgaggaataatggtgtttattttgtagattgcccctcagcctgagtttgtgtgatgttttctcgtgattagagtgagctatgcatttttggcaagaatacgagagaaatgacattgtgtactttttattgcatcatatcaaggggtctgtgatactgctatgtcatagtggtgttaaccttgatcgtgtagttaaggtgccaggtttcgcctgtgaagttactatctttccttttgtagttgatagatatcttgggagagatattttctaactataagtattctgcgcatctcctcaacctttcacttactaactttagcatctctcagtggtttttttctgtagcagttactttggggtttgcctgatgattcaaattaatttttgtgtatcatatgagatagggggttaggttcaattattttcttcatacggagatctaggaacatttctttctttctttttttttttttttttttttttgagactgagtctctattgccgagactagagtatagtgacgcaattctcatctcactgcaacctctgcctcctgggttcaagtgattctcgtgcctcagcctcccgggtagctgggattacaggtgcccaccaccacgtccagctaatttttgtaatttttggagagatggggtttcaccatgttggccaggctggtcttgaactcctgacctcaagtgatccgcccgccttggcctcccagagtgctgggattacaagcataagccaccgcgcctggccagtctagccctattttcttactgagtagtcttggtacctctgtcgaaa

SEQ ID NO: 31222 - DNA, 1077 bp, Homo sapiens
tttttgaataaaagattcagtgattaatattgaataaaaggttttatggagatatataatactgacccaattaaatatatatatatatataataacactattattttgctattttgctttaagatgatgcccttgcagtttttaggtattttaaatcagttttaaggctttaaagtcaaaattcattgtttagatctaaaaggaatattgtaaaaattaattagttgaccttatttccaaaaattagtagattcagaatactgaagttcttagttggcagaagaactctattgtctagtgacaaaataggtgactttttctttttctttttttttttttttgagatggagtcttgcacctgtcgcccaggctggagtgcagtggcaccatctcagctcactgcgacctccgcctcctgggttgaagcgattctcctgcctcagcctcccgagtagctgggattacaggcgcccaccaccatgcctggctaattttcgtatttttagtagagacagggtttcgccatgttggccagactggtctcgaattcctgacctcctgatctgacctcgtgatctgcccgcctcagcctcccaaaatgctgattacaggcttgagccactgtgcccagccctagatgattttttcatagacgttttttctcaggtttttaactgcagtgccattttagtgtttcacatcttgactcacattggagccctttgttgcccagatacaattagggaccagatttccacctgggatggcaaccacattgtggggacctctagttgggggctcctgaattgactgaatgtaccctttgttgcttagctaagttagagctacttttctgtttttcagctaagtttccatgttgtgcagagaggggctatgacctcaaatcagctgagtggatgatctgtccatgttcaatttccatggctcctcttcactggtatagataaccagacagtgactgcacttctttatgcaatatttagcacagtatcaagttggagactttcatatgtgcttttggttgaggtgattttgttttggcagtaccaaatttct

SEQ ID NO: 31223 - DNA, 1043 bp, Homo sapiens
catgagccaccacacccagccattatttttaaaggaattattttttctgagcagtaggtctcaacagtgagcttaaaacattcagcaaaccatgttgtaaacttacatgctatcatccaggctttgttgttttatttatagagcacaggcagagtagatttagcataattcttaagagccctaggattttcaaaatgggaaatgagcattggcttccttttaaagtcgccaggtgggttaactcctaataaaagagtctgcctgtcctttgaagctttgtagccaggcattgacttctcctctctacctataagacccagatgacaccttcttcctatggaggctgttttgtctgcattgaaaatctgttgtttagcatagccaccttcatcagttatcttagctgtatcttctggattacttgctgcaggtcctctatcagcacgtactgcttcaccttgtactttaatgttatggagatgagttcttttcttaaacctcatgaactaacctctgctagcttcaaacttttcttttgtagctttctcacctcttttagcttttatagaattgaagagaattagggtcttgctctggattaggctttcgctcaagggaatgttatggctggtttgatcttctattcagcccactcagattttcttgctgtcagtaataaggctatttcattttcttatcatttatgtgttcactggaatagtacttttaatattttttgagaacttttccttcgcattaacaagttagctaacttttcagtgcaagaggcctagctcttggtcttttttggcttttgatatgccttccttgcaaagcttaatcatttctagcttttgatttaaagtgagagatgtatgactgttcttttcacttgaatacttagaggccattgaagggttattaactggcctaaatttcaatatcgttgtattccagagaatagggaggcccataggagagaaacagagatgggaacagttggttgggggagcactcagaacacacacatctatttaagttca

SEQ ID NO: 31224 - DNA, 1046 bp, Homo sapiens
gctgggaccacaggcacatgcacaccaccacacagagctaatttttgtgtattttgtagaaacagagtttcaccatgttgcctaggctggtctcaaactcctgggctcaagtgatccacccgccttggccttccaaagggctgggattacaggcgtgaaccactgtgcccaggtatgttttctaaatctagctttaggtggttattttagggaattgcagttgtgaggcacttattgctaaacttaaatgggcaaaatgttaatatttcactcaagtaaatcctttttatgtttcataagtttgtgcagaaagtatgaaaatgttgttagaaaatgggacagtgttctagaaaaatggggcagtattttaatgttattttgttggctttcatctgtatatttaactacactggtaaataattagatatattaatatgtgctagttataactagaaggaaaatgttactctaggattcctgtgtacttcagtttcttcaagcatatggacataaccaagacagccatgcacattggggcttggcttcacttgctgttttttggatctgtggtacaactacgtcaggaacctctggttagcctctttgaaggtaagaaactagggagcaaaggcgagacattctagccaagttccctaaaagctgtcagtctacctaccatcagacttgtgagtgagggagggtatcgtagacctgggtttagcaaagtcagattaactgttttatgcctgtttttgtaaataaaattttattgaaacacagctacactaatttgtttattgtctgtggcttccctctacaatagcagcgttggatagttgctacagagacctcatcccccgctctccactgcaagcctaacatttttattatctagccctttaaggaagaatttgtggactattattgcccttgatcatttagcttctaccaccatcaaatgactcagctgatccagctaaccacaagaattagtcatacccactgagcctggatgaacctccagttgatctagagaattgtgtgaa

SEQ ID NO: 31225 - DNA, 1035 bp, Homo sapiens
gactagattactttctcattccctttgcataaaattcagaatatgtgtatgctttttgttggaaaattagtgataaaaatagttcattttatacaaatttcctttatgagatttcttagatgttatcatcatagtttgagaaatacaaagcaatgtaaattttaacaaaaataccttatagtgttattgtaacttatctgttagttgtaggtattctattttgttgggaagaggagaaaatgacattagtttctaatattgggataatttaggtacatgtaaaacaaatcagataaatatttaagtgagtttattaagaaaaatattaaataattatgtagattttagaagacaggacacaaattgagaaagtagtacatgaatttgtttgtttattcattcttaacaaatatttgagtgcatttttttgtgaaggcactattctaggcacctggaatattattagtaaaagaaactgcccttgcagagcttacattctaacaaggaggatagtcaatgaacaacaaatataataaataaattttatagtatgttgggtctagtacaatgggaaaaagaaatatagaacaagttatggagcattgggagttcgggaggttgggagagagggcaggtttcagtgtttaacaggatagaacagttcattaagttcataatgaaaagaagacatttagcaaagatatgaaggaggtgagggaatcttagatgtctggggaagtgtgttaagatgataggaagagcccatgcaaaggccaaacgtcaggaagatgtctgatgtgtttctgtcttctaaatttttcaagttaattacaaatcatttattaaattcataatgtgaaacatgtaagtgacatttaatgaacaagctgattttacaaatactttttcttaggtgatagagaaactccctaattggcttatgagtgggccccagattataaattttactttaaatcccttcgtaattcactggactggtagaactttcaaggatttcaagatatcctacgtctt

SEQ ID NO: 31226 - DNA, 1070 bp, Homo sapiens
ttaaaagagtatttacttttcacgatacaaattatacactaagtttatttaacaaaatctgcttactgtaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtgggtaagttggagcaaatcttatctggtaaggacttggtgattccatggcgatgttcaaactaaatttttgttctctgaggtttttcttgtggcttatttgctataagagtagaagaaaatggaataaaaagagagaatacagtagagaaggaagaaaggataaatcaaaatagttacctcagatttttactgtggtacattttcatttctatttttatttaataataatataacaatattggaatcaatataaacagcaatatcaaagtttagtatgtaagtagaggaaaatttgcctaattctgtaggaaagtttcatactctgtttcctttgttatgagtatgaacttaaaatttgtagactacttagtgattaaaaatgtctattaccatattgtaaagctgttagcggaaaagtataaagttgaaacagaaggaggggaccatgtgatttactattgtttaagccttttttagtatagaatgggagcttgggcaatattagggtatgtgtgtgtttgtaagagtgagtgtatctgcttatgaggtccagattttatttttcatagaattgatattattaaaacaatgagattctagttttgtccatttagagacagaacttgaaatccactcataagtgtttgtcaaattagaaaacattaaaatgaaacaatcttttttaacagagtaaatttacagcatcttgtttgttttattcaaaattgtaattggggtcttttattctaggaagtagaatctaatcttggaatttatcctcttttgtcagtctttcagtgtcttgtgtgaatatatttattgtaat

SEQ ID NO: 31227 - DNA, 1032 bp, Homo sapiens
tttcttataaggcttccccctcctacgtgctctttgcctttcttctttggaatgatgcagcaagaagttcatcatcagatgctggcctctcaatcttggacttcccagcatccagaactgtgaggcaataaatttttattcattataaactaatgacccaaaccattgcattctgttatagcagcacagaatgcaccaagacacctactaaaatgctttcttcgtaatttgaataactttagaattcattaggaacctaattttgtatttctaagtgtgcctttcttcatgacctgctaccatgaaaagttttcaccgttattatttcctcattggattttcagtagatggatgctgttctgagaaatgtacccaacaagacttttgggatattttactgaaatacttgtatttatacattcttccatttttctttgtataattttcagaagctttatactttttgagagaggtaagaatttgcctctggatatataatttatttttctataatatggggatggtggtacttaaaaagctgtaagtattataagcagtgtgaataagaaaactagtaccatgtagtaatcatactttatagatatatgttagttatggctttaaccttggcaaaattccagtgtcttcagttttagagtttcatgtaataaattcctgtcaataaggggttttgttttttattccctctacctagtgattggtagaagatgttgggagtgatttgggaaagctggactctgagttttgacagcagttacatacttatagagtctgtcatatttttcctaacctgttatttatacagcaggaagtaatttatgctaatttacccctatttgcatataggttatagagttctgtggtgcagagcatgcttagaactccttttaagtgtctgtttggatcaaagcagggctgtgtgatagctgttgtctgacaccaagctgtgtggtgttgttttcattaaacatttatcacacttccaatgtgacagcaggcaactttgtgcca

SEQ ID NO: 31228 - DNA, 1187 bp, Homo sapiens
tctaggagagatgtaatagtagcttgggccagggatttggcattggagatggaaagaagttgctgaatttgagacatatttatgtatttaatgataggtttgatttggtaaatgagatgcagatgttaaggataaccattagttttctgatttatatcattggaacaatggtgagactttttactgagcaaggattacattggaagatggcagggtatcatacatttgctttggacatactgagtttgaggatcttttgggactttcaagaggagaatgaaagtagtcaggaggatatattgtaggtgcagaactcaggagagttttaacatggtctcaggttttcaattccgttttattcttaactctttaggtattttacttggaccttgatgactacagaaacctataaaggggaggctgcagtaacccaagcaatatcttccatatggcaagattaaatcacagtgactgctggatgtgacccatgggccacaacaaagataaatgcattgtgccatggattactttggatgctgttaaaatgtgtctggcactattgtagttactggagattgcaaagatgaataagacacggtctttgatctcaagaaacttccatgtagtttggaagccagacacacaaataatgataacaatgtagtaagagtgctgtgacagaagatgcccactatactaggggagcatattgaaaggacacttaatccaaaattagccagtcaaggaagattttctggaggtgttgacacttaaaccatctggaagaatatggaagaggaagtgagaaggaaagggaaaaacagaaggattaaaaggagagggattattatatgtttaggaaaccatttttattcctcttttttggggagtaattacctttttattgttagacacagaaaataccttctggaaacaaggtgacatcaagcattgttggttcttcctttttttcttttgttttctttctttcattctcctcctctttttccttcctccttttctgaatagatgatatatttcagaatggaacattatataagggcttacatacagtacagagtcttatttacatcttttcccccatccactcaattcctattctttccctaaaaatccatgtaattacatttattagttttttagttatccttctagggtttctttat

SEQ ID NO: 31229 - DNA, 1062 bp, Homo sapiens
gtatatgtgtgtataaacacgtgtatatgtgtgtataaacacacatacgtgtatatgtgtatataaacatacgtgtatatgtgtatataaacatacatacgtgtatatatgtatataaacatatgtgtatgtgtaaacatacatatatgtgtatatatgtatacacacatacacgtatatgtgtatgtatgtatataaacatacatgtatatgtgtatgtatgtatataaacatacacacacgtatatgtgtatgtatgtatataaacatacacaggtatatgtgtatgtatgtatatatatacacatatacacacgtatatgtgtatgtatgtgtatatatatacacatacacacgtatatgtgtatgtatgtatgtatatacacatatacacacgtatatgtgtatgtatatacataattatattcacaaacacacattttttagagtaacctttccttgccttttaattgtgtgtgtgtgtgttttttgttttttttttttagagctgtcaaattttaaggaggtaagtttctggttgtgattgaaagcactgtgtgggagttaatatgcctagtcaaaatatttttgaaactctttatttgatacaatttcacattaacaaagaagttgcaagaagagcataaagaacttgtatatgccctttatccagactcatcaattgtttacattttgccccatttgctttatcaaattctctttgtttctcttgactacacacatgtatatttgtctgaaccagtgaagagtaagttgcaggcaccagtctctttagccctaatatttctgtgtaagaattttttacatagctaaagtacaataatcaaaattaagaaatttaacatttgtacaatatgattttctaagccggagttcatagtccagcagtccatggtcccagttaatgtcatattcctattgatgcatcaatcacagctccccttcacctaggatgcgatctaggatcatatactgcagttagttgtcatgtctttttaagtttcctttaatatagagcagtatctcagtttttatttgtct

SEQ ID NO: 31230 - DNA, 1049 bp, Homo sapiens
tttcagcactgatgatttatctctatattaatagaaagctaattgaaaacagcttgctatatgtttttgtttagtactttggctttatgtaattttaccagcatatgttttgctaaattcttaaaatagtagtctaaaatctacagtgcatttttgtgatttatatttactttaaaaagatatatatttaaaaccataaatggcttagagaaataaaattataactgatcaaatcttaacatttagtttaagtaaacttaatacattttatcgtatctaacaaaaagtagtcccatatttttgacaattcttttttcttatcagttccttttcacaaaagtaaatatatgggaaattataagaaaagcatgttacttgacaggtggggatagtcaccaccatactcacaagaacatctgtgaacacgttgcttgaaattagatgtttacattgaaattgttgactatacgctttctataaacaagtatatagaaccttgggtttcagtgtccaaggacagtgctctagagatacgtagaagtgaactatggcttgtattataacacctgctcaatatcttaagttagtattgaactttaagaatgaagtcatgttttagcctatgtctggggagcacggcataattttagataatcttgccctcctcagagagaatggtagtcactgaatctaaccagataatgcttggcaaaatgatctactcataaccaagtaatcacagcacttcaggtgagaagctgggctcagtaactcatgcctctttacaaaaatcagatttatacttatatgacatgtttttactacccatgaagatattttaaatgttttggttgtccttggagtggtgttgcatgaagctttgagcttcgtcctcagtgttagaaaaagaatgtttctaattgactaaaggaaacaatgttgattgagttactgaatgaataattaaaaaacagaaatggaatccagtaaattgtgaccctctcattcttttcctttcagcaatgtgattgtgaccttaaaaaaagaca

SEQ ID NO: 31231 - DNA, 1047 bp, Homo sapiens
ggctacccttttcttcacatactcaccagcatttgttattgtctgtcttttggataaaagccattttaactggggtgagataatgttttgttgtagtttggatttgcttctctctgatgatcagtgatgttgaatggcttttcaaatacctgtttgtcacttgtatgtcttcctttgagaaacatccattcaagtcttttgcccactttttaaatcagatcataatatttttttcatattgaggttattgagttccttatatattctggttattaatcccttgtcacatggatagtttgcagatattttctttgggatgcagatattttcccaatctttgggatgtctctttactttgttgattgtttcctttgctgtgcagaagctttttaacttgatgtaataacatttgtccatgtttgctttggttggctgtgcttgtggggtattagtcaggaaatctttgcccagaacaatgtcctggagagtttctccaatgttttcttgtagtactttcgtagtttgaggtcttaaatttaagtctttcattgattttgatttggtttttgtatatggtgagaaataggagcctagtttcattcttctgcatatggatatccagttttcccagcactgtcctttctccagtctatgttcatgacacctttgttgaaaatgagttcgctgtaggtgtgtggatttgtttctgggctctctattctgttccattggtctgtgtctgtttgtctgcaagtaccatgctgttttggttactatagctctgtagttttattaaagtaaggttatatgattcctccagttttgttctttttattcaggatggctttgggtgttctggatcttttgtggttttatataaattttaggattttttttctatttcttcaaaaaatttcattggtattttaagagagattgcattaaatctgtagattgctttgggtagtatggacattttaacaatattgatttttccaatccataaacatgaaatatctttccattttgttatgtcctcttcaattt

SEQ ID NO: 31232 - DNA, 1048 bp, Homo sapiens
atttaaaaaatggaattccttttggggagctagcactttacttgattagggttctaaattaatgttcattgttatcagaattgattacaaacatttatcttttaatgctgatctgtaatgagattttaaacatttcacctttgaaaatgtcttcacacagataggtattgccaaatttgattgcaatctatgatcatattcattgcttgaaaggcatttataaaattctgttagattcttttcttgatttttgtcttttagttattatactgcagattaatcacttccaattgaagtagaagctcctcaattgtgcagttaagtggacttgtgaatatggaaattttctttacacttgcattaaaggcagaaaaatactgctggaagtgtaatttgaggtcaaaaaacatactccttgaaatgtgtgttggaatgaatatcttctttaactttgacagcatgggaagtatataaagcagtttgacattactttgtgattcaagcaacatcagttgttactgaaatggctttactgttggatgaattttgcatataagcaccattttgccttgtaattttaggttgagctcattaaaatttatttttatttatttattttttgttttagagacagcatctcactctgtggccaggcttatatactgtggcaggatcatggctcactgcagcctttggaactcttggactgaagcaatcctctcactcagcccccacctagtagttgggattataggcatgagcccctgtgcccacctaaggagcatttttatgtctactgctgaagctaaaagtggtttaggataaaagtggttgagggggttcttctcagtcagaaaaatttcagtattgatccctaatgtgaaacatcacaactagactttaccactgttaagccatcaaactgctgccatgtgttggaataatcaggatattcagcatctgtatctgtcaaaaaaatcatacaaccaacaacggacaagtccacaagagcaagtgaggttcactgttgacacttctgattaaatac

SEQ ID NO: 31233 - DNA, 1027 bp, Homo sapiens
gcctcatggaagaaagctgccctcctcatactggtacacatacttggtacacagccagtgctttgcagttttctggagggagatgcagccatatccacctccccacccccagccctgtctgtgcttatcaaagagcttcatgtggtaacaaagcaggtttacctaagcaaataattaagttgggaaatggatatatacatagaagccacataaaataattactgacaatcaagtgccagactattgggagttttctataagggcaatgcatttgaccttggtatccacagatttaatattctgtctattcaaagtgatgtggcctgttttatgtgacaatttgtaacttttgtgtggcatgacttaaagcctatgttctgagaggatgctgtgaaggagtcatgtaacttagccaatgaataaagcctactaactgctcagcactgtatctcacagtggctttgttttttctgatgttaatgtattgaacaatcctcatcaaaggtctgtgtagtaatggtgatgttgacaataattagtaatatttgctaaatgcagtatgctgagcactttacatgcattattgcattttcaacttgggacatttgcaaagatcttagcgcttacccattaaatgtcaggaaggactgtaagtttagagattaagaaattgttatgaacatagtcatggtgggagtttaattggttcttgtacaataaatataagaatttgcagattttgagaagaagagaatcttgttttaggtagatgaatggatgagcaaaattatggaggtgataatgaactggtttgagaagagttacatattggcagaaaattgttagccaggtaaggtagattataaagcaggcaatgacaagaacttgggatatgaagacattgatgttagggagaaggtattggaggacttttggtggttagtgataggagccaaaactaacatagacaaagtggggatacattattgaagagttcaccatttctgtttgcctcgtgcattgcaaa

SEQ ID NO: 31234 - DNA, 1050 bp, Homo sapiens
gaaagggaatgtgccaagaatgatgactagttttctctcagccatgccattcaaaacattttataaatatcttttaatttaaagaattacttagaaacatggcaaagcaatagcctacattgtctttttgttttaaagagcagtttcttgtcctcattctcaaatacaggtatctcagaaaattaagtgattttccctaagattgtggcagacacagttgacagcaaacctaccctgaaatgaagctatttacagtctttgtttatcccattttgtgtgaacattaatatctttctttcagaattactaacgtgtatgatgatgagatgctgcatcagaccctgctggcaccattgtatgacataccttaacctttctaaaatctgaaatattctgataaagcatgtctagccccagctatttcagataataaagtatggacttatactttgaatctgatcattttcgttctttatatattgcaatattattttctaataagaaccattttgtgacaatgtagctgtgcgagaaagcgaagtagatgtgtattatatagcacagactctaagatagattgccaagtgaaggtacaaaacagagtgtataatatgcttctattgtggatttcaacaaacatagaagggagaaagacacacacacacacatacacacatacacacacacgagtgcatatcttcagaaggattaaccaagattgagaactgggagtcagtgatgggaggaagacttaattttattttgtgtgtgtgtgtgtgtgtgcatgcatgtgcacacatacatatatgttgccctgttcagatgtttcactatatgttaatactttttggtttaaattttaagttatacaaataactatatttgaatgttcttgtgaaaatgtaaagattcatttgacttccagctccgataaatgcattaattttgtaatgataaagtataaaataattatttatatagatagtagccttctctcacaccttgcagtaatttattcttatcatttgtcagtaggactgcagacattag

SEQ ID NO: 31235 - DNA, 1025 bp, Homo sapiens
aagaaaagtagcacagagaatgggtgtcttacaaataaccattgcaacactacagaaggatttaaaaagtgggaagtattattttaaactgaatcctaaaagggtcaggaaagacatttatataattgtttaaaataacgtgttttctagaacatcctgaaatgttaatgtttatggactaaaaaatgtgctgatacttaaaattatggcagcaaaaaaagaaggctataaagatgctaaataaaagaagatactaaagcagggtttaaaactatataaagtttatttttattatgccaccacataccttttcattttagaaaaaatttaggaacctttgaaattatttgaactttaccttttaaagtataaacaactgttattgagtctaattttattttaacctctgtgtcatgtctaaaagtattagtaaaaataactagttttgtgtgaaattattttaaaattttatagaggtctaatgtcataagtaactgatacatattaaaagctgtaatttcttgcttttatgggagaatctcttggtttagctattttaaaaaggtctcaatttctaacaggagaattttttttttttttttaagatggagtcactgtgtcgccaggctggagtgcagtggtgcgatctcagctcactgcaacctccgactccctggttcaagggattctcctgcctcagcttcccaagtagctgggattataggcacatgacaccacacccagctaatttgtgtgtgtgtgtgtgtgtgtgtgtgtgtgtgtgtgtatgtgttgtgttttagtagagacagggtttcaccatgttgtccaggatggtctcgatctcctgacctcgtgatctgcccacctcagcccccacaaagtgctgggattacaatcatgagccactgcacccagccactcaaaggggaattttaaacatttctgcttagtggcataatgtgtagccattacaaatacattgtgatttggtctgttgtttcttccatttcctgtttgtttct

SEQ ID NO: 31236 - DNA, 1053 bp, Homo sapiens
ctctagctctgagtcccagaagaaagttttatatttaactattgcatcgtaattgatattagtaaatgttaataatgttattggtttggaattaaaatctgtttcgaatatttagccacgatttttagtggtatgattctgaaaggcatatgaaggactaaaataagatttaaaaaaatgtacctatagggtgttatgattattatatcaaacataaatttgagtctgagattttattgtatttgggttaggaacatactttatatgtgctaaactattacatatttgtactttggttcaaaactttgaacattttctttgactcttttataggcgataattcacctggacttaattattctgattttgtgtaatttttttgtatttatccctttattgtctctcccactgccatctccttagtctagatgccaaacatttcactcatggcttattccattacctcctaattggcttcctgcttcaattctattacttctgtagcgagacactaatgaatagtggaaagatcctaagcctgccatcaccacttgttctgtaactttgagcagtttaatgtttattgtttagccagaacagagggtttttttaatcaaatatgacagatgtgtgtttttttctagttcattgaggtgaaatttacataacataaaattaatcataattgcttaaaatgaacaattcagtggcattcagtacattcacagttttgtacaaccatcaattctatctagttctaaacattgcaatcactccagagtgaaaccgcttacctactagcagtttctccccagtttcctttcccccaagcccttgacaaccaccattctccctctgtctccgtttgtctattctggatatttcatataaatggaatcctataatctgtgaccttgtgtgtctggcttccttcatttagtatgtgtgtgtatgtgtgtatatatatatatacacacaaacatacacacacacacacacacacacacaacttattaatccattgataaaatttgggttgtttctacctttatt

SEQ ID NO: 31237 - DNA, 1172 bp, Homo sapiens
agccataggagggtggaggcagcacagccggctgccttggggacacgggacacaggggacccactaccgttattgctggtcccgtagccacttctgccaccaccacccatgcctcccccactgtggacagcccattgctgccatcattgggtatcatatgttaatgccactcctttgctcaaaattactcagcggttctcagttgcttacaaaatcagtgttatgtttctatgcttaaggttctaaagttctatatggtagatccacagacttttctaactttatcttctagaattcattactgtgctttttccattggtcttcaagtttcccgtattcttttctacctgggaagctttgcacattgtttttctcttctataaatgccttctttcttccttttccccctctccaaacactccaaggctcttctaaaacaagatttccacatcttttccctgaccattccagtacctaatgtttctctcctcatttgaattcttttagtcctgtctttgcacaccatttatattgatgttgattcatacactgctgatattaatatttagttgtttcatgaatgttatacttatttttccaatgaaataaacttccaaaggtcaggaactgtatatttatccagacatggtggctcactcctataatcccagcactgtaggaggccaagatgggaggatcatttgagcccaggagttcgagaccagcctaggcaacatggtaaaaccctgtctctacaaaaaaatacaaaaattagccaggcatggtggcacatgcttctggtcctagcctcttgggaggctgaggtgggacattgcttgtgcccgagtgaagtcaagggttccgtgagctgtgattgcgccactgcactccagtgtgggtgacagagtaagaccctgtctcaaaaaaaatagaaattacatttaaaacttctacatctttcccagcagttttaacaatacctatagtagtactacatcagagaacattttagctgttaatcttttgtaagtaagtcattgtagagaaacagaggatctagctgtctgaaaaacatttagatgctgatgtgctcattttaactgctgtttgatggattttataataaatatactaagatgttacctagcttcaaaagcagaagatatatgaca

SEQ ID NO: 31238 - DNA, 1032 bp, Homo sapiens
gttatatacttcataaatattttctcccagtccttgtcttgcttattttcttaacaatgttttttaaaaattaatgatttgtatacagcaaaatgcaccttttttagtgacagttctttaattttcgacaaatgcaaatggttaagtaacagctctgagaatctaattgtagaataatcctatcattcccccaaattcccccataccccttttttgtgaacccactactcctgactcctagaaaccactgatctttttttttgtccttacacttgaatttttctgaaatgtcatataaatggactcataatatgtagactttgagtctagcgtttttgacttagcatcatgcatttgagatttatccacgttgttgcatgtatcagtagcttatttactttttattgctgagtagtattccattgtgtgaattagttaattgaaggatgctgttgtttctaatttgaggcaattatgaaataaaccattataactttctcaagttagatattgtgtgaacatggggttttgttctacttgggtaaatacctaagactaggattgctggcataataactttgtttaacattatgagaaactgcaaactgttttccaaagtggctgaaccatattttgctcccaacagcagtctataagaaatccagttgttccacatgcttgacaatactttgtatggttagttttagttttcctttggtcatttcagtgggtgtgtagatgtctctcattgtggtttcaatctgcatttgcctcatggtgaatgatgttaagcactcttaatgtgattatttaccataataggtcttctttgcccattaaaaaaattgttcatttttcagttgctgagttttaagagtttgtatattctgagtaaaagttcatgatcaaatatgttatttgcaagtatttttcacagtttgtggcatgttttcattctcttaatggtgtcttttgaagagcagctcttaatcatgatgaagtctaatttctcagtttttcttgtatgtattg

SEQ ID NO: 31239 - DNA, 1052 bp, Homo sapiens
tcttcaacatacctgacaaaaacaagcaatggggaaaggacttcttatttaataaatgatcctgggaaaactggctagccatgtgcagaaaattgaaactgaaccccttccttacaccttatacaaaaattaactcaagatggattgaagacttaaatgtaaaacccaaaactataaaaaccctagaagaaaatctaggcaataccattcaggacataggcatgggcaaagattttatgacaaaaatgtcaaaagcaattgcaacaaaagcaaaaattgacaaatgggatctaattaaactaaagagcttctgcacagcaaaagaaactatcatcagagtcagcagacaacctatagaatgggagaaaatttttgcaatctatccatctgacagaggtctaatatccagaatgtacaagaaacgtaaacaaaattacaagagaaaaaaaaagcccattaaaaagtgggcaaaggacatgaacagatacttctcaaaagaagacatttatgtggccaaaaaacatgaaaaaaacctcaacatcactggtcattagagaaatgcaaatcaaaaccacaatgagataccatctcatgccaatcaaaatggcaattattaaaatgtcaagaaacaacaggtgttagtgagattgtggagaaataggaacgctttcacactgttggtgggaatgtaaattagttcaaccattgtggaagtcagtgtggagattcctcaaagacctagatccagaaataacatttgaaccagcaattccattactggaattatactcaaaggaattactgggtatacactgggtatatacccaaaagaatataaattactgggtatatacccaaaggaatataaattattctcttataaagatacatgcacatgtatgttcatggcagcactattcactgtagcaaagacatggaatcaacccaaatgcccatcagtgatagactggataaagaaaatgtggtacatatacaccatggaatactatgcagtcataaaaaggaatgagatcatgccctttgcagggaca

SEQ ID NO: 31240 - DNA, 1762 bp, Homo sapiens
ctgctatatttctgtctatgaaaccacagataggaaagcatgtaacatcatctcccatttggaacattatattttaagtcttacttccacccccacctccaaccagaatggtaatattgtttgttctccttccctctaggaaaggagtcaagcctctactctcagtattgcatatagataagtctaatacacctccagccagattgttttagccatagttagcctactgatttctttgaaacaccaccattatacagattttaagggataatgcatatcagtttgttcaatacggtaagaaaaactgaatagaaaataattttatcctcattgttaatctattaaagggatgagggcactactcttaggaaacagaatgctggtgaagagcagaaccgttctggagctgaacaacctgactctgcatcctggccctaaggtcacttaataattttgtgaccctgagcaattgttaaacccctctgtgcctcagttttcttaactgtaaaatgagtatgaaaaaccatagagaaccatattaaatcattcattgaatcagttaatacatgtaaaatgtttagaaagatgtctggcacatataaagggtatataataaaggctgattattttagtggactgcgaattggcacataacgtgtattataacctagtctgcctccctgtgtggcaaaggctagaaagcaaaaatctacatgtttgataatcttttgtatctaaaattctggatatgagttaggtcccaccagttatgtgtattcacatgcagtttttttccacatggaattttgaaaatggaagtggtgtggtaggctatctacttgctgcttcagctgttgctactagcgagcacagctatggagacctgaggtatttctctagcagtgtgccaaacatctagccactagctttatgcaggtcgaaaggcaggtgcactagtagcttcttgatttgcagctgtagcaggttattcttgaacttctcagttcaaatggcagcctcctgatttctcaccgccctgagaggtagagggagcagcgccctagcaagctagttctgcagtgttgatttaggcatcattattagaggcacagcccagagctggtactttcagcccttctaataattttattattcatccaatttctggtgtttaatccacttttgtttaaaaaaatgtttgaattaaagagaaagcctgaccaataggaaaatgatatacacattagggcatttacactatgaaatattatgctgctgttaacaaataataaattaactctccgtcagttaacctggagagatttccatgatacgttttggagtgtgaaaaacaaagtacataaaatctatggatatgatttcagttatagtaaaagcaatagcaaaatttatgtatgcgtgtgtatacatgtcttgtattttatacctcttttatatagtctatgaaaagtaatttgaaatatttctcatataaacatttgtgtctcttcaatggatcaaaatataatgctgtcttttcatggggaatcaaaattcagctattttatctaaaaatatatagtaacttttaatgtgtctggaatctatatatgtgtgtgcatatatgtatatgcttaagtgatcttaaaaaaaaacaacaaaaataaatacaatagaatagtatccaacctgaaaatgaaggaaattgtgccaatctgccaataacatggatgaaacttgaggacattatgccaactgaaat

SEQ ID NO: 31241 - DNA, 1839 bp, Homo sapiens
cgggatcaactaattttatggtatactgagaaaaaaatgaatttcagtagcaagattcctcagtagaattaccttcttttggatctcttggcattgttaatgaaagcaagctatctgatttcagttatccttataatgtgcccatagtacaaacagacataagactaaatgcaaatgtgtctaagcaaattataatttttaagtactgctatgttgtgtggcattctgatcaatgtaactaattaataacataatggcccttataaaactctgtggtaccgtaaatcacgtgtatagtacttatgaccaagcaatacagtgaaaatatgttgtagtggttattagcctaatcctattaattcagatcttaattggaatcttaatcagttgaaaatgaatggcagtgagagtaatcacagatattgaaatttcaaggtgatttgtttttatgaaaaaaataatatgaatgcttatcttagcaaaagaaacttttttaatacttcagaactcctcatttacatgttgacagttgatatttctacagctctcttgttttcattaaattagctctaagcatcttttaagacatttgcttaagaatttcttaagtaactatagatacttgaacattataattctttgtaatttttaatttagacttttcactaaatcacactgaccttatacgtagtctgcaatatacagtaccttttttctttcagttcctgagaattgttgaaaaagcatattcctccaatcatagctgttttaattagcatctttaaaaatctagcattctaactagagtataaactacaggattacagaggacttaatatccacaatgcctaacacatagtagaaactcagtttcttgaattgttgcatgatgaatgaataaatcaatgaccaatttccctttattcttttaaattcatgctaagtagcttattttgagcttgcaacgggattccaaataatctcattgaaagtataacccaactttgttaagggcttttctaagacaggccgtaactattaagctattgctgtaataatttagagcatgcaaaattaaaccaaagaatgtcaaaatactgtcaaaatttgctaaactatttgctagattctttgttgttgtttgcttccaaattttttttctcttgagttgtctagatacttgaatgctatcaaattaacagttccctgagagtgattaatgtataagctacatttattttatttcatataattagtctaactgcaaattgaaaccttagatcagtatgcatgtgtgtatatagttctgtatctgaaagaataaaaatcctttattttcagtctgtaagccactagtaattcactctgtcacatcatttatacaattcatctcttaatttctcatcatgctgatgtgcaatacagagttgaaagcattgcgaaaatgtagataaatgttgtctacccagctccctttatccactctctgttatctcagaaaagctattgtattagcatagcaagatctgtgccatgcaaattcattctattatgcagtcttcctttgagtgttcttaaatcaataacataattatgtttgcaagtattgcatccaaaataaaagtcaggctgcacaccaaaactggtccaggatgactactttgccttccagcctttaaccaatgggggcccatttagagtgcacttcatgtccttatatagttcagttgatttttccacttagtgaatatcgctagtacattggtgataggcgctcactcttgagccactaattctttccactttagttgttataggaatgttatatctttcagtaaa

SEQ ID NO: 31242 - DNA, 1071 bp, Homo sapiens
ctgaagaaaaatttgaagctagcagagcttgatttgtgaggtttaaggaaagtagtagtcttcgtaacgtaaaagtgcaagatgaagcagcaagttatgtaaaagatctagctaagatcactgatgaaggcagctatgctaaacaacagattttcaatgcggagcaaacagccttctataggaagaaaatgccatctaggattgtcataggtagagaggtgaagtcagtgtctgatgtcaaagcttcgaagaacaggctgactcttgtcaggggctaatgcagctggtgactttaagtttgaagccagtgctcatttcccattccaaaaatcctagggtccttgtgaattatgctaaaccacctgtgcctgtcctctataaatggaacaacaaagcctggatgacaacacatctgtttatagcatggtttacagaatatttaaagcccactgttgaggcatactgctcagaaaaaaagacttctttcaaaatattaatgcacattgacatgtacaaggagaataatgcctgctaacccagcatttgttctccagcccctggataaaagaactaatttcaacttttcaagtcttaatatttaagaaatatattttgtggggctagagctgccataagcggtgattcctctgatggatctggccaaagtaaattgaaaaccttctggaaaggattcattgttttagacgccattaagaacatttgtgatttataggagatcagaatagcaatattaacaggaatttggaagaagttgcctccaaccctcatggataacttcgaggggctcaagacttcagtggaggaagtaacagcctttgtgttggaaataggagaaaaactagaagaggaacctgaagatgtgactgagtgactgcagtttcatgattaaacatgaacaaatgagtagttgcttcttatggatgagcaaagaaagtggttccttgagatggaatctactcctggtgaagacagtgtgaacactggaaattacaacaaaggctgtggagcattacataaacttagttgataaagcagtggcagggtttaaga

SEQ ID NO: 31243 - DNA, 1436 bp, Homo sapiens
gaggcaagaccctccaccagcaaaaagattatgacttgttaaaggctcagatgatcatttgcatttttagcaataaagtatgttttaaattaaggcatgtacagtgttttttagatgtaacactattgcacacttaatagactatagtgtagtgtaaacataacttttatatgcactagggaagagtaaatgttactgggtctattgcagtacttgctttagtgtgatgttctggaaccaaaccaagaatatctccaaagcatgcctgtaatgtatgaaatgatgacaggtcacaaggagaaccgtggagcatggtgatgggataggttgcgggagggatttatatatatatatatatatatatatatatgaaagccctatgataatataacctttgagcaaagtcgaagtaagaatatgaacacctttcaaagttaatactttcctgttttcttttttttaacaagttgcattcttgcacatctatattcttaaaattcaaattgtttgatgttgtatctgcttgataattcttcaaaataatagagctatgatctcagcactgtacttcagcctagacgacagagtgaaacccccatctctaaatattaaaaataataaaaaataaaatgcaaatattataatatcttgcaaaccagcattagtgaatttggattatataggatcttatcactcctaccactttgatattttttaagttagtattttcactagactatcacaatcattttacactgttagacctaggttttggggtttttttttctttttgtttgttttttaattcttaaaggatgttggactttttgaaatatttttttctatgtcttgttgagatgatcatgtgggttttgtctttatctaacctacatctataaacatttaaaataatggtgatttatttgtagagatagtagagagtaaaacaagcctaatttattatactaaaactagataaattaaactctcagacataatgaattgagactgtcttaaataaacatcaagcaaaaatggaattctgactattattcctctccccccaaattaagttatagttttgtttcaacatccatctttagtatcagtgtagagccatgtcatgagttattgtttatttgtaacaccagccttgtctatccacaataggatatcacttttataacctccccctcccttcactccaattatttctttttcagcagtaacttaaactaataaggtcaaacttggaacattttctaaagaggccaggaaaacctagttagtagaaatgattgtgaatcagaagtctggtcagtttcatcccagaaattctatattttcttttcaatatatttgaagtcctcagtaatagtttatcagtcaggtgtttactaaaagaaatatatctagggaaaagagttgagagtact

SEQ ID NO: 31244 - DNA, 1041 bp, Homo sapiens
ctccaatcatggtgtaccttaagttctagaacgaggaataaggaattgattagtgggtcagtaactgtccaactggaacaaagttgggaaaccactgtgataaggtaaaaaaaaaaaatttaggttctttaatgagacttgtgatgaaagggtaaatatcagattatagtgttggtatttttatgcaatatgggataaataaagatgttttttttattatgcattaaatgaattatattggataacagtaacaggttttcattaattttatttataactacagatgcttctcaacttaacgataagattacattccaatgaacccatcgcaaattgaaaatattatacatcaaaatgcatttaatacacttaacctaccgagtatcatcagaacatacacattagtttacagttgggcaacatcatctaacataaagcctactttattataaagtgttgaatgtctcatgtaatttattgaatactatactgaaagtgaaaaccagcatggctgtatggatcattgaagtactgtttctcctgaatgtggagtgctttcataccacagtaaagtcaaaaaaccttaacttaaaccattgtaagtagggaaccatctaataatggatctttatgagataattctattctatttatgaataaaatagagttctcttctactcttcttttatctaacaaacatattagcccaaaataattatttgtaatatttacctgcctacttactatttaaactccaacactgaatctttcatgattatgtatattttcaacagtgagtccattcttgcacaccgagaaaatatgcgacagatgataagaagtttttctgaaccctttggaagagacttgctcagtatctctgatggtagagggagagctcataatcgtagaggacataatgatggtgaagattctttgactgtaagttcttttttttaagacagttagtgagaaggccctgtaggaatttgaagaaaagtattacagaagtatatatctataatgataggatatgactaa

SEQ ID NO: 31245 - DNA, 1076 bp, Homo sapiens
gtattgtccatttctgaaccacaaaacagtgcttaactcagagcagtaagtcagtttgtgggatgaatgtttccaaatgggaaacaaacattttaaggtaaacaatgactaccatcttgccttatcaattagcctcttttcacccattttttgttgggtgggtggaaggccagatgcagcaggatgggttattgacagaagagaattataaaggatataaagtattttaactctctgtctgtcctatactagcctatgcctctctccttgtgctctcctcatattaagaaacagaggatgttgtccgggaggtcataataacctaagtgagtaaaattctgaaagccaattttcgattcccaagtgtattggctgtctagaatttccaaggaacttgatggatcagagtaatgcaaaaaagcaggacctcaagccccagggttttatagcacctataaaacatgttttacagtttctgttcaattttatgctgttaagctaaatatttgacatcatatggcactttaagcacattgatttatggtaagtcagcaactgcatctgtaataaaaagtccaaagtatgggttttaaaagtaatctgctgtatttattattgacataaacagttacctgcagtccatttgaacatcatcttagatttaactcatgtattaaagatattatgttttccactcagcaaggtcaccttcaaggtgaaaactgtatgtggttgaaaatgaaaaagatcaagtgtataaagataaatatttaaaaaataaatgatatataggatttcatttttgtacactcctgattaataatcatattctgtttattttttacacccaccttcttctcccaatctccaactccagaaaccactaatctgttttccatctgtataattttgttatttcaagaatgcaatgtaaatggaatcacatagtctgtaaccttttgagagtgactcttttttttttcactcagcataattcccttgaagtctgtttacttttatgtggattgtctgtctcatgcttgtttcaccagggtagttacaactagggtggcata

SEQ ID NO: 31246 - DNA, 1044 bp, Homo sapiens
acattttactctttttcaagtatgtaggctgaaattggagagagcttaaattagtttggagtctcagtgttataataatccctcatgttttcacagggctcacccagttgtacagttcttttcctttacatagtttcaattggtattgtttacaagcactcaattttgggatcatttgtaaccagaaaacaatgaataaaataatgaattatattttacagcggcaaaaatcaagacgcagggacattaaatgatggcatgtcagaacaaagtgccaagcaaaggcttcagattttttccctccgctataccacaatactatgattctgcattgttactcaggccacatactgtacagaaccttatgtaaattatggaggcttgattccaagttaattatttcaactaccccatctgtaattttagtttgaatttacatatgatattaatatactataaacctcctctgtagaatttaaagagtgtattctaaaaaaattatatgacatgtcaaaggacatagaagagtcaaaacagtttttgaagaaggagaaccaagtgggagaatttatatacctaattttaagatggacaaaaaagctacattaatcaaaacatgcggaattggcataaggatagacacaaagaccaatggaatacaatagagagtctagaagtagacccataaatatattttcaattaattttttacataaggtaattcagagggggaaaagattgtatctctaacaaatgatataggagcaactggatgtctaaaaaagaaattaaaggaccttgacctttagtcacaccatatacagaagttaactggatcatataattaaatatagaagctaaaatcgtaaaacttacaaagcacaagggaaaagttttgtgaccttaagttagggaagactgtcttagataagacacaagaacacagaaataataagaaaaaggttaattggacttcattgaaattataaacataaaatcttcaagaatagaagatgaggtttctggaatggtagtatgagtcac

SEQ ID NO: 31247 - DNA, 1027 bp, Homo sapiens
tgaattttgaggtcttgattgatttgagtctaatgatcacattttaatgtttggttacttgaaatttgtaaaatggacatggcattttcagacttaaagcccccaaaagactactatttggcttcctctgaaatgataaacaatcgggggctggcaggagtttttggtaagtcctgcaaaggaccagcactgagaaagggagaggaaagaggggcagggctgggctgtggctgggtcggctcccttttttctaggggcctcaacttctttgtttctggcctgccacccctgggctgagtagcccttggagaaaatagtgtgtaacttatttttagtgcttttggaaaataaaataatgggaataatatttttatttaaaatagcaattaataaaggtttgattgtgtctaagctttgctttgtgattatgattacataggaatcattgagaagaaatacatattttaagggccctatgttttttcactcctagtgtcacttttatctgtggtcttactctatttggtgaatcgtgcccagggtaagtagaagatctgatatttgcttcttaaaccgcagtggatcatcttgtggggtctctgggtctgcctctttgggggccagtgctttattccatgcagtaatgactttctgttcataatgatggaaacacatttgattatgtaatatataattatgttttctgggccttcatatttattaagattgctgtcattttttaaaatctagccagatgagtttcttaataatataaaatcttagatgttatttttatattaacataaagaaatatagcatttaaaaagtaacctaaagcccctctgtgttattgtcctacgttaaaagaaatcagaactaagcaaatttatagctataatttacattttaaggttcaagatgtttggtttagaattagaaattacagattttttttcttttgctaattcgtactgtatgcattagtggatttttgttgttgttcttgataagattttgatgttgtcat

SEQ ID NO: 31248 - DNA, 1024 bp, Homo sapiens
tgaggctacactgacacatcattagcacacaaagtccatagtttacattagggttcacgattggtgttgtacagtctatgtgttttgacaaacgtataatgacatgtacctaccattatagtatcatacagcatagttgcactaaatttttaaatagcaatgataaaggccttctgactccaaatctagtgactcttccttgtgacttcagctgccccagtaacccctggagaaggaaaagaaggtccagagatgagcagttgtggatggagcacaacagagaggatgtgtgttcaggtctgtgggtcacactggtctggttgcaagcctctagtatcttccagtttttgaatagtactatatgtaaaatatcacgttataaattttgtgctagtccacagtgtgaagtcattagatggttttcacagggatacccaagagcaaacaaggaacatgaaagacagagtgtgacacagaggcaggataaaataggggttctgagtgcagggtctggaatgaaagtgattcagtttgtctcatgaatttgctacacagcaactgtgaatcattaggcatgttgttctactgctctgtccctccatgtcttcatctgtaaaatgagaatgatggtacctacctatatcagtttgttaaggctgccacaacaaatgagcccaccaaactaggctgcttaaaactgcagaaatgtgttgtctcacagatgcatgctacgcacccagtgggtttgtgccagaactaagaaaatcagggtaaagagccctgcacttttcatagcaagcagtaaggaagctgctttctgtccataatacactacttcacctctcaagactgctattcggtataaacaatcctgagaaacggcctggttaaacagtgaaagagtaaacaggaccctgcaatgttgacctattcagcaagacacataagagaacaagaggccaggaacaactgtttcccaagaaggactagatctcatatggaggttccagaaaggcttccttga

SEQ ID NO: 31249 - DNA, 1024 bp, Homo sapiens; identical to SEQ ID NO: 31248

SEQ ID NO: 31250 - DNA, 1024 bp, Homo sapiens; identical to SEQ ID NO: 31248

SEQ ID NO: 31251 - DNA, 1024 bp, Homo sapiens; identical to SEQ ID NO: 31248

SEQ ID NO: 31252 - DNA, 1024 bp, Homo sapiens; identical to SEQ ID NO: 31248

SEQ ID NO: 31253 - DNA, 1070 bp, Homo sapiens
ctaggcaaccaactgatctgatttctatgttatagattagtttatgccttctaaaattaacataagtggaatcacagtatgtgtggatttttgtgtggcttctttaactcagaaagtgattattttgagattcatccatgttattgtatatatcagtggttcgtttgaactcttgctgagtagtgttccattttgtggatataccattttcatctgttgttatacatgtgcattgtttctaggttttggctattacaaataacattgttatggacacatgtatacactttatctatttatttttggggtgaagttttgctcttgtcacccaggctggagtgcaatgatgctatcttggctcactgccacctccgcctgctcagttcaagtgattctcctgcctcagcctcctgagtagctgggattacaggcagccaccatcatgcctggctaatttttgtatttttgtagagacggggtgtcaccatgttggtcaagctgatcttgaactcctgacctcaggtaatccgcccaccttcgcctcccaaagtgctgggattacaggtgtgagccactgtgccgggcctgaatatacactttcatttctcttgggtaaataactagaaataagaacggcttgatcacgtggtaggtgtatgtttacctgtgtaagaagctgcctgtcttccaaggaagtactattttactttgccatcacatgatgcttaaatcactgaaagaggtttccccttttcccattgctctattccatctgcatcctgctttccaggacacctcccttcaggtggctgggtggctgctccctccctcttaagagaaaacaacaagagagcaaggagatcacttgtcacatccaaccagtctttactcctgttgtttaaaaaaggaaaggaatcatttttaaattagagaagagctctagctgtagactcaacacattttaagtgcagttttattattttttagtgcctctgacaggtgcattttcctcatttaatgagaagataagaacaattttaattgacacgttaattgaaagcaaattcttc

SEQ ID NO: 31254 - DNA, 1070 bp, Homo sapiens; identical to SEQ ID NO: 31253

SEQ ID NO: 31255 - DNA, 1070 bp, Homo sapiens; identical to SEQ ID NO: 31253

SEQ ID NO: 31256 - DNA, 1070 bp, Homo sapiens; identical to SEQ ID NO: 31253

SEQ ID NO: 31257 - DNA, 1045 bp, Homo sapiens
ttgtaaatttagatttgaggttagagtactaaaaaataaaaacaaaagcagaaaagctgctgtgctctgaaatgccagggtgtttttaatgtcaagtccagcagcataatagcttttacctcttttccccacctaaagaaagagtagtgttaaacttatttccaaaataaaaggagtctgaacctctaggaaactggtacagtatcatcttagaaaagaacctaaatgctaatctacactcataaaaataacatgttttcaaatagtttcagaaccaattcagtctcctgtttttctcttcatgataccagtagctaaaaattaccctacttaatgaaaattgcagacaattttttttctttatgcagtcttacataatttttggtccattttgacctagtctgacattttattttgaacaactacatcttaagtgttctgtcttttttttttttttttttttttggaagatttattgtgaagagcgaaagaacaaagcttcaacagtgtggaaggggacctgaatgggttgcccagtgctctgtcctttttgtttccactctaaaattggttcggcaaggagtaagagagtagaccactggcattttatttttgaacactcgaattgtataaccagtaatctgttagagttgttatccatcttacagtgaccccatcatctgacccaaatagcgtttaaaataagagctcgttctagaagaacaactttaggcagcagtaactttaaaacattttgaatacctgctctactgtggtatagtgatctaaatattagatttatttttcttgtgtctcatatagaaactctaaacaaagcagatgaacagttgtgtctgtactaacacgtgactaaaacctctatagagttccagtgtgctgaaagccaaattaaagttctctttttttagtaaacaatcacactgggaatgagaatattagagctaagagggaggccagagcaagggtggtaaacgcggatgcttccagaggtcacatagataacccactggagcagtgggcccag

SEQ ID NO: 31258 - DNA, 1045 bp, Homo sapiens; identical to SEQ ID NO: 31257

SEQ ID NO: 31259 - DNA, 1045 bp, Homo sapiens; identical to SEQ ID NO: 31257

SEQ ID NO: 31260 - DNA, 1045 bp, Homo sapiens; identical to SEQ ID NO: 31257

SEQ ID NO: 31261 - DNA, 1027 bp, Homo sapiens
agtcctttttgtttggtttaggtgttggttgtctttgtaaacactggaagctgctgagtcatctccctcggctttttccatcacactttaccccacatacattcatacacacttggctcaagcttttcggttctttctctggacactagatgactgtcagccttacctgggccctgccccagaggctgccccagcatctggtaggagcttagtgagcggaatggattcctagtgaaataatgaatgtctttccttgtattctgtgtttgaaacctccaggatagcaattccatctgctatatgaaataagaaaaagtaaatattctttggttaacctttgtcattcgcctacttaaacctcaatcacatttctttgaaatcatgccagatttgtggagagcaaattgccaggtaaatggagggcaaattcaccaaactaattcttagttttttccttctctaagggaaggaacactttgcagcttaacagcattttcaaagtttcaaacaggactggctactgagttgaagaagcattagttggcccttaagtcctcccctctggccactgttgtccacttcacacatttggaccaacttccctcatctgagcctgaatcctattagccagcactgaaaatctggcatggtttcaaagaaatgtgattgaggtttatgtaggggaatgatgaaggttaaccaaggaatgtttactttttctgatttcatatagcagatggaattgctatcctagaggtttcaaaataatcttatcgagatgacttttgacccgtcttcaatagcattacaacaatccccgcagcctggagactaagctctgctgctgttttgagtgagctggccccacagagggtgtgacgtgggagtagagatgagtgtcggcctcaaagtctgctcccatctctcaggaaagcaccttctttagattaaggtattggggctgacactaaaatagatgatatttgaggctaagttttcaatttcactctttccagaaaaacaaagt

SEQ ID NO: 31262 - DNA, 1027 bp, Homo sapiens; identical to SEQ ID NO: 31261

SEQ ID NO: 31263 - DNA, 1027 bp, Homo sapiens; identical to SEQ ID NO: 31261

SEQ ID NO: 31264 - DNA, 1027 bp, Homo sapiens; identical to SEQ ID NO: 31261

SEQ ID NO: 31265 - DNA, 1050 bp, Homo sapiens
ccaggaggcataggttgcagtcagccgagattgcaccactgagttccagcctgggtggcagaatgaaaccctgtctcaaaaaaataaaccaaagggatataatttacataccgtaaaattcaccttttttgttgttgttgttgttttgagacggagtctcgcactgtcgcccaggctggagtgcagtggcgtgatctcagctcactgcaacctccgcctcccgggttcaagtgattctcctgcctcggcctcccgagtagctgggattacaggcaggtgccaccacgcccagctaattttttgtatttttaatagagagtgggtttcactatgttggccaggctagtcttgaactcctgacctcgtgatctgcccacctcggcccctcaaagtgctgggattataggcatgagccaccacgcccggcctcaaattcacctgttttaaatgcacagtgatttttagtaagcatagttttgttcaaacatccccacaaccaaatgtagaacctttctgttattcccaaaacattcctcttgctcattggcagtctatcctcattcctactaccaggccaaggcaaccaccgatccactgtctttataaatctgccttttctgaacatttcatataaatgggatcatagaatatccaatcttttacatctggcttctttcacttaacatattgtttttgatagtcttccatgctgtagcacataacagtagttccttcttgttgctgaataatattctattgtatggccgtattatattttggtcgtccatttaccagttgatggacatgtggattgtcttcactttttagaccttatgaataatgttgcatgaatacatatacatctttgtgtagatgtatgtttccatttctcttgggtagattctcaggagaggaattgcaagatcatatggtaaatttatgtttcattttataagaaactgccaaactgttttccaaagtaagcacactatcttatattcccatcggcaatgtatgaggcttacggttttttcatattcttatcaaaaa

SEQ ID NO: 31266 - DNA, 1635 bp, Homo sapiens
accaatacttaggtaaagaattttcttttgcagactaagaatgattgctttgcatggctggtgaagtctgaaggagaaaagcaagcaatggggtggggtggcgggctgcgggtggcggggtcgaggagaggtgcattgtcaatgacagcagcactgagcagattctaatgacttcactgtggtacaaagcaacctggacactgaattgcatctggtttccaatgaaagagaaccacttagagtgcttagctgggtttaaagcagtttcctcacttttgtgtggccactctgggtgtttgcccgtatctgtacttctgtagctgactttttaaaatgcctgaactttggcttgtttttcttcatggattactaaaaaaaaagaatactttcttctactaattagattagattaaagttaacccatgggaccctttggcaaagtactgagtagattaatacttcttttcagctagagtttttgttttgttttgtttctgacaacagagaaggaatggagtgtaacctgttaccttctggtgaaattcctcattgtgcttttgtcgctgtattcttactgtgtgcaagacccgccagtcacaggctctaagtctaagccttggtttgaacggccttgggaataaagtaggtttcccagaccctccctagggccctcattgttttgattttcctttttacacatatccacctacagtgtgctacagcccaaaacccaaacttaaaaataaacatgcagtccccttttatttatccaatggtgagacaggccatcagcagctgcagtagactgaagcctagaggtagaccctcaagtcagacaacagccctctccacaataatcagccaaggagtgttcacaaagccagcatatcttacacccaagcaggacaggagtgtggatcgaggagtaagctgctgtggtgtggaaatttcatgcatcctcaaatgatgtagatgaagaaggcattttacatcaaagtagcaccttctatgctcttatcgtatggccccagagtgctgtgcctaatgctaaagttctggggagagaaagtggttgaaaagctgtaaacaaatagttgggtagactttaaagtggggacaataacactctgagattcaaagtagaaaagagcaggcaaagtgcagcattgatcacttggaaacctcctgacattttgtcaccagcttctctcctctatctcccctctgaggatttactaatcacctcagctttgtgtcatcctccccaggaaggggcagtgtggagccgtggtagagcactgcctgggaatctgcagggccagtggggccacctgcccgcagcagagcctttgtgtgaccgtagggaagcctggggcagggaaccactgcccctgctaccagcatgctgtctgtcatcagcaccaggagctgtgccaggggctttgcaatcctgatcttatgcagccttcatactgcaagcagcacttgctggagcagcctgtccaaggtcacagagcaaaggtcagctgtgtccagcatggaggccctgctctagtccatggtcatatcacaggtccttttcctttttgacagcatttggcttttgtagattaacaaaattatatattccaagtt

SEQ ID NO: 31267 - DNA, 1056 bp, Homo sapiens
cctttccatcttaactaagaacttatacactgtgctgtaacttctgcagttcgaagcatgacagtgaaactagcacaaatttatttttcctttttcacaatttcacagataaaagatttggttttattgtaggtcatagcaacctcagcattcattttttttctttccttattaagtcaagaacttttaccttttcacttaaaggaagcactttacagcttctctttggcatatccgaattaccagcatcactactctttcatttggggccgttattaggtaaaatgagggtcacttggacacagcactgtgatactgcgacagttcatctgatcaccaagccagctactaagtgactcacaggcagggactggagacagtgtggatgcactggacaaagagatgattcggtcctgcatgggacagagcaggatggtgtgagatttcatcacgctatttagaatggcactcaatttaaattttataaattgtttatttctggaattttccatttaatgtttttggaactttgttgactgtgggtaactgaaatggcagataaggggagacactgtatatttttctccagccacatatgtcagctgagagcaggcacagagtagcaaacagctgaatttatccacaggtgggatttaaccaagtgaatatgaagtgagggggcaagtgagaataattgattgagttaagggttgcaatgataggtaagggaatctaagacacagagagagaggagaggacaccctgagagtacagaatggtgaaaagtggacagtatatggggtataaggcctagtgcaatggaagaattattggattaagaatagttggaaagaatgaactggaatgacaatgcaagattgttggagaaggggaggcttgaagatgaaattatggagggcatgaagttgttggtaatggcaaaataggatatggccatgggagcaggtataattgagatggaatggaaaaagacggaatttacaggccaaaattttgcagggaccatctaacagacatggaaatttccaggattta

SEQ ID NO: 31268 - DNA, 1025 bp, Homo sapiens
gagatgatgttaacagtttagtcataaattttatgtttctgtcctgtgttcagtgacataccaggaaaacacattttcagaaaaggtatgctatgtaaattcttttcattactattttacgttatcctacaaaataatttttttgaaaatagaagcctgtaatcccagcactttgggaggccgaggcgggtggatcatgaggtcaggagatcgagaccatcctggctaacaaagtgaaaccccgtctctactaaaaatacaaaaaattagccgggcacggtggcgggcgcctgtagtcccagctactcgggaggctgaggcaggagaatggcgtgaacccgggaagcggagcttgcagtgagccgagattgcgccactgcagtccgcagtccggcttgggcgacagagcgagactccgtctcaaaaaaaaaaaaaaagaaaatagaaacgctggaaatatttttttaaatagtaactctgattttcatagtaaattcaattttcataatgaactcatgatctagtgtgtttagtttttgaaatgtccatgatcaatgtaaaaagaaaaaacaaactcatcacctttactctcattaaatttctataaggaagaccttcaattgaaatctaatttttttttgttgactcacccaatgctatatataatatattattgttatattgtattgctgatgtggaaaactcatgatataaaatgaaattgatataaaaagacagccatctgacagcctgaaagtgggcggcaggggcagtttataactcaattcatattgtagattaggaaatagaggctgacagctatgaagcagtagcccaaggaaacacacctaataagaagtgcagtcaagtccagaaccaggtctttgatttgatccaaaattttatcaactctagaaccatcaaagatggcctagattgcaactttggatgaattagcattagtgtaacctttatatatatatatacatatatatatacatatatacgtatatatatacgtatat

SEQ ID NO: 31269 - DNA, 1036 bp, Homo sapiens
tgtgagtaggttttctaagggagagcgctagtatctgggcccatcttatgcatggacagttcattctagagagggcagcagcagaggaggtaccagagacaatccccatagaaggataggagtggctgtctccccatttgcaagctactggcaaaccatcaggcattacattcagctcaagtctctgccaaggtggtgttttattttgtgttttccattcctgtattcatttggaccacatggaagtgaaattaattacagtgttaatcccaagcatgtagtcaaggtcttgccaccctgcctggaaatgtggtttgaaatagagggataatggctgataatgattttttttttcaagttctagagcaacccttctacactttaaggtatattcaaaaatcctaggggtctctctttttttttaatgcaatttctgattcagtggttctggagtgggactggagggcttacatttctagaaagctcccagtgctgttgataatctgcttggagaacacactttgagtagcaaaactctagaaagtttcacagataagtgatgccacacataataggaaactctcagatattttaagctggcacaagctatcctgaaaacggtggcacagctccatctggaaagggtttgggctatgagcttatctacgtgctgagcttctttagggagggtgcacagtgatgtcaccaccactgagaactgccctcaactgcttgcattcatgtttcaggagcagatgttctatcacttgtctctgtatagtgcttattagagaacacttacgacaaaaaaggagctagcaggtagaggagtggaatggtcttttagtattctcagtactattccttgttgctgttgttttgttgggaaatttccatctcgaattttgaggtgcctctctccaaaagataatatattatcaatgtatgtgtatatacatgtgtatgtatatcattactatattactagtacacatatattaatctgtatgtatatatacataatcatgagagttca

SEQ ID NO: 31270 - DNA, 1106 bp, Homo sapiens
atcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaataaaataaaataaaaaaataaaaaaataaaaaataaaaaataaataaaaataaataaattcctgccaaatgcccatatgtagcacctcagaggtgctcaaaagaggaaaatccaaagccaactgaaactctttcaccaaaaaaaaaaaagatgtatttcctgactttttttctatgcatatatctccatatttttgtttataaaattggaattatagcataggtactgtttttagccttctttcttttacttaacagtcggaaactttcatccaatctaataatattggactaagcttactcataagattcatctaatgtaataatattggactaatcttattcataagattagtatttctactagctgcagaatagcccatcatatatttcaccataatatactttatcaatcttttattattaggcatttaagttgttgccagctttttgttttggttttgtttttgttttgctttctttcttttttttttctttcttctctttttttctaccattaatgaatttgtttcctcctttttaaagtgctctgacatctcaagacggactttcctaaagtatcagtgttgtgatattgtgtaatttaacctctctgagccgttttctcatatgtgaaacagggttcacagtgcctgcttcatgtgtatctgagggttagacataaaatagtaaaatgcctggcacttagtagatgctcaaaaacagtaacttttaatttcagaatacagattacttggaaattacttggccttatttaacatggaagtagataacatttgctgcctacgagagatggctgttttattcctcgtatcagaagaggcctcgttctggtctttcattcatgctagagaacatttcagttgaaaa

SEQ ID NO: 31271 - DNA, 1106 bp, Homo sapiens; identical to SEQ ID NO: 31270

SEQ ID NO: 31272 - DNA, 1106 bp, Homo sapiens; identical to SEQ ID NO: 31270

SEQ ID NO: 31273 - DNA, 1106 bp, Homo sapiens; identical to SEQ ID NO: 31270

SEQ ID NO: 31274 - DNA, 1106 bp, Homo sapiens; identical to SEQ ID NO: 31270

SEQ ID NO: 31275 - DNA, 1106 bp, Homo sapiens; identical to SEQ ID NO: 31270

SEQ ID NO: 31276 - DNA, 1106 bp, Homo sapiens; identical to SEQ ID NO: 31270

SEQ ID NO: 31277 - DNA, 1106 bp, Homo sapiens; identical to SEQ ID NO: 31270

SEQ ID NO: 31278 - DNA, 1106 bp, Homo sapiens; identical to SEQ ID NO: 31270

SEQ ID NO: 31279 - DNA, 1712 bp, Homo sapiens
cggcgctggaagggatgggggcgagcaaacgggttcagttgtgaatttttgtttgtgacctgtggaatggtacaggtcacaaacaaaaattcaatatctttattgtattcccgctaaaatcgagacggtcaatcaagagagcaagtggacttttttcccagagacaatcaatatgactatgtgagcatgatgaaaagttttttgaccctaacctcacctccgtggtgttagattgccgttaaagagaagacgataatttatttgaagccactgtagcttttgtgagtccaggagttgggtgacattattaaaccctcgtggcagtgtcgctgaagttcatgagtttccaaaatgaaggttccaggtgctcagcggtacggagaattgcatctagagccttaggatttaacctcctgtttaggataggcagcaggaaatagcttgttacggttttcccagatttgctctatgatgtagtgttttgactcttaagaggtataggtgtatagaattttgtgaccggtggcatttctttcaagaatttcttttttagtaaaaccaagctgaaggtttagtcacccccgtgagtttaagataataacatatttaagtggaaaatatagactcctaagtttcataaataacatccctccatcccctactttaaagatgggcagtcattagttctccgaactaattgcactaatgtaggcttttcccccgccgtttgccttcgttttcctttcctttcactgacttagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataaggtatttgtatggaaataactattttataactttttaaataactattgtaaggtaatacgtttttacaagatgtttcagttttgtaactatcctaaaattcattcactccctatttatcctgatagtctttctgtctctctctctcacacacacacacacacgtttcatatgattttaacactgaaattatcttttgtttatctggttatctttggtacctctagttacaaagttttccattgaatggagtcggtgtgtgtttctgtttgaaagagtattttcccttggataatttttttttcttaaagccttctatggaacccttagataatttaactataaaatgagttttctaaaacgtctgcgttagaattggagcattcttattgaatgttgaagcttttaagagagaacttgatgtaagaaaactcaagtcgtatgcctgtgattagcaatgagaacttttaaatacttgcagtttttaactgcaagtaaaaaaatctaacagtttcagttaaaatcagtagtattagcatgaccttatgaacttttccgtgttttgtttttgtttttttaatgcagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgata

SEQ ID NO: 31280 - DNA, 1466 bp, Homo sapiens
gaagctaatgtaatattgtcccaacgaagtaaataatttataaattgtcaaatttatattacatttgtgcttctgaagtatatgggatgctaaagccaatttgttcacatgataatctgaacctttttatgtgatctttacaattgtttaaaaaacatttcttcccaaataatacaaaggtgaatgttccaagttaacagattcagtttgactcaattaaatttatagataaggaccttaggaactcacttgttaggaataagaaacagggattggactacggtagaactaatagtgcccaattaaaactttgagggaaagtgacaatggtttctatggattgttttttttaagtcgcttatgaaaatctcagactcctaactggcaatttaaagcatttgatggtaagtaaaaatgtgatttttattaccttctctcctactgaataacatctatcttaaaaactgatttgggaggctgagaaattggaaacagcatcgtagtatcaacatccaagacctaaatcattacttggaataaaacatgtagactatttggccagtaatagtgattaacagcaaaagtaatctaaatttagtaaaaataaacatttatttttgagattaaaaagaaccaaattttttagaagttcctaagagtaaaatttttcagtgttaatatattcgcttagcaaatttttcaagtaggcatttttattacttaaatccattaaaaatttcattaattggccattcaattgaattcctattaaggcactatgctaaaatgctgtaagtaatattaagatggctaaaccttatttcttgtccttaaagacacatacatgccttcaaaaagtttgttgtgattgaccattgtgttttttataatcgtacattttcttttatatatacctactttgggagcctcggtcccgttgtaagtctgtacaagtagagttttattagctctgtataacatttcttgggtaactatgacttataaattaggggtgcttttgctccattcaggggtagaagaatggttaatgtttttactaaaaagttgtattaatgattgctgcctcaggaatatttttgtaaactcctcaaaagctacaactattagcacaactttaattttgtcaaagttttcaacttcatatgcttttgtcttcatattacaaaatctaaagtttgaaacacgaaccaggctgggtgcattagctcacgcctataatcccagcactttggaaggctgaggcaggcagatcacttgagcccaggagttggagaccagcctaggcaacatggtgaaactatgtctctatagaaaatacaaaaattagctgggcatggtgacacacccctatagtcccacctactcaggaggctgaggtgggaggactgcttaaacccaggaggcagaggttgcagtgagccaacatcgtaccactgcactccagc

SEQ ID NO: 31281 - DNA, 1124 bp, Homo sapiens
aagagcaatatactatcaaatgaaatgaaagctaagaataaagatgtaaaagatacagaaaagtaataatattttgggaagtactaaaagtatttagataattgtattacatgtgtatttatatataaagttacttctagcacattgtgagtgtaagacatttgccagcatatcaagtggtggcccccttagtgaaaaaaaaaaacttgccttgcatccagttccttgttacagatgaaattccctactctgaagtcttagaaccgtggggatgctaccccctagtggcgtagcacagtaacaaacaataagcatttggcttcacagtttaatcttttagtagtccacaaatctgatagagggataggatttgggtttttctagatagatttttaagggttttatcatgtccctacttgatgccatttttcaatgacactagtatctctaattatttttaaataaaaaaatttgtatagtaagtttattgtatagtaacttgtaagtatattcgtaaaaggtaaaaccaaaattttactcctatggtaaaatttttatatacctagacattgtagtcactggaaaatgtgttattttccctccaacttagaaaggcaaaatagctgtcataatcaaaaatacaggtgcttcttcaactatggggagagggatcatcttggaataaggagagttttaggatcctgccttattaagagcctggacatatttatagaggaagtgttccaggtaggaaatgtggttttaaaatatgtgcacattcaaaataatgacttacaatatacttgctttgctaggaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggtaggtgttagaaaaaaattcttaaaatttcacgtctgaatatcatacctagttttcatggatgtgtttgccccttattgcctaagagaatgaattagtattctaaatgttgttttaaggtttgtctctgaacatgattttaccccctcaagggaaac

SEQ ID NO: 31282 - DNA, 1393 bp, Homo sapiens
gccctgccagagacagttttccttcataagaggtcaggtgtttgtagaagtagttttactattagattgagagaatatagaaattacagtgaatagtcgggaaaatacttgttaaagctagctaatttaactctgattataaagaaaagaagaactagaggaccctgagaaatgcctttaaatatgtcaaatattgatagtattgggtaacataaagatgtatgctcctataacttgttttataatctcaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaagtaagttttttttttttatcagtgtttattttggtggcttttttttttttaacttaaagattattttttcaaaaatactgaaacctgaactggtaagtttggacttttaatgtccaacattcctaaaactagtcaacctagacttagatgactattcttttaattcctgctgacatgttttttaaaaagtttactaaatgagagtttgtagtagtagcagaaggtgtgatgtcaaatacagtaccttgattattatatatgccactcctaagcgtgttgaatcatcatattttgttgccacctgtaaaacctggagccacactaagcgcaggttaatgtctcttttgtttttgcttctatagctcttgtgtaatagttaaaagctgtggctcttgtttcagttcttggttcaaatcctaggtcaatcacttactgtctctgttcttgtgccggttgtcatatctccaagtcatcttccttaaaatgagaaagaatatatctactttgtgaaaataaagaataaatatatctatataacgtactgagaaagaaaataaatgttagctataattttagcattatattaataaaacgagagcatgaagttgtcacattgatatgtattatctaccccaacaagagtaagcataaaattatctttgtttgtatgtaccacagcatttttgacagtgctaagcatgttaaatacctatgttaatggataatggtaattgactgcattaaaaagtcatggtagagtctgctttggcatatcaacatgttctaatgtcaaactataaaacttaacaggttagaatacctgtgtgatgaagtgtcacttaatagagtctgctttggaatatggacatgttctaatgtcagattataaaactttacaggttagaatacctgtgtgataaagtgtcaatggataatgcagtagctttcatgatgggatacttcatagttagtggatt

SEQ ID NO: 31283 - DNA, 1033 bp, Homo sapiens
atttcattttattttcacttttagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattggtaaagtagatttttggggggcatggctttactttttttttttaagaaagtgtaacttatttttttgccttgacaaccatatttcaagtgtcactgtatataaaataagattcattttgtttgttttaaggcacatttatttttaaacattttgcccttacagtttcttgtttacttagctttagataaatacaattatttcatacatatcaagaaaaatactagtaatgtcacacaaacttaaaaccattttatccttttttttaaaagagagactttagccaggcacaatggtgtgtgcctgtagtcccagctgttggagaggcagaggcagaaggatcacttgagcctaggagttcaagtccatcctgggcaatatagcaagactgttttttaaaaaatgaaaattaaaaaaaatttttttatatatttggggtttcacaccattttacttaggtttgggctagcatttaaggatataacaagggataatctaaaaatccaaggctagcaatagtgaggaccattactgcttcttagcttcgagggaagggagttgtggtccagaggagatggggaaaatggataccttaaccccacctatttcctgccctccagtcttagctgaaacctcaaattggctgaaggtggagagtcaaaggagccagttgatgcagtccttaagtcagcctttcggagaagggaacaaattgatgtaaaaattacccaacatgattgcttctgcatcttgtatcgggacttccaccttattttcttaaagataaacagtttgatcctattcatttgctctcaaagaaagccc

SEQ ID NO: 31284 - DNA, 1063 bp, Homo sapiens
ggtatcatacccaagaaaccactgcctaatccaaggtcacagtgatttgcctcctttgttttcttctaaaagttctatagttttggctttatatttaggttttaatctattttgagttaattttatcacgtgatataaagtagggctcaaactactctttccatgtggctatccagttattccaacaccatttgttgaaaagattctttaccccattgaattttcttggcatccttgttgaaaccacccaaccattaatgtaaaggtttatttctgggctttcagttttattacttgtgctggtataggacactgtcttgattattgcagcattgtaataagttttaaaatcaggaagtctgagtcctctaattttgttctttatcatattgactgttctgggtccctataatttgtatatatgacttttaagatccagatggtcaattactgccacaaaaaaaggcgaggaagtaactgggattttgatacaggttgtattgaatttgtagatcagtttagatagtataggcatcttaacggtattaaatctttagaaccacaaacatgagatgtcttccgtttaggtctaattttagaaccttttgtgtataattcttgtttcttttgttgaatttattcctatgggtttttttttgtttttttttttgagttttcttttttgttaactgttgtttttgtttgtttgtttgtttacttttagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtaatagtgtttttgtttcttggtttgtttttttttccccccacagcattgactttatttaatcttgttggggagacatctgaagctgacttctctcccctgttttccaggta

SEQ ID NO: 31285 - DNA, 1048 bp, Homo sapiens
agtggaattttttttaattatgaaaaagcaatgcacgcccactgtttttttaataagtttccagaaaatacccaaatgatcaccttcattttgacgtatgttctttcaacttttctaatacctagtttgcatgtaatgtatttatatatgtggtagatatgtgtagatatataaagtgtgcatatggtttttttaatgtcatactagcttttcttaaattatggttttctttccaaggcagtataaatgtactttgtttttaattgctttagagcattttgtttataacataatttgacaaattttttttgtattatgtacatggctatgtttaaaaaaatccttgtaggtataccttgattcagttatttccttagatttcaaaaattacaagtattacaccatatgtgtacaatgtttaaggcatttgttgcataatgccagattgttttcaaaagttataattcatgcactactaacagcatattcaaataattatttttccaagtctttgaacactagggtggtctacataagtttgctaccttgtaaacagaaatgtggcattttaacgtgtctttataatgagcttacatattttgtgtttgttggccattttcattttttatatcaatggcacatatctttcctcttcctattagtgtgtgtctttttcttgaagattttaagtgccctttttaaaaattcacaatgtttaaagcaaatgttaaaatattgaccttaaatgttaaaacttttttgtagcgtttaatagagcaagaagaatatttgaatgtccaagttaaggaacttgaagctaatgtacttgctacagcccctgacaaaaaaaagcagaaattgctagaagaaaacgttagtgctttcaaaacaggtatgtttagagatagaccttttttggggggaaaaaaaaaacaggtttttaaagcttgcaatatttaagaagcagtagaataataatagaagctaagtatatgcaagtcattgcactattttatggtgtttgttataaagtaagtgttattaatag

SEQ ID NO: 31286 - DNA, 1052 bp, Homo sapiens
tcattttgggattttcattccagaaacttttaggggtatcctaaacattacacatggaattctttatttcttacaattgagctttttctttattgtctaataactccatctccatctcctctggtatcagtggagaccaaattattttttatttgaaccaaatatttccattttggaggagtaaaatataaattaaaaatgcaaattagtagcagaatcacagctagaatcctaggtcatcttcctagatcttttccactagaagtcaaaataaccaaattcctttcacactcaaatactgttttatgaattattcctgccatcattcctttacatgttatcaatgtaatgtttattgtccaaaaaatatttgaggttacatgtttgtgtgatttacctgttattacttaatgtttgacttttctttgtttctctttaggaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaa

SEQ ID NO: 31287 - DNA, 1050 bp, Homo sapiens
ttgatagagaaaaatcaagttataccactgttgaaagtaccttaggcaaaacttaaaaacccaagtgccatggccaggcgcagtggttcacgcatataatcccagcactttgggaggccgaggcgggcggatcacctgaggttgggagtttgagaccagcctgaccaacatggagaaactccatctctactaaaaatacaaaattagcccagtgtggtgtcaaatgcgtgtaatcccagctacttgggaggctgagacaggagaattgcttgaactcagtaggtggcggttgcagtgagccaagattacaccaccgcactcatctggacaacaagagcgaaactccgtctcaaaaaaaataaacacccaagtgccattcacgtaaaatataaaggttaccaaatcacatgctataaaactaacttttaagattaaaaatctgtgaaaacagcaactaaaagtaactaactgcatttttaataaaatgcaaacttggctccttatctttacgatctgtcaaactcttaactcttccttcaaggctcaacttgagcctgccttttccccagattaggtcccctgttattctcattaaacactgcatttttacttcatagcactttaacaagattttatttaagaattttgtaacttttctgtatacattagaatgtaggcctcctataagggcaggaattgtgtctaaacaatggttatattcctgcaatttaggcacaaattttaacactgcaggcattcacttgttactgcttcaatgaacaaatgccttttcagagacctgtgttaatacagatttttgttttggggttttttgttttttgtttttttaatagcaaaatctctgcttaggaaaaggtgtaaaacgaaaatctatcagaaaatactccattcaggccaggtgcgggggctcacgcctgtaatctccgcactttgggaggccgaggtgggtgaatcatgaggtcaggtgattgagaccatcctgcctaacagggtgaaaccccgtctctactaaaaatacaaaaaaattag

SEQ ID NO: 31288 - DNA, 1116 bp, Homo sapiens
tataccattcactcatgtttattctctttgcttttcttattacccctcacagctcctgcagtgtaaggtctatccaaaagtcctttaaataatgaccaggaaaatgtagattaaatatgtatataggattctgaaagttatcctaggcaagtggttttcatcagtttgacaggtaactctatttctggtgtgaggcaagaagtttgagaattgggggctggctcctcagaggaagctaggcaatactctcagatttaactcagcctgccattgagaaggtggttcaattatttggttaggagtgttatggattacagtacattagacgtgcctgagttttcaaacgtaagtgcaagaacacgtcctcaaaagttcaatctatagtttcccttccccaaacgatcatgcaaaataaaattaaacatagtatttagtgaatatcaaaaagtggggaaatgtaaatgaaccatatcagctgcctggggggcagaaacagtgatttatagacttgagatttagaactcaaacattcttggtttgtactcaaggaagagcgtcattaggtaagttgcatggcagaacagaaaagagcttactgatagtgtgggaataccttagaaaggaataaaaatcatcacctttatctaatatctctctcactttatatatgtgtatatatttgtttcttctacattaactattaagttgaaggaattacattttagaaaatgttgattatgaggaattggtagaattctcatgtacaaaatggacattttctactttggggagctttatgaatcatattgaaaattagagtaactgagttcttaacaagtaacagcaacagctacttcttaactccttcatccatgggaaacagaagttgctttgtgtgtgtgtttgtgtgtgtgtgtatgtgtgtttactcatgcaattattactgatcaccatactagagaaagatggtctcataggatgaaaatatgatgttcccttaatgattagattaaacttcccttggcagtgttgaatctaaactgaaaaacatttttgccttccttaaattgagtaggagttatggctatgaatatttagacttatatcatgcctatg

SEQ ID NO: 31289 - DNA, 1067 bp, Homo sapiens
cgtacctatgtgtcttgtttaacttcctgtgcccagcagtggctctgctaaaatactgtatatgtatttcagaatgtcattacttatttttggccagtgttttgttccttaagatttatttggtttttaaagaaattgagatataatttacatgccataaaattcaccactttaaagtgtatgactcactggtttttaatatagttataaggctttatagccattaccactgtctacttctagagcattctcttcactccaagaagaaaccctgtgtctgttagcagtcactctccctattctgtttgttttttttttgccaaataaatgttgtcatgattatctctattacataggagcctgtcttccgcagagtgtcatgacagttgtttgacctttcgcgtataggtttatcacgttcaccttttgttctaaggttgatggaggttgcagttttcagcactaccaccaccaccaccatgttgactgaaattattataggacataaaatgacagtgtgttactcacaatcacttgtgaaagtttcagtgcttatgaacaacagacaactgagcactgtgcagatttctgactatgtgacaaagttggcctgtgctttaaaatttaatgaatagagaagtaaattcttctgggctatgtggaaaggtttagatttatttgtttcttacactaattagttttttgaaaaaaatgcataaaatgtgttcatacttacacttatttctgaaggactggaattggttgttcctaaactaacatgattgactttcttaaaaaacctcatttataatttaaaactattttgaatctgtgtttttattattccagaagtgatatatgctagttgaaaaattttaaaaaatacatagagcttagaaatgttgtaaagtaaaaaaagagttctttgtcatcctttcactttagagtttatgcttcaaatttttaaaaatgcctaattctataacctacttgattctttgctcagtttttaaatacttcagaaatgcttgtttattgaattgtgttattctttattttaatactgt

SEQ ID NO: 31290 - DNA, 1029 bp, Homo sapiens
tgaaagttagcagagattggttcatgagttgtaagtaaagaagtcatctctacaacgtgaaagtgcaaggtgggccgggcacagtggctcacgcctgtaatcccagcactttgggaggccaaggcgggcggatcatgaggtcaagagatgaagaccgtcctggccaacatggtgaaaccccgtctctactaacaatacaaaaattagctgggcgtggtagtgcgtgcctgtagtcctagctacttgggaggctgaggcaggagaatctcttgaaccagggaggtggaggttgcagtgagccgagatcacgccattgcactccagcctggacgacagagcaagactccactaaaaaaacaaaaacaaacaaacaaacaaaaatgccaggtgaagcagcaaataatgcagaagatattgctaaaataattgatgaaggtggctacactaaataacagattttcattgtaggcaaaacagccttcctggaggaagatgccatctaagaatttcgtaggtagagagaagtagtcagtgcctggcttcaaaacttcaaaggacaagctgactctcttgttaagagataatgtagctggtgactttaggttgtagccaatgcttatttgccatttcaaaaaaacctatggcccttaaaaattttgctagatctagtctgcttatgctctcgaaatggaacaacaaagcttggatgatagcacatctgttcacagcatggtttactgcatattttaagctcactattgagatctattgctcagaaaaaaagatttctttcaaaatattactgctcattgacaatacacctagtcacccaagagctctaatggagatgtacaaggaaattaatgttgtattcatgcctgctaacacaacatccattctgcagcccatggatccaggagtagttttgactttcaggtcttattatttaggaaatacattttgtaaggctgtagctgccatagatagtgattcctctgatggatctgggcaaagcacattgaaaaactt

SEQ ID NO: 31291 - DNA, 1856 bp, Homo sapiens
aacacccttggatgagacagatttttgaaatacaagccagttcacatgttctgtggtttttaaaaataagactgcataaagtttttattttttatatattactgcatatgaagcctgttcagtgagtgttatgctttgccataggtaagcttacagaatttatttgagaaaacgtagatatataaataggtctatttttcaacaggggaatggtaaggtttactaaatgtttagtgatacacacacacacacacacacacacacacacacacacacgggaattttttgccctttaatattgatgaaggaaaaagcaaagatatttttcatgttttttgctgtatttacctagactattccaaacattggtgatttttatctaggaggtttatccatttaagggccagagtcagcctttcctgaatacgaacataaaacctttgctttgaaggacattttgcacttggggcaaagcgaaatttgttaagtaaatggattttatgtgttggaggactagagaagtagtaacctgggacagagaaactgtccaatttaagactaccagtccatggccagtcacaggacgaagaacatttagagctgaatcatctatattttctaagttttgcgcacaccagcaaatgattcagactatgtttgttcccatgtgccagggagctcttgtgctgatgtgatgaaacttggcatagcacagtcctccagcagagcagtgcctgcctgtttatgctgagataacttgcactctcttgattttactcaggggacttctgcagttttttgttttgttttgtttttaaaactgtgtccctgcctctagtgcatttcccttttagtatttttcctctcccacagtgtctcagcctgaggtaatttgactgtcatatatgggaggtttggggtttatattatctacagattatatatgttgtataggttcccatggcttcgtttcatacatagtttgaacttatatagtcatttccagcattccttcctgtttcttcttacttttagccaccgcctaatctgccgcagagctatttgtgtcgattgccttggttgtgaaagcaacagctccccacacccaagcccttagcttcagaagtgctttccttatgactttacagagtcatcttggtggctacgtcgggttctgcccaacatcctctacttagacatcttgtcctaggaattaactctataatactcctcctttctcaactgcctccttgcatgggaaaggctcatcttagtctttttggtttcacagtgtttcagaaagctgtagttttctttcaactctgccctcatggttttaccttcctttctctcaccctgggtccctgggtccctaaccctggtcagtgatctgtgacagtacctggtcatgtaattaggagagagggatctggtcattatataactaggttgtggaatgccagctgaacaagtggctagaaacctacaatccggcttggaactgaggtttcatggtgttgatgtgactccatgcaagtgagcaatttactctgtgttagaacgtttttattttgaaaaggtagacaacagggtctcatttgatcgttaggaagaacactaatgtttattgagcgccgggctgggtacttcattctcacgttctttttcagccctcagagcattcttgtggtagggcaagtgagtggcagatgcattgaggaagacatgcatgtggatacacacatattcgtagtttatttatactgtaaattttaaatatgcctaataaagttatactaggagacagtgtggtatagtagaaagagcatgggctttgaaaattcatgaagacctga

SEQ ID NO: 31292 - DNA, 1032 bp, Homo sapiens
cagggcttgccaggcacttggtgtggcactgagtgggcatcattttattacttcaatcccaaagcaggttcctctggactatggcattgctattctctagagctggcttctgcttcagattttgatgagggtgcttttttctcagctcacgatgttagcgccttccatgctctttagctgcctaaagatgttcatgtctttgggcctctgcactggatacttatccaagtgtatgtgaggctttggccctttggtggtaatctgctgccaagaacggttctttctccccttttcccaccttcctcttttctttcttaaatataattgtgcattaattgggtcaaagagaatttgatccttcctaactgttcctttcctaagttgtcactgtgatttccaagtaactttagacaagggatttaaaccattgttcctttttctttcttcataaaatgaaattggcagtattgctgctttataccaggaggactcagaagcattgcattctgggctgagaacgtctaggtacttttcataggaggctgaaattgcgggtgtgatttcagaaatagtcttctttgtgcttgctgttttgaaatgactgatcctagaaaggtctctggctgtgtagttacacactgcttgattttaatagaaaacgtttaataggagcatttttttttggagccttgcattcagtctatgagagtctgcaaggctttaaccaagagagtatgcaaagacagggtgttctccctttccctggaaaggtgggattgcttggcaagtagccttagaggaagtgtttagtgtgtgacatcagggaggggggcagctggccaggatttctaacaccgtgattacaggtagcacatgctaaattagggttctacaccgctagtacatggctgcatttagcaggaaagtgaagaagcctgaatgtgagaaagtccttgccaaccttataataaagtaggtgatgtttataatgtctattatgtatatagcacttgtccttccagaacagaattt

SEQ ID NO: 31293 - DNA, 1049 bp, Homo sapiens
tacagatacaatgataatgtcagtaacagtttccatttattgagcactattttgtcatgtattgttcattcactcattctcagcaaatagttatcaattacctactatgtgtcagattgtcttctaggtgttttctaagtggtgttatagggtatcctacagcaatgaaaaaattcttgccctcatggaacttacattccagaggggacaattagtcagtaaacaaaataagttttcactgtgtaacatactgtatattttatgtatttattttgttaattgtccttctctatctgctagcatggatagagggaatggatccatgggggaagggagagtagcctggagaagtaggttggtaccattattgttgttatttttaaaaaaatagatcttaggtatacagaattatattaatcatattttttgctccatgacatcctttgtcattttattgttatttatatactaataatgcaaggaaatcctatgaacctatcactgactatgacatctagaacactggcaagaattttgatcttttaagttctcccattcatgccttattttgacatcatattttaagccagtaagtggggacaatgtagagtccagatcggaggtgggaagagaccaaaggtgaggagaccagttggaggtggtagatgaggagaggatgatgaggcataaccttagcagtgatagtggaatgaagagctggatgagattggctttatgagagaatgcagtattgcattgtcatcatggcatggagttattattcatcaactctttatgtttagataaagtacatgatgatgaaatcatccttggtttatttgctttcatgctttcaacatgtagtgctacaaagctagagaatctcaaaatttttatttcagatttaaaattttgctgtagattaattaaaacataaaagtacatgcaaaaggatgtaaaatttaatgtgctagaaccccatattcacagtacctagcataaaaagttaagtatattagtcctcatattacccctattgatttcatttc

SEQ ID NO: 31294 - DNA, 1050 bp, Homo sapiens
gcccttccttaaaagaagagggtggagagttagtttgctttctgccatgagaggatagaatgaggaataggcagtctgcaacctggaaaagagtcctaaccgaaacctgaccatattggctccccagatcttggacttccagccactagaactatgagaaatcaatttctgttgtgtgttagctacctgcctatggtactttgttatagcagcctgaactaagtgtgcttattaaagtactgaaccataagggtgatggtattttgaatacatgttttagcaccattagtgtatgattagggcagggaattccctaatgagggaaaggtcataggctggaatcctgtgcgtgtctgtttgctcattccgtggcctaagtctgatcttttaacgtggctcctcacctgacagttgcaggcccttgggcatgaggggtgccatatgagagaatacggatggatcaccatacctccatcactaggatcatggccacaaatcagagctctgtcactgataacctctttggaaactaatagttttgcatctgtacatactatatgtatagatttatgtttttcagaacacgagcaggagatggttctattttagtattatgagactaattttttttaaaactgtatcttctaagattcatgccttatatatgtatgtacttttttaaagtctcatatttttatactctctttcctgccttgggcctcattttatttccttcagcttagtgtttttgcaattcttcctttagggatttctaaatattcatattttaatttgactttccttaatttggaattccattttatgctccagagcctcagacagtgtcataaatatgatgatggctcaaatggttaaactatgtgccaaaaaaatctgtggtcagctcagccacgtgtaacatccttatatcctgatgtatgctggctttctttattcctgacacatctttttagaaaggtagacagataaatagatagatggataaacagatagccatttgcaatggagtaatttctatttgtctacatt

SEQ ID NO: 31295 - DNA, 1120 bp, Homo sapiens
tggactctggtctaatacttacagtgatagagtatgggtaaatacacaaatagacttttaagggtatcctttagccttcagactttctgagacccgctgagatacagaagagaagaagtggagagattccatgggcaaaaagggacttgagagttatggctcctcaagatctaggttcttattctcactgagcctcggcttcttcatctctaaaatggagaatatttaacttgtagagatattatgaaggtaaaaatagataatttagcacaatgctatatatatatgttttaaatacttgtcttttgccagataccggtttgcaaatcttttcttgccatctatggattatgtttccatcctcttcacatgtcttctgcagaggaaaagtttttaatcttaatgatttacaacttgttagtttttccttttcctggattatgctttcaatgtcatgtctgagaactgtttgtctagccctaggttatgaaaattttttctatgttttttaaagagccttattgaaatataattaacatactgtacaattcacccatataaagtgtacaattcaatagtttttagttaggttcacagagttgtgcaactgtcattctgataagttttagaacattttcatcaccccaagcagaagctttgtacccattagcaattatgctctatttctccccatcttccttgtccccccaacctaggcaaacactaatctactttctgtctctgtagatttgcctattctggacattttatataaatagaatctgtggtcttttgtcactggcttctttcacttgaacagtgttttcaaagttcatccatgttgtagcatgtatcagtatttcattccttttcattgcagaataatattccattgtattaatatgaatatataagattttgtttatctattcattagtttatggacatttgattgttcccactttttggctactatgaataatgctgctatgaacatttgtgtacaatatgtgtatggacatatgtttcttatatatccaatatgtacataaaaagaatatggtacatatattggtgtatggttggtagaaatgcctattcagagtctttgtccattttt

SEQ ID NO: 31296 - DNA, 1026 bp, Homo sapiens
acttcattgtgtgccttaaaaatgttgtattattaggatcctcaccttgaaagattgtttcaaaaaattgttattacattgaaataagtcttttaaagtacaacagtgtcctgttatctagattagatggataactgaggattagaatatgtatggaagatcagtcaccagttaaattggttggttagttataaagtatatgttgacagtgtgcatagtgctttgtgatactcttgaaaaaaattttaattgacatataattttataattagcataccataaacttcaccttttaaagtgtacaagttagtgcttctttttaatatgttcacaaagttgtgcaactgttacccctatctaattctacattgttatttgttaattgcttattatttatttattttttactagttttttatgtgtagcttacttcaaaatatatttgaggtaatttacagtaagagactcattataacagggccactatgatataagaggtcaaaaacagtagtagaaaggaaagaataccaaaaactcaaactgaaattaatgtagtattgctattaggcaaagcatataaatccagaactctgaatctggtagcatttttttcttctatcatggtgcaaaatttatttctcctaagaacttgcttttcttaaacaagtcaaatcacactgtttcttccctctttaaagttccctcttgattctcacagccaaaagtcatgtttcatattaatgtttgagacttattcaaggtcacatatatttggggggcaaacatggcatatcttcttgtagtatcaatttttcctaaaaaatttagagaagaaccaatattttatattaattttaaaacattgcttaatgtaaaaaatagatatagagtggaatgaagaatttgcctgaaatcaatgcaagatttcaaatagatatgctcaattgtgatctcagctgagaaaaaatgaagtgaaaatagagtagaataacgaatttgcctgaaaggaatgcaagacttcaaata

SEQ ID NO: 31297 - DNA, 1053 bp, Homo sapiens
ccctttcccagtaatcaacctacatttaattattcatgctatgatggactgcataaattaaagaaaaaatagaaaatctgaaagggaagataatgatctcattgttatttgtagttgaccatggtcaactataaaagtataaaaatactaaaattattaaatgtcatatttatgatcatttgttcacctgaagagtattgaataataaggggtacatttgggttatactgaatgagtgttgaaaatgattgaaaatcatgaaaataatttatttggggttgaaattttatcaaataaataatctataaggtgtatacattatgagcaagttagcaagagtgtcttgatacaaagtattggtaaaagaaaagatagttcacactgagtttgttttcaatttaattcatttttgcagatgtcaacaaaatctttcacctttttatagtatttaggaagaagagagcatgtaaggtcaaactttaattaacttttctttgcctatactggactttccctacacaagtaggtacttatattctgatcacaagtccccacacgtcggttgtagatagcaatgtcaagttagtgcatacccagctactaaagtttactggactttcaggtgttcttggcatgccaggcaggtggtacccagttatttagagagatctttctttcagaccttagacatgtcttttacatataaattacttaggtactttgaccgcatcatgtggttcagtttgttttacaatgaagactagagcttggggaagggtggtttttgttgcccatgcttacctgaaattcagaaaacttatcttgaaggagccagagccagttggtatatctctgagaactgtccttagactcttagctgggtggtgttttcctagtccttgtgtaaaaggataaagatggtggaatgtataaggtaaagtgtttttaggatatacgtatctgggtgccacaaagggcatgagtagggaacagtgaaggataagggtgaaaccattcattgatcctaatcatggaaagccttgaataccaggc

SEQ ID NO: 31298 - DNA, 1033 bp, Homo sapiens
ttaaggacatgtatctaagtgttcatctgggttctctaaccccctcctctatactgttatggtgttactaaaattttattagttataagtaactttacttgacactttcttcacatttccttcctggcttccttcctttccctcctttttccttatatgcttaaatctggaggaaaattttgttctgaattatatattttttaatcaatattgcaaacagacaactgtaaacctcaagtttttgttaatgaagtacttgaaaatatgattttttatttttttgctattatggttagaaaatagcgataattttttaatgaatggctggtgaaatgcagcagacacagtgcaagttggtggcatggtatcattgtaaaggttaaacagctgtgctggaaagagtcattttggtttagtccttttaatttggaacttttttggcagctgaattccaggacagactgtctatgacactttaatatatttaacatattttcaaaaactatcagaactcaggctaaataacctaaaccactttgacttcatactgggttacattttgcttgttgaaaaaaacttaagttggtttttaaaagaacaggctggtctgcaaaaaggtgatgaagaaatattagcctttgttggaagttgagaagtattatataaaccttagactgatattgtagaatggcttctaagactgaaaaattgtaggcatcctgttttaatcctctgtaacccagccatatgcgtcaaactgagcactcctaatacctgatacttagaaaaaagagtaagagagctgtttttctgtgtacaaatacacaagtgacacctagtatctatccctctattcccccagctctggtcttagggaaggggggtccaggcattttccacctggagaagtaggtgcctgacagcagatgcaacattggtgacttcctggactgtggcttgtcttcaaggcaccctgccaagacttcggtgtcgggggaactagagaattagggtaaaatttcagggcctcacc

SEQ ID NO: 31299 - DNA, 1035 bp, Homo sapiens
cagttgtcctccaaaatgccccaagagtattagaatatgatagaagattgtttatttgctaatgaagacatcagaactagccgaatggttcaaaaataattttaaatactttatacattgaaacaaatcaagccactataataattaggagccccttgctctggtgcagggcataataatcgctagcaaatccttagttgatgacatcacagtaatctgagacagagaggtggggactgtagtggacacttaaagcaacattgctgtgtctccttggtaattcatgaatgacagttcccggcaattcatgaatgtgacacttctcggtcatttctgtgttttggcaggtactggtggctttaaagccagggaatcaaagtccttaaagttgtaattaattttcctgaagctgataatgagacctactgcgatcctttcacataagacaggtctttacacacaatttatgaaaacagaataattaatagaaaatgatttcaattgtcctctgtaatatttcattgaaataaatgttgtagagtggttttagctcttggcaaatcatgcaataataataataaaagagaagacggctgtgtgggaaagagtagttatttttaaatcttggtagacaaatgggacctgcccacttgtctattgagcacatctctgtaatttctcagaaattaaacagcatgaccctttgattgaatccaaagctggaagtttaaatagataacttcaaagtaattggcttgaaatccaaggatctattctgggatgctttagaaatttttattcccttttcacctcagctttaaaatatatataaatgtcaaggcttcagactttaaaactgttgctgttgtactccaaactattttcttataattggcactgttcaaatcctttttggaacaggatttgagcttgagtgagaagagaaggtagtttggaagaatcaagaagtatgtaacagtgggatctaaaaatctaaacaaaaagaggttaaagggacagatctgatgtatttca

SEQ ID NO: 31300 - DNA, 1029 bp, Homo sapiens
tattaattttctgtctatatcagacatttcctaggtttttggctacccagagtctgaacctctgtttttatctggcatgaattctttgttatgtggggttttgtgggaggcggggttccttttccagaaggggtcagattttcttgtctttagaagctaggctgcagccatgtgaattaggttcagccaatcactattactcacccagaactttgaatcttgagtgcataactcaaagatgcagagacagtttattctttttagcagtggtggtgttgagagtccagcgacatcattgtctagttgcagcagtggtgatgagaaaggtgtgttaaccagactcttttgtggctgagtccctgtgtcctagcctcccttcagcctcccttgattctagctcacttccaggtcaggcttctagcttttccttcaagatatttctgtatccttcaaatatactttttccctttaagtctgccaaaatggatttctattgcttgtaaccaagaactctgactgatacactgcgtgaaaactaagctaactgtggcaggttatactttccaaaaattgtaccaccaatatatatcctatcctatatgctcttctaacagtgtgatttcacattcctccattgagaggtagagggctgtgttccccctgcttaaacctatgtggatgaatagaatgtgtagaattaataatgatgtgtgggttccaaggcaaggccctaaaaggtgatacaacctcctcctggtcctctttctttcctgtgacatgtgccttggaaactgagtccaggtaccctgaatatgccatattagagagagcacatggaaagactatatagaattagaggggtatgccagaggaaccccagctgttctagccctcagctgtttgagttttcccagtgtaggcaataggacagacatgtgatcaagcaagctgtcccatgacttctcagccccagccttccagctggcccaggtgacatagggtagagcagaaataaactctgagcccttc

SEQ ID NO: 31301 - DNA, 1051 bp, Homo sapiens
tgctattcttccctcacagcaagtgtttatttaaatgtcttcacacatgctgtttcttctatctgaatgccttcccccagatttctacacggcttcctcccccacttacttcaggaccctgcgcataggtcaccttatctcaagcgcttgaatatgcctcatatgatgtagctccttggtacatacttgttgatgtctgtggggataggcaaaatgccttttgtcatgtttgggtctagtattttacatcctcattcttttttcttagaattctgatcagaccaattattgagaagcttttgggaaacactgtttatctttcctcatagggtgtggaaaatctcttctgtgctagttttgggtgccaggcagctttgcattatttgtttttgcgtaagttggtctcatttgttcattttgtcaaaaaaatccttttaaatttctgatttatggtttcctaatttttcaatgctatatttctttttataattatttttgttatttccataggatttttgagaaggatgggaggtaaatgtgtagggccaattctgaatctttaaaatagaaatgcataaaatgtgcttggctctgttcattcacaaccatacctatccatttgaaaaattaagcatttttctgtttgtgtgtgtgtacgtatgttttaatttattgagtctgattacaatgcccacttctacatatgaattttcagagcctcttgtaatagttccacagccctaaaattgggaaactatctgctatgaatatatagcagaaacatagtcattggaaatggtgggcacattggtatccctaaagagtagagtaaaattcattttcatctaaaggaacccaatcctcttgtttcacatttagaaatcatcttatgtcattccctgttactctcacagaaaattcagagtaaggaacacaggtggagaagaaatgggcaggcagctttgcagagatgttatcaagataacatttttcttcacattctgtagactctagagaaatggtttacaagagagctttaaaggtattgttt

SEQ ID NO: 31302 - DNA, 1032 bp, Homo sapiens
aaacaactgatcaccgtagccttaccaagtttacatataaaatataccatcaaaatatttaataaatggtagctattatttttaaagatggtattttctattacttcaattattattattttattccataaacatctcttgaggatctaccacataccaggcactgtgctaggtatgtgtgtgtgcacacatggaggtgggggaaagggagagggataaaggtggataagttataccacttgttctctaggcgtctatattccaatggaagagacaagtcaaagggaaatgataatgtattaggaattatggatagatatataatactgtaaattatatatttatgcttttgtattgtatttatttatattgatacctatatttatcttggtaaaattctgtccatctcttcatccttccatccatttatccatctaatctgcaggaccttgtttccatttttgccttgagttgaagggaagagaaaaattgtcttggatgaaactactctgaataagcattggttgatgtcaagcaggggaatgaacctctaccatgattataatgagtcaggtagctttgttgttttataaaggtatttctaaaaccctcttcagaagcaatgcataagtaaaataagttttctacgtgaaccaaggctaaagctccactcccctgcaggttttgcgattttactctagataatatgtactgtttaattatggttcatccatataataaaatattatgggtctgttaagtacttttaaaagcatatatgatgttctttcaatttgttaggtagaggacatgactgtaaaatattacttagtataatctttatatgcattgaaaaagactggaagaaaatacaccaaaaactttacagtaactatttttggacagagggattatggttggttttgattgattgctgtatatgtttctgtatttctcaagttttctaatttgaatgtccaagtgtggaagaggaacagatggtaaagagtatggctgtagactcttgtattg

SEQ ID NO: 31303 - DNA, 1058 bp, Homo sapiens
gagaagaggcagcgttgagggtagctgaatgagagagacgggtcttgtatctaggaactttgagactagggtcctggcagagggtctccttcaggaacctatgtaaatacagccagaaagtctggttgtatacctacctgcccctttgcccctttcctctagcgtctttttctctgtggattcataatgtaattcaattgaaacctttctttctggagggctgcagcagcagcctctcttaaagatttctgagccataataggttgttccatgcattttgatgcttgattagaatcttagaatgtgggaactgcagtttacagacaatctagctaggtccttgtttgaaaatgaatgcagtgagaagactgctgtgttgatatgaaagctgataaatagtaaacctggaaccagaacccctaattcagatctctttccactgcatgattgctcttttgtttcatttcgataaggcagtcagcacaccaagagtttaagctttttaaagccaaggacttcttagaacctcccccccttaatgcctaccccatgctgaatatgttccagggtaacaaaagtgtacattgaattgactttggagcaaaagaatctgttagctgtgctgactatggctccctctgattaagtagggggatgtttgtttcaatgtgagaaattccttttctgggctctgctatgaatatgctatgccagtggtggctgtgggtggtgggtacaaagtcaagatactaagccacaggactgcattctgacccagaatagttagttggtcattatgatagcattcacctgagctctcctgacttgcttgggttattggatatgtaaaacatacattgataaaggaacctctttaagaggcaaggcacttgtgcgtgttttatttcaagtatattccaaggagcttgtttagtcctataaataatcattgatcctcagtgcctcacagcatgtattatttccattttgcagatgaatcaagaaagtcagacttgttaggttttccacctaaggcaaatgtgttaatattgtgtaaa

SEQ ID NO: 31304 - DNA, 1033 bp, Homo sapiens
aaaaacattgtgggtttttttggccaggcaccgtggctcacgcctgtaatcccagcactttgggaggctgaggcgggtgaatcacgaggtcaggagttcgagacaagcctggccatcatggtgaaaccccgtctctactaaaaatacaaaaaattagctgggcgtagtggcaggctcctgtaatcccagctactcaggaggctgaggcaggagaattgcttgaactgaggacacggaggttgcagtgagctgagatcacgccagtgcactccagcctggccaacagagtaagattctgtctcaaaaaaaaaaaaaaattgttattttttttttttttcaaatcagtggttgacttcattacatttgcctggaaaatagactggtaacaagtgaaaaactacctgaagaagccagttcaacttagagtgaatccaaaagggcagtggggccatgagaagcttcatttcttagcagtcaaccagagggagtttccaggggtcctgggaggagggtttagataagtgaaagttgtgccccttgcagtgctcttatttttcagtttaaaagatgcctcctgccatccacatgttatgcagttggggatttcaacccacttacagcatagtcttccctatttaatcatagaatctcctcatttttaactgacctggccagcttctttatcaattttgttcacatactgcgggcctcaagtgttcatttaaacgtttgggactgtaactgctaaagctgttttcacatgtggaaaatatgagcctttaagtttcgtttagcagatgctcaagccagcagccagcaatatgccccacttctagggtggtgcccagagtactggactgagcagctgaaatgcagcttaagttctggttttattgcaaatcagccaccaatgttgaattggtttcttagtccctgagtctgttgccttatttgatgaattaaaataagtaatataattcaggacccttgggagaagtgttttatatcactttgctaacactgaagactctcc

SEQ ID NO: 31305 - DNA, 1035 bp, Homo sapiens
gtgagaaaatgaacattctcagttatttgcgaagttagtaaaattgcagtccctattccatttttttctgatgaaaatggatacatgagatctcatttattgctctcctcaacacctttactgtcccagattccattcacgttccaaatcgtggacagtaaaactgaagtcagataaacacagtcacaggtacaactgggagcgagttttaacatagtggtaattttgcaaatgccaacatgaatactagtgagtactcaatttacgacagacaatttcacaaaaaccaaccacagagtgatttgatattcttgcttcttagagagttttctaatccatataatgcaatgggtcaggttgctcatatgattaaaaaaattaatcctgtagaaatgatgtattagacatctctaacccaagaaaaagatgtcttttgtataacttttaaattcccatttgtctatcttaggacaaatgatgacttcttcgtgtagtaatgaaaacgtctaaatcctgctctgtggagaaaagctagaaccatgggacattaagcaagaatactcctctgatttaggctcccagactacaactaacagtctttatgtatttatcatcttggttattgttttatctcaagcatatacagtgtgcagaaagtagaataatgaataaaatatgaccatggagaaaacccataacttttgcttctattatagaaagcagtgtttgttctttttaatttattacatgttcacattgaaacattaacatctacaatattgtctttcagtttactcttcaattactaaagcaaatgattttgatttatagcacttacacaactgcagttcaggtcacagaattgaaatctatttgataatgtctcagcattctcatgggcagccaggaaaaaaaaaaagagagagaaagacaaatagaaattttagtgggttcagataaatgattattctgacaaacctggaaaatagtaattaaacagttcattccaaaagaccccaatgtaaactctgctca

SEQ ID NO: 31306 - DNA, 1050 bp, Homo sapiens
agcaatgaagagcaaggacgatagctgtctggtgcctggtccagtgataggaagaatcagttatcactttatatagctgcaggggagagagaaatcaggagatctagaaggtgaagggaatgttcagcaaagttgaggatttaggagatttcattgttaatgaatgttgagctccggagggcacagtagaagggttttaggattcggggaggagtgttagatggggacagaatagggaatatgcataaccatatggaaattggagtatgggaaataggggtgactgaggtgtctgggactatggtaaagaaagaaagggactaataaagttgattagtcatggttgtctgaggacacatagtgcagtggttgtgttggggaatgccgagcaggatgtcaaggagactctccattcctgcaggtggaggttggagcttgaggggaagatcagtcttattcagtgcctttggggctttttttttttttttttttttaaccactgctgatggagattgaaggaataggaatctgcctatcaccctgtgtacctggcatcacttgttaactactaggctttgttttagggaggccagctatatgaggagggttttactctggtgtgttgaatctttgcatctacactaaaagtggccagtctactttttaccagacagtgcttgataaaagtataatctgctgctgatacctctcaaatctgttaactgcagcccaaatttttttatagatctccagaccaattgtatcttactgttcactgaaaagtcctcttgggtatctcacagatactgtcttaaactgaaatgtctgaaatcaaatgtaacatctttttctcattatatccattgtttatttcggtataggtagtcacaaaaagtgtactgcctagttgtctaagcaaatacttgagcatcattctggagtctgttctcttcctcttttccatatccagttaccattaaatcttacagattttttttctgcatcacttggactgtgcagataaatcttacagatttttatctcctaact

SEQ ID NO: 31307 - DNA, 1032 bp, Homo sapiens
tcctgacctcatgatccacccagctcagcctcccaaagtgctgggattacaggcatgagccaccgcacccggctgttcataaactttctttgttctttgtttttctgtcccccttggccttgagttttattttttctagaattagaattacgagttttattttcatttgctgatttattttgtctgtctttttgccaaagaagtcttaagtgatatctctaatctgttgtgactacaatagagttttctaataatttgattttgtttaaaacagatgtaatttataatatagtcatgttagtagaggagaatcctattttgcataattattttcatagggctttttttttttttttaagatggtctggatttttattattcctcaaaacaacatgctcagaagatggtcgaatttcttcagtgtacagttccctgtaggtatgttctgaaccttgaatgtgactaaatctaaggacttgggaatggatgcggatcacatatattcttcaggctcagacaacttctctttatttaaaatcgtagtagaaatacttacacaatcaggaagcatatattgggttaaccacccactcacagaggtggtaggacttgtgctccaaagatcgggaaattttcatagctggagtttatattgaaaggtactattagtgtgaacaaagatttgcagtgggcgttagtatggcttttaataatgctatatagaaagtagattggtctgagccaacagcatgttctagaggtttggtggaaaaggttcaaaataggtagggcttagttagaatggtgaaggttttgacatgcaagtgcaggacagtaggttttaccagaggaggcatcatgaagccattttagaccttggacaatgatggtttgatttaatgaaaattgatattcctgagtccatacaggttaatgatctttgtctttatattactactaacttttttcttaatagatacaaagcatcacaaagactgatctctcaagatatccatagtaacacatacaatt

SEQ ID NO: 31308 - DNA, 1053 bp, Homo sapiens
aattgggttgtgttttagttggggttgctataacagaataccatagactaggcagctgaataaaaaagcaaaccttcttttcacagttctggaggctaggaagtcagatcagggtgctaactagcatggtcagattctggtgagagccctcttcctggtttgcacatacatggctgtcttcttgccatcttctcacatagcagagtgagagctctctagtatctcttacctcttcataagagcactcatcccatcaataagggctccacttatgacctaattacctcttaaatgacccacctcctaatgccatcacattagggattagggtgtcaacagatgaattttggggcaccataaacatgcagtccatagcaggttggttgttttcttgttttttattttgatgttcatattgttccagacttggccagtgggtacccctccaagctggggcttacgtcctttggacaggtgcttctctgtatttgatcttgttcttatgctgatataactttttgggcaggatttgaatttttcttgttcaggccccacatataatctactcttagcttattttgcatcatgaggaaccaatgtacttaaaaatagggcagtttgagttgagtcatctgtgatttaaggaatcatgaaatggcttcataaaaaacactgatgtcagtgttatgtattctcagcttatcagttctgtcacatgttgaaataacttgatcagtggggtagtgagccttgatgacagcaagaaatcagtctaggtatctttctgtactcaaaataatgtgataagaaaattgaattttagttgattgacttgatacattttgaaaactgtgttattgtctagggaagagacatgattcagggtgacaaaacaagatctgtaataattaaaggttatttggaataggttgggcagccactatgtttctgtagcaatgttgcttgtattgttttatctgatggcaattttattttgtttttgttggagtcagcactgcagtggtgcctgtcacacattttccttctgaaaca

SEQ ID NO: 31309 - DNA, 1043 bp, Homo sapiens
aaaaggtcaccaattttgtttatcttttcagaaaaaccaaccatttgttgatcttttgtattttatttcaatttcatttatatctgctctgatctttattatttcttctactaatttttgatttggtttggtcttgcttttctagttctttaagatgcattgttagattgttttctctgatgtcactttgtagtgcccttttacttttattctgacctttggagattagaatgaggtgtaaattctgagcctgagcctcagagattgcatgtttcctctcgggcctctgccattgctgtgagcacatgtttagttaaatctgttagaggaagtgagggagaacaaacccaggttgccgcacctgaagccagctaaccctcagacatgtaagcaagcacagctaaaatcagtagagctgcctagccaaaccccaactcatcccagacacatgagcaataaacttgtatgcccctgaggatttgtggttgatacagagcattgttgtgacattagacagttaatattgtgacatacgaacactgaattaacaatttttgtggctgggcatttctaggttttttctttttcttttttcccataaaaatttgtttcatttctcattattttctgagaatatatatgtaaggatgaatttactgtgtcaaagagcatataagaatctcagtacatagaaaaatcctttttagaaaggtcgtacctaccatgtaatgcagtttatgagattgcctcttttacagtcttactgttcttgatgtttggtatgttttctcttttaatgttttctaggctcactttaggtgaagcccagtctgtagtgatctgttagatgaacttctgtagcagttacaatctgttctacgtggttagttttataaacctcctgagttattatcattaacatttttatatgtatgtctttctctccaactaggctatatatttccttagggcagcacaaatatagcacaatgcataggtcctcaagtatgtagttagtagtacaatctgatttgagctacaat

SEQ ID NO: 31310 - DNA, 1044 bp, Homo sapiens
ttcaagcaccctcacttctcgagcgggagaaggtgcgggggaggggggtgggagggggaggggactgctgaacgtttcaggccaaggagacgctcgcggcggcggcggcggcggcatcttttaagactgacctgctttaaaagtgccactttaatggcctaggaaataactaaaatcggattacacgttacttaccaacgtctcctcctaaactggagcgccaggtcgtgtataaggagtcaatataggaaacgcagggctggaacctgaatgcaaatccatcagccgcccccaaatcgcgcaccaagggagcggcgctcgggagcccccagatcagcccatcgccggagctccgccagcgcgtcccccccgcacccccggcccctcctccgcgccaactgtgtaaatcagccgccgcagtcctctcgccgcgcatcgcaggcaaaatcccggcttaggaagcaaggaagcaagtgatctctctctctctctctctctctgtctctctctctctctctctctctctctctcctctctctgtctctctctctctcgctctctctctcgctctcgctctcgctctctctctctcgctttcgctgtccgcctttccctctcccccattatcggtcacaacctggcagctcttcaagagacaccctgtgaaattgagtgtcgggaagtcagcattctgtacccgtggattgatttgtaacttttatttgcaaatgagagagatgcctgtttggaaaattacagcccaaaaggtggagggtgatcaaattaagaacatctgagctgtattggtgggcggtatcgctaaacgcctccggggagcggtttccaagtgatttgcagtaatcccccaccttcatgatacatgggtgacgatttgaaagtacacatatttcctcatctgtttacatttgccgggggcggggggcataaaactgtagggcacagggagttgggaggggggcatttgcctgagagatgctggataccatttcgcgataaattagatacggacactggaacaattaa

SEQ ID NO: 31311 - DNA, 1144 bp, Homo sapiens
gacctaagtgtatggaaaaagtaatgctacactttaaaatatagttaatattttaactatattgttattttttatatatataactatatttaaatattttatatttatatataaatatatataaatataaaaatatatatataaatatatatataaacatatataaatatatataaaatatatataaatatataaatatatatattatatataactatatttatatattaaatatatattatatataactatggttatatatatatataatatataaatatagttatatatataatatatatattatatataactatagttatatatatatataaatatatatatatcaactgaatagcttattgagtattgaagggtgccaagccagtcagttttttataagttaagatactttctcagaatttagaagaaaattatatttaagggtaggggaacctaatatagtaaagaggagacatcactaccaatcttacataaataaaagtattgttggagaacactatgaacaattgtatggcaaaagattagataacctagatgaagtgaacaaattgctagaaagacacaaactactgagaccaacttaagaaatagaaaattcaaatatagactcaaaaatgctcaacaaaatactagcaaccaaatctggcaacaaaagaattatataccatgatccagtaagttttattccaggaataaaggttggtttaacatgaaaatcaattagcattacatactatatcaatgaaataaaagacacataattatctcaattgaagaagaaaaatatttggcaaaacacactttcatgataaaaacatttaacaaactaggagtaaaaagaaacttcctccacggggtaagtacatctacagaaaacataaataatttttttaaaaaacatagctaacatttggtagtgaaagtctgaatatttccctttaagatcaggaataagtcaaggatgtcagctctcacacttttattcaacactgtattgaaggttctagccagggaaattaggcaagaaaaataaaaagctcccatactagaaaggaagaaataaatttctattcacatatgaattggtcttgtatatagaaaatcctaaagaatccacatg

SEQ ID NO: 31312 - DNA, 1168 bp, Homo sapiens
agttcaaagttccacagatatctagggcaagggcaaaatgccccagagatttgagcatttttgctaaagcatagcaagctaaagcatagcaagagtgacctgtgctccagttcccaataagttcctcatctccatctgagaccacctcagcctggacttcattgtccatatcactatcagcattttggataagaccattcaacaagtctctaggaagtttcaaactttcccagattttcctgtcttcttctgagccctccaaactattctaagctctgcctgttactcagttccaaagttgcttccgcattttcaggctatttttatagcagtaccccactatcctggtaccagttttctgtattcgtctgttttcacattgctgtaaagaatgacctgagactgggtgatttataaaggagagaggtttaattgactcacagttctgtatggctggggagacctcaggaaacttacaatcatggcagaaagtgaaggggaaccaaggcacatcttacatggtggcaggagagagagagcaagtagaaaactgtcaaacactttaaaaccatcagatctcatgagaactctcactgtcatgagaacagcatggaggaacaaccctcatgatctagtcacctcccaccaagtccctctctcgacacatgtggattacaatttgagatgagatttgggtggagacacacagccaaaccatatcaagaggttaggcaactatcatgaagtttcatagctgagaagtggtagaatggggtatagacccatcctgtctagctccagagctctgttcataatcaccatactccgtgctgttccctttacctttggcttttccttcatatgctctcaaactatgagactctgatctttttactcagtctggatctgtttacctaaattcagcagtagctgctcttgctcctattctccccaagtagattcaaacctttgccctttagttttagtagtcaattccagttcatactttattgatgatattgacattttattatatggattttctcagtgtccctgtcctcagttttaatattatttacatatgtttacttttcttctttcttctgtgtttcatagaaatacatttaccactcttgtttcaaggtaatccctccctgtatgttccaga

SEQ ID NO: 31313 - DNA, 1162 bp, Homo sapiens
tgccgaacctgcagatttttgttatgctgtgaaggcttttgttataaacaaaagtatatgtggggatctaatgtacggcatagtctgtagttagcaatactgtattgtgtacttgaaatttgctaagagagatcttaaatgttctcaccatgggggaagagaggtaactaggtgagatgatagatgtgccaactaacttgattgtggtaatcatttgacaatgcagtgtacatgtatatcagatcatcatgttatacaccttaaatttgtgcagttttatttgtcaatcatacctcaataaagctggagaaaagaacatgataataaaataagtcaaattatattgcttatttattatgaagtttaaataaaatttgctgttccagcttacaaagtccaaaagataagaaaaaaattctcagcatgaataaactgggaatgtatcttcacatcaaaaattcatttttcaatgcatttaatggtttactcatgctgagaactacttcttatcttttgaacttttgaaccctgtatgtatggagatgagcaaaaatgtatatgagtttcttttaaatgtactggaataccacatgtaaaacaaaacaagtagaaaactcaagacccagcaatacacattgatcaattatgtgataacataataatatttgtactgggctttaggcatgttatatgcaatactgaaatgaattttgctatgagaaatatcataggcatcagccattgaaaggtatgcctaacatcttttgtaaagcaaatcttgcttgaatttaactaacagtcacaagtctgggccagtaagcaacacagtcagtgtcccctccacccttcataaatctatttgcagtagaaatctcattaacattttaattgttttgtatctaaagttgctctcagtgccacatttaaagggctcaggctcattaaaatttaaggaccagagagctcatagtctactctaatgacctagtgatggttgtaaaggctctaaatattttttggttctttgaataactgaggaattccttgtagtggctaagtatgcctgaagataggttgttgcattgcccaatttcaatcccatcagaaagctctctccctcttttccctcatctaaatcctagggtctcttaaagtccctttc

SEQ ID NO: 31314 - DNA, 1217 bp, Homo sapiens
tttgtcaactgcaaatttaaatctcattttctcttaaaggaacttgataaaaagtttgaaatgaaattctgagtaagaaaggtaatgtgcttttactgcagaagccaatattctgcacttgctatttcttgtaataatatatcttccttgccatttgaatttgaagtatatgatacctgtgtgcacttgtgtgcttgtgcaattttactcattcttatttatttctgggtattgtgcaccagaaatacactaacaatattaccaacaacaaagaccattgtgatttatcacttggtttggtaggggtaatttcacttattagttatttttgtaactaaattccttattttttcataaaagcctactaataatggttgtagctataatggaacattctactattctctattggagtttaggctagtcaatgttagaaactacgaacatgataatcaatcattaaaattcccttaagtgattagagtattttatgttgggtaaagaagatgaaacttgctcccaaagttctctgctctcaggtcagtctggtgagtctggcatttgaagggtagaggtagaagataggaggaagcagctgatgggcctgccaccaatgggttatttttcagataggagggtcctaggaacccagataacctggtcagacttttttgagggtaatttaataatacacttcctgagagaggcaaattagaagaacagagaagacaaagccaaaaattgaatcctacataagacaaagggaggagagtagtgacagtcaagagaatagagaaactcaaaagatattaaaggtacaaatgtagctgcacaggttaggatctcggtctcaacaggagctggacactctattggtcaagaacagtaaaaagttggatgtgcaggacatgatgcattattattatatatttttgaacatgaataatctgctctaatgtactatatttctcaaaatttattctctggatcgctgcttccgttgtattttaagaagtgttacatgaagtaaagtttttgtgttcaaataagtttggaaaatgctttgttaagtaacctaacatactattcattcttgtaaggactttccagagtctttaatatgctaatgtatatttttactcccatagaagggcatatagatttctgtgtattcaaacccatttgactctgtagcctttctaatggggatatcttga

SEQ ID NO: 31315 - DNA, 1026 bp, Homo sapiens
gtgtcaaaagtaaatgaattcaagaataaccacttgaaaaggaattctcccttaatgtctttggtgcaaaaatgtgctcagattgtactggctctgaagagtgagactcaaagaagtaaattactttctagctactagttttcaattgctactggctcaaagtgctagctaaccttgcaaaagtggagcagagaagaaagcagtttgcatttttctcctaatcaaaatggaagagagtgagtgagataccatagtgtcacagagatttctgatggcagaagtttataaatagtcataaacatctcattgcaagtctcaacaagaaccacttaaatgtcctgtatacatttttcaggcaatttttatttggaataaagggtctaggaaatggttttgaggtgtgaaaactgatgtttatagagagtaaactgttttctttgaaggcctttcaagtatatattcagcagtcatgtaattatgtaaatttgtcttggacagttaaggcagttagaagctagtactaatgaaatgctcagttatagattcaaccctggtctgggccagtgtgtttcagccaaagagaagcctttagcaaggcccaggaagcatctctgaggcatccctgcaatttgttgagcttctttggtcacaaggggactgaggacataaaaatcaaggcttttcccagaaaacctgcctgaactgcatggcagttgcatcctctgtgtctcaaatggatagaactgaatatactacacattttggaatgaagagggctgttgtttttttcaccagtgaatctgagtatggtagaatgtgtatggaataagcagtgagggatatctttatgatgtgaaatggtttaaatgagtttaagaaatcgatgacttcattcacaaaatgactccaagggattgttcactttttgaatggctactacttttctcccatctgtaaaatggaggcagtaatgtctagtttcaggattgtggaaaggaataaataagatactgtctggggagcacc

SEQ ID NO: 31316 - DNA, 1033 bp, Homo sapiens
gcttgactctaagttgaggcttcctggaatgccaataaaggctatactcttgacttcattctgttctgctggaatttccacttgctgagtttgatggagaaaagcatccccacaatagtaatgcatgagtctttaaatgactgtgtgtcttagtccttattaatgcagatgagactttaataaattatttactgagcacttaatatttgccaggcactattccaagttttttttttatataaactgcttatttaatctctgtaatgtatccacaaagtagatactatcactacttaaagctgaggcacagagtagttatgccagttgcccaaggtcagacaggtagtaagtagaaaagcctggattcagtttcagacagcctgattgcagagtccaatcccttcactacggcattctgtgtctctccggttgagtacaagtcccggaggacttgtctttgattggtttcattagtaaaccaacattagctaatgttctttgccactctgaatgctggtgaaaagctggcaatagaagataattattttctggaagatgagtattacatataacggctgtgtcatcctctgattcaaggcagtagagtgtagtcgttaaaattgttctggaattagactttgtgatgttttagctgagtcctcagatttccagttggtgactttggaagttatttattctctccgtaccttaatttcttcagtctgtacaatgaataagaggaacagttcttacctgatagggtaatggaatggttaaatgaggatctatacaaattacttgatccagtgcttcacatgtagcaagcacccaataaacaaccaccacatcactaccatcattatcaccaccaccatcaaagtgatttggcagaaaggtagtcatgctataatgcctagcagccagttatattctttgttcatcttaatgtgaatgagataagtcaatcataaagttacctaggattgagtggactttttatagacctggttatccaaactatatgtggatctat

SEQ ID NO: 31317 - DNA, 1029 bp, Homo sapiens
ttcccaatgttagcccttctaatgagctaactttagtttacttcctctgtgtgctatagggaagacctatacttcctctgtgtgctatagggaagaaaaatatacaaagactttttttgtttactctgccttctttttgttagacccttgtgtcttccctatagaacagtgctttgtataatacttaataaccatattgaatttgccaataaaccaagcatcatttcctctaaaattttccaccttaccaaagtaaacttctaaaaagcaaattcaggggaatatacaaaactgtgcatatttatcatgggttgaaaaaaattcatatttttcttattttgtctaatctatgactttttacttttaacataatttcctttatatctattcattattttacagaatataagatatttttcaaaatttagagtaagtactcagttgagtcccttgtgtgaaataatagacgaattggtttgtgtgttacctctccatctgccatcctaagggaagttgggaaatctcaggcaagattaatgacaatagaaattttgttccatgattaacttatattctgtcagacagccttttggaacagttttataaccttctttcctctatgctatttccccacactatttgcttaaagatttttttttcaaattagtcatcattcacttcttatttcctttgtagaaaaattaaaagttataaaagagagaaaataccaaaatactacttatactttgattaaatcttgaaataatttttaaatggcacctgcaacttaccctagacctggtgaaattcttgtgaggacaatgttaactcatccaacattaataggatggtacttatgtggcaggcattgtgctcagagcttaattaagtttctgctccatcttcaaaagactaagagtatagttggagaggagatacataagcaaaaatccccaaaaaggtaacaagagcagtatacaagttgttctgaaaataagggagaggtgctgacttctcctggaggaagct

SEQ ID NO: 31318 - DNA, 1075 bp, Homo sapiens
tgtaaattcaaacagttttacattcacagttgttcatctcccattggacagaagcagaccaacaattcagatttctgatgtttacattagtacttagtactttcatattcttaggaaaggattttttttaacccctttcctaatctctgaaatgcccaagtgttctaagtagcatggttgattaacatataacgaatctattagtagtgcatttaatgatgatgaaatgctacacacatttaaaataacagatataatagctcactgaacagaattatcctaaagttattttggaatcctcagaaaacatttacttgttctctgaagttatctgtgcagactattgtgatttcgtgaagggagaactcaagatcgtacacctacatttcattaacttttttggtcatgtttcatgtgtctctaaggcaatagctacagtaactttagttggtttttggctactatctcacttgtatcaaatagattcatagaaaaatatggtgacagcattggcgggaagtttggaggacatctaattcaaacctctcatatttaggacaaagaaataagaaccctggcttgggttttagggcacctgatgaggaactagaacttcagatatactgtttattacacaaaaatagatttttaaatttgagattttttgaccaaaaaattttatcataaggcagtaaactcaggtttcatagatctacataggattacttgttggatataacccatttaagtttaaatacccaattcttttttgagggctggactctggtcattctggcagttgattcttctattttcctacgagttctgtattatgagaatttatgctctccattccaataatggaataaaataagagcatgatactggagattgccatcccatgtggtgtgttaaagattcagtctatcctgttgcagtctcattgggaaggagcaatagggagacatatgtgatcactgcatcatacatattagatggtaaataaaatttaataaagagcaaagatctttttcctgttagggaataaatttgagcataattgcaaattacaatt

SEQ ID NO: 31319 - DNA, 1054 bp, Homo sapiens
tataaaatatatcacagttttttcattgcttcatttttaatacattataaaccttaagcaattgaaagtgtcctgtgcccttgagctttaagagatgagtttaaaaaacttataacatgtaacataatccaattgaccaaacatatgttgagttttaactatttgctaaggattgtattaagtactaggagtacaaagatgaataatgtaggattcctcacttcctttgccttattcagctttttccttactccttttagtttttcactcaataggtattttttctcctaattttaaggtctaccttttaactgtaaatggctagattggactacatggtgtctaagttttcccccaattctgcaattctatgccttctaaatgtatgctttgaatgctaacatggatatgtgcaaacactgaggcaggttttgcttagacatgcagcaagtttgaaattcgtttatatacacgtttaagaaactcagcttcggagtcagacgggcctaggtacaaatatttaccacttaggcaagctaccaaatctctgaatttttctctgtggtgtattttataaagtagggataaaaatactacttcctttataaagcattatgaagactatatgagataatgcatgtaagagacttaaacaggtgtgttcagaatataataaactcgaaataagtattagtctttattcatcaggcaatataaatataggtaatttacttgtctggaaaaatattcctaagtattcgcaagttaggtaaagtgcatttgtccttattttacaagagaagttagtgaactttaatgaggatgacaggataaatgtattttctgtctatgctagtcatgttcttgtcaagaaccacgctcagaaattctttgttggtagcagactatcgcacagtggaatcatcttacatctagtgttttcattgctcagcactgtgctgaaaacaacagctctaccatgtttgcccaatgagtaaatgattggctggatgaatagatgaaaatgattgctgttaatacactaaatataaaa

SEQ ID NO: 31320 - DNA, 1103 bp, Homo sapiens
atttatcttttgtcttaggaggcttttaaagttttctctttatccttaatgcattctagttttattgtaatgcatttaaatatgaatttacttttaatttatctggctttcttccagcttttgctttctgtctgagaatacatttttctttttctttttctttttctttttcttttttttttttttgagacagagtcttgctctgtccccaaggctggagtgcagtagggtgatcttggctcactgcaaactctgcctcccaggttcaagcgattctcctacctcagcctcctgagtaggtggggttacaggcgtgtgccaccatgcccagctaatttttgtatttttagtagagatgttgtttcaccatgttggccaggctggtcttgaactcctgacctcaaaatctgcacgcttcagcctcccaaagtgctgggattacaggcgtgaaccaccgtgcccggccacattttatttcagttcttaaaaattcttaggcatcattatgattctttttaaaaatattggtttttcaccattctctcaacttgctacttctggaactcctgttagtgatgtgtgggagcagagagacattagtagtgctcaccaatattggaatagttattccttcaaggacatatgtgtgactatacctcttaggcccttgcagttaagcagagctatgtaactaattatggacaataaaatgtgagagaagtgatgtgtgttattgccaagttgaagcaaggaaaagcccctgcgcaactctctagtctctcttttcttctgctttagcaattacgacagagggcctgaatgaatggtaaacttctatgaagatactgatatttgggaatatttgctactgcaatgttgactctcttatcctgagtaaaatagaaagcctctcaagctaatccgcatgttacctaaaattctcttacatagttgtcatttacttgtttctctggtataatctttcagttcagtaattttttctttagctgtgttcagctcaggattagtctcttttccagttttaattttagttatggtaattttctttctagcatttataactccatcataaccacattctc

SEQ ID NO: 31321 - DNA, 1062 bp, Homo sapiens
ggcctctctaaaaatttttgcttctcccttgagtggcataggaagtcattggaggactgtgaactgagaaatgatatgatctagctaacatttttacaggagtataatgaccgttaggttgttgccaccaggctcaaataccaccactcataaaggcatttttgaaatagactgaggtaattcctcacggaggggaactgctactgtcaaacagatgtcatcagaactataagaatatattagactctttcaacatcgagaaaatgatcaggaattgtaaggagtcactatggtgggaattttttttttttttaatttgagttgagaacctgtctgtattctttttttaccaaaaaaataaagacttgctcaagaaagacatgtgtccctatcagttctaaaaatatcatatctgctctgatggttaattgctgccagattaaaaaaattcttattaaaacaagttttatgttatgagaattgtaggtgaatttagaagccagagatacaagaatgtcttcagcttgtttgaacgtgttgttgttaaatagaattttgaaaactgatgaatagaataaaaaatttatcctgtttttctcaaactatgtctaagaaccaaataattgattagaaggatagtatttttatagaagtttatcaattagtaaagaactgtggttatatgaactatccattaatgaacctactacttataaaatgtatccccactcaaacatatcttcagtcagatatctgttctgattctaccccattgtgtcaactccctttctgttcgtatatcagtataacatgcttttctaatcagcatgttagatgtggatatattgattagtaaaatgcaaattatttctgaatgaaagtagtaatcacataaaagaaatgggattttataaagttcaaaaaagtggtcctggagaaccatttgagcctttctcaaaattattaataaacagtggtctaacagagttatactagttatcatttgaagaagaaaaccatcatggattatcaaagataatgcttttaaagtgaaagttttga

SEQ ID NO: 31322 - DNA, 1046 bp, Homo sapiens
tctttccctctgacccatcctgcttggtcattagaggaagcgtcacagaaggaagaaagcagtattatgcggtgccttccaagacacagacacaatggagattgctgtggcaccaatgcgtatagagatgtattaatgtgatgataagtagaggggctgagatcttgtcagtactatcttattgcatgggaagtttacagattaaattcttttttctgtgtcgtattttattcatctttaatatcccttataatagcttttcagctgtagaagaaacctcctttcttttcttttcttttccaactacctctttcatagggtcaggagctccctctgagtccactactcttagatgatttgtccccaataatttatatatcatcacttaggttatttttagttgattattttttggggtataaaagagtgaagtgcttataaaagcttcctggcaaggagagccagagtgagaaggtacagctgtgagtaatgagtctaccacttatctctgggggcttgcaggacaggtttttagcctgtttctcaacatttctttggacttgtttgtaaccttggtagtcacagtgtgggagggtaaaagggaagagcagggctatgtaagtagcaatctaatatataccgtctctttctagatgagattttatgatctaatgtattctttaaaaggaaatacaattgtagaaattttcataggaattcagagaatcactgcagaattatccttttaatcatataggtgcacaacaaatacaaatccacatacatatttctttttctctacctcatccccacacccctcctgacaaaactcaaactgtgttttaagtgttctgtgcttggtggtggctgctgccattttcggcaattattttattttttttcaaaatctgttgctttgaaaggccccgtagtgttatgtagggtgtaggtctacacagttattacctactgtcagcaaaactgaatagctgggagggaataattatacaatcccttttgccataagccacttctgaacatattgc

SEQ ID NO: 31323 - DNA, 1035 bp, Homo sapiens
tggtggtggatttaagagaatttgttttccttcacaaatgaaatgatgtatgcaggatttgatatgtaattctttgagtaagagataattgctgtacacactaaccaactatttgcatttagttagcaacagtttctactgaactttatctcatgtttccttaagtaaatgtttggaagtatgtttgtcttatttagtaactttaaaaaaattttaccacatctcaatgcttctcaaaggttatctaaatatctactcaaggaaaacattctttagttactcagcatcacaggcttcagttttctcatatgtatgacggcttgtaatgcataatattcttaccagccctgacatgcagtagtagttatttatatggtattgtattgtgtattttagaactacattcaattacaattcagtctgtattcattttaggaaggatgcatgggaatgtgttctgaagcagggcctctcaaagccaagtccttaaaccacataccttagactaatcttggatgctggcagaaaatgcagattccttggttctgtggactgaattgtctcccttcttcaaattcatacattgaattcctaagctccaatgtgtctgtttttgaaggtagggattttaggagataagtttaaatgagctcataaaggttcattctaatccaatgcaattggtggcctttataagaagacaaaaagcgttctctttctctgtctctttctccacacctgtgcacactgagaaaaggccatgtgaggatgcagcaagaaagtggttgcctgcaagcctagaagacagccctcacattcaaaatccaaccatgctgccattccgatcttgcaattccagcctccagaacggtgagaaaataaataaatttctgttgtgtaggccactcgagctatggtattttgttatgacagcccaaactaagacagattttggcaccaaaaagcagggttgctgctgtaacaaatacctaaaaatatgaaagcagctttggatctgggtaatggtaggctaga

SEQ ID NO: 31324 - DNA, 1024 bp, Homo sapiens
tgcctattctgggtgtgttgtataaatggaatcttatgaatgtgactgacgtctttcacttagcaaaatgtttccaggttcatccatattgtagcatgggtttcaatacttcattcctttaatattccattgtatggaaacaccacattttacttgtcagtatatcagttgatagacatttgggttgttttcactttttggttactatgaacaatgatgctataaacatttatgtgcaagttttaatgtgaatatatacctaggtatctatgcatcataccgtattgctgtgttttaccctttcgtgccattttgatcttagagctggcttcatgatatacctatatccctgcatcccagacacaagcatctgtcttcaaatggtcttgtttcatttgtctcaattttaggccatctgcttttcttatgttcatattctctgtcatgtttttatataaatccagggtttataatgccaaccaaatgcatatctttaactcagactatttctatggactttaaatctctgtatctaaatgctctttaccagataggtcttttttaatatcctacagggacttctaaatcaattttttatttgcctccattctaatgtgctcctcctcctatatattatactatgcgaatgacacatcctaataagaaatccaatagccatatgaggctcattcctttccttatccaattcatcaccaaaccctattgattcagtttcctaaacatatcatgaatctgttacttcttctccactctcactgacattgccttagtttaagctctcgtcttctctgtgcactggcctcttgtcactctgtagatcattcccttcctcttccatctattcttcctgagcctgccagaaggattgctctgaaacacagatctatgcatatcactcccctgtctaaaatatctcaatgattccgagtaatctgcagaataaaatgcaaacttctgggcttggttcaccaaacctttcacaatctgaccctaatgatctctc

SEQ ID NO: 31325 - DNA, 1047 bp, Homo sapiens
gataacttgattctttcaaaagaactttcagtaatctcagtttgatacattggactctttaagcatcttctactttatttcactataaatagtattgggctatattttaagtgtccctttactggctcaactttctcaactgattgttagttctttgagttatggaactatttctgttttacctttgccatctgtgcactctgtacattggtaagcactaaataatatgttgaatgaatgcatgagttctatatgctgtaaatattccaagaactctcggatcttatgtttcaggttctctgtgtttcatctgaccctacttcttccatatctagagccagagacagtattaaatacttgatatgcaataactggtggcactcttattctaatgcccttttcttacacctattttcatgccaactgctagcttgcttttctttttggttctcacagttattcttgctgttttgccttagttttggcaaggataaatgcttagactgatctccagaggccacaggacttgatctcactctatggctagtgagagatctgtgtgtgcctagtcttcatgctgggaccttattattctgtgcagctctgcaggtgactgtttgcgaaaggatataatgggaaatgaaacatttgcctctgtaatagttattgcttaaccactaaagaaaagtccaaatacatttccaagctttctgtaagtttcttctgactctccctttaaacaattgaatttattagacttttaaaaaggaaggagattgggggcgaaatgggaattcaacccctgcatatcattttttcctcacacacgtagttctagaatcacttctttaaacatctacttctgttgtaaggaaaatagcctttattttggaaccccatggggcttctgatttctctcattcaaatgaatgtatttgcagtttggaggaataattaatagggctctcctgttgaatgttgaatgagagagtgaatgccttttagccaaaagaggttcttgtttgtacacataaaatgtgatattct

SEQ ID NO: 31326 - DNA, 1029 bp, Homo sapiens
gaattcacatgtttaaaagatgctttcccacccgtaaaagtgtcagtgtgtgttcattgtacacgtagttaaaatgtgtgttgtagatttgaacagagaccttttaacttagactcaagattatgtgattattaaaacacactcacatctcaaatccttggttgtcttataatgtcatgacctttaactacaagaagagatgcaaatactgcatattctcacaatacttaagcggttagaggggcattttagacttctttaggtttttccacttattctcagagggttagcagaattgatgagtgagtatcaggtgggtttgatacatttgggcaggaagagagcaaacttctctattagctgtcaaatatacatcaatacgtgatgccttccctgtatttaacagcagttcgctagaccatctcccagtattctgttgatctagtaacttcaagttttttgtcacatagaatgttataatttaatcaaaaaggtaagtggcaaccttctttgagaaagtcttatacctgtaatgtaacttcatgaatccaaagataaataatagaacagtggtctttaaccttagctacatatagaggactttagagaactgctgatggctgagatccattcccagagattctggagtacaaaattttaggaattcaattttttaaaagattctaaggtgattataatttgcaaccaatttcgagaaccactgatatgatgtagcacatacagatcaccattggatcttcctaagatgcagattcattttctggggtgtctttaagtgggggcctgagagtttacattccaaataagctcacaggaaaagctgatgctgctggttcatgaaccacactggagtagagggtgtgtagaatttatctttttttttttcctctttttcataatcttctactctccagaacttggatgcttgttttaattccatactatatccctggagttttttttttctttcccattttgcttgtgagtttttgctcacaagtttttcta

SEQ ID NO: 31327 - DNA, 1029 bp, Homo sapiens
aaatgaaaaattctcattctgaagaaaacctgatgcttctattagtcgcatgatgattacatctgtaaggattccagtcagaatttatagcagtcaataaacaagctcaaaactcctaaaaagtaacggatgagattgaatctcattttcccctacttaaattagaacattattaactctgtgttgtttggaacttaggagaaggttcattttatttttgttttttaggttgttaaaatccaagtagagttaactattgaactacaaattgttttttaaggaaaagtaatgggtaattttatggcatgggctttgagttcatcacaaattttcaacactaatgaaattattatatccttatgttatcatttttggtaacttttttatattgggtttaagtaaccatcttggcaataatttctaagctaattaattatatatgccaacagagttcagtttgatttagttgtatattcaattccctttttattgtggtggaactaggaaataaactctaattcaattttaagtacaaataattaaatgaattgggcttatgaatgaaatcttctcattggcaatgccaggaggtcaattaactagttttacagtatttctgtgaacgaaaatgcatctccaatcgtgtgataaatattcgctgtataggactgaaaacactgttgattttattaatctttcagttagtctggagtagatattttcattagatttacagaaaccactatacatttttgaaagtaacatttcttaatatgaatttgatgtggaagactatcatctcttttactcgaccaaaataaaactctttggagacactttatttttatttcgttttactaaagcaatgtttgtttaggttatgttgtgaagtatatacaaaccatgtggattttgatactgaaattcagttcaaatgtatatcttctataaacattaaaagagctctttcataaatgtcctaaaaacagtgattagaatcgtgcctgaaacagcatgattctctgattc

SEQ ID NO: 31328 - DNA, 1606 bp, Homo sapiens
gggccttggatggggctcagaagtgaggaggactgaactgtaagtttcagaagcctcctggtaaatttgcctctgaaagcagaaatggtacccctgtcagtttcaagggcaggccttccagaaggagtaagagctgtagcaatcaggtaaggtgtggactaaagatagaacagtggcagcaaggactaaatgttagagtcacctgggagacttttaaataaaacatttctatgctccagatttctagagattaatacccaaattgtctgggatggtgccaggttattgacattatttagctcttgtccctcctgtaattctaaaatgcagccaacgtttaaagctactgatagttaataataattgtggtgaagataattttggagctaccatatagggaacatctcataccaagtgtgagatggcactgtatcaaacactttataggaattatcttcttaatactcatgacctgcagagatatgtgtatctccccatcttaacaaggaggattctgagctccagggaagtgccttagctcatacagcaagtgcaggaacctggatctaaactctagccaggcctggctcattttatacccacatatttctacctccttaggtagtagcatctttgagagggccacagaaaaagcacaagccctcacagaaagaaccagacagctgattgtctaccactagggcaatttgtaaggattgtctgccaaagaagtcctgggaagtccaggaacctccacacatacctgcagagacagaggtcactgttaccatatctggatgtcaaaaaggtcttttggaaaccaaggttttatcctttttttgttcttcccctcatctcctcacccccaacaccaagggttaaattcaacatcagtagctgtggcacaagtcctcctaacaccttttgtcctcattcaccccgtcacttttgctgctcacaaagtgctccttgctccctgggtagatactactacccctgtctgtaggtttcttttttttcctccattaatgctttccttgccccctgcccccgcttcttcctatgcatcatctgtagcctactgaagtgtgtttttatatacctgtgtatacccggatatacacattgggaaatgcttcccaattcctggcttaaactcttgtgctccattactcatttaccaaatagaagtgtcttcagctgcacttaatttcaaattccttggtcatgtttcggtacctccctttctcctgataagtgggaaatttcatagcctgggaactgaatgggtccatactagcccaggtacaatttgagaagcttaatatcataatgcacttaaaataacctgcagcaatcgaacaccaatctgtacctttataggaagtttatgcaccatggtttaccccatctagctggaagttggcttcaaaatcagccaggctccccattggcccataaaattagtggtgtccatgcaaggttcctaacttgtctggacatgggataattcccacggtagctgtgacttggtgatttgctctggttcccttctccccgaataaataggcaggtgaaatgcagaggaaggagcatgggaggtaga

SEQ ID NO: 31329 - DNA, 1030 bp, Homo sapiens
taagtagtgtgagtgtatatatgtaatattaactctttgaagcatggagtttgtttttctaaaacaaagtttttagcctagtttttaggtatcttagcattgtccttttcttgttggattccactaagaatttaatgtcctttaaatatattgacagcatgacccaagaatattcatgatttcctcttcccttttaaaatataaactttaacttttttcactaatctagagattttcattttgacccaagactgacaattttaagaggatttttgacagctgtgactgtcaagaacagaacaggataaatgattaaactgggtaaatccaaaaaaccaactgcccatagcaaaaaatatatgtgtgtgtgtatatatatatatatatatatatatatacacacacacatatatatttatttctggtttttagaaataaatatgtcaaacgaatataattgtatttgtcctgagccccctttcctgagaggattgagttctaactgcttatcagccattgttcactgccatgcaaggatttagaagagagaggaaacaaacattctatagtttcataggcattgatccgtataaaaatttactctcccattaaaatagtttaaattactaaaaagaaactaagatcatagtgaactttgagttttattttacagtcaaattatgaatgggaatcagataatggcatttatttatttatttatttatttatttatttatttatttgagacagagtttcactcttgtctctcaggctagagtacagtggcgcgatctctgctcactgcaacctccgcctcccaggtacaagcgattctcctgcttcagcctccggagtagctgggattacaagcatgcgtcaccaagcccaactaattttgtatttttagtagagatggggtttctccatattgggcaggctggtcttgaactcccaagctcaggtgatcctcctgccttggcctcccaaagtgctgggattacaggcatgagccattgcacctggcctaatg

SEQ ID NO: 31330 - DNA, 1095 bp, Homo sapiens
cttatctcaaaatttcagtcaccatccacttaccatgtacttttttcgttattgaagcattccagatgcttcctttttgaaaaagaaaaaaggactaaatttaacggtatgtacagagactattgtgtgtgtgtcttgggaggagtataaatatgagctcccattaaagtaagatcttctaaattgagaattgtaagttgtttttatgcttccgttcgtgtggctctgtgctgtgtctgaggaacataggaatgaagaagacattgtgttggctcacaggacgtctatagtcacctgaggaaagatacaaataaccaagtatgagttaactagtggtttccaacaaggaacgactgtacccccaggagacatttgccagtcgagatggggatttacagcaggaagttagatatataaatataaagattagcagagcactgggctaaagatatatatatatatggtagtaataacacaatagttcttgaaatcaaaagactgataaaattatccagcaagagtgtgtgggtgatgaggacactagatgagggacacctgcaatcaaaaggatggacacaaaggaataccaaagataactgaataaaataataataatattgaacattttgtagaacccatactatttttaaaaagttctcctaagcacttatatgaatgctcataattagcctgttattgtcagcgtttttgtataatgattgaagcaggaatcaacagtatcaaatgcaacagagacatcattacaatgagtactaaaagtgtccatagatctggcaattaggaggtcattggaagccagagcccagtgggtagaaaagtaaaatgttgatgggcaagtagagaagtttaagccaaaaaagtttggattaaaaggaaaggaaaagaaaataaatgaccatgttataatgggaacaaactaaaaagaggtcatgtttttcatggtggaagacatggaagaatgtaagaggagcagccatcgtttatacacctcgaggaaaccgaagaagatgccttatcaactctgagaggactgggaagtttgacaaaccaggacaggcaaagagacataagagg

SEQ ID NO: 31331 - DNA, 1037 bp, Homo sapiens
tcacactgtccactacaatggcatatatatagtggtgggtaactaataattatttgagaagccaataacaacatatttaatgggtaagcaggtggcctagtgtcctgaccttagtttagtttctctcattgttctcaatttcatcctcaaatgattctatgtaaaatttctgggtctgtaccataagcttcccaaatctgtaagactagaaaataccttagtttattgttcaaaagtaatatttcagataccaaaattatgacttgtctctttcttcacatcaaaattagagtgcattcattctaattaaaatgaaatattattttatttcatttaatccaaggttaaataatgatgtcattctatgatggttcatttttaacagagacccaccgaagtttctttttgtatgtctagttacaagaggctaattctgtttgactattcacttgcagatataaatgaatgtaccattgacaatggtggctgtcaagatcgatgctgtaatacagttggcagttattactgcaaatgtcaagctggccagaagctggaggaagatggcaaaggatgtgaaggtaacaggactgtctgcttactgataagggaagagagaacatctatgtaatgcaaaagaggaggttgtcttttatccagagccagttgaagtgcctgtgttgaatgttgtcaagagcacagatcttcctctcatgtctagattacagtattgtaaccctaagaacatttcaagtagcttattatgggaaacatatgattatatgctggtttggttgtgtcatgttctgattatggaatttcaatcattcatttaaatccctggataaagtacatattttttaaagcatttcatttaattctaaagtaaaaatgatacttatcataaaatactcatatgttgctacaatgtaaatggaggggcacaaaactaaccacaggaataatattcttggtatagaattagctttttgcacaaacctcaattttctgtttccttttaaaattaattccttcattta

SEQ ID NO: 31332 - DNA, 1024 bp, Homo sapiens
agagatatggatcaatggaacagaacagagccctcagaaataatgccacgtatctacaactatctgatctttgacaaacctgagaaaaacaagcaatggggaaaggattccctatttaataaatggtgctgggaaaactggctagccatatgtagaaagctgaaactggatcccttccttacactttatacaaaaattaattcaagatggattaaggacttaaacattagacctaaaaccataaaaaccctagaagaaaacctaggcactaccattcaggacatagacatgggcaaggacttcatgtctaaaacaccaaaagcaatggcaacaaaagccaaaattgacaaatgggatctaattaaactacagaacttctgcacagcaaaagaaactaccatcagagtgaacaggcaacctacaaaatgggagaaaattttcgcaacctactcatctggaaattttttaaaagcaaaatgtttaaaattcaaggatttagtagagagcattttgagaaatggcttaattgcatattctggaaatagaaaacttattggatagggcagagagtatattcagggaactagtggatgatttattggggctagacagaggacagtttcaactcaataggtaaatcccctaggtaagtggataggaatgtggtttctgatggaggacatctgagtagaggaataatagggtggaaatgtgatttctgaaagttgttctgggcatgagtcataggatgttatagaaagacaaaaagacatggaaatgacagggataccatttatgggccagtgaaattgcctagctattaatatccataagttgtataaagagggaagaatcagttaattctgatgacacaatggacccaagggaaaggggacatatcaaagtctctttaagtaagatgatgatgaataataaatctattatcgatagcagaaatgccaaatgcagtatgtagaataagtgcatctttaaaagcactaaacagaaatatcacattccaacc

SEQ ID NO: 31333 - DNA, 1014 bp, Homo sapiens
cataggaccaggggttgggtttttatactccacatgaaccagtcatttgatttgtgctgtcccagaaagggaacatgtccttggataagggagctatcttcagcaaaagcaccccaaggaggggtgacagctaaaggctgtagactggcggcactcctggcacgtggggtggaagccttcgttactgaaaggagatccgggtggtagatctgatagcatccactacagtagcctatcatgtgaagaggttgacacatttagtgagtgcaaattgagctgttttgagctgagggactctcataacttggcacacgtaattgagcagttgctgctttctttgcctacctgcttgaatccctgacgttttagttttctttgcatatttcgaaaaccaacaagtgatgtgctttgttttctgatattttgtgttacaaataaatatgaagacttcatagatttaaatgacagtgggtctgttatattgctatctgtgtgtagtttttcttaaaatattagggtagatttcaatatggtttctctgatgaccttgtataatttgaatggacacttttaattagagcctgcaaaatttctaaatgtgccatatggtttgcataaagatttagaataaaagtaaggataattattgtctgtggaatagctaaaagaatgttcaactagccaactatcaaatgtgattcagatgttaaaaaataaaaaactgaagcaacagtaatcagtttggaattacatgtaataattatttctggattttttattttctgtagaatttgtggtaaaatcttaatgaaagtattaaagactccctcctaaaaaaaagtacagacatacttgtcttattgcacttcactttactgtgctttgcagatactgcagtttttacaaattgaaggtttgtggcaaccccatgtcaagcaagtctatcagcaccatatatttcccaatagcatgtgctcacttcatgtctctgtgtcatgttttggtaattctagc

SEQ ID NO: 31334 - DNA, 1052 bp, Homo sapiens
agatcaagaataattgatattctatgtgacccattaaaataggtcttatttaaggcaatactgtttcaaattgtatctcttttaagtaggctaacctgaatgtaggcaccctttttttgcactttacagcaaaactaagcaattcccgcaaccatcccgatcagaggaccttgaactgagagcacatgtttaatgatgcccagactagctattgattaaacactgacagtgttcagaggaattgagaatcaaaaagtctcccccatggccagctctgccatgctcacttcttaatagatggcaaaggaggattctaaatgagatccgctgccctgcgcatcctcagaactccacaggcaatgggattaatttctgctttgcagttttttggaactactatgtctaaaatgtccatccttctccagaatttactacagatgtccctccttttttattttttgttcctcttctttgaagaaaaaaagttttcatatgaatttaaggcatagaacaatatcctttcaaatgtggaatgaattaaagctcactgttaattactctataaacaaataaaagaacaaatcctggagaataattcaggctgaaatatcattctctaaatcaaataaacaacaatataaaaaaggctaaaagaaaataaaaagaagaaaggtttcagacaggactaatattctcattggcattgctccattgagttggttactgcccagaggcacagatatttttaggatattcttttgtctggtaggagattatgacccagaactgtgaagtaaggctgtttctacacttaaaaaaatgtaatttccaatggtggaaccacccagctgttttaccttcaacaaacattgatgaaacacctagagggtgtcaggcacgttgcttggtactttcccttttaaaattatttaatccctccaacaatccatgaaatactcattataatccttttaaagatgtgaaaactgaagctcagaggaattaaataaatcctctattatcaaacaatcagtaaataggtgagagcaaag

SEQ ID NO: 31335 - DNA, 1048 bp, Homo sapiens
cttgtaacaccctgcaagctgccctaggatgggtgtgaccttggatgaggaggctgttttcagctgaaggcaactcttggagaaacatttagccataagctgcgtgctgccaacaggaccagcacttgaggaatgaatgctcttctgaaaagagaaattgagtggtgtgctagcgcctcttctccaagagatccacttactttgtataataattagtgggaacagcacctctcggattctggttggtttagttttcaggaaaatttacaagaggaaggttagtgaagtgaactacatacaatcccagccagcgcatctggtcttgatgctgcaactgacaccaaacatatctcattacaagtctgtatttctcttaccctacttctattactgactgttcagatagggctcactgggaaacagactgagatgtgcatacaggatgtttactgaagcatgtgtgcttttgcgaacaacacatgtgagggggcagggaagcagaattgggcagagagaggagctgaattgaaatgcagttgcaacagacctcattcaattttgtgagaacttcagagctgcaacagcttttcagattgaccccaccatggcacaatgtagctggactatatactcttgcactggatcagtcattagacacaggctcttctaatgtaagggatattgtggctctctttagttaatggcatttcctagagagagaaactaagctgaaatctgtcaggtgtcataccatagcagctgagggaatgagcatttcagtcctgaaatggaatctgagcaacacatcatgatatctattacagtagttaaaaatggcatctcggcctagcgcagtggctcacacctgtaatcctagcactttgggggctgaggcaggaggatcatgaggtcgagagatcaaaaccatcctggacaacatggtgaaaccccttctctactaaaaatacaaaaatcggctggcatggtggcgtgtgcctgtaatcccagccactcaggaggctgagacaggagaatcgcttgaacctgg

SEQ ID NO: 31336 - DNA, 1076 bp, Homo sapiens
cttcgtatggtacatgtctctgcatacaaatactgcttatttataaggacagcagtcatattgaattagaggccatcctattccagtatgacctcatcttaactacttatgtctgcaatgattcaggttcaaataaatttacattctgaagtactgaaggattagaacttcaacatatgaatttttggtggacacatttcaatgcattacaaaccccacttttccgtatttccaaatatattccagtactgatatgttcttaatatacaaatggtcacatttaagcattcctctgtgtctgtgttgtcttctgaaccataattctatgtgctgaaccagaaagaatagggcatgaaggacaattttgagtgaggatttaggaatgagcaagaagaggcctacattaaggcaggcaacagcctgagagaccctgggacctggtgggtgtacgaaaggatccaaaacttggaagccatagaaaaggagatagaggatcatataagttattatctacattgggaaacctgaaaaggactctgttaactttagaggtagctctgtactatccctggcaattgggactaggatggccctacatggtggcatcataaccatcactttgaatgatctctactaatgtctctttccatccactggaaagtcaagtgttctctctaagcagctttctacagcaaagcgtatgtgggcacacaatgcaattaccttgagcctggaggccacttgaaggattttttacttggtatgtcacttggacatctgtaataggggagaaaataatgtcagagggatatttcagaaaaggaattgaattactgtaacactcctcaaagagaaaactatgggtatgttttcctgaatgcaaaggtgtgactttttcatattagaattcctgtgctgccttccatccctaacactcaatggcaaagagaaaataatgaaaggaaggcaagtaccatttgccaaagatgtggccaagataacgctgttgtcaccatgaaacctttatgttatcctacatgatgtaaaattatttctgattaccatagaatggaagg

SEQ ID NO: 31337 - DNA, 1032 bp, Homo sapiens
gctcggtgggggagcttctgagacttattgtcgaggagaaggaatttcaccaaggtaatcaatcagttaaggtggggcaggaacaaatcacaatggtggaatgtcatcagttaaggcaggaactggccattttcacttcttctgtgattcttcagttgcttcaggccatctgggtgtatacgtgcaggcttgggctcagaggcctgacactttcttcaagaggcaggatattatccaaaccctaaaggatgggtaaaaattacgagagtgggctggtatagagttcatcccaggtagaggtactagcatgaacaatgggctaatggtgtgaaaaaatatgcacatataagatataaatggagtggtttgtatgtgatgggaaatgaaaataaaaggcctagaataagggtcaaatgatgaaaagccctggatgacacattaagagatttaggctttgtttttgatttgaaagtaatgagaaggatctaagtatttttgtgggataaatgaatatgaactcagtcacattgtgcagcacgtcattgtatctctgctctgttcagcatctctgttgatacttgcttctctggttgtggataaagttccagaaaactcacaaaacttttctagtcactcaatttttgttgtataattcaattaaaaatatcaaaacttcaatttctaatcaaatataaagcttgttcccttggctagccaggcctatcacaagctcaaaagtggggaagaaagaaatgatggacttcttcactctggcctcatccggctcttgtcctccacccctttctaggaacgtcctcttcaaggataacttctgtggggccgctatccaacctgtaggaaatgtgctgttttactttgcaggttgttgaagtgtcattatgtagtctcttatcttcagaagcaggtcagataccagctcatgaatcttccagtttccaggaggctcatattaagctctcagagtgattctctcaaagccctctcctttggttgaaggcaagaggaaagtac

SEQ ID NO: 31338 - DNA, 1045 bp, Homo sapiens
ggtaacgaagtagcttcaaactgagtaaaagcaaaaaatctgaaaggtgcctgaattcaaaaagcacatctctaaagtgccatgctttatagaagagaatgtatgatatttttactaatatgaaacatgttttcaaagcatttaaaaatctttcaagatcttacaaatttcacagcacatacagaataaaaatattgagaatatacgacttacttgtagtgtaggttattcttagggacatataaaatacttaaaaatatcaagattaggaacaaaattaggcactcaattggaacaaaaatcagattttaattgtttttatccctggctatggaaagagtgcttaataaatagcagctgaactaatagaagaataagtattgatcaggtgttactgagagaattttctacataaggcatggtctctgcagcttaaccctcactgtcctcactgtgtccaagattcagaaagtgcgtcttatatcattgcaagttggaggttttctgaaagacttcaagaacaactttagatagaaccttggtttttctctgtggtttctttccaaatctagtaaaatttcagtggctgtgctgctgatcatatatttaagattgatagaactaattctgggttaaattacaatgtacacaccaagctgaagatcattctggtcactcggggccaatgtctggatacatccccatcccttggcacaacagaagctagtttttcagactgtttccagatttaatgaagacctcctgccccaactatcttgacctatagaatatcattgtggttaggattctgaacatggggatcctttactttccttcctcatggattttagagtttcaagagtatcccataaaaaaatgcatattcagtagtccccacttacccttaatgtatatgtttcaatatacccagtggatgcctgaaaccacagatagtaccaaaccctatatatattatgtttgttctatccatacatacatatgataaagtttaatttataaacaggcatggtaagatattaacaac

SEQ ID NO: 31339 - DNA, 1036 bp, Homo sapiens
agggctggtgatggtagtcctgcccctcccctttgtctctggctgtccttaggggtatttctgtcttcaggcacttttttttttattattttggtaaattattttatttcttgcatgatgatttggaggaactatcttcaaaccagtacaaatatttcataaatagcatgtggccattttctaaccaattgagtaatttgttgcacaataagcctcttcacatctttcagcaagatatacattgaatttgaatagtaaagacattacgcaataaattaggacacaattaaaatttgctttaaatatttctttgggggagaggacaccacacttccactcaatgaaaagaaacacttttgcagtccagaggtcttttacttttctatacctatttgccatgaatccatagcgactgggttccggcagctcaggctccttctcactggttctcccaaagtgtgcatctctgggtggagcaggctggcacttctcttgaacccaggtgactttctctttggctttcttcttttctgatcattttccttcacaagtttcaggaagctgcctcagcccttaaagtgcttaatatgctcaatatgaacaataattctcctgacaagaaccttgcccataacttgtttgcttacaacagtgccaacagcatgctgtgtaacattgtagaccctcccagttttgccttcgtaacacttgtaggacattcctttttgatcagtattcattccctggatgtctacaatatcacctttcttataaactctcatgtacatgtccaaaggaacagctccatgttttctaaaaggcctagagaacacgtatcaagtgcctctcctctttccctttgtgttcattttggtgaattactagaaaatggcagttctggcccaaaggaagccaggcgctttcattgttccctgttggttgagacagagacagcattgaaagggaaccctgccagggaacacaagatggtgggctgtccacctcgatctcacttttttcagtgtaaaatccctga

SEQ ID NO: 31340 - DNA, 1032 bp, Homo sapiens
cacaatagcaactgcttaaagaaaacttcatgcaaaaggcacatgctgttatctagatagtggggtgcccttaaagtcttttcttaaaaaaacagggcagtaatgttatacagaccactaaaggaagcaagtagtttctggtctacagacttctactgtgatctacagttagtccttcgtttctctaagttttaccttgggaagtttttctttttaattcacaggtcttctttctgagtttcctttttcatatctctggaagtctcaagctgctttcaaaatgtttattggctcctgaccttatcccaagaatcttaagtccttttcaacgtgacattgtattaaaacttttcttttgcatccattaactaagtaaaattttaaaaataattggtcataatttgtccatgtatttttatgtcacatagtttttaaaaatatcatatttgtattcatgtctataaagagttgtacatcaggctattgttaagaacactacccacatgataacatggtctgtaagagatgagtcagaagctacttaaaatagttgagaatacagaggtcatggcaggctgaataatggcccctcaagatgcccatgtcctaattcctggaatatgaatacattaccttacacagcaaaagggactttgcagatgtgatcaagttaagcatcgtgaaatggggagattttcctagattatttgagtaggcccaatgtgattatgaaagtttttataaggagatcagagaagagagaagctaagctgctggcttcgaagatggagaaagatgtcacaagctaaggaatgtaggtggcttctagacactggaaaaagcaagaaaatctattctcccctcaagcctccagaaggaacatagtcctccccaataacctgatttacatttctgaccttcagcatcatgagataatacatttatattgtttaaagacactaaattgtaaatgcatattagtggtaatttactgcagcagccataggacactgacacagaaatgtttataag

SEQ ID NO: 31341 - DNA, 1024 bp, Homo sapiens
gaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagacgggtgtgtggggagatattatttttatactgtgactaatatagtgtatttttatagagagtacttagcacacactacttgtgaccagaatttggtatatttttctattcatcaaagtatttaacagtgttaaactgttgaaaatttatttgtaattgtaaccaagtatttaatggctgtttaagccctaatgcatcaactccttataccattttccctccaaataagtatgttgattctagcttaccaagtatttaacagagacaaagacattaaaactgataaagagaaaatgtaattacaattcaggccaattttcagatattgccaacacttctcattacatacttctagactctgttgacttctgaacatgttcattggaattacacatacagtgttccctaagcttctacagttacctttattttgcatgtcctctgcctggttgtaaagtatgagcacctattggtacgtttacattcgtacttttt

SEQ ID NO: 31342 - DNA, 1053 bp, Homo sapiens
ctgtgtcgcccaggctggagtacagtggtgcgatctcggctcactgcaagctccgcctcccgggttcaagccattctgctgcctcagcctcccgagtagctgggattacaggtgcctgccaccaagtccggctaatttttttgtatttttagtagagactgggtttcaccatgttagccaggatggtctcgatctcctgaactcgtgatccgcccgcctccgccttccaaagtgctgggattataggcgtgagccaccgagcccagccctagattcgtactttttaaaatgctgtatgtatttatctcgtgaattcagaaacactaatttcttttgattctactggtgttttcagtggtctggaaaagattatatttgttttcagttccaacagttaacattttcttaataacaaagctagtactgttgatgaaatcttatatgacttatgcaaccaaaacactattttcttctaaatataaattttattgttcctttaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggtaaaaaaccaaatgagttgtttgatcttttagtcttttaatcaccatagtcttatgaatagactattatattagaattcaggacagtagaattgtaattgtggttccaccaaacaatgttaacacgttcaaggaaccacaaggaagccacagtggttgataggaaataagcagggggtggggactactaggaaataaggtcagactcgtccagaagtaagatcagaatggtccagaatgcagcttaagaggatcattctgactggtataggattataagagtggaatcagggtaaacaggaatctatagataaaacccaagcaagggtgatggtggttcaggccagggtggcagcagtgaaagaaataagtagtagtagattctggatatat

SEQ ID NO: 31343 - DNA, 1208 bp, Homo sapiens
aatcattaaggtctcatttcagattcttgtttgtttatatatgtatatgtattcatagcagatatgatggtagcattttgaggggcagtttgaacatttgcacaattatatgcacaatcatatttacataatttaaaaatagctcttccaaataagtagtatgggccaaatgaggaaacctagaaattagctttgtggaagtgctcataggctggacctaattggggagcagatggaagcccagccaggcaggtaaaacatagaaacataggtgcttcaggggactgaacacagtgacaaaaagaagtggttatctgggcaggaagaaagcatctagttaacaagtgctgtgatgtgctggagcaggcaccagtgaggtgtaagtagaaaggtagctagatagtcaccattagcaggcaccagtggtggtagtgagacgtagcttctagattgtattgtggcaattagacattatcaaagcaggaatggagaaaccaatcagaaattctgaaactagaacatgagatttgaaaaagtgacttttagatgacaaaaataagggcaacccaatttcttgagtaggattgtaaggttaaagagaaactaccaagcaacgttgacttaatctggggtcagataaaaaatgaataaagcaaggatctctctctctcttaagaagtttaccgtctagtgaaggagcaaacaactactacaaattatatagtgagttagaagataagtgctatggatagggtaacaggaaacgagagaatgggaaggtgggcttatgttttaaacagagtaggttgtggttgagggaaaacttgaaggaagggagtgaaacaaaaggacctgcttatttgggggaagagcattctaagtaaagggaacagccagtgtgaaggccctaaggtgagaatataaaatatagtaataactgataaaaagagagaaaacaatctatttagagagaaattagtgaaaccaggaatacatcatgttttgccaaatatattgcacatttttcaatttgatgttgtgcacgtccttttcagagtccaaaaatctcaccttagtatatttaatcattgcttaattgaagataatcattacagtggcacactgaattgcgaagtacttggagaaaaaataacaccaagaaagctgaaaagacattatttggacccatcaaatcatcacttttaatc

SEQ ID NO: 31344 - DNA, 1027 bp, Homo sapiens
catgcagtggtgtaattatagctcactgcagcctcgagctcctgggctcaagtgatcctcccaagtagcttggattagaggtttagccaccacgcccagcactaatcaggatttaaatattaatatttaaggtgtatgaaatgtgcagataataaaactgttttcccagctttttattaacaaatactcccttctgaggcagtgtttgaattactcaattagagaaatttttctccccacagctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttat

SEQ ID NO: 31345 - DNA, 1067 bp, Homo sapiens
atcggctcccaccacagccctccaaacagctctgcgctctgagcgccccctccccagggtccccctctccaggcaggaagatgtccaagtcccgtgcggcggaggcagcagcgggggtgacagcgacggccccgagcccgcagatagtggagcagaggggtccagggaggcgctgcaccgacgttggggagaatgtatgtcctggcaatcaaagatcttttcctccgtgagcctaacaaatgctctggaatgtgttccagccttcaggaggagaactccgttacacgtcacgaagtcaaatgccaggggaaaccattagctggaatccacaggaaaagaatgcaacacggagcacgaagcccaagcacagaagatcaaagacgccaggagaggacccctcgcaccttttccaaaccaaaaatgtgaagcagcagaacttccaaaacctccggcctcgtcttgtgattccaccaatgcagccatcgccaagcaagccttgaaatagcccatcaagggcaaacaggcccccgaaaaaaagctcaaggaaaagtcgcaaactcacggatttctaccctgtcccaaggagctccaggaagggcaaagcggagctgcaatttgaagaaagggaaagaatagatgaattggttgaaagcggaaaggaaagaaggagtgaagactgacctcatcaatgacaaaggccgggtgtgaacaccagagggagctctcccggggcgcctttgtggtagaaaagcaccggagcctcacggagatcaccgacgccacgggacccctccatggtggatctccgtggatctccacagtaagccgagatcgcgccaccgcactccatcctgggaggcagagggagactccagctcaaaataagtagatgactgaatgaatgaatgaacgaatgaatgaatgaatggatgttacaggtttccaaggtggacttaaacagatggctttatattaccaaaacttttacattctagttgtttttgtgcctttttttttttttttaatacaggttgaacgttttgtgcttcccatgcatgcagtcaaaa

SEQ ID NO: 31346 - DNA, 1047 bp, Homo sapiens
gatgagtgaaaagcagtaattcactgtatctgaagtatgaagtggtgaagtatgaattggcctacagtttaacaggctccacgggtgagttgtatgaatacagaaatttgtttgagaagcatgagactagatccccaagagctttgcagatcacattaaattttattttacatgactattatggaagtctagttaaaaggtaccctaaagaaagggtgggttgggggtgagggataaaggcctacatattgggtacagtgtacactgctcaggtgataggtgcagcaaaatctcagaagtcaccactaaaagaacttactcatgtaaccaaacaccacctgctccttgaaaacctgtggaaataaaaaaagagagaagataccctaaatatactactttttttacaatagttttctgttaattgttatacaaatagaatttcattttaaggaatgtcataatatttagctcaatatttgggatcatttctatcttccctgatataaagaactctggaaagtcattattgaagctccaagctataggtaaacataaacacattctcattttttaaaacagtgttcctgaagtaattcatgttcactgttcaggaaaaaaagtagtgcaaaaatttatgaaatgtaaaaagaagcctcctgtttttccttttttctctctcctccctcaccaattccaattgtaagagaatagcttagtatgtatccttctatatattttctatgcatttgcaaacgtgtatgtatgtttctataaattctttattaacagttttattaacatgacaaatgacatacagctgatattttgcagacctggtgggcatggggagcttggagcccagtgccacccaccctggccctccatggccttaaaaaaaaattatatggggccgggcatggtttctcatgcctataatcccagcattttgggaggccgaggcgggtggatggcctgaggtcaggagttcgagaccagcctgaccagcatagtgaaaccccatctctactgaaaatagaaaaattacct

SEQ ID NO: 31347 - DNA, 1033 bp, Homo sapiens
gttctgatcagtcttagctactcaccattccctagtagtattattgtctctgcttctgcctgttcattcctgtgtatcccgccttcatttttacctattgaaattttcccatctttcagagccacctcagatgcaaccagatctttgatggatcaaggtgaaactccttagtgtaaacatcactggcctctttgatttagccattatttttcttcagcatcatctaacacacttctattcctgtgctccaccctaattacttgcatttcccaagacctaccacagtctttcatcattccattcattaagtgtttgcagaatgaatactgccttccttgatttctccaactagaagtcacacctttctttagaaccatggttagaacaggacttagcttattgtgtataaaatttaacaagtactgctttctcttccagtaggaattacctcccttccttgaaggaagggactgtatcctctgtaactttgtgcttcttagtatggcataatacatttatgtattaaatatttgatagcactactcactgtatattaaagtagaagcccagtgtaacaaaatgccaacctctcccctctctgtgacccatgatctccctgcggtgttctctcctcattccaggtctctcagtgtacttgttcctattgccttttccttttggctaacttcttctgggctacactatctaacatctggctgttgaggtgactactaaattgaatgctaattcaaacctggatgttcacctgtaactaggaatgttgttctggtcaaaagttaagattaactggaatggtgacaactggtgtcttttttattcgcagtcctcagttttgaactcctttttggctctaaacttgcttgtgggattatcggggttttttaaattttcagtactccattcttgattcgtctagaaaatctgggggattaatctaaaaatttatagatttcctttcagtacaattagcctaattacttgatttttaatcttattttaccatttaaaggtt

SEQ ID NO: 31348 - DNA, 1051 bp, Homo sapiens
ttaaagcaaattttgaatgaatctttaagttaggtatctaccttcccaccagccccccaaaaaacctctcagtagtttctttcagtgtacaaaatgatgagcatttttctatgatgaggttttaaccattattcagggtggtcttttgtttttaaatctttttttaactaataagatttacggtgtgtattttatacagaaatgcattataaatgtttttaattgtgttctgttttttgcagtctttaagtgccatgccaattgttcttatattctatagaagttcgctcaaaatactcaacaggggaataggcagcggacagtcagaatggttggaattttggctttctaagaaaaactttattttgcataagcatgtggtcagatcattttgtgcatatgcagcctggattggatgttaagtaaatgcttgttcagtgccggtacatttacttaaatctgtttttatttttgtcatgtagaatactactgtggtcatcataatgtaatctatttctgtaccttttttttttttttttactttgaagtctttaaataaaatgtataatacccattgagagtggatcatttttcatatgtagtatgtcagaaatttgtataagaacaaagatgcatcaaaatttgttcaagaaaaagtgaaaatttcagagtttggaattttgctgtacttaaagcaccattctggtagaactgatgctgtcgtatttacatttaataatgttacatttagctggacatagtggctcacacagcactttgggagactgaggtgggaggatcacttgaccctaggagtttgagttcagcctgggcaatatagtgagaccccatctctacatacagaaaaataagaaattagccaggcatgccggcaaagtgcctatagtcccaggaggctgaggtgggaagactgcttgagcccaggaggttgtggctgcagtgaactatgatcatgccactgcactccagcttgggcaacaaagtgagaccctgtctctcaaaaaatatttaatgttatatttattaatgt

SEQ ID NO: 31349 - DNA, 1034 bp, Homo sapiens
aaattggtaactttattttaatatgtatatctgaagaattcaagaaaacaaaggcatcctcagaggtgtgcctcttttctttattattagaggcaaaacgaacaattttataggatttgtagtgaaattataccagattataaggagaaccaaaactaagtcgcaaaatttattaatttaaggggctctcgctttgaaagtttgagagtaagttacgataggcatttgtatccattcattactttcctcttttcaaataagcaactaaatagaaatgctaatctcagacttaattatttaacagaagagtgtaccatggaaaacctccagacaaatttctccttggttcagggctcaactaaaaaactgaatgggatgggagatgatggcagccccccagcgaaaaaaatgataacggacattcatgcaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcc

SEQ ID NO: 31350 - DNA, 1025 bp, Homo sapiens
tcttaattgtttttaacatacagttaggataatttgttataaatgtgtttatggcttaccacagcatattaggtaaaattagcttgcaacattttatcatggttagtgttgtgcgtgtccccatcatttgtattgtttaatttatatctctgaaaaatgcagccttagaaactgttgggcttccttggtgcttcatggagtagagggatatcaaacgtgaaagagaccaagagttttgtggtagcagaataaccttgtaaaaggctaccttgggaattaatgagctgcactgtcattcagaattcattcaacaaataatagatatttgatagatgagtccctactacatgctaggcatatagtgctaggtattaaaaatacaaaggtaaggctggttcttgacctcaagctgctgtttaagcagaggctgcgtagccacttaacagggattttaaatagggaattcagacattggctaggggactatgctaggtgatctttaagattccttagaagctctagtctgactcttactgggttggtcaagactaggaaataaaataaagaataggagctaagagggatgactgtttaaaaataaaggaatgtgctagcagttatttaaggtggcacctgaagtttagagacacagaaataaatagatgctaggtttggctcatgagtaaagataaaacttactcttataaatcaaactgtagggttttgaaatgaacttgatcaaaattgagtcagatttcaagtcaaggtctttgagcaaatttagaatttgcttgatattctgaagatttgagattccagtattcattataggaaaaactttgaaatatataaatcaattttagtaattttatatttttttctttttcttttttcgagacaagccccacactgttgcctaggctgcagtgcagtggcaggatcatagctcacagcaacctcaaacctgccagcttcaactgattctcccacctcagtcccctgagtagctgagactacaggcatgc

SEQ ID NO: 31351 - DNA, 1023 bp, Homo sapiens
ttgtaagttttttgttgttgagccctagatttttttctactagtgtaaatctgtattccctccaagtatggtgataaggggactgagtcttatttacatttgtacaatcactactttacctgttgtatttgcagtaagtcttttgagccctattaaacctgtcaattttcttgtcctgtcagaaaactgagattttggctcaaaaatggatgttattaacaaaggggaacaatatagatgtcttagtacaaagaaaatgaaatgtaagaggagattgtctggagttcaggggatagagtgtcaagtcttaaatggttacatctttttgctaagtgttactcagaatatagttacaaatatggtacttaaatatctagctgaaatttgtttgtcccatgagcttctcacatgagtctactgggcaattttatgtgagttttggtcaaaattggtaatctcttttatcttagttttgcataatttattgttgccattttatcaaatgagtaggaagtagtgaagtatttcaagaagattgctcagtggggtttgatacaagaactgcccagtagctgggcgacattcagagctctctctctgaggtatataagaagagccctgggagctcctcactgagcctcctgtgagtcaggacatagccttgcagtctgccactgaagcagcctcaccaaagcaaagattccctgctttggaagggtggtgggcaagataaagtcctccaaagtagttatagattattctttttctggagtaaaacttacctgctcagagttgttacacagctgtataaagtccttaatgcttttaattctcaggtggttttgagggaaggagaagagcctgtgattttccttctgtgtatctttttagtgcttagaaattacttgccaaaaaaaaaaaaaaacacgaaattacttgcaagctggttatggttgcttatgcctgtaatcctagtgctttgggagttggaggtgggagggtatcacttgagcccaggagttc

SEQ ID NO: 31352 - DNA, 1227 bp, Homo sapiens
tttttctgatttatatattatgacataaaaattgaaattatattattatcgttatagaaattttaaaattcgaaatataaatttacagtgaatgaatgttgtcttgaagtttctcttgttccttgtgtggtgtttcattaaactgtaattccgtattacctaaattgaggaaacgtttttctcagcttttcttcattgccattaccaaagtgactcaaaatcttcaaagcacagttaaaacactgaattgtgccgtaatgagaagggccttctgcatagggagtgtgaccctccctcctagactctctgtctcttgtctttggcactcatgacagtttaatagttagaaggcaccttcaaggtccgttaggccaacttctcatcaaatgtcccaaggtctatatgccccttacagttcagccattcccaagaggcaacccattcagctattaagtagctcgaaatgtccaggttctttcttcatttggttagagatctgcttcttacattctttatgtcttggtcctgcaactgtagttctttatagcataatgcagtggttctcagattgtggtccccagaccagcagcatcggcatcacctgggaacttgcatgaactggaaagtgtgggcttgggtctcatcaatctggtttaggaagttgaactccagatgacaatgatgcacactaaagtctgggatgcacagatgtcctatagtagaaagtgggtggggctttggaatgaggaacccctggcccagaaacccagatcctggccctctgtgatcttagggcaacccctcagttttctcctggtcagatggagctgatgggggcagctaattcacaggcgtgctgacagaattcaatgataccccataggtaaagcacagagcagaaaatccaacatactgtgagcactcaaaatcggcgtgtagtgttatagagtcatgcaacgcatttattggatgcctttgagtaacagtctacatagagtccatgcgtttgataattaacaagttgagaaaaaagtttacatataacactctagacatgaaactgttaaataccttcattttacagatgaaaaatccgatattcagagaggctaagtgacatgttcaaaggcacacagctggtcctacaattgatgccttagcagcctgagctccaattcttgataaaatgcccagtggtcaccttaaatttcttcagaacagagtggg

SEQ ID NO: 31353 - DNA, 1044 bp, Homo sapiens
acactttcctcttctcttatatacagagactggcaaacagactgctcagcaagtgtttattgaatgaatgatttaatgatggagcaggacatgttgttttgacactgagatgccatgtgtttgaaccaggtgaaaacttatgtttgattttaattttaaagacatgttctaattataattcttactattggaggcatatggaactttcaatcaagaggaataactgagatacttcaaattatgtgaagatagaaaggtttttcttgttcagtcaataattattgcattgcagataacagaaacccacttaagctagtttaagcaataaaggtttgaggaaaatgaaggcagtgtttctatacctcctgagctcctggaaccagccctgggaagtcactggaagcacaggttgcatttcatcttttctttgctcttccttccctgatatttctttttgcagagcccatcctatatgaataatggatgcttattctaaactcatgaagtgataccaattttttcttttaaaacggcctggtctgcacattactttttttttttttttttgagatggagtctcgctctgtcacccaggctagagtgcagtggcgtgatctcggttcactgcaagctccgcctcccgggttcgcaccattctcctgcctcagcctcccgagtagctgggattacaggtgcccgccaccaagcccggctatttttttttatgtttagtagagacagggtttcaccgtgttagccaggatggtctcgatctcctgacctcgtgatcctcccgcctcggcctcccaaagtgctgggattacaggcatgagccaccacacccagcctactttttaatagtaaattgaagttatgggtgttagatatattctttgcaagccgttttgaagcagattcttttcctaatgtgtcatgtacaatctgtgggggaagaaggttatataaagcaagaatgacttctattcaacaaaatagtgatattctatattttcctgtctcttttgtttctttctttaaaatgaa

SEQ ID NO: 31354 - DNA, 1071 bp, Homo sapiens
tttttttcttgtttgatgttactttattacacttatgaatgaaatactaatgctgttattttatagaagatcataaaataaaagtacactttcttagtgttttatgtttctttaaaaagataattaccgtgagtcatagagctacaattacatcaagagtttcctatacgaagcaaagtctctggtgggtttttggtacagtctttgcacctggatcagtggagcaaaatgtcatcacacttgaaaaaaaaattacttaacaggcccattaagaatcttcagaagtttgcatcttgttagggatttgtggtccaagagttagtactacagaacaggctcttttgtagacctagggaaaccagtttgtttctctgccacttaacctgcaagacttattataggtgtttccttctcctgtctgttttgaagagacttcctctgggaattaatggtagaatacttatgactcctgagagcagagaacgttcaggccatcatcatcttctccctctgggctgtacatggcctccctgtgtctctactgcctgtcatacctccccactcctccacctcagtcacagggcgactgccttgctttcggtctacctttcccaactcttcaggctcatcctggtggatcccattctgtagcccctgctgctcttttcaggggattctattttgtcttatacacttttgtcatttagttacccacctattccccccagtggactcccattctgggctcctgcagagggcttgtaagttcacctttatatccccagggtcagagctgatgctctgccgagtgaatggggaagcgccagaaagaacagaagctaatgatggactggctcgaccatggctcccactttcaatactcatccctctgtttcctcagacattttacttgaattaattttgtagttctccttctgaactgctgagcaagtatttggacactttgtgaggagccttttttttttttttttttgagatggggtctcactctgtctcccaggctggagtgcagtggcacaatctcgtctcactgcagcctccgccacccgg

SEQ ID NO: 31355 - DNA, 1077 bp, Homo sapiens
ataaagaacacactgatgacttttccccacgtaatctctgaggtcggtattttagtaacctttgagataataatttaactcacgccctatagaaattatgtatgcagtaggcccttggtagagactgacatttatataaggtcagtgttggttgacctagtttgatctggccctagatttataaatgaatgaatgatctccccagaattaggaagacatgacatcaaaaatatgaattcatcattactgtaaaagtttaacatgctgttaaactgtagcatgttagtgagacgaggcctcagtatcttctgctggttggggaaaaaaaataaatgtgtattaagtctcaggagcctgcgtggtcctcatgcttgttaaatccagaatgggtctctccctttctccaaagatggagtttggccttggtgggattctgtgttgggagctgcagtcccagatgcttctgctagtttaatagaagagatcaggaagaacaaactggcaagtgaattggacagatacagacccaaaagacttcagataattggaaagaaattttgcaaccagggcatttctgccatcaaaacagaggtatcttgcaatgattcttgtgctggctgttgttgaggtcttactttagcactggggatgggagataattcccgtatagccataatatgggaaatcaccagtatcctttaagatgacaaaattcaaattctaataaagacaggatttgggacattttttaaagagaggtgctgggtgtggagagggaggaagtctggtttctgataagggcttctcctcattttacaagtctgcttgtcatgagagaagtattattcctggaaatgaaaaacatggaggcagaaaatccgtttcttcaaaaacagatagtggatttttgcactgccaacctagctgttgatctgtcagtcttggtaactgaaaccctatgaggctgcgtaacatctcagatgttcagcttcaaatctgagatcacaaacagggtcctaaaacaaaaagtttgttaaatgcccagtcaagaaaatggggctacggaaaaactcaaaa

SEQ ID NO: 31356 - DNA, 1228 bp, Homo sapiens
taaacacttcttaaggaacaagttataattgtaaataggaattaactgttattttccttctattgtattgcaaagctaaatgatggtggcagataccactatgggatgaaagtaggctttgtgttattttgaaaatgtgtatgaatttcattacaataaatggaataaacggaatagaaacaacggaatctacctttaagcctgactgaagaagttgccctggatatatctgagatacaggaaagttatgttcacatggccacttagagattctggtcttttgtctcctagttcaggctatttccgtgcctttgttctacccctctttggggcctgacataataatacagggctctcaaattagaataacttgggtttcacgatggagcacttagattgttatgtgacttgttgtgttacaggtgatttttgtggttctgagtcctttttaaaaagcggcggttctcttgcaggaagccagttgagggaagttctccatgaatgtacgtcacaatgatgatgaccgaccaaatccctctggaactgccaccattgctgaacggagaggtagccatgatgccccacttggtgaatggagatgcagctcagcaggttggtgtaggaagagggaaatttaagtcaaattgtctaagtgggaaacagtaacacagtatttgatttattttgggattcaaaggtttgtgatttcaaaccttagcatttctagaggtaagtgtttttgttgtagaaatactgtatcgttttttaaaatgtgattttagagaacaaaatcttccctcattcagtttgtattcttgaagtattgaaaaatggatgacttctgaagtgagtcattttcagactgcataaaagtcttcgaaataaaatgactgtttattcatgctgtattgtgcttgactagtttgcttggttggccagagctgcatgctcagagggtcaggttttggcttcacacaggagtgatctcgacaagacacgtagggcagtgtgaacccacccttgctcctggaatagtccttccaaatgtgtagctcataaaatcacggtacttattttctctgaatctcctttgtcactagtcactgaacattgtggaatagagttatttgtgaactcagtcaagtagcacttgggggaaacaatttagacagtaagtgaaactttaacaaattattagggattgaactattatctctaacattaatta

SEQ ID NO: 31357 - DNA, 1043 bp, Homo sapiens
tttcaatcagctttggattcaggcttcaggtagggcagtgagcaaaatgaggcaatggacacattcacatcttcttccaggatctttctagtttacttgcttatgtttttaatcctgggacattttctttgcatgtgttattaccacaaagataaatatttggcattcgcaccccatcgcttcccttttcctgatttggagaaaagagggggctcaaaacacaaatactgcttacttttcagttttgcctgaggccagctgtgttctatggcacacagactggggtctcaaaggtgtgtgtggatgaacagtttgggtatgggggcctgggaagagcttggagattgggaatcttgggggtggggctggggagtggggagttgggagtatgtgtgaccagaaaatagtagcatgaggaataggtggtagtactcttctcatgtagtcaaaggtcacttttgaagttattaggtattcctggctagaatccttagttgcgtggaactcctctgcagcttttagattgtatcattttcccccttaaagatacctgttggataatcataaatgtgggctccaagggagaagtattcatttatacatgaaaacaagctacacaaagtgtggccagtggaaaaaactctagaagtgaaatgggatctcctctctggtatggtttatatcttgattgtctgagggttggatttaacgcttaaaaatgctgcaagtgtactattttgtctttggtcagttggtactcttctcccaggaggagcttttttttgggagacagtcttgctctgttgtccgggctggagtgcagttggcaccgtcacggtttgctacagcctcgacctcctgggctcacgcgatcctcctgcctcaccctcctgagttgctagaactacaggaatgcaccaccatgtccggctaatttttacaattatttttgtagatatggagtctcactatgttgctggggttggtctggaactcctggtctcaagtgattctccccgtctcagcctcccaaagcactggaa

SEQ ID NO: 31358 - DNA, 1002 bp, Homo sapiens
atcagacttaagatgaattggtgttgagttctcagagtacagctctgtagtgtgaatccctggtcatttcgtagctaatgcttaacctgttagccccaatttcctctcttaaaatgggaacaatgatagtacctatctgataggattgtgaggataatccattgtaagtgtcattattcttatcatcattatctagttgtatacacagctttactgatttttcccccccctaaatagatggcatgattgtgggcaatgacttcattttcctacttgtagaaatcagttgaaattctagtctccctttcattgcttatttatgatagacttgctttcatagggttgctggtgatggcaccagttcaaacattttagatgaaggtttataagaatgtgtatactgttcagatatggggttatagctaaaacaatgggtccagtgttccatgaatttaaagtaaattttgttgtagatttttagttgttggttttcttttgaataacagccgttcactcttgcaccacgcctgagcagctatattcagagaaggctgtatcctcttattttatccaacaaagcagtttttctaatgtgcctccttttacattttcattgaattccatacttctggctgggcatagtggctcacgcctgtaatcccgacactttgggaggccaaggtggggcagatcacctgaggtcaggagtttaagtccagcctggccaacatggtgaaaccccatctctatttccccctaaataccaaaatacaaaaattagctgggcttggtggttggcacctgtaatcccagctactcaggaggcttgagacaggaggatcacttgaacctgggagatggaggttgcagtgagctgagatcgtgccattgcactccagcctgggagacagagtgagactgcgtctcaaaaaaaaaaaacttgtttccatacttgttaaaatttttatttagtgcattctgtttcttaggcagtaccaagaa

SEQ ID NO: 31359 - DNA, 1028 bp, Homo sapiens
tcaggtgatttgcccgcctcggcctcccagagtgctgggattacaggcgtgagccaccgtgcctggcggaaatagttttttaaaaacattaataaaatatataaaaaaaagcatggcactatcatcccatgagttagaaatcaagatctaggattaaattggttaatttattcttagttaatagtcacgacagttcttattctgtgagtcaagcgctcacctgttgagtgacatagttcttgaatcatatgcccaaggaaaaggacatgtctaacatctcagaattttaaaactgtgtgtattaacagtggcttatatccttttgcacatcagaattacctgggaacttaaaaaaaaagtttaaaagttgatatgtaggctagttgtagggaagtgtcacattgtctgagcccaggggaattgtcagattgtaggggaattgtcagattgtaagggttggggactgggcatgagtggttttgaaaagctcccgggccatttgaatatgtagtgaggttgagaagctctggttaacgtaaccctcaggacagctcaagaaattcttgcactgtgctttcccacgtacatttcagtgtacaggctgtgtacctgtggctgtttatcaggttcatcttctttagcaagtttggcagttttgtaaagtgtctaaagatcttttatcttgtattcttatacatattaagtaaaatctatgtggtagttggctttactgaacctattaaaattgctttttagctttggttataagcttctaagtaataaacaagaaccatcagacagaaatatgagttactgctttcggcagagtacagatttactttatacttacttagatgtaaacacaatagttcacgtatgtttaacgaaattcaaagttcacctatgtttaatgaaattcaaagttgattggaacaggtatgattatgcagagtggacagactttaaaaagtgagatgagaaggccaggcgtggtgcctcacgcctgtaatcagcaccgtgggaggcca

SEQ ID NO: 31360 - DNA, 1056 bp, Homo sapiens
aagtgaattttatctgagatatttaggtaaataaggacccaagagagagatgccagctctccgtaaactagtgcctataaccaagagttatttaggagctttgggtcatctccaacttattctgagaaaatcagtaggaaaaccacaaagtaaatattcagaaaagtgaatatgagttaagtaatttggtttgtaagtctaaagttctgtacagctgtctctgaagcctggattgataatgaagtctagatctttgggtttgtttgggtttgtcagtaatagctattgatgatcaaaaaagccatatgagcaaaaggttttgagaaaaaagttaggttctggattcattttaaaaagttagccactcgtttgtgtattttaagaaatctcatctgctgtactgaagccttatatatgttcctttatcttaagataacatagatagtacaccattttagacttagagaggtggtagaggtcaattcatttaaccatcacattttacaggtaggaaaatcaggacccttttataaatgggctggcacatctgcagattgtcctgggtcactgggaaggtgggggaggccggcaggggctgaccagaatcagcctcaccagtggatactctgtcagccttctcgcctgcctgtaaacctgttttcactctttttcatctggcatggtcctgaagccaagggcagcagtgggcattactattacacagtactacacactatacaaaactatgcctccttccagctccctggaataggaacctctgttcatagacctttgcctggaattagactgaaataggctgtgctcactgggccttgcctgttgtggattttggcttcccacttacaggggcggagctgcctcttgtgcctcccagggactgactttgcatttcccttggctccctctctgtggctttgttcctcattttcatcaccagcctgctactaggactggtccctgctgtggttatgttaacatcttctagggtttacaccccaaccctaagaagtcatgtgaaatcttacagaagagctg

SEQ ID NO: 31361 - DNA, 1036 bp, Homo sapiens
cagaataaaaaataattttataattgatttgtttaaatattgattaattatgcattcttttaaaggccaaataaaaagaaagaaactttttgccccactctgttacactactactaactgagcaatcttggtttatggaacttgaggttttgggaatcattaaatatttataaagatacttatagttttgggttttttgtttgttttctttgagttgtatagctggagaattccttttcattcatggtttcaggtttagctttaaggcaatatataccaacttttgaagagcaaattgtcaaagtcattaattatcttcagtttggatagtacattgaaaacattaattattttgaataatgtatgtttcttcagctattaacatctgactcgtctgttttaggacctgctgaagttcccatgatgtcacccaatggatccattcctcccattcatgtgcctccaggttatatctcacaggtaatccatttgatggacttctctactcactatggacactgtcgttgctccaacagaatatatgttgaggcttcaaagccatattccaggagttaatttgggtaccgtagtgctaggtttgccatcattttgtggcaccacatggcgtttcttgtgtcttgccacttgacgtaccagagaaccagagaaaaggagacacagaaggcctactagactgtcctctgccaagtggggtttttatatttgattgtttggttgtgatttctttatggagtctcctgcttcagacatttccttccacctgtaatacaactttctggaagaaaattcatagatgtagttagttaacatattaaaggagacatagctcacataaacagggcctaccttctgttacagaaggaaaaaaatggagttcaattgctccacaatgtggcaaaagctaggcttggtgagttattgagtatgatgtgagaacttggctgtttgcacttaaatttctctgagctttggttttctaagtaaaatgatggtaatagcaatctcagagatctgt

SEQ ID NO: 31362 - DNA, 1053 bp, Homo sapiens
acttacttacttacatagccagattgctggccagttttcctgctgttgcaaataaatgacttactttacacaagtctttgtaagtaagaatcactggagggagaaaggggtgtagaacaggctcttccagcagggacaccagatgatggatcacattcacatcagccgtcagttaacagaaaagaacaaggaatgtagaattccattatgtctcctgctcatgtattttgaggaagcatttcattccattgaatagagtacagttctcaccattgtgacgcaaaaataacacctccttttatgctaaaggtccatttaagaaataccagttaaaaattgaacatttctaacggagagaagcttcagtgtgctttttcttactagtattattgctgtgattacattaaatgcaaaaatatttattgcatgtactaggaaaagtggagaatttttgacttggatatagttcggattctggaaaacttctgtagaaaatccaaatagagtaaaagtagagctgtacactcgcttgtatgaaactgatgatggaagcatgttgatgctctttcccggctgacaggtatggcagaatatgctagacaatattggaagaatagttaaaatggaataatttgaattgaaaaagggaaagaagcagtctgtaaggcatgtgaatgactaacttcatttcaattgggctccttgaccagaagatgggtgcaaagttaaatgaccttccgtgatagtattatgtcttttatgacacgttacagtagagtatctgaaaaagattgttaatatgaagaaaatagaattgagaagccaacaggatgtgtacacaacatcttctttaacgctggcagtacacacacttcaatgaaatgaggaaggccgaaccaaatataaaatgtcttagttgtcttgttatcaccaagagataggagcaagatacattgttgtcatgcagttgtagaaagaaagaaacacacacacacacacacacacacacacacacacacacacacacacacacacaatctcctgcagcaggct

SEQ ID NO: 31363 - DNA, 1079 bp, Homo sapiens
ttttccaagcatcttctttcacaacactcatcatgaggacatcttgggagcaaaagtgtccatactgatttggggttacttaagtttttctttggtcagaatccctcatttcatccatatcctcagtcctagattaagtaatcttagggcacacttacggcttctgacgttaatgccacctttgtttcctaaagccctgatgatgatggaactgtgcatgttaaagcaggaaaggggaagaatgttgtcagcatatctagaagcctagccctggaaaagtacttaggtggcacagaaagcctctttctggaaaaccactgaactgatagttaaattcaaaagtcactcctagaatcagtttcagcacacattaaattcactcgtcttggatgaagccagtgaaaattttaagacaaaaacaagatttattatcaaatactggtctctccaaaaagttacatgggatcagaatcagatgtcaatgaataatttgtttttgtacgtttttatagttacatgttattacttctagaactcatttgactggttgaactagagaaccagaatacaacatgcatttgtttttttctatggtggaagagaaaagtaaaattaaagtggaagttattaatactatatatattcataggctgctaatatgtactgcgttctttccttttgtgtttttctttaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaaggtgagtagattttcgttggcgtcaggagccgttgaaactgattacagcgtttcaatagttcaaggcggtcctttgtttcttgtgaaataagcatagtagaaaaggatctaggtggtttgtaagactcatggggaattccta

SEQ ID NO: 31364 - DNA, 1067 bp, Homo sapiens
actagcctggacaacataacaaaacccctcctctacaaaaaaaaaaaatacaaaaattagccaggcatctgtagtcccagctgctcaggagcctgaggcaggaggatcacttgagccaggtcaaggctgtagtgacctgtgactgcaccactgtaggccagcgtgggcgacagagtgagagcctgtctcaaaaaaataaaaatttattataatacctgtactgtgttttatagaaatgtggtggaacatttcttgttttgctcaggaatttttgaatttttgtattttcaggactgttttaattaagtaccaacgtaattccattcatagggcatgttgtatattataggcatactattatttacaaaaagttgattttgaattaaatttcatttgaaaactgttaataaaaagtggtgtaaatcaagaaatgttttccatagagccaagctagttaaaaagaaagtaggatcctgcagtagaaaaagaacattggaagaattggtaagattctgattaggtctgtatgttaatagtatagtatcagtgataatgtttttcttttcttttttttcttttttttgagatggagtcacgctctgtcacccaggctggagtgcagtggcgcgatcttggctcactgcaacctccgcttcacaggttcaagcgattctcctgtctcagcctcccgagtagccgggattacaggcgcctgccaccacgcctgactaatttttgtatttttagtagagatggggtttcaccaggttggccaggctggtctcgaactcccgacctcagatgatccacccgcctcagcctcgcaaagtgctgggattccaggtgtgagccaccgtgcccggccaccagtgataatttcctggttttgatcattattctatagttctgtaacatgtttctcttcggaaaagcagagtaggagatagacagaaatttctctgtactatttttgcaacttttctgtaagtataaaagtagtacacaataaaaaggtgtttgaaaaaatagagaaaatactattttgttcataattttcccagtgggaa

SEQ ID NO: 31365 - DNA, 1030 bp, Homo sapiens
tccgactcctcctccaggaagccttctatgaataactttactcggagcccatcttttccccaccaaaagggattttcgttgtttgctattatttcgtacttaagacattttctgatgattattctcttctttcatgtttttcttaattagatgataatctagggcaggggtgttgtaaaagccagcccatcttttgcttctcaggcccctcctaccctagccctttacctgcgggccctctcagtctccctcacacccacactcttgacatcccgagctctgagatggccagtcctgatgagggaagtcttcccagctaaggatggtttgtttcgaaagtcattcttcttttaatatattttgtagtagaaatttgattatgtatatgtatatatttaaagtgcgttgtagaaggctatgatcttctaaagcaggagtgtatttgcatgtaaaatgtggtcctttaatggtggatttttaatcaaaatttataaagaatgtggttctttgatttatttgatttgtttaatcaataatattagtatattgatggatattgcagactcctggaaacatgaagagatttttcacatcagcctagccaagaagaatttgcttgggattacattacttctccaaattggaaaggaaaatgctacttcccttgtacttaatttgcagagctgaagattttttaaactgacataatgcaaattaaacaaaacaaagagacctgcagattttatctaagtttcaagattagcatgttacttgagctaaagagaaaacttctcaagtttgggttttggatagactctaattaataaaacttaaagtttagtttttattttctgaggtgaattcttggagtggttcctcaggttaatgtttgttttgcccattagtccaatgtcacctttcactggaattaggaaattattttcccatactgtgtttttcaccctaaaccaaaacaaacagtaactgccttagtcctcattcagctgtctcagcctcctgtgctcagagg

SEQ ID NO: 31366 - DNA, 1032 bp, Homo sapiens
ggatttagccgggctttgaatacctcttttaccccttactaacagtttgacttaggggaagttgcttaacctctctgttcctacgtttcttcatccatacattgaaaataataatagtacctgcctcttaggattactgcagagattaaaaggtttaggacaatgtctgccacgtattaagcgttaagtaaatgtcagttgttaatagtaatgttattgttaataacaccaccattatatcttggattgcattttagtccttcaccttggaagatgattgcctaaaaagtatttaagtaaaaggaaacttgaatgtttgtttacatggcaaattttatctctgggataaaagggggcatgtgttatagtgtgtttagttagaagctccttgggtctgttcttgggtgagaagctgtgtaggtttatgaacactgatcctattgtgcttattttaaaggcttctggaatacagtaatttgaaaaaaagtgattaatatatttccatttctaatctgactgttggatgttagttatgtcatcaagttaccgtagtgcatctctttttctctatacattttgaagctgttttggcaataaattgatcatatacagtatcatcaggggcaattttaattattaatcatctgctttcgatcatctgctatgctccctcccttttattaatcatctgcttttgatcatttgctgtgctccctcttaaagagggaggcataggagaaaaatgtaaatattttcaagaagttttttttttttttttagacggagtctacctcttgttacctagactggagtgcagtggcacgatctcggctcactgcaacctctgcctcccgggttcaagcgattctcctgcctcagcctcctgagtagctgggattacaggtgcctgccaccaagcccagctaatttttgtatttttagtagagacggggtttcattgtgttggccaggctggtctcgaactcctgacctcgtgatccgcccgccttggcctcccaaagtgctaggatt

SEQ ID NO: 31367 - DNA, 1050 bp, Homo sapiens
tttgtaataagttgggagttgagtcctattaaatttagagaaagttatgattccctcaaagatgtaatacatactagatatagccaaaagagcgataaggacctactgattgtgatgttaatacatgataaacattgaaacattttacattttaacagaagagatgcctcagattgaaacaagagtgatattggttcaagaagctggaaaacaagaagaacttataaaagccttaaaggtacggagttttaggttttagttttttttgtaatgcaatttttcttccatcagtgtgtaaatagtttcatagctttcttaacctcatacttaagtctcttttccacagactattaaaataatggaagtccctgttataaagataaaagaaagttgtcctggaaaatcggatgaaaaattaataaaaagtgttattaatatggtaggtcaaagtaactcattgcatgtggcatgctgcacttcccttgattgtattattctactttctggtgattggaattaggcacaaggtgtattgtgtgcaatctgaagcttaatgaatagaaactgttttatactttttaactccttagcttcttttttctcattcattttatatttagtctaaattcttgctgtatttccaaaattataaatcacggtaatttataatcagggaatttgcctcagcatacgaaataatctaattctggaatccagctgttttagtttgctagggctgccataacaaaataccacatagttaattgcttaaacagtagaaatttcttttctcacagttctggaggctagaagtccaagattaaggtgtgtgtaggtttagtttctcttgaggcctctcgccttggcttgcagtgtccttttgctgtcctcacatggcctttcttctgtgtgtccttgcatccctggtgtttcctcttattgggacaccaggttggattagggcccacccctattatctcatttaaccttaattacctctttaaagtccttatcgccaaatatagtcacactctaaggacttcattcttc

SEQ ID NO: 31368 - DNA, 1047 bp, Homo sapiens
tatagtattattttcctatttttctgaagatagttaatttgtacaataagaactttatgtatggtatcattttcttggtcagtagtggatatctttctaatgcatcttgatatcaaaatgcatgtacttaaaaactttagcattctaattttatggaacttatgcatacttgatgatttatgactaataagtaataagtcagaattatgcctttataatactgatctttaaaatttaagaacttaatttgaatggagatatgtatatgtaaaaatgtaagtacgtaaagaaatatggttgttcattaagtgtaatgctgattattgtgtgatagaaacttattttctacaaatataaacatgttaaagttgatattgaattgattgttaagccttatttagagagacagatggattatttgatatataaataatttttatttctgctaactatatgatgaaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagaggtaagcatatacatttattatgacttttcaagttaaaatttttattaatgaattttaattagcaaaaaatttatttggaaaaatctcattgattgctgagagcaaaatatttagaataggaataatagtggctattctaatgtggtcctttaattcctccattttaaacttagtggtgaaaagctaaggcctttgaaagttaaataatgataactgtacatatgcatatacacagacaaatacatagtcctttttttttttttttttttgagacggagtcttgctctgtgcccaggctggagtgcagtggcacgatctcagctcactgcaagctccgcctcctgggttcacgccattctcctgcctcagcctccccagtagctgggactacaggtgcccg

SEQ ID NO: 31369 - DNA, 1069 bp, Homo sapiens
tcacattcttaaaaacttgtctttaaagtttagtggaatggaataattgttagaatttagataaatccctgatatagtgaatatggaagtctttgcctttaattacctttgttctagctgtagagaaaagacacatgaatagttaagcttaataatgttgcaatttaatgactgcttactacatgctaaatgctttatacgttttgtgtgtttataatagattttattattcctgttttacagatgactaaactgagatacagagaagttaagtaatttctccagggtcatataactagagagtgatagtgctgttcaaaaagcaaacaaagtcacaggggaggtcacataaattatggagaaaataggtagaatgaagtcagaggagggtgagttcactttgtgctgaactgatacagaaaggctcctataattcttccttggttatcagtatttccctttctttttgatttttagtctgtaaacaaatgtgttttctagatttaagaaacaaaaaaaatcaaaatctcctccggacctcatgacacttttcacttattgtcccatttttctgtttgctttcacatcagcatacttaaaagaattactttgatctattgtctcatttccttgattctcgttgtcctttcaacgcattccaactgatctgcagtccttgttggggagacagtttttatgcattcaacacatgaatagctactcctttatggacacaattttttttctttgcttctgtgatattacttactcatttctcattctccttggcctaacttctttttttcaattctaaatgttgtatgttcctcctgagtcattgtttcttctctattgtactctccctaaattatcgtagtaaaatctatggttttgaaaagcatttgtatgctgatgactcccaaatttgtcctcttccctgtcaagctacctactttgtacttccttgtccatgtctaatagatatcttaaacctaagataaccaaattagacctttggattctgccactcttaattcctctgttcctttgctcctcttcatcagtcttt

SEQ ID NO: 31370 - DNA, 1923 bp, Homo sapiens
gtgatccgcccgcctcgacctcccaaggtgctgggattacaggcataagtcactgtcctgtcaagtaggtttttatcttggtgttttgccgctaactttgtggatcaatttgaatttgtgtcagttatttagctagtctggacacccttctttgacaaaatgtgttattttatgtttgcagagtcataatcttaatttagaaaatcatattctttgattcagtgaagctttgaaaatttgtcaccctttagttttctcaagtgtaacttaattctttaagcttcttttttgtaaaatggtacttcaactattagtttttcagttttttctttttttttttttttttttttttgtcatctaggctggagtgcagtggcctgatctgagctcactgcaactatttgttttttttagctgattgcaggtttgtcaaatatttaaaaattttaaagcttatgttcttttctaccgtgaaaccagtacgtgccgtgaaacatttgtaaaactcaagagaaaaggaaaaagggagagaaatacccataattccattatccaaaaatgtctaaaattttgggtttttttctttatcctcgtaacacatagcagttttttttcctgttttaaatgaagccaaccatctattgagcattaccacatctattgagcaagaagttggtattgtacacattttagaaatgtgaaaccggtacacacagagaataactttacagaggcagtcatctaataaatgctggatccaagacttgaacctttatttgtataacttcaaagtctgttctcctaactattaatgctattttgcttctttaaaatcatgctgagatacattcttttggtatgtagatgaatacaccatgtaaatgtgtcttaaatttgtacagtttttcgtatcatctcaataacagcattcctgaaaacattggtgtctgtattttataatatcacatagtggttaagaatatgtagtggaaaaaacgggtttgtttttttttttttctttttgcgacaaagtctcgctctgttgctcaggctggagtgcagtggtgcagtcttggctcactgcaacctccatctcccaggttcaaatgattctcctgccttagcctccctagtagctgggacaggtgtgcgccaccacacctggctaatttttgtatttttagtggaggtggggtttcaccacattggccaggcaggtctcaaactcctgacctcaggtaatctgcctgcctctgcctctcacagtgcttagattacaccactgtgcttggcctgaacaaagcagatttgattgagtttgaagtcaggtgactttaagtgcttcagttttcctgtttataaaatggggataataataactgactcatgaagttgggcaaactaatcttaagttttttgtagtgttaaaacttttttttacccattgtgtttacacccactgtctagcatttagattactttcggtaaatgtttactaaatgatggttgtgttacctttaactttcaaaattaagactagcactcactgtattttcttatctaggtattatgtatacaactttagaagcctcatccttactttgcttccaaggtctagtgagctgatgttttgagtaagatgaaaatttttgaggttgttatatacatctctctcttttcctcagtatgaatttttctttttcaagattaaacatcattaatccttgatgtacaattttctgctcttagcttggcacagtggctgatgtctgtaatttctgcactttgggaggccgaggcaagtggattgcctgagcccaggagtttgagaccagcctgggcaacaaggcaaaaccccatcgctacaaaaaatgcaaaaattagctgggtgtggtggcgcatgcctgtagttccaactcttcg

SEQ ID NO: 31371 - DNA, 1045 bp, Homo sapiens
gatgttcattattttacacatcaaattaagacactttgtaaagtgcttctttccaatgagtatctcagaaataataaaagttgtataaggagctgtcaggtttaattttaaatatttcaattcgtgctatttcaggatgatcttgaagaccttatagttaattgggatgagagcaaaagcattggtgacatttttctgaaatatgtaagtattgtatttcttttttaagttttcagattaaaatatgatctcatcaaggactggcaaggagtgtaatttgcctatttaaatgtgagaggttttaaaactttgatatgattgtgtttataaaatacattggaaatgttctttgtcttctgaaacatgccttctgtatgcaatttaacactttagtagcccaagattattggaagaatgccaattatcatgctgtggtataattgttttagtatgtatcaagttatttgcctttcataaatggccacagattgtatttttattttatatattatttaattttcattttaagttcaggagtacatgtacgggtttattatataggtaaaattgtgtcataggggttaattgtacagattgtttcgtcacccaggcgttaagcctggtacctattagttatttttcctgttcctctccttcctcctaccctccaccttccagtaggccccaggtatgtgttgttcccctctatgtgtctatgtcttcttatcattttgctcccacttataagtgagaacatgtgatgtttggttttctgttcctgtgttagtttgttaaggatgatgccctccagttccatctatgttcctgcaaagggcatgatctcgcattttttttttaatggctgcatagcattccatagtgtatatgtaccacattttctttatcaagtctatcattgatgggcgcttaggttgactccatgtcttgctattgtgaatattgctgaattctaccagatgtacaaagtttttatttttctcccttcttagttgataacactttttgctgtcatgtctgtttctat

SEQ ID NO: 31372 - DNA, 1049 bp, Homo sapiens
aagagggtttatgaaggctgggctttataaaggaaggtttatgtgtgatcaggttgatggggttggaaaggatttctttgtaagttttttctaaaaattaaacattggtgtcaggagtgcattgattgatataggaccaaagtctgaatctctatgtttacaacgagttttacttgaagtattgatcagcttttaataaaattgcagtaggttttaatttttaattccagaatctgtttctttatcagccatcttctaaactgcaggcattttctttttcaattagcagtaatcgctcctcggatagacctcattggctacgatactgccactgcgcaaagctaaactgcaggcattttctgtttcgtcttacatttcttcctgatatctgtttaatttcctcaattcaggttaaaaatgctgtcttctttatttaaaattattttaattaattaattcatttatttattggagatagtctcacccggtcgcccaggctatagtgcattggtgtgatctcagctcactgcaacctctgcctctcaggttccagcgattctcctgcctctgcctcctgagtagctgggatttcaggcacatgccaccacgccctgctaatttttagtagatatgaggtttcgctatgttggccaggctggtcttgaactcttggcctcaagtgatcctctcacctcagcctcccacagtgctggaattggaggcatgagccatcacgcccagccttatttcttaaggtagcattttccttttgaagtttctcagattcatatatcaggttcaactgtgtgtgtgtgtgtgtgtgtgtgtgtgtgtgtgtcagggtctcattctgtcacaggctggagtgcagtggcacaatcttgactcactgcaacctccacttcccaggctcaagtgatcctcctacctcagcctcctgagtagatgggcctacaggtgtgcaccaccgtgcctagctaatttttgtatttttttttttttagagatgtgcttttgccattttgcccaagctggtctcaaactccagg

SEQ ID NO: 31373 - DNA, 1687 bp, Homo sapiens
gcctgtcactttactaatgtaaatagctatgattctgtttatacagatcggttccaatgacatagcagagaccgagttttattccttttactatttttgtgatgagtagaatataatctctgaaactgtatttcagaggatgatacgagttctaaattcatgtatattgtatatatatgtatgtatatttaaagtgtttcctgaacaatccaaatttccaacagtttcagaattattattagatatttaatactactattactaagtatttgagtgaaatatctgttctttataaaattattaacctactgaagttaagaaaagcaagtgactgtcatttcttagctgtgtgtcctgtagcaagtttcttattctctcaactgcatttttgcagatgatgttatatactgaggggcaatttgggtggtgattaagagcatggactctggaaccctagtgttcaaatccttgctctgctatttactagctgtatgtgttttggcaagttattaacaatctgtttcaatttcgttgtctgtaaagtgagtcttaagtagttataaggattaagcgagttattatatgtaaagtgcttagaacagtacctggcacattgtgagtgctcttgagttttataagtgatttctttttatttataaaatttccgcaggtaagacacataaataatactcattaaatatatattttaaagttgcttaaagtcttcagttaacacatcaaagagttatggctaaatctattagtgtatttatacaggtttttcatcaacattaatcttaaccaatgggagagaagctgcatttagttgataaaatgaatatatgcaaagtagtttggccaattaaaattgacaaatgcagataaacattaatttgtgaaaattagattatagctttctcgaagccacctgtagcaactattgtaaacattttcatctttcaaatgaaaataaatgaattttatagaaaattttagaaaattaatttatttatggttatgtcacttttaatagacagcatatgtaagaagcagctaaaataccttcaagacattaatgtcatcttctcaattgcttgtttctgttctaacagattacccattctgtttccacaagcaatgtaattggatttactaagcatgtttatgttcagcgcctaaactctactggtgggcgctctcagtactcctggtttcaatctgtacgtcattctgctttccgagctagtttttcagagatactagaaggaaatactgatttttcaaatttcaaaaaagttctttccaagtcatctttgacatttgtgaagaattaggagatttgccaaccactaatggaaacaagcctcatgaagtttaatgtgagcttattagctatttaaaatttgtatttgcgggaaaaaaaaaaggaacatattttttctccaaggaatcacttatttggtgggtgggaactttggaattcacaatgttatgactgctttgaattaataacaatttaggtttaatagagtttcttaagtccagaaaaaataagttccattagaaattttcttatttaggaaaattatcattttaaagaatagtaattgtcatgagtagtggatttatattccaaatctgattcttaatgttagatttatagcatttatagaaaattatgctttta

SEQ ID NO: 31374 - DNA, 1056 bp, Homo sapiens
ttacaattgcagagtactccactgtgtgagtggactctattttattcacccaatcccctattgatgaacattagtttctagtgttctactaccacaatgatgttgcaagttttatgaataggtcattttgtatttctgttagcataatttgcaaaacaaacaaaaaaactacatgtgggattactaggtcaaaagatcagtatataattttggtagatattatgggcatattttgttttattgcacttagcagatagtgtgcttttgatagactagagatttgtagcaatgctgcattgagcaagtctattagcacagtgtttccaacagcatgtgttgacctcatgtgtctgtgtcacatttttgtaattcttgcaatattttatactttttcattattataacttttggtgatctgtgatcagtcatctttgatgttattattgtaattgttctggggcaccacaaactgcacccatctaagactgaaaactttatcggtaattgttgtgtgtgtcctgactgctccactgaacagctgttctccagtctctccctctgcttggatctccctaactcctgagacacaatattgaaattagactaattaataattaatcctacaatggcctctaaaaaatcaaaagctaggaattactaaacttagtgagggaggcatgttgaaaacagagatagactgaaagcaaggccccttgtgctaatagccgagttgtgaatgcaaaaagagttactgaaggaaattacaagtgctattccattgaacatgtgaatgataagaaagtgaaacagacttattgctgatacgaagaaagtttgaatggtctagagagaagatcaaactagccacaacagtcccttaagccaaagcctaatccagagtaaatccttaactctctttcaattctatgaaggctgagagagataaggaagctgcagaagcctgaagctagcagaggttggttcatgaggaaagaaatggtctccaaaacataaaagtgcaatgtgaagcagcaaatgctgatagggaagctgcag

SEQ ID NO: 31375 - DNA, 1903 bp, Homo sapiens
taaaaggcatctttacagcaaaggaaacaatcaacaaagtgaagagacagtcacagaatggaaaaatatttgcaaactacccatctgccaaggaattaataatcagaatatataatgagcttaagtaattcaataggaaaaaagatccaattttaaaataggtgaaagatttgaatagacgtgtttcaaaagaagacatacaaatggccaacacatatatgaataaatgctcaacatcactaatcaaagaaatgtacatcgaaactacaatgagacatcatctcaccccagtaaagatagcttttataaaaagaacaagcaccgagggatgtttgttcgagaacataaagggtgacccttgtatattgttgatgggaatgtgcgtacaaccactggagaacagtataaagtttcctcaaaaaagctaaaaatggaactatcatatgatccagcaatcccactgctgggtatatatttaaaagaaaggaaattagtatatcaaagagatgtctgcactcccatgtttactgtagcactattcacaatagccaagatatggaatcaacctaagtgtccatcaacagatgaatggataaagaaaacgtggtatatatacacaatggagtactattcagctgtaaaaaagaataaaactctcatttgcaaccacatggatggaactggaggacatgttaagtcaaataagctaggcacaaaaaggctaatattgcatgttctcactcatatgtgggagctgaaaattaaaagttgaacacatggagatagagtagagtgacggttaccagaggctgggaagggtagtggggaaggaggtataaagaggggttggtcaatgggtacaaagatacagttagatagaaggaaaaagatgtattgttcagcagcacaataggttgactataggtaacaataaacgttaaaacgtaaaaagtttcaggaggtttgagtttgaataaactattttggcttactttgaaagaggccattttgggattggtgttttgttttgaggcctagacatcaatcaaagctgaccattgaatgcttggtattttgtctttccacttttttaagagttccttttaagcatattattgttgacattttaaaagtcccatcatggcttaggaaaaaaccaatactcttattattcaaagatgatatgattgcttagatagaaaattataaataatctggagaaaacttagattaaattctgaaacaaaatcaatatacaaatagataccagccacaaacaagtaaaaataccttttcctaaaagatacttgttacaatagcattaaaaccattgaaatacttaagaataagtctaataaaagatacacaaaatccctacagagaagactgtggaactttatttacaataattaaagaagaccttaattgatatgattgtcaggattggatgcctcagtgttgaaaaataccagttttccccaaactgaacaaattcaaataaggcaaataaaaataccaacaggctgtgtgtgtgtgtgtgtggctgtgtctgtgtgtgtgcataaaacgtgactaattgtttctaaatttatgtggaaatacaaagggtcaagaataatgaatatggttacagaagtgaaagaatctgtttaatcagatacaaggtttattatagagctgtagtaatcaaaacagtgcagtgctggaagtcttggtgtattaaaccaagccgacagcattatcattgtaaaatagtgggtgaaaaacagcctattcaataaatggtgctgagaaaaactggtatctttttttttttttttttagaaacgttgtgtttaatggtaaagcttagtacaccccagcaccaggaatggcatggagtcgcagcagcagggacggacag

SEQ ID NO: 31376 - DNA, 1047 bp, Homo sapiens
tcggtttccatcttactggattgtcaataggaagatatgatttttcagttatgttttaattatctgtaaatgaaatcaccaaagtccagtcttctagacttaatattattattattatttctgaaatataggtatgatcttattaacattggccagtggctccttatagattattacatgccaaagtccacaaccctaatgccactcaatgcttttcacaattcattcttaaacctccttatgtagattaaaacactgtcctcctggccccccttctgaattcactctttagtccattcacaagactcttaattactattttccccaacactacataccattttaggattttgtggtttgcttatgctaatctttcttcattgatccattccctgcccctctaccccaccccaccaaatatacaccaatgataggacagaaaaacattttagttccttgggtggtctttccttcatcatgatgcttccttcctgtacccttactctgagctcccacaacacagtatttatactgggagtagcccacctttcacacttctaatggttggctttctcactgcacagtgaattgccagagatcaaaagacatgcctgatttatcatgtcattcggaaatgatagcttacctttatgtctgaacatagagtctaccataaatgaatagtaaatgtattatttataaatatatttggctatgaagtaacagaaaacttggctaaccgtggattaagcaaataaagctttatttatctcacataataaaaagtcaggagaagagagttgcttaagcattttatcaggcttcttctattatctcgaaacctttcttctcatgggcacaaggtcactgatgtgcctccaaactcgtgtctgtctttggggcccaaaatgggggagaagaagataacagtattctacctcagggtttctcagctttgacactgttgtcattgtgggctggataattatttgtctttgttatgggggagtgtactgtacattatagggatgtgtagcatcatccttg

SEQ ID NO: 31377 - DNA, 1194 bp, Homo sapiens
gggaggctgaggttgcagtgagccgagattgtgccactgcactccagcctgggcaacagagcgagactctgtctcaaaaaaaaaaaaaaaagaataggtgcattacaactctgccagttgtaactcaaaatacgctgggaatagtcctggtatgctattttgaatgtcatttcttcacgagccttctctagaacccctaggaagcctgagatctcacagaacagcctctcgtgggacactctaccatagaaatctgagaaaaacaagagtatgggtggtgctgctataggggagaacgaaggtataatcactggaaatggaataatttgttagagtgttagaaagagtataaagagccatctttaacattgcaatatcttttatttatcctgctacactcaggtttgcaaaactgccatatgtatacatatatatcaatatgtaaatgtgtatctatctacctctgtttatctttattaattgaaaattatagttgaatgattgatatgagaaagcctgagaagaaacaatcacttttcttggaaaaaactgttcatattccatatgtactgtagacgggaatgtggaaaaacactagaaaacgtgtcactggcccctagaaaacgtgtcactggcccccaggaaaataaatctagcattcatctatcagtccatatatttttttgcttatcttcatgaatattatttctttcccccatttccaactcctgatttcctgtctcctgatccctgtatccagtcaacaatgtctcttacacacgtctcttacatggcatcctttctgtacctaaatccagaacccaaattcaggattttccattgtgcttttgaaatgttgcaaaagccttctaaatgcaaatatcagcaaccaacactctaatatgaataagtttgtctgactatttccctccgccatgtgatacttggctaaaaagaatgaaacataaaaaagacaagtattgatggggaaggccaggaagatcagtttaaaccaagatcattgctagtgagaacaagcctaggttaatgccaggtgcttactagaaggatgttttagggacctgtaggggggccaagaggcaatctctggagagggtgggagattgaggaatttgggtctgggaaaggggtgacacaaatgagcaagataagggggaaaacaaccaaacttgt

SEQ ID NO: 31378 - DNA, 1049 bp, Homo sapiens
tatcaaactgactctctgttctttgtaactaaaccccaaaccaaactgattaacctacagccgcaagaacaaaatcaaacaacacatgatgtatgttattagagcatgtctataactcgctttttacatcaatttaccaaacactgagtgaacccagcacttgttgagaagaaaagacagaaatgattatttagcctttgctaagaaattaagaaatcagttttaaatgaccagcattaaaagcaaaacaatttttcattgtcaccatccaaatatgctaagaaggaaacatctagaatatatttcccaatattaaaattatttcagagtagttataaacaaacggaagactgctccacctcacacaattttgtttattctggttagtggctcccattctttggcaaataatgtatggcacacacatgagttctggaacatgttttaataactcttaatttcctaccactcatgacccatctgtcatgatttgaggaccttacattagggaagtcaaatagggaagactgtgtgtttgtgaccaagagcattaattttaggcgtggtttaactatgtgtcccattaattccatatctacaggtttttatctgtaactcaacccagccagatccatgttctcctcttctttgtcttgttgtatgccttgagaagctaaccttgacttctataagttacatccacccaggcccccttgatagttggcttcttttaaaaatccaacaaatgcaagacaatggtaggagaacagagtgtaagagagagagtttgggttaaaaccccatccccgccattctttcctgctctaagccatgatttctagcagttactacatctttttatcactatgacccaggttgggtggcctttttctatgcctccagctctaactgtactccagtaacactatttttctcttgcccttaggccagtcataacctctttctattgtcattcccttggtgctgcaatgttcctttttatttttcttcaccctgtccagatctaaagtcatccttattaaaacttc

SEQ ID NO: 31379 - DNA, 1049 bp, Homo sapiens
tcagaaatactgtgtgttcggttccagaccatcacaataaagtgaataacacagtaaagtgagccacagacattttttggtttcccaatacatatataaattacgtttacatgacactgtattttaatgtgtataacattttatctaaaaatgtacataccttaattaaaaatattttattgctaaacagtactaatgatcactggaaacttcagtgagtcttaatctttttgctggtggaaggttgtgtcttaatggtgatggctgctgactgatcggggtggtagttgctgaagattagggtggctatgtaatttcttttcttttcttttttttttttgagaaagggtctcatattttcttttttcatgggctggggtgcactggtgcaatcacggctcactgcagtctccacttgccaggctgtagcaattcttcctaagtagctgggactacaggtgtataccaatacacctggctaatgttgtacgtgtgtgtgtgtgttttgtagagatgggatcttgccatgttgccgagctggtcttgaattgctaggctcaagtgatcttcctgtgttggcctcccaaagtgctgggattgggattggtagtttttttttttttaaataaagcaacaatgaagttggtcacattgattgatccttcctttcaagaaagatttctttatagtgtgcaagtcagtttgatgggattttacccacagtagaacttctttcaaaattggaatcaatcctcttaaactatgccactgcttttatgtatattctatatcatttgttgtcatttgaacaatgttcacagcatcttctctggaagattctgtctccataaaccactttcttcacttatccataagaaggaactcctcattcattcaagtttgttcacgagattgcagcaattcatttatgtctttaggctctacttttaattctagttctcttgctgtttttaccagatctgcagttacttcctccactgaagacttgacctctcaaagtcatccatgagggttagaattgacttctt

SEQ ID NO: 31380 - DNA, 1033 bp, Homo sapiens
cagatcacaaattctgagccttttttctgatcctcctagttatatctgctcccatagaaagtttgaccttttatttattaacactgttacttccagaacctcccaggctgattaggagctctgagcctagtaataataataatgaaaatactcctgtagcatttattatttgcttgacattgttctaaacactttacatactcgtttaatcttcacagttaatactatgaggtatattctacagcattaagaacagtcacagagcttctaatgacagcaggatttgggttcagattttttaaaattttaaacatgttttatttggaagaacacaataaattctacttgtttttcaatacattctatgcattttcttaaattaaattacattttatattcaggggttacatgttcaggttataaccatagtagtgggtaattactagttacactagaagcccaatccccaccactatagcctaactgtcacagaaagaatgaacattgtgtccgacaggtaattttcaactctctgcacaccttccaagctccttatcttttgaagtccccagtgtctactgtttccacttctatgtccatatgtacccattgtttacctcccacttgtagatgagaacatgcgttatacattgattcttttgtctatgagttatttcacgtaggataatggcctctggccccgttcatgtcactgcaaatgacactgtttcattcttttttatggctacacagtattccatggtgtatccataccacattttgtttatccagtccaccactgatggacacttagatacttagattggatcactttactcttgcaaatagtgctgcaatgaacatatgcatacaggtgttgttgttgttgttttgagacagagtcttgctcagtcgcccaggctggagtgcaatggcatgatcttggctcactgcaagctctgcctcccaggttcacgccattctcctgcctcaggctcccaagtagctggaactacaggtgcccgccactacg

SEQ ID NO: 31381 - DNA, 1034 bp, Homo sapiens
gagagttaattgctcatcaatacctgggggaaaaaaagtaaataatcttttcagttttgatgagtaaatagtaagatattaaggcagtattctcagttgtgtttaaggactatctaaattggagtatcttcatgtacttgttaacatgccaacatggcctctactccaaactcactgaagttggagaaccaataccttacattaactagcatagcaaaaatgtaattcctactttatcttaatggttttaattacttaatgatttactctgtataaaaatgttgaataatagctagctgtcttttcatgatgtattagtcaggactctccagataatcaaagccaagagtaggggatatgtgtgtgcacgagtgtgcgtgtgtgtgtgtgtgcgtagggagagataaatttattataagtaattggctcacatgattatagaggctgacatgtcctaacatctgaagccagcaagttagagactcaggagaactgttgttataatctgagtccaaaggcctgagaaacgagagccaatggtgtaatttccagtctgagtctgagtccaaaagcaacagaagaccaatgtcctagtttgaaggcaggcaaaaagagtgacttctcccttactcaacatttgttctcttcgggcctacagtggattggatgagacccacatacattggagaaggtaatctgtgttactgagtccaccagttcactgttaatctcgcccagaaacactctcaaagacacacacaaaagaatgtctgggcacctcatggctcagtcaggttgacaaataaaattaatgatcacaaatccacgtgttgtcaacttgacatccatatgtatctccttaagtcacacttaatctccaaataaaaacaataactaggttataattccaactattatacaagtctcctgcacacaaacagagaatacgctaattccttccatagacaaggaggtaaagtcctcgagtaatgttaacttttctccttgacattccataacttaaatactgtgat

SEQ ID NO: 31382 - DNA, 1056 bp, Homo sapiens
atggattagtggtttgaattcttcccaggctatcagcaatcagaagttgttagtactctcttggggtctatataaaatgaaggtggtctgattacaattctgggccagcaggaaggagtacaatttctattacaggggggtaggaacggaagtcttggtaaggaggccagatgtctccttctaatggcttataagaacaaaacctgaacatgttttaattttttttttcctcaaagcactatctcgggagtagtgctaaggtatttcattccctccccacaatcattttctcccactataataacttattcgttaatttacttacgcatttacttctttctctaacactcaaaagttcaaaaagttcattgagattgtctctattttacttgttccaagccagtgcctaccaaaaccaaacacttttggcccttcacttaccatatgcagccaccttgttaatcactgtttctctggacctcatagtttattgcctttgcaaataggggctgtaaatctattgtgcttctctaaaattaatttctggtcaatatatcaaagaagctttgatgacatttgaccaaggcagacgaagatacaaaaacctatgtaaaatgattctgaaatgcttcctatagatcagccagacttttaaatcgtgtatgccttactataatgaaaaagtgaaagagaaagcatgaggaaactagagtaaactgggaactgtgcttggaacccagagtgataccagcacctcacattttttttttttttgtagatcatgtgatgcttctgtagtggttatagaagcagtgtgatctgcctgtagagctaattggcatcaatgagttttaagacaactttctgaaggaaaatacagtatgtgattttagtttggtaatgaaggctggatttttatactattgaaacagcttgaaacttttgaccaaggcctgtagaaagaaatatatgtatttaatattagaatctagcgaacacaaacacgctaacacgtgtgtgtatgaaagtatatatgtatatatttatatatatgaa

SEQ ID NO: 31383 - DNA, 1063 bp, Homo sapiens
tccccatggtgcacatcagtaaatgttcatgtaattatgagagatgatagaatagaaaccctctgtgcacactgaataattagattaaaactctcaactaaaacactatgaccacttgtatttttacccttacagttagttcccttcacatctaaggggagcaatgaaaaaaagacatgttgtaactttgggaaataaaagatctgttcctctattattctgttattcttgttttaacgcacttgttcattatctgatcaaacaattattgagtgtttaatgagtcctaggggctatgctggaccccgaagataaaaacaggaagacttggtacttgtcataggggacaatcaagcaaggactcacaaaaatcattattataatagctacaatttgtatagtgcctaccacaggccaagcattgttttaatggctttatatattaacttacttaatcttcacaataaacttatgaaaaagttactattagtatttccactttactaaggagaaatatgaggcacagataggttactgtgcaaggttccacagttagaaagtggcagaaccaggattcaatgccagatggtttagctccattgactgtgcccttagccactcactataacaaacattagagatgctatgggaaataagtaaaatttacatatggtagaatgctacccaaggcagggaatggacatctctatcttggatgggagctggagagaaaacacttcatcatggtaatgatacttgaaatgactgcagaacaagaggaagtggcccatccactgagcacaggatgtgcagggatgagtgggagagggcttctttaggtagagaacagcttgtgatcagagagtacagtgagagatgagcctggagctctaggtgggatccagatgtctccggagcttggagtatttctctaggtgataggatgtcattgagggatttaagtaaaggcttgacataatcagatgagcactgtagaatgttctttctgacaacagtataaatgatggaatccaaggatgataaaccacgatagggaataact

SEQ ID NO: 31384 - DNA, 1066 bp, Homo sapiens
taaactcttattcacttatataaagcacctctgtagaaagtatgaaaggtgcttcagagaagttttcgagcctttagaaagttccaaagcctaaatatatatatgaacctttttgtattgcagcaagtcattctgttatgtacacattttagtacagatggctattttgagagagtgtacgtaaaactggttataacaaatgaattttctattcccaagatttgtttttctctcagtatgttatcattttgagctacatttttggaagcatatatgacaggtgtacttaccaactgtgcctgaaagaatgatgttttgaaaaaaaaaatctaccacttcaaacctctagttctctgttctttcttcacgttgaaattatttctggatgaatttgtttatttcttatttctcaggtgtatttatttatactttgtaccctacctacatctcaaatgattttaagatagcttttaaaaattcatgtataataagacagttaaaattaaaaaaaaaaaaatctgacactacatgtatatgactgtatgagagcgtgaggttctcaatggaaaagtgcatatgttaccagtggatggtgtccaggttcttggcaacttgaacaaagaattggacaaaatgcacagacaaagcaaggaaagaatgaagcaacaaaagcagagattcattgaaaatgaaagtacactccacagagtggcagtgggcccaagcataggggctcaagagccctgttaaagaattttttgggggtttaaatatcctcaagaggtttccattggttacttgatgtacaccctatgtaaatgaagaggatgaaggaaagttacaaagtcatttactcggtgtttgtcctatgtaaatggagaggatatttcctgtcatagctgaagtgtttccctttgatttagttttaggaagtccttaggtttcctgcatccagaccccattctcctgcttcacatatgcctaaaactttgtaatatcaaattttgttttgagcttgctggtaggcaagacaaaaaggagcactgattaaaagtattctaagtta

SEQ ID NO: 31385 - DNA, 1032 bp, Homo sapiens
aatttgaagaaggaggtgccatttttaggaatgatcagaaatgtacttttaaattatctatatgcctataaatcaccactgccaagttctagaaaattctaaggtaaaagcaaagactggaagataaaaatgcaattttgaattaatttgaagtgtagccagtcatcagtttttaaaacaatattctctttgttatcaaggtgacaagtttttaaaattctgaaaaaacgaaattcagtttaaattttaattctctgggtgtcaagtagcaagatggaacaaggttatgattcttgtgtttgctcattaataccattttatgacaatgatgatatttctgcatacatttgaaatgtgttaatgacatgtagttaaaggagaggacattggttgacaagttgaacctcagtcactagggaccatggatggaaactgaagtaactttgggaggtatatacaatatttatttgtttcagttcttggtgcagaacagaacgttctgaacaaagaactaatgcaaatgtaccctttctggctccaactgaagcaatgtgatgccttgcaattggaattttgagacatggaaaactgggtcagattttctttctgcttcaggctacattttttttaaaaccctataataattaattttaaagatttcccatttgcttcatgttaaaactatgtccttcaacacgtttaacagtgaattttagctacataattttatttgaaattttttaggctatcaaatgcatgatgattggactgactgttaactttgtatagattgagtctactctcttcaaaagaaatgcagcattttctgaccagtgagataagataagcagaagttgttttatattcagagtactatttttttaatatggtaaagaaatagaaacatgaaatgttttttccaagctaaggtaacaaaatgaccttacggtcagtgtttggatgtgaaagaggaatagaagattgatgttttgatggataataattgactgttagctgttctcactcttctaa

SEQ ID NO: 31386 - DNA, 1071 bp, Homo sapiens
ttaaacaaggttgcatttttataattctgggcagacataaaaatatcctctctttgtatttactcagatggaagctgaaattgttttccaaaaaatggctctcacggcatcattggtcaacttgactgtgataatgtgaagtaagaataaagaaaaggagttaggtcccaagtgagcaaaaactaaaaacaaatgagtagtttttcagtgttttctttatgcaatgaaatatttgtattatttgggtttacaaattacaaagatacatggcttcataactcgttcttttgtcttttaaattatcttcatttttttctttatctttgggagcaaagtgctgatgagttagtgtgatgtaagaatagaagagttaagagaaggagaagaatggcaccaaacactagctttatgttctcaaatttggtgcttaggccactgataattgctattcttttgaaaatatatatgtaaattattttcattttttaaattataataagcctatgttctgtacagatattttctagcttatttcactgtttactatatgattgactttggacaattatttaaactttgtatattcttcatttttaagttgaaattaatgatagtacagggtccttgtgggaattaagtaggctaagatatgcaaaatgtttagaatacagccttatacccatctgtactcaacaaaggttaattataagcatagctgttacatgtatgattacattccttagcttactttctataaaacaaatcacatatgtaccctatattgtagggtgcattgttatgcctggaagatatttaaagtgatatatggctttattgctaaagagttatgctttttatggctggttacatcctaacaaagtagagatagctcaaggatactaagaaaaaggagaaagatgaagggaaaagtagattaagaaagaggaaaaataaatgtttgaatgcaaagtgtaatagaaatacatttgcaactagaatttgaggtttaaattataacattaaattggttgtcatgatggtatataacagcgtcttttgaaaacatttatt

SEQ ID NO: 31387 - DNA, 1040 bp, Homo sapiens
cttttatatcagatcctaacatgctggagttttctcaggtgaaaaatcaggcatcttttgctacaagatatgttctctctagatcactaagatagcctaatccttaactgtgattttggtttttttaaataagtcttgtggtagagcaaagtagagttcattctgagtcatggctcagatggaaacaagcaaggttacacccaagactcaattaaaatcgtggctcatattctagtttatacctgcacctatgagacatactaacacaaaaaactaacaaatgtagttttttttaacaactaaaagtgcattagctgtgtgtgtgtgtctgtatgtgtaggaggatgtttctctgtcagccatgataggcaacattctgctgcaggaatagcaaactcaaaatattagtggcttaaaatgacaaaaactacttctggcacactcagtttcctctggaaatatagaaaactcttgatcaactgtcctccatgtgacatttctgtaactcagactgccttgatcttaatcttgtatctctgccatctcaatacctgacctcctcatttcctgaggtagagaaagagtagtcacagggttccacattgccctttcattgcctcaacccaaaggaacccataacattggctagaatgagagatacagctacacttaactgcaacaggactgggaaatagaaggaaacacatagatcgtgtcatgagcgttactgcctcagccatgattccttactcatttgatcataagcagaatacttaaattttcatgtctgatttctcagagatttatcctgaagttccttataaatagtttttcttcaaatgctggtttgcagtgttctgaaactacgggcttctgccgagggtgttaatgatgattcattcggttgaaaaacaactaggtaatttatcataggctagatattggggatacaaagaggagtgagatgcagtgcttctgacctgaaggagcttactgattagttttcaaaaaagatgtgtaaacgtttatattatactggt

SEQ ID NO: 31388 - DNA, 1088 bp, Homo sapiens
tacataataataaccaacattgattggacatagtatgtgttagaaaccattctaagtgttttatgtgtactaagtaatttattcctcaataaatccctatgatttcaaaatgattatattcacaatcttacggataaaaacttgcagcactgatagatttttaaaaaaacaacaaagaaacttgatcaagattacccagctgggaagcagagaaactgaggtttaaatccaggtagcttgattccagagacattgccctgaaacttaatcatagagctttgatatttaaaagtaaactgcttcttggaaaggtgaccttaaatgtagttatttgacattatttatgcttcaaaatgaatgatccgaaagaaggctttgatgtgcataaacctgacactggaagagagatcgctctttggggaggaaatatgatgaagaactgagatgctggaatcttataaacataagccccttccttcaaaattttcattagaaaattgtaaacactttattctgctattaaccacatgggcctggagactgagaagtggaaggcactaggcaggcttcctctttaactaaactctacctcggcagggttagatctgcatagttgaatcagccccctaaaggaaacagacacctgtgaccacatctgcttctttcccttgagcctgacacctgttctttcatcaggatacttctgtagtttgggaggatgtggttgaaagaatgtatttgtgaattgcaagcaggtaattaaggtagctcagtaccttgaacatttctgatgttaggagcaggcatttgaaaacagtaatgacagtaattagataggtagtgattctcgcttgaacccgggaggcggaggttgcagtgagttgagattgcgtcattgcattccagcctgggcaacaagagtgaaactccatctcaaaagaaacaaacaaacaaacaaaaaaaggcagggattcttttcctgcgttatttattatttacctgttagaaactaatgtatgtctctctgtaaatgcatgagttaaaaaataaacgaataaatgaatgagagagactagtgatattttgtt

SEQ ID NO: 31389 - DNA, 1031 bp, Homo sapiens
tggtatgtatttgcaaggaagtgaaaagaaggaagtaatctgacattaggggtagagaaaacctagcctgagccctaggactattgccgtttatgactagtggatttttgaagtgcttaggtgaagatgtgggctacaggctttgcaactacttatgtttagtaacctcagaaagtctttaggcttttggttttcaaagtaatatactattgggggtataaatcacatcccctttgttactcctgtacctgagcaaggaatttttcacaagcctcttcacttcctgtcagactttgccattcatgacataccatggataggaacagcgtagaaggtgtttgaccactgcggacattgaatgtgtctttggtgagtcagtataaaaactgaagccatggcagttattatttctacatatgacagtgaccctctgccatctgaactttacttgccaggtagaatctgtgtctggagccttaatttgtaagatctgtactcaagtcctgactctaccactggacactgaatatctttcacttttagtctattcatttgtaaaagggatataataaaaatacctgttctgctttctaaaaatatttgtttaaagcataaaatgtagtgacacatgcaaaagccattaaatgtaagtgatgaagtacaatgctaatgtaaggcaataatacatttaaaataaacatagtgaacattatactagaaacttcaagttaatgtagcaagacttattatttattccaaataattttgaacaaaaaagtaccattatttttaaatgagaaaatattatgattttaaacctttattaataaaaacagaatcctcataatgccctgcttttttaaacagttgtgctttcaattaggcttataatattaacaggatagagaccctagatataaggaagcttcttcctctctgaagttctagcaagaattcagcacttcagttcaacattttatctaatctaatgacagtttttattttcacaagattaggaagcaacctcagat

SEQ ID NO: 31390 - DNA, 1058 bp, Homo sapiens
taaaagaatcccgttgtcaagaagtaaaaaggggttttgttgttgttaaatgatgttttaaaatcctgtccaatttatgttaaagaaagtacctatggaggttgagactgaaagacagtgatacatgaaaaggaataaaagaacacagcaaacataaggtctggcaacgaccatgatagttgtttgcctgccaacagcagtaataaggactagttgtaccggttgagaaagctgtttaattcagatgcatccaaaaaatatgcatccttcaaaagagatacggtgcatacatttatactttaagaaacaccactgtgaacttcaatcttgaatgactcaaagaaaacgtttaaattcttcaagcttacagacataagaaagaatgcaataaattgtgggaactggtagagattttgccaaaaataaagggccttctcttttgtgtatgtatgagggtgtgtgtgtgtgtgtgtgtgtgtttaattaggtaaaattatgtaagttcatttaggctctgcagcattttctgatgacccagtaatcattttctgttatcccatttagctgttaagagcaatgaatagaaatctgaaaccaaaagccattccctttaaaattctacatgcattaacttgggttgcaggaggaaattcccttataaaagtgaaggtattaccattaacacagagaactctttcagtcgttcagataataattctgactctcatttctaggacctgtcccttcagttgttttgcagctaatggtcagaggtttgttcagaaccacccacacacacttgtttagtccctgggtgaccaacagaatgcatttatgagaaggttgggccggagaccgcagtgtgtgcctttggtacagagattctctttggtgcaaaatctatctggcctttatagatattgcattagcatcgagcacaaaatgttcaactgcctgactcttgaacccttttccctgacctcaaatgaatgttttctgaagatataaatgtgtgaaaggtggtcatttatataaacctggagaaatacaaggagata

SEQ ID NO: 31391 - DNA, 1029 bp, Homo sapiens
aagaaaatgtattgctcttgaataatatccaattaagcttttcagcattttccaagagcattcaagaaggaaaacatatcccttatcaaggattctttgccttataactaaccaggtaacttctagaatcattctcactattgctgatacaatctattcaaaataatatcgtgaagaacgccgattttatctgtaatctatacggatactgttgtgagttaaagtaagtttgctagaaatagtcgtgggaacccacagttttagaggctcacattctataatcgttcttgtcatgggctagtcccttattcagacattgaatagcctttttctttccagaaaaccatggtacttatatttttgtcttcttttattttcaaggaccatgtagcttttttttcatatttatgctcatatgcaaagcctatactagtctttcttattattttctaatttttatttttttagattatagtagcattttaggctgaatcaggattgtgtgagaaaagtagcagggtttagatcgtgaactttaatgtggcgctccaaacaggccttgcctttactgcagtgggttaacatgagcatgttttactcctctgagcctcagtttttacatttgtgaaatataggtactgatcccctatatcttaggtttcttgtgagaatgagattagataagcatgttatataaactagcacagtgttagcatgtagcacatagtaaaagttagtatgattatgatatcttacgatgatcatcaaataatgaggagtttaagttcagttgcctttcagctaccctactattgctgagtttaatgagtgacctctaatggagtacagagcccaaaacacaattggtaaaacattatctatggcatactacaaatattttgctcattcattcactcattcatttattgatcaccctaagtggaaggactggaaacaagaatataagctctagcttaaggaaatagataggagaggcacattattgcaatatagcctaattataatatt

SEQ ID NO: 31392 - DNA, 1044 bp, Homo sapiens
tgcttcactgtatgagaagggatttcatggattttataataaaggaagattacaaagagacaataatctcttggattactttatactttctctggattgatactttatcacgggtattggaatcagacacataagaaactaaattgactataattttagacaaaccttgtaagtcttagttacttcttttgtaaaaatgggaacattaatatgtataaaatatttgatagtgattggcataacaccaggaacataatcaatattcattacatatgagtttaattttgcctaaatttttaatacagatactgatacttttcttaagaaaatagcaaaaccagaacttagattgaatacaaaagtagattttactaaaacaagagaaaagtaaacatatccttctttgcctctatatttttctaagccctgacctagaatagctagtccttagtcccctagtgatagttatatcaattactccctagtcaggaagatgtctaagccaaaggtaaggcagaaattctggagaaattagccatcagcagacacgatgtctaactgcctccacctgattgagaattctcatatccatgacacgatgaaatattatcagctgaacttaggaagggcgctctgaaattcttacaaagcaacattgtgtgtgtgtgtgtgtgtgtgtgtgtgttggcctttatctggatttattgttgatgaatggcttgattttaaatcaacaggctatggttcaaaccatttcacttcctttcagtttgtccatttgtaagttaaacttttaaattcagtcccttttctgtaaaactgcagtaagaacacgtacctctaaggctgttttatgaattaaataagataatgtatgtaagatggttatcatattggcacatattaagtattcagtcaattatagtacttgttcttattatttattaatagaagtaatgcattcgttacttattaatatcttccaaagcttgaactttgtagttctttaaacgtatttatgtgaaatcttaactgtgcttactt

SEQ ID NO: 31393 - DNA, 1034 bp, Homo sapiens
tttttctgttttcatgttatctaaggacaaagataactgtatcaaaaaagactaccactcttaacaatttaaaataactcttaaggactattaaaagaactatctctattctggaaaagataattttactaattatgatttaagtatactatgaaatctcaaaaacgtctaagtctccaactctagtttctctaaataatacttttttatttcatcattttccctaaccacaaaagtcaagtataactcgcagcttgccatagagaatcaagttcacctaagtggtttgctgagtcccatggtctaatcccaatcttacttcccactaaattctgagaataatctgcttccaacaaacctaccggtgtatacatccatgtatttatcattctctactatttattcaaattctctccactttacaatgttctttatctaggcaagagcacagtgaatctcgtttcttttacctcacgagattttcattacctgtagctatcttatatcgcaccttgtaatgttccatgtttacgtggcatcatgctccatgaaggcaggaaatgcatccatccaagttagaaacttttagaaactctgtttgcgagtgggtggggaaagtgcagggaagtattttcagtcctgatgttaacataaaccttaacccacccattgttaaccatacctttaggcaattcagtaccaccttcaaagttataggactattaactgctttattgcctgtaatgatcttggtagagtgtaactggaaagccaattgagtctttcttaccactttctcttttatccagatgtggcaaatgatttttttctccccatgatcagcaaacttctcattccttttctgaacaccttctgagttatgaattgcctttttttcctttctttttctttcttttgaaatggagtttcactcttgtcacccaggctggagtgcagtggcatgatctcggctcactgcaacctacacctcccgggttcaagggattctcctgcctcagcctcctgagtagctg

SEQ ID NO: 31394 - DNA, 1077 bp, Homo sapiens
ttagtttatggtaattcccaattgagcctatttaagaatgaatcacaaacatacatgtggagaaaaaaatgccatattaaaaaaggagagaaattaaatttctctctgaagctttgtttacatgggcaacatgaagtcaatagaaaccatctctgcagcatttacttgatgctctatgttagaaataaatagagaaactgggaggggcaaccttctctggccctggaaaagttgactggatgaaatgttaccagtcagttatccctctcctaaacctaggatgtttgccaccaagggtatagtctgactggcaaggctaagaaggaatggaaatatgattcaagctagaaaaaaggatgattccaatcaagtctcttaataacttctcctatcatcaactcaggttcaactggaaagtgtgaaactcctctctaaggcttttactttttcccatcatgcctagctttttgagtacatctttgctcctttctggtctgataatttaatgctgggtatattaactatgtaatttgtagactgttagctccttgaaggaaatggtcatgccaaattcacatggggtgtacagagttggtattcagtaatcatgatttgtataaatggatgtgtaataaagagaagagttttaaccaaaaattgtatttgttctgtctggctaggattctttgggtaactttatatttgacaaactttgatggtgaagagaaaatgagatggaggtcacttactgaataatttggacctttaagccccctttacctggacttaaatggaaatttgattggattgctttcttccaatctgggcttcatttgacctgatttgaaagtcaataacatggtttgatagaaggactttaatctatgcctcatctgcttgatttcagaagtctttggaaaatctgaaaaaggtgggtgttttccgtcatgcctggtctccctttagagggggtggtgggaacaggaaccaaaaactctgctctctggtgatgttggttacatctgtgcagctatcagtgtttcctcctacacctctatcctaacaaatacatttttt

SEQ ID NO: 31395 - DNA, 1047 bp, Homo sapiens
ttatacttgcaaatctcaaggtgtaaatatatttttctgaatatattccttaatatttcaataattggctgcaaaaaggggctttatgtatgatgcagcctttagtcatttttctctcctagcagcagtgatacatttaagaaagataaaacttcttaatctacagagtggaaaagagcaaaactgtaaataagacataattagaaagatgtatcttcttacgtgatttggggcattttgcaagtccttcctctgcttatttatattttcagaaaaattcccctaatagccaatgcataattgtcaatttatagactctggggtaaaagaggcatctggattgtgcttttgagaccttgtctttactactttcagactgaatgtgatgaattgttaaataatcttcagttagtaaaaccaagccttaaaaaatgaaggcatcctataaacattcagtttgaaaatactaaaaagtatctgtataatattatgtcagaaagtgaaacatgacactgtcgtaattctaaaatgaaaattaaatagaaccagaatttatacaaatttattaccgtgagtttaccagtgttgctggagtttaagatgtcagaggaggaaatcattatgtctggcattgctggatcaattacctttatggcttctaataaattttgtcttctgattttgatggatatttaatcatctgcttctggagagatttccatttatatacctggaaaatgcttcaactgagtacttattaactgttagcaatagatatagttctgaaagatagatatagttctgtggttactgtgacttaaacaaacattgggaccacacgatcactttataatgagatttagtatccttttgtagttaagaaaaataaaaaatttggtaaaattattgtttttctttattatctataaatgcttcaaagtagttaataagagtaatttatactaaaactttaaactattgaacaaatggaactgttggtaaatactttgaaattttgtttctgtgaatgtaaaactttcattcagc

SEQ ID NO: 31396 - DNA, 1042 bp, Homo sapiens
ggctagagtgcagtggcgtgatcttggctcactacaacctccgtctcccgggttcaagcgtttctcctgactcagcctctcgaataggtgggactacaggagtgcgccaccatgcctggctaattttagtatttttagcagagatggggtttcaccatgttggccaggctggtctcgaactcctgaccttagatgatccatctgcctcggcctcccagagtgctgggattacaggccagagccaccatgtctggcctgttattaattatacaaatagagttttagcacaactctttttccacctaactggaaaaaatgaaaatgaagaaaattttctttggaaaattatttggtagtctttcagtttgttcaaatttgtctaatccatgcatatgtcatctgataaaatcagactccggttaagacctgtgttcaacctttttagcaattttgattagtatattaataactctgaagccacaaattggtctaccttatatcttctttttcctattagatgtaacctttctaagagcaggtatcattcttttttttttttttctttgttttgagacggagtcttgctctgtcgcccaggctggagtgcagtggtgcgatcttggctcactgcaacctcttccttccaggttcaagtgattctcctgcctcagcctcctgagtagctgggattacaggcatggatcaccatgcccagctaatttttgtatttttagtagagatggagtttcaccatgttggtcaggctggtctcgaactcctgacctcgtgttctgcacacctcgacctcccaaagtgctgggattacagccatgagccactgcgccaggccgagaccaggtatcattcttatctctgtatcctatataatacgtcttagtgtcctccaaatagtaaaatcaacatttcatgtatgtatatcccataccattcttgcaaattttaatgtgtgccttgcatattcacataattttattatggcttagtgttaaaccattttggttagatttttcacaacataact

SEQ ID NO: 31397 - DNA, 1026 bp, Homo sapiens
ttggcctgagtcccgaaggccatttagttgttaatcaggtgaagggcattttagctagaaggaatggcaatttaaggagtattgaatccaaatgccggaagttcagtgtggctgcagtccagatgttttatgggtaggtaggagtagattaagtaggaagggatgtggaagccagatgatgaagggctttgcttacaataaaaaaaaaagttggattttatccagagtgttaaggcatgaattaaagcttgaggatttatagaaggggtagattccagagctattagaagaacacagtatagcatagtggctaaaaggagctgcctaaatctgagcttaaatctaggccttgtcaactaagagttgtgtgacttgtgcatgttatttaacctataaacctaagtgtccttatctgcaaaatacttgcctggtacatcgttactgtgcagtaaagagtagctggtgctgctgattctggttgctacttgcacttcttaaaaagtggacttgaagactgaatactggcagtaatggaggagtagggtgctactggagaattcactagaaatataggaagaagaatgggtttggattttggtgttttagacgtgttaaatttgaaacagaaagtggaaatccaatggaatccatactagtttgtgagctgtcagcaatgttgtatggaaagatgaaaccgtgagttaatgacaaaactgcctacatggaggagatagacaagaagatgtcaagggtgaaaaactgcgtgcattcactattatttgaaaattatgtggaaaaataaaataaaatccctgaacgagaaagagggaatcataaagggatataagagaaaatggtgttacaaaagtcaaagaaagatttccaggaaataaattgtttataatactgattgccaatgagatgtcggttgtgataatgctagaaaatattcacaagaaggagccactggaagtcactgtcaatgttcagagaggaaaagggaaaatcaagtttcagtggaatagg

SEQ ID NO: 31398 - DNA, 1062 bp, Homo sapiens
gaatgaatgcaaaggcgcagaagaacatagaaataaataatgtacaaatcacacttatttggcattctggcacatttggttcagtaagttcccaaagaagtgtgagtggatagaatccacatttaggaaaattgaccttgaatagcacactttcacaaatgtggaagagaaagagataaaaatgagaaaagataatgataaaatttagttggaggaaagagctaaaagaacagaaataaatgaggagaaatttgacttgatgagccttttctgtgggaattgatgagcttccattctgtgagttaagagtcctggtgaggcagtgattagattggaagattaaaaattgagagaggtttggaatgaaacagagtagttgttctcaaagtgtggtccccaggctagtagcatcaacatctcctgcaaaattgttatacatccaactccttaagtctcaaccagacttcctgaatcagaaactctaggggtggagcccaacaatctgtattttaacaaaccctcctgatgattctcctgcacactgtagagtctaagaaccactgttaagagtttagtgatttaaagcacacgttctgtgtttaaatcacagcactgccgcttattgtcttttgcaaattactaatatttaacctctccttgtctcagtttcttcatctgtaaaatgaggataactagcaataacatactcatagtattcttgtaaagtctatatgacccaatgcactggaagtctttagaacaatctctagcatattgaaataataattaacaaatgtgtattatcattgtgggaaaatggaataaatttctaagtatacatataagaaaattgtagttctgattagtctagtgggctgtactttgtgacaattgcccgcttagtagccaagactctttgttttagtcccttgccacaagcctgtccgcccaggagtcctgttgtcttttctttttctgcaccatcttcagcagcataaggctattttgatgaatgaaatggaggaaaggaggaagaataaaccaagaagcaaagtaatgtgt

SEQ ID NO: 31399 - DNA, 1027 bp, Homo sapiens
aatcattagacaaatgagtagaatgtggatagtcatctaaagatcatagatagaatgagtatgatagagttccacattttttctcataaaaaacatttttattccatttcattctttttctctcaaggaaaaaatactaatatagaataattaagtttaaaaatacaagttttcgagttcttctgttttttcttcattattttgggtaagttatcatgtttctcataagtattgttaattttcttttagttcaccttcatatttgaagggcagcacattacttagtcttacttgggcactgtcaattgccatgtactagtcaatgccaaatgtcaaatgccataagctagaagtaacttgtaattatttgcagatagcataactccaggatacccttttctttaattttccctaatcagttattgagttggatatatgggctgtaagtaaaggagtactgatcccactgtgctcaggaaatgcttctggtcgagtccagcagacacccaaaggattagtgcagaatttccttaaacattttccatcctgaatcagagacatgtgtatccttgtttgaaaggcagattcctgagtccatcccagacctactgaatcacaatctctggggctggattccaggaacctaacctcagtgcttgtctctctacctactccttgatccttatgctccagcctcttgtagtctctgactcgtgcccagtatgtctccattagaaagccatgcacagctcttcctttgcctggatctcttattttccaactttctcatgaatggttccccctcattcaggtctcagttcaagtgtcaccttcacggagcagacttcataaactccccaagctaaagcaacccccatcctcaccataacattttctatcacattaatatgttttattttttaatgtttagtgtctgtcactttttactaaaattgaaactccactagcacaatagcttttctctgtcttattcgctgatatatttgcagaaggcactccaatacat

SEQ ID NO: 31400 - DNA, 1049 bp, Homo sapiens
tgaatgagaaacctgacagtcacatcaactgataaaacagcatcagcatgacttacacattccttaccattgggcaaatctacatgggaaatcgcatgcttgtactcagaacaatctaagtcagttttttaaaaagaagtaatccttagctaagagaccttgaaaaactcttgtccactataaagataactttgaccacagaataataatactccaaatctttggccaaaatttcctctcccatgggcaacacttgaatgtggaaagtcagggtttatttttctttctgatgtttctttttctatacttccatgtctgagaagcctcctttaggattaatatatttttaaaaaattctgatgatgcagtgaatcaagtatagtccaatctaggagtctcctgtaatgttaatatgactttgtaaatctctgatctcactcactataatagatggtgttcaacaaaagtaatagaaaatcttattcacagtggcttaaactaaaaggacatttacaaagaagactcatgggttgcagtcttaccgcaggtgcatcaagtagcttaattatgtaatcaaagaccttctcctcccacccttccttttccccgtgctcagcattttggcttcggtgttgatgactgtcatagcttcatgtcctcagagaacagcacacaaaccaagaagggagggaaggggccaaaagcctctctcatctcagagcactctcttatcagagccatttttgcactcaagctcttccttcccagtttacttctctgtgggcatacctggatcaccagctcacttacagacagatagaagaataaggttggcatattggctcagaataatcatgatccatcctcagcagctagacacattgttttgggtagggatggatgatgttgttgccttagtaagcaagaagtgggaatggctgttaaatagacaatcaacagatattatcacaccatactctgttgggtgattataatagtcttaggctttacccaaaatctattgatcaggcatctctggtgttgaggat

SEQ ID NO: 31401 - DNA, 1083 bp, Homo sapiens
tgtcatatatatataataggtttgagattatagataccagtttcaagtgatatagtagacatgttagatttggatataacagttaagcaagggcttcaatttctttgaggattttgatctgatgttaagttgccaaagcagaacgtagagcttacagcaataaaagtgaatcagacagtgaggagggaaagcaggtgctgtattgatatttacacatggacagtaacatcatcaaaattgtcatcttcaaacatgtacagcagcttttgcaaaaatgagagagaatagtaaattcagaaatgagagtaactttaaactgtaatgtacataatgggtgaagtcttccagatagctcctccagattttgcacaaagcagtgaatcttgagtgagtccaatttttggttacgggtattttctttgagttgataatagatatgtgggattctgagtgttcttgaaaaagtccttattccggcagccctcatactggtaatattttgtcataaagactttgaaaggttctactgttgcatgatttgcaaatgactgctattccccctcaaaataacacaaattggatttaagaccaatatcctcaaaactggctgaaatgaaaaatgaacaaagtaaaacataaaataatatttctgcaaaataataatattttaataactcaaaagcagttatgtcagtaagtgagagcttatctttggaaggatcaaattcaataatacaatgggtcaacttcagattagctattgcttaaaattattggtgattgaatagaacttgtaattccagactagtcaacagaatccaagcgtatgtgatgcctcacatacatttgttaaaccagagaaaacattagataaatatcgacttttctcttgtcattttgagtctaatgttttcttttctttcagttttttatttgtttgtttgtttgagacaaggtctcactctgtcatccaggctggagtgagatgaggtgatcatggctcactgccgcagcctcaacatgctgggctcactcactcctacctcagcctcccatggagctgggaccataggcatgtgccac

SEQ ID NO: 31402 - DNA, 1027 bp, Homo sapiens
aaatatttacataatatattcatgtgataaggatattgtaattcaattcaaatacatttattaagcagcaattatatgtaaaagattgattgtcttgggtgttcaaggacaacacagctagacgtataagccaaataaagcttggctaagtttggtctagttcaatttttttaaaaaaaaaaaaagaaaaagaaatatgaaaaaaaagcagtaaaaatagaaatccatcttcaccaagcctttaaagcaatataaatttatactgaggttcctgcatactataacacacagaaggaattcctaaaaatgttctttatccagctgtctacccaaagttctatcatcctggcaaactgctctctccaaaattcatcatcttggactctctctgaaactccaacccttctctcttataccctgttctccaacattcgaatttgtttagtttgtcttcttcctaatatagctatttctgtttaccattttgagctctggaactctaaccactacttaccaccaaaacaaaagactagcaagtaggttcaggggaaagactatacataaatacacaggtccacaatctctttggtgccagatgtatttcagaattccaaatttttcaggttttaggaagaaatttggtgaataataaacaccactaaggggacagggaagcactaatgtaataatgatatattattattactgcaacaagatatatagtcacactatataagacagagacacatcagttcaggtcaagttttgcccccaaatatattcaggatggctcaagttttgctgtctaatgaatttttaaaagcttaatttttatagctttataaattatgaaattaaagatgagggaatgtggtcctatacatcaatactcaaggatcatatgagttaatttgcataaaactcatagatcagtgcatatctgatacggtttggctgtgtccccacttaagtctcaccttgaattgtgataatctccatgtgtcaagggtggggccaggtggagata

SEQ ID NO: 31403 - DNA, 1053 bp, Homo sapiens
gagaaatgacagcaaaataagtaggactttcgtgttgcagcagtggtagctggaaagcttactgaagttgagctactgataagcccagaatggaaataaggccaaccctctgatgctccaaccacctccttgaaaatgatctttgtgaggccaatattcaaaattctcacaattcaaagacattactgtgtcctaattatctttgactttccatagcatttggctccccactattgatggtagtctctaatttgacatacaggttgccccattcctctgttgtctttttttttcttttttggcctactcccctcttttcagagaaaagggactaggggctaaagaaggctaaatgctcaccacatgtcttctgattaactctgtgtgttacgtaaggggaatgacggagagagcagtctgttactaggtgaggtcaaggacatccttcagaagaaactgagcaagtgactgcttggcaactatgtacagaagggatgaagaatgaaagttaagtagacaatctaaatgaattctcgaaacttctgaaaggagctatctttgaccttgaaggggaatgtaggcaaaataaaggataaaataactgacactcattaaagaccaaatttgtgtagggcacctcattttatacattatacaagaaaaaaattgataaacaaaaaaattagacatttctgctcattagaggacactactgagaaaatgaataggcaatccacagagagaataaaaagaaacatttgcaaaacatatatttgagacctcattgtctcattttacttcagcaaattctggggtgttaggaattacagttttcctcttttagaaagtaagaggtttttaattttggagaatttttaataaaaattctcaaacattaataaagccaaaagaattttacagtaaatgttcatatatctatcacctagattctatcattaacattttattattcttgttttgctacaaatttattcatcaatttgttttattttttaatatgtagttcaaagtaaattgcagttaacagtacac

SEQ ID NO: 31404 - DNA, 1027 bp, Homo sapiens
tggaacttttaaggacataacaacagtttgccagacttctattaaaaaagtagatttgctcaaaatatagcttctttgtgaactataggtatggcttcaaatgttttcactgactgcataatgagcaactagagagcaaggatttggtctaatttatggctgtatacctagtatctagcttggagctctgagtaactaaaacaaaatggtaaatggacttggtgtagtcccaattgctacatggagactcttgctatgcagcaaattacacacacatgcaagtaattttattcaagaattatttgacagtaaagacctaggcagttgtgagaaatagtggtatctaaaataaaatcaatcattaacaaagagtttacaattttgaaagaataattcaatgagttctataagaagaaattattatgttggcttacataacccttcattatctgatcctctctttattctctattttagtttctttccatccctcctccctaagctttaggggttctgaactggtgcttttcaaattgtgtggaagaatgatttgcttttgtttgtttgaatatttcatttctaatccactgtggacgtgtgcatggatcctgctgcatgcatatgactagtacactgctcatttcacatgacaatacaagaactggtccagactatattcaaggccatgatgatgagttcactgatactctaatgttgtaacagtgtccactttccataaaagtttctaagcacttattcgcaatgtccgatcttatttctgtgcatagtctgacagtgaattagtgaattagtggatcactctccaccaattagcacactcttaaattacttgcagtttgcaagccagttgatgccccctgccattttgcttttggtttctccttcctgtaatgaccctttcttctgctcccgactaatcttctactagtctgttgagacttagcactagagtcacctcctccagaaagccttccaagactgatacaaaactctattactatgctta

SEQ ID NO: 31405 - DNA, 1056 bp, Homo sapiens
ttttaggtgtctaaatattccttccagttttgtgtttaatgttgctttcaaggaacaaatcacttgaaatttaaatttggattcagtgtatgctgatactacagcatttacattagaagtaaaatcagaagccatccacatgttcctcaactatgtctggtatggtcaattgaaaaggagccaatgcaaacgcccctttgataattaaagacattttaaagaactgcaaaaacctaaatcaccatctttgttgaattgtgtagaatgttccacactttttttctttattttcattattttttgtttgttgtttttagagtggtatacacttgatttgtcatttttagaagtgaacattctgccagtacctacttcccaagacttgttaaagttggaaactacagatgttcacttgggtggcttctcctcagtgaacatttccctgatttgtagttaattctctattccattgagtactgtgctacatttccctgtagatttgtgcttgctttttccagcttttccacatctccacctctcaaatgaactaatcataacattacgtttggttgcttgcattattactgtgtttagtttttatttctatctagctgttttaaggggatgttcgttgtattttttcaggtaagattagatattattcctgtttttgcctggatccgacatccagaaaaagcgtaaaacctgaaaccaataagaaacaaatgattttattccttgctatttaactcttcaagcattttcgttgggtttaagtacattgtaaaaattaatgagtattattaaaagagttaactattatgacactaactccaaggatatgccaagtgcatagtgggtacttaaaaatattccaatgtacaaagaagtaaataatgaaaagcgttaaaggacatttgcttgatatagtctgttaaaatacataattctgacctaggaattcttttctaacatgatgactttttccctaaattatctggataaatgccttcattttaaaatatgttttgtatatgtaaacatagaatcttggaa

SEQ ID NO: 31406 - DNA, 1147 bp, Homo sapiens
aggcttagctataatatgtcactcccttattcgacttttcctcaacacttcatagaatttaccacaatttataatattgataaattgtgacagttgcattcattggacaatgctcagtatgatgattatactaatgtaagcaaggtaacatttcaaggacaatgttaaactcaattttccttaggtttgaaacaaacgtgaaggtggacatgatattcactttcccacatacatttaaaatacctataggtatagacagatgtagaattttgcttacagagaaaattgcagtgaatatatcatattgtctgtccagaggtcttgagcattatcttggtttctaacatcaaccctacaacttaataatcacatttgtatatatacttatgttttcatgattttaaaacaggaaacatctttgaaatgtttatgattctattgaatttaaattgagttaaagttggctcataattaaaatcacaatatgttatagtataactttttttcaaaaatcagctacatattgagctctgaagattctgaaattggccagttacagtggctcacatccataatcccagaaatttgggaggccacagtgggaggagcgcctaagcccaggagtttgagatcagcctgggaaacataatgagaccttgtctctacaaaaattttttttaagccaaacatggtggtacatgcctgtgctttgagtgaattcagctgaatttctctcctttgacttagttgctatttttccaaacactagccaattcaaaatggctgtgaatttctctatttgtgtattttattgtctttggcattcacaaaagagtgaaccacaatgtaaccaaaataaaatgtaactgtgattcacttccatatgtggttaatggcccatggcaaaattttgatgataattcatctttattgaattatattaggttattatggaatcaggaagacatctagaactatcatcattctttaagaatagcatttttttcttctcaaagttgacgtcagcagaaggcatcctggacagaaaatgaatcaccaaagagtttatgcttcattttataaagaacttcaataccagatttttaaaaataaattttattatttagggtgatagtataaatatact

SEQ ID NO: 31407 - DNA, 1054 bp, Homo sapiens
gcttgtataaaaatttgttttattgtgattcaatattttctatgattgtgttaccaaaacactagggtttagtttacgtcttgctgcttgccacacagaaagctaatcactgagacaactagtattgccagtgaagaaggctttaatcatgtgctgcagccaaggagatgggaaatcagtctcaaatccatctctccgactgactaaaattaggggtttctatagcagggaagaaatccaacaatgtataggaaaagaaggaattaggcaggggtaaggaagaaaggttagtcaacaggaagcaggtagcaagtgatacaatcatgacaggactagcgtctcattttccagttgcagtgatctggtaagtttcagctccttaatactatccacggggtctgatggtagatttcctgagaatggaactgatagaagacaaatgtaactttctcaagttttaagactgggaggatcaatttctatatgtattgaaagaaatcataaatgtcagttctgtggggcaattggactggtctcaattgtgagcctcactttccacctgcttccacaaaagcaggaattctagggttggaagagcttaacatggatggtccaaatcccatctaatataggaatcgtcaccattagctcaacaaacaatgacagttaactcctggggtagttacataaaaatacagccaaaactagttttggacaatttagtttctaaattgaggaacaacctgaccccccagaattctgtactcatgtgtgttagatatgattttttgagcaatataaatgtagttatatcatacctttcacacacaaatagaattaaaaactctcatattcttaggtttttttctccttctctaggctctgtttaatcagttcttctgtctcttactaatatgaaatggtttccagatggtaacgtcattctgtattttgtatcaataaaacatctaggagcaatcagtgtaatccagttatggattgagtttggagggactataacctctcactaatcagaaactattgccattggctc

SEQ ID NO: 31408 - DNA, 1083 bp, Homo sapiens
acctgaaactgattccatgtcattgctattgggtatagtgctgcatttaacatacaagtgcatgtgtctttttggtagaatgatttgggcttttaaatatgtatactcagtaatgggattgctgggtcaaatgatacctctgttttaagttctttagaaatctccaatctgcttttcacagtagctgaactaatttacattcccaccaacagtgtacaagtattcccttttctccacagcctcatcagcatctgttgttttttctttttgactttttcataatagccattttggctggtgtgaggtagtgtcttattgtcgttttgatttgcatttctctgatgattattgatgatgataattttgtacgtgtttgttggctacttgtatgtcttcttttgagaggtgtctgttcctgtcttttgcccattttttaatgaaattacttagcttttgcttgttcagttgtttaagttcctggatattagacctttgtcagatgcatagtttacaaatattttctcccattctgtaggctgtttactctcttgatagttttattttcctgtgcaggaactctagcttacttaggtaccacttgtcaatttttggctttgttgcgctttttcttctactattcttacagcttgaggtcttacctttaactctttaatctatctcgagttaatttttgtgtattgcaaaaagtacaggccattttattcttgtgcatatagcttgcaagctaatccagcaatatttattaaatagggagtcatttctttattgcttgtttttgtcaactttgtcgaagcatagatggttgtaggtgtgtggttttacttctgggttctctattctgttccattggtctaagtgtcttgtttttgtaccagtaccatgctgttttggttactgtaggcttatagtatagtttgaagttacatagtgtgatggcgctggctttcccaatgctgtttttttccagtgctgtgtaaaatgacattccaatgctgtgtaaaatgacattggcagtttgataggaatagtattggatctgtagattgctttgggctgtatgga

SEQ ID NO: 31409 - DNA, 1067 bp, Homo sapiens
gtccatcaaacatttcccacctcctacaatctttgataacactttaaaaaaattctaaacaaagcttttctaggaagttttagttttttcaaagctgctttgcttttgtgtctcagtaatggtgtattacagggcccagcagcacatggatgatccactgctgtaatccaccagcagggatccctggctccgtgatggattattgcattacatcatcagcccaagggctgacaggaaagaaagtacttcaaacagtcctccttcgtaaattgttttagtcttaatgaaagaaaagatatggttttgaatgggtatggatgagtagaaaaactgactatacctttcagctctgtattgaattacatacatgtgagagcagctaccaaaatgctcttggttcacaagatggaattttctgttcattttaaacatatggcactagctaatgtgcataacagtgaccacaatgaatataatattccataaaataatgaagagatttttagatcatctgaatcaaagaagaaatttaagtagtattagtataggttttataatatgtgcattttagttcttcaataatgtgtgctattgccctattaagccaaatgtttgtttaaccacatactacatttcatatccttgtcagataacagaattatcgctgaacttgaatgtatccatttacatatttttacatgaaaaatgtgaaatgaaaatttacattcatgtcaagggaaacaaatcacaaactctattaatcgtcttactcaatattttaaatttagtaaggtggtaagtttgttgaaagaatagataggcaaataaattaatagacctttaagttcacttttttctttttaagaaatcagtttcaaatgtacagtgatgttatgtttctgagagtaataaatcaaatatttttgcaaacaaatgaaatacatatcttttaccactctaaaataacttaaaatcaggtgtctaattggttgttattagagaattgtatggaaaacatagatttgaaagaccgaatttttattttaatttgcctacatttctcttct

SEQ ID NO: 31410 - DNA, 1040 bp, Homo sapiens
atggttattagtctttacaccttcattactgaagtagataataaggtgaagatattagctttactttaaagagataagaatagaggcatataggaggtcagtgactttctcaaggttatgaaatcattctgtggtaaaaagaatacatgattcaaattcattttaactaccacatcatcttttttcagattactttttaagtcagtagttattattaccagtgaaattatgataatcatattgatgagccaaaggttgtcattagatttctcaaatatccaacaattcctgggccaagattactacataagaaatgttgtatttatttttaaatgaattgtttgccttagaatagaatactattttaaactattaagttaaagcctagataagattaaattgagttcttggccacacagcaggttatcttattatcttgatttaaaaaaaataaatgaaattccaaggtccatgtgtacctgtagaaatatttagaaatgtaagtagttgaagaaaagagtagataggtaaagttgaatatgtgtgtttgagaaagtgaagggcacaataggatagaaaatatattgcagtattgcaatagaataatgaaaaacatcagtattcagacagcttctgatgtatacatagctgaggtcaaatatcaagcggattttttttgtctcccagactgagatcacaccgccttaatattgtttgttagatattggcagggaaaaagtttagtatggtataaatgtattttttaacttaaattatttcatagatttttaaagaattccatgttaactctggagaggaaggagtacaatatgtagtctgttgcaaaaccagagtagtatatattttagataaatgggtatttttgaactctagaaaaattgaatatttctgggggttattaccccaagactgaaatccaaatgtcatctcagctttctcacaaggcccttaatagttgaagaatagaactttaatttaaaatccatctctaagaagcagcatccacaagactaccctct

SEQ ID NO: 31411 - DNA, 1161 bp, Homo sapiens
tccactttacccccaggacactataatgtgggcatggagaactgaaactgtgcttctcaaagtacatgatgcatgcaagtcacctagggatgttactaaaatactgattcagtaggtcttgggtaaggcctgagattttgcatttctaacaaatccccaggagacgtgggtgccactggtctgtaggccatcctttgagtgaaaaaatattaaaatccattaaataccatatgacatacctcatagtgaagattctaagtgcaggcagacttcatgaaagtagtaaatgatacaatggaaaactctccatgtaagagaagaatggacactgagaaaatgcaagcccattccctgttcctactcagcttataagatgactcacttctcatcttctctctaaagcctttctgacacaatctcaccttcctggcacaatctcacattgccgctgtctctctacccctttctattcatgctctaaagtattaatacattcagaaagatctttctaaaatacaaaaccgactttgccactcttaggcttaaagttctttaattcctatcacctgccatttaaattccacaatggaaggcccttcccaattggcccctttcctgactctctagactcaatttccaccacttctaccacatgtcacctgcattcgcccagcttcaccacactctttcttacctctgcttgtcataggccattgcctgtgcctggcacctcccgtccccattgtctactaggcaacagtgcatccattcttactggaagctcaaaagttccctcctccacagggcctgccttctcctgccaggcagagttatgtatttcaacgcctttttgagtccatagcatataaaacattattgagttctatttatctctactgatttcagtactcccaagagagcccctattttgcaaggatctgaatctcatctttctttataccttctacccatattcaagatgtgaaagatgttttaataactgttggttaaaagaaaaaataaataaataaatccgaactagctatttactcaaacatccctttttaccaagaaataatttatgatggcactaataaacaaaaccaatgtgttctgtgatgagatttcagtacacaacagaagtaaatgttagggtgaagg

SEQ ID NO: 31412 - DNA, 1013 bp, Homo sapiens
tgctggctaaatcttatcagattatgataatatgatatcttggaaatttttcaggcaatatttttttcttaaattctatattattaaactcagatttatggtgagttgctttttgacaatggtgccaaaacaatttaatgaggaaagaagagtctttttagctaatggtgctgaggcaagtagatatcaacatgcagagaatgaagttttattcttacttcctactatatacaaaaacgaactcaaaatggaccataagcctgaatataagagctaaagctataaaacctcttagaagaaaatttatgaatatatcttcatgaccttgggctctgtgatggtttcttaaatatgacatcaatagcacaaacaacaaaagagagaatagataaattagagttcatcaaaataaacatgttttgttttgcaaattatacaataaaaaatgtggaggtgacccatagcatgagataaaatgttagcaaattatatctttaagaagggacttgtatctaaaatatattaaggactcttagaactcagactaaaatgaaataaaaaaaagaatcagagtagacatttctcagaagaagaagacatgcatatggctaataagcacatgaaaaggtgcttaacatcattacacatcagggaattgcatatcaaagccacagtgagagactacacccactggggtggcaaaaagtcagataatattggtgaagttgtagagaaatgggaatccttatatgtagcaagtatcgtacccttatatgtaacccttataagtaacccttatatgcatcagcaagtattggtgaagttgtagagaaatgggaacgcttctatgtagagaggggaatataaactggtccagctgttttggaaaacagttgggcaatttctcaaatcgttaaaaagacataccatatgaacctgatattccattgctagctatatatgaaaaaagaaatgaaaacatatgtcctcacaaagtcttgtacatgaacatt

SEQ ID NO: 31413 - DNA, 1047 bp, Homo sapiens
aatgtattccacatttgaataatgagcagagtaagaggtaccaacaaatgaaacaattaaaggaggccataaaaacaacagagatcatttcaacattctattgaggaaatttggggggacacactttaattaaataataacatcagtatttctttacctttgtaacttttaattaatgaagatgttttaagatgaaatataaaatgtgaacctgagaactgtttaacatttaacattatggatatacatatccatgtttagaatgttctctgtgtattaatgcatgattttgtcataaataccccactaggaagagaaaggtcggagagagtgtgtgtgtctctatgtgtgtgtatttgtgtgttttgtcctggcaaaaagacaaactgagagaacagaagaacaaaagagcagtactgaaaatagctagattaaaggttgtttttctgtcaccacacaccagatatggagagtagtaaaagcagacagatggacagttctgttagttttggagtgtgtgaatagagaaaagaaacattctgttccttttattcagaaaaggaatttctagactaaattactggtatcagcaataagtttcatattctgaccaaagaaacattattttttttttaccctagggataatgactcatgctgttctcagaattttgcttttgtggaaactaaagtgcagtcataaatacggcactgttatttagatcttagtgctaatgatactattgtgagtagactagtgatgggtaagaacactagtattataaacccagttgtaacaaagaaaccaagcacatcttaattagctgattctagatgggaaagtagattttttaaacaaattaactaattgttttaattctgtgaattatgcaatagaaataggacccataattttatttttttaatacttcattattttgaggggtttatgtcagaagttaaatttctaacttccaatattgacagtggagataattaaacatattttctctgccttttttccttatgttcctcaaaattagtataa

SEQ ID NO: 31414 - DNA, 1027 bp, Homo sapiens
taaaaaattaccctctatatgataaccaaatttcctttaagtgttgcttcagtgaaccaaatagtgttttactaagtgtaggagttctagctagataatatctaccatctctttacaacaagcctgaaacagtaagttctgtttccctttctggacacatgcatttagataacattgatccagtagataagagaaagggaggccgggtgcggtggctcacacctgtaatcccagcactttgggaggccgaggtgggcggatcacgaggtcaggagatcgagaccatcctggctaacacggtgaaaccccgtctctactaaaaatacaaaaaaattagctgggcgtggtggcgggcgcctgtagtcccagctactcaggaggctgaggcaggagaattgcttgaacccgggaggtggaggttgcagtgagccgagatcgcgccactgcactccagcctgggcaacagagcaagactccgcctcaaaaaaaaaaaaaaaaaaaagagagaaacggatcctttattgaatttctgtgttccaagcactatgctgagaactttacatataccatctcatttaattcttttgtttgtttttctttgggatggagtcttgctctgtcgcccagggtggagtgcagtggcaccatctcggctcactgcaacctccacctcccgggttcaagctattctcctgcctcagtcgcccgagtagctgggactacaggcgcccgccaccatgcctggctaattttttgtatttttagtagagatggggtttcaccatgttggccaggctggtctcgatctcctgaccttgtgatccgcccgcctcggcctcccaaaatgctgggattataggcatgagccaccatgcccgaccctcatttaattcttataacattactgtgagatagtaactatttttattcaccttttgcaaataaggaaactgccttcaaatgagcctacaaagaagacttaagaattggagagttctccctagggtcagtggaattcaggatgatg

SEQ ID NO: 31415 - DNA, 1049 bp, Homo sapiens
tgaaaatgaattgcagttcctcactaaaggaatttaaattttttgcatactagtgatgaggacttgattttccaccctgaagttgtaaaggtctttcagtctctctaaaagtgtgagttaaatctgttttctcacggccagcttttaaaggtcagtgaaggacggcactttgaaagaaatggataatatgcatccttccagagctagtatatattacagctgtccctttggactcactccagaaacagctcagtgactcttagaggaagagaattttagaggccctaactggggcccagaaaattgtactgaaggatacttgcttcctgtgcatctccactatagtaaaatttgtttaaaattacgcttcttagccctcaaatccaaatggtctcttgagtgcttttgatttttctttaaccatccgtttcctactatttctactgctacctcgctttgttcaggcccttgttacattttcactagagtaatttcaacaatttagtttttctacctgctcttctatgctctaggattatagtgcataaaaaaaagtgcactatatatatagtgcaccccccccaccacccccagcataaaagaccctatcctgaaaaagttcatagcctaataggaggtcaaacatgactacagataattttaatgagtatgttgaggtacagttatagaaatacatataaaaggctgtggtaacatttaaaaagggagtaactgactctagaaatatttaaagtaactttcaactgcagtaataagaccattgaattattaacccagatttgaatcatgttgtttctgtagcaaatgtagagggaagttttgttctcctgttccaaatcagactaaagattcatttggtaatttaaaaatcagaaaagctttttttttctctctctctctcgttaatgggttgtaggggggtgaaagaaccgtctctgtctcctctggaggctcagtatttgagtccaagaaataaacttgacagtagacagattaacaggagaaaaggcatgtaaatgtatcgtatg

SEQ ID NO: 31416 - DNA, 1050 bp, Homo sapiens
atagtgtagaaaaaaacacccttaacattatttccatagataaaactaattagaactgtaaattctaaggagattatttatctaaactaattttaaaatcagaagttaaggcagtgttttagatggctcattcacaactatctttcccctttaaatatgatttattgtctttctcatacacagatgtattgcttggtaaaagattggcctccaatcaaacctgaacaggctatggaacttctggactgtaattacccagatcctatggttcgaggttttgctgttcggtgcttggaaaaatatttaacagatgacaaactttctcagtatttaattcagctagtacaggtaaaataatgtaaaatagtaaataatgtttaattacaataataatttattctagatccatacaacttccttttaaaaaacctactgcactaactagttttatgcttaaaaaaaaaaattattaccagtaatatccactttctttctgaaaaaattttctttagatcggccatgcagaaactgaccctgatttgtttttttggaatcacctaggtcctaaaatatgaacaatatttggataacttgcttgtgagatttttactgaagaaagcattgactaatcaaaggattgggcactttttcttttggcatttaaagtaagtctaattattttcccattaaattcttaaggtacatattacttgctttcttaatagatttataaatatgtattacttatatacttttgtttatgtttggctggaagagttttccatactaaaagtattttgtaccagtgatgagcttctcaacttttgctctttgaaatttaaaaagcagtaaattcaaaactaaattttagtcatgaatgagagcttaaatatttttaaagatttttgttctacttaagtcaaattttctaggtccagatgaatattgctgtaggtttcactgtgtgtatggattacaatatccccaaacaaagaaaaaaatgttttaccttgaaattcagaacaatgtcaaactcccgtggttcttact

SEQ ID NO: 31417 - DNA, 1037 bp, Homo sapiens
cctgctgccgttgtctttacggaacctttggtgtcggggcttggaagtctccttggcgccggcttctgggcccgggcgaagctggtgcgtggcgccggggtggaggcggctaagtcccagggacttctgccctgcgcctccgacgggcatttgtctggctgcgtccgggctcgggacgatcctgggtcctcgctggcgctgcggccctgcccggcggcttcgtgacctccggcggcgaatccccgggctcgcgcaacgagttgtagccgcggagagcaggcgtcgatgctggcgcccaaagcctccagcctgagagtcgcctcactcgtgtgacggtgcttagaaacccccttttttggttttgtctttaagtactgtctagggaaacgaatcatttgaagcagtttatgccttttttgtttttttcgaagagaaagatttatgccggactgaaaaatagcgaatcaagtatttagtgaccgtgtgatattgcagtaaagactgcctccacgttggacatgtagtggattctagttcaggctctcctgcaacatgtttttgtttcaattcttttacaatttaaagcatatgcttattttaatgagaacgaaaaagaaagcttaactctttttaaactcgttaaaaatggagttatttactgtaaagacgtcttacagcaattaggaagaatatacattgcatgaaaggccttttgaaacgtttatctatttgatgattgctgactgcctgttgtatgtattctattttgtgcatagactttcttgttggttgaaaaaaatgacaggtggaaagatgttggtttctaggtgatataaaaaatttttaaacatttttctgatttttctgcagtgacacgtgttacatatgtcgtttgtatttcagagggaggggggactgtgataggttgcttgtgattcagaatcttcctgctaagaagactagtgagcaaatgtttatgacatccttgagtagaaagctaagttttttcaaggctgttatgcacacaaaaggcacat

SEQ ID NO: 31418 - DNA, 1006 bp, Homo sapiens
ggtctcgatcttttatttcttaaataaataatctataagggctgtaacagtttaaagtttataatttgggccaggcaaggtgactcacgcctgtaatcccagcactttgggaggcccaggtgggtggatcacctgaggtcaggagtttgagaccagcctggccaacatggtgaaaccccgtctctgctaaaaatagaaaaattagcccggtgtggtgccacatgcctgtaatcccagctacttgggaggctgaggcaggagaatcgctttaacccaggaggcagaggttgcagtgagctgagatcgcgccattgcactccagcctgggtaacaagagcaaaactcggtctcaaaaacaaaaagtttataatttggtttgctttcattatgcttgctttccttatggatgaataaattaattcagattcatagtcctattttggtgtcaaaagatttaactataggtcaggcatgagactgtctcaaaaaaaaagaactatagaaggtaaatcatttcaaagaaatgtggaaatttgcatataatcacatatttatcaagatatacagtttttagtatgtagtacattgttttcaaaataatatatcttaattagttctgtataactttccaattgattaaagatctggtgccattgtattattcagtaccagaaatgagctgtatttttgcttaataacttctttcatgttttacttacaggcattttttactgtctacagaaacttattgtaattcatttttcctcactccagtagtaagaattataccaagtaagtggactgtattgaaactaattaattttgtaacagttaatgagaatttaattggatagtggttgctgcatgtgttgtgttctcagtggaacgttgaatgtgacctcataaataggaaaatgatttttttcttgaaaattatttatattctgatctgtgtgatgagtacttttttctggaagccaggaggccgatacatatttgtgacaat

SEQ ID NO: 31419 - DNA, 2625 bp, Homo sapiens
gagccatgatcatgccagtgtactccagccttggcagactgagcaaaacttggtccctcgcaaaatgttgaagcccagttttcactattaacctgtatttcagtttccccatgctaactttgaaacactggggctggcctgagggtataaaggcttattcaaactcagtaatttaaacttaaaatcctaaggaacttcaaaaagtgtaatctagtccaaatggggcatcaattctaaagcatttgcttgtttgagcagattttctgtgtctgaggtatatagataacttatctttttatgactaaatccaagtccttagttcctgttggaattcaaaatcatatttaaaaattgatgctttgttctataattaatgctttgattgtataaataataagtattcttccaaatccctttttacagatgatgattctgataccgagacgtcaaatgacttgccaaaatttgcagatggaatcaaggccagaaacagaaatcagaactacctggttcccagtcctgtacttagaattctagaccacactgccttttctacaggttgggggaactaatttatagcattgatatattttgtattggtgaattttaaaaaaagtgcatgcaataaatttttttttgcccagttgtatttaacagatcttatttagttatagtcatataataggtttgttttattcttcagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccattttctgtatataaatatatctttaatgtggtattttcaattgcgtgatagtttgtagtttcaaccactcttggtgactgtcatcctgtttcttccatattctctgatttcatgaattgaaaagaaacaaatgtattgaagaagtgagctacagttttccttccttaaccatgggtgctagtaactttttaaaactcaagacaagattagttttttatgtgtgaagtcattaaattattacacgaccagaactaaaatgcaatatacagttaagtccacggatactcccattaatgagaaataacactaggaagccactattacaggaagaaaagatttggttttcatggcagtctgtttttttaaaaaaaaatttttgagccactatctattgttgaatattttaagatgggatgagggaggaactaataagggcttacacaataaaaaataactatatcataactcattcataacttgatgtttcattttctgttgaggaaccataaattcattcacagacttaatatttttttcttagagatggtctcgttctgttgtccaggatggagtgcagtggttgatcatagctcccgggctgtagtctcccaggctc

SEQ ID NO: 31420 - DNA, 1076 bp, Homo sapiens
tgtccagagtggcattatttgtctttttctgtttttcattttcttttataagagaggcccaggcagatctcaaactcctgggctcaagtaatccacctgcctcagcctcccaaagtgctgggattacagtcatgagccaccactcccggccttattcatctttttttaaatacattatttctgaaattatattctatggctgattactgttatctttacaactcatcttatttgggttttcagaaagtttcaaaagattaaagttttcccaactaacaaggtaagttgccatgaactaaacatgtccccctcaaaattcatatgttcaaatcctaatccccagtgtgatgatatcagaagatggggcctttggtatatgattaggtcaggaaagtggagccctcatgaatgggattagtgccgttagaaaagggatcccagagagcgctcacctgttttccatgtgaggatacaatgagaagtcagcagtctgcaacctggaagagagcctcaccagaacctaaccatactggcaccttgatctcggacttccagcctccagaactgtgagaaatttctgttgtttataagccactcagtctatggtacattgttatagtagcctatattgactaagatagagtagatttgttttgattcttccttccgtctgttctccaaactcttaaaataagttactcccttcatgccatatcccacatcacttgcttgtataccgtgtaaatattttatatatacctgcctggcatcagtttgtgctgattttgtaaattttgaatgtgtttgttttagattttaagcataacattatggcacatatcttaataactttttatggttacaatattctggttaaattccttatggcattcatccattgttagtgagcaactaagatgccgaagaagaaggacctaacctagaatgacagaatattagatctgggatgaaccttagagatatagtctagactcaaaagtgaaaaacatgtaaaaataattgtgtcctgggtgtcaccacaggctcactcctgtaatcccagctctttgggaggc

SEQ ID NO: 31421 - DNA, 1046 bp, Homo sapiens
tgagctgtttcacctcatccctgggggaagcagatagaacgtggtaaagtagcaaggtctttcctagcttggagaccttgcactgtatcttaatttctgaggggctcctattcaaacctcacttttttctctcagtatgtggctcccccttctgagctcaagatctgaagatccattcagtcaggttggaacaataataggtcagtgttaggttctagtttctctctttagaaatgtattcttgtctcaagggtagcttgtatgtttgagacctagaagtccacttttgactgtgcccttgcaacttttaatattcttgaaattcttttgggcgggattcttgtgacccattgccacggagtatgcaccttttaccaaacattgagatgctgtgggtggcatgttaacataaagcaaaaatacatacaatcttaggtattccattatataactaacttaatattcatttatatcacttttctaatgccatttcaattttgcagcaacatataagaatccggaacttgatcgaatagccactgaagatgatctggtagaaatgcaaggatataaagacaagctttccatcattggtgaggtgctatctcggagacacatgaaggtggcattttttggcaggtaattatttattattacttctaagattagtttccaggaatcagctttgtgtctgatgtttcaacaagtaatatttctcccatcctcccccagccccgcaagtttctgcctgtgttgaatgttaaagctgttagcatgtgaaagaatttgtgcattttacctcctggtataaaatgaagctttatgaaagtcaatcatatttttaccttttaatgattctcatctctaagaattggcttgtagacagttttaagaatggaaatatagataaatgataagcatactttgtgttttactcttttaagtttacttgattatgtgaaagtttcagaagctaggatgaaatcacttttgtcatacctagacaggcctagaaggaaagaggctcttgtctgagataactattt

SEQ ID NO: 31422 - DNA, 1065 bp, Homo sapiens
gtctttcatagaggccattcttctacataggtacttgttcgcaatgaattttgaagagttctttcgagacatggtaaacacaaatagacctcagttcttacttcgccatgtgagagaaaaaaagaccatttctagccttagaaatcatttaatatagactgataaactaataggcaaattttgtagattcctggtactaaataagtgctaacattttgaaatgaaaaggttttacctgaatctgattccgcagttgttctgcttcttgcctcaactgttccagttcgctcattttttcaatttgtttacctcaggagctaatgagtgaaaacagctgttaaaaaacagagagcaagagaaagattcagttctctacttacatcttaatctggttttacaatactgacatataacttctttttggacctactgaaattcaatggaggtagtcaattattaaaggaatttaaagatgcttagtaaatatagaatgaggttatttactgaagggttgtatacaagaacatgatcagaggatggaggagaaattccaagttgtagtattcaaggctgaattatggggaattagtaccagaatggagtctggtgagaaatattttacaacagttcagaggacaccaagagacttccccacttggatgtctggattggcacctaacacagtacctcaaaactgaaccccaccccacccccaagccttccccatctcaggaaacggcaagaccatccttacttacaattgtttaagctaaaaatgtgggagcagtcctgttttaatcatagcctccccatcgaatccatttgcaaatcatgtcagttattccttaagaaattatccaggttctaattctgatttcctccacttctactgtctgggtccacatcaccatgaccatctctcacctggtctcctttctgctgccctcgaccactctctggtctaattagagcaactagagatccatttaaaatacaagtcactttaaatcctccaatggttttccactccactaaactctatcttgacccacagaccctgtatca

SEQ ID NO: 31423 - DNA, 1209 bp, Homo sapiens
tactttcagaccgtgctgaggtacttgcagttctctgacctcgctgtgttctcttgcttcttggtcttcccacatgctcctactcttgcccatattcccttccccagattttactattgaatatctcaggaataggtttcccttttacatcaccatcttccctgggacatcctgagcttttctttttacagctttattcatcatctacttcactaaacaggataaccttcagggaaaaggcagttttggtgcaccattgtgtgtctactgtgttaaaggaattttagtgccaggtgagcagcctccctccttcctccctccctccttattaagcaccagacttagtagacacctaatagatgctcagtaaatatttgatgaatgagtgaatgtccctactcctaaacatcagtttagtatattcaggtagtataggccatctgcagcacagaactgtggaaaatgggatctgccaatatttaccaactgtggaattcacctggaatagttttcccgctcattgagttggaggagataggaactgccatatggctgccaaactgctgaaacagctctttttcaatgctatgtgagaatggttatagtccctagctcaattatcacaacctcccactgttcttaccaagtttctgtatattttgttaaataaatgcatctcagtttgttgtaagctctttgatcagtctccagagacttttagtgattgtgttaattttgaccagcttaatagtagctgttcctaggataaaggtttccctgagtgcctgatacctccattctggaattcctgcctcttactatttgtttttaagccagaaatattattttataccaatttttatccctagattcactgtaatacatttttaactataaggtacatgtttaagaaatagtttctgaaacattataagagcctgccctttacaataaacattattttagcggccttgatactttcttttccttaatgttttaaactagatttgctaatggtcgttctactgggctgattttggacagtggagccactcataccactgcaattccagtccacgatggctatgtccttcaacaaggtaaatgtatttaaccaggatacactgagatgattttagatgccatgaggatgcacataatgaaataaaatgatgagtagcactattaaagcatatcagtttctgaata

SEQ ID NO: 31424 - DNA, 1027 bp, Homo sapiens
cattcacactgttttgcagttatcaccactgtctgtcttcagaattcttttcatcttgcaaaacagaaactctgtaccctttaaacaatgactccctgttctccccttttctcagcctctgacaaccaccattcaactttttgtctctaagatttggccactctaggtactttatacaagtggaatcatgcaatatttgtcctttttgactgattcatttcacttggcataatgtcctcaaggttaatccatgttgttgtgtcaattttcttcctttgtaaggcaggataatatcccattgtgtgtatataccgcatcttgtttatccagtcatctgtcagggacactgggttgcttccaccttttggctcctgtgaatagtgctgccatgaacatggctatctcactgtctcttttagcatcatatcccatcagtcaccaaattctggtatatcctcctctctcccttgcactgctaaggctcgggccctcatcctttctcacctggactgtggcagaagcttcctaacaaccaccttactttcccttccagtctgtcacactacactcttggatatttttaaaataggggtctgatcatctcatttgcccgccttgaaatcctcaatggtgccattcagacttttctaacatggcacatcacctcagtttaccttgttgatccagctttcctgcccctctgcttactttctgtctgtcccaaaagactttccattctctaggtgctccatgctcttgcccctccatgtgcttgctcatgctcttgcgttggcctggaatgcattctctcaccctcatcctcctggaaaagccctgttcgtcctttaaagccagctcagatgttctttgtgaggactcctcccatcctcagaagctgagttagatatctgttttcctttgccttcactttgtacatctctgtcatgggtgggatacagattgtggggatgtggaatagctgaggtcttggagaattaaaaggaaaagagtagagaactgaaaacta

SEQ ID NO: 31425 - DNA, 1024 bp, Homo sapiens
atcacttgaacccaggaggtggaggttgcgttgagccaagatcgcgccattgcattccagcctgggcaacaagaacaaaattcaatgagaaaataaaataaaataaaataaaataaatttccatcagattccctaataagtaaaaaactcttgacaatgaaattagcaaagactatgattacttaagaaactatagactcttggatatagagtatttctatatttttctttagaaaaatactgtccttgaacatttttgttcttctgattgctaatttcttggttcttctactagttgcctagtgtttttttctgacagattaatatttgttactcccagcctatgtggctgtcagactcacttattcttcctcctgcttgttttccccaattataaaatgattcagataatgagataataataattagcccataatgtataataaacaacatttatgtattgccatatagcacagaaagcactttgatatatttcaccccctttaaatttcatgcaactctgtgtcgtgggaattattgctacggccatgtttatagaggagaacactggagctcagagccctatatggcagcctgccttaggccagagagctagctggtgacagagcatgacctctattacagatcccatattttccccagtaaatcttctggttcaaattcattgactgaattacattttattagaagagaatggaactttttaaaaaaatcacaatggatttaatgaataattgactattatagtgatgcagtatgtttttcttaggaggtctatctatccaaagaacatgtttatttagaaaactcttgaaaatacttacctaatctgttgattaaatgcatgtaatgtgttgtctctagttgaaggacttttctaattttatttaaatgatttcaggtaaaggcagaaaagttatccacaagcacaagctatattataattataagcttttttggatgctattttttttttttgagacagggtctctttctgtcaccc

SEQ ID NO: 31426 - DNA, 1028 bp, Homo sapiens
tctcgacctcatgatccgcccccttcggcctcccaaagtgctgggattacaggtatgagccaccacgcctggcagtatcaccctttacacacacacacacacacacacacacacacacacacacacacattttgtttgttttttgagacatggtctcactctgtcacccaggctggagtgcagtggcgccaccacggctcattgtagcctcaacctcctgggctcaagtgatcctcccacctcagccccccaagtagctgagaccacaggcatgggtcacaacatctggctaatttctgtattttttgtagagatggggttttgccatgtttcccaggtgaccatggtgctccgtcttgtgctcctgagcctaagcaatccactggcctcagcctcccaaagtgctgggattacagctgagagccactgtgcctggctaccctttttatattttaacttgctgttcacatttgggtctctcttcactctctcagttgtgttctgttgatcttatttgtctgtctctgcattggtatggcaagccttgatatcttttagtgcaagcactttttccatgtttatttatttttctttctttttttttttctgatgctgtggttgaagccatatttatttttttttccagaattttcctgggtatttctagccatttatttttctatatggattatggaattagttcatctagcttaaaaaatcctattgggattttgatgacaatcacattgaatttatagattaacctataatccacatccttgtgtaagctctatgagggcagggactttctttggttttgtccactgctgtgtccttagcacttaacagtgcctagcatatagtaggtgcttcataaatatttattaagtatttaacatatcgtacctcttttttcacatttcctttttgtcattcaataatttttgtaattttttataaaggaactcatattttgttagattttttttttagtaccctataatttttttttttaaccattactgcca

SEQ ID NO: 31427 - DNA, 1026 bp, Homo sapiens
tttagctctaatgttacttgactttttgagtatttgcatgtttgagcttgttttcctttggaactgttcctctcctgttttctttgacaccattctttcttggcttccgcttatcctttctcagtttctttcaccaacatctcttcctttgtttacctcttagttatcggcatttcctaggatgccatttggccatcctgtcttcttcctcagaaggatacttttcttcatcagggttatccatatttttgtttaaccactttctctaagctgatgacattcaaattaatatctctctggaggtgaagatctgatcatcttattctgatctggatttttctactccagcatttcataggtacttcaaggttggtgtgcccagactgaacacagtattctcttgctaaaaaatttccttcctcttcaattctggagacctagatattctttgatctgctttccctctgtgtcttactggtgatcttgttacctgggcttcccaaatagctctgaggtccaccctgtcttctccattcctgctgttcttgtctgagtgctcattatccttaaaaggactagtgctggccaggtgcggtggctcacacctataatcccaacattttgggaggctgaggtgggtggatcacctgaggtcgggagttcgagaccagcctgaccaacatggagaaaccctgtctctactaaaaatacaaaatcagctgggcatggtggcgcatgcctgtagtcccagctactcgggaggctggcgcaggagaatcgcttggacctgggaggctgaagttgcggtaagccaagatcatgccattgcactccagcctgggcaacaagagtgaaactctgtctcaaaaaaaaaaaaaaaaaaaaaaaaaaggactagtgctgttgcttcctgactaaccttccttccctcaaacttgctgccttcaatcccacccagtctgcacactgctcccagagccatctttccaaatgcacatatctatggcacactggcacttaaatctc

SEQ ID NO: 31428 - DNA, 1086 bp, Homo sapiens
taagttttggagctagtcttgaacctaagtttgtcaactctaaaaccatacttccatattatgatgttgcaaaaaaaaaccccaagaaaccaaacaaccattccagcctattgttgtgaaatcaggaaccaggtacctgacacatcgtaattaccaatccttgcctttttaagagtttctaagaaattttctttctgagaaattccttctgagaattgagtatcttgcacatttgtctattttaactgtaaagctttatgaaatggctcagtcttcatacatcagtcactgatacataagtattcataacttgatggaaaggcctgctattggtggttgaggacagatggacggccctgtcagaggagaaagttgtaaatgtcacacccttggtatttcatcatcaccttggatttctggcttttccagtgagtgctgccatagtgtgggatattattttcctcacttcttgttctttgtttttgttttctcctcagatctagatactgatgacgatttaaatagcgacgattatgaatatgaagatgaagccaaacttgttatattcccagatcactatgaaatagcactaccaaatattgaggagttaccagccctggtcagtgagtgtgcacggctgctagctagatgcgcatggctctgtgtcaggtgtgtgtgcgtgtgcgatgtgtgtgtgcgggggtggggtggggtgggaaaagccggttgaatgagagaagaggatgaaaatgagcatgaacacgcacatacctcttctcttctgtgacaggagtcttgccggcttacatttcagtagtgctgggccttttgctgtctcttacttcaagtgctgttagggctttgttgctcattagctggtctcttccaggttgggctggcttcttgcctcctaaatcacaatctgttccttagattttcaaactctgcaccccagatctacagggactgctggagagggactcttttctgatcagaaggataacagtctttttatcatgtttattatgttggccttccatgtaacattttgtttggaaaaaaatagaagtgctccactgctgaaac

SEQ ID NO: 31429 - DNA, 1090 bp, Homo sapiens
agaaaattctttaacactgtcatttataagttgtgctataaagtctgagggaaatgatcaggactgcattttttaaagttagacattcgagcagaggtctcttgaaataatccagctttggcacatgagtatttgagccacctcttctgggagataaattgtgtcagggttctttgtagaagcaaagcccattagaagggtctctgggctttggaagagagaaggaggcagagatgtggcactcatgtttggtgccttctccttccatcagtctaagctggttcttcctaggcagaatagacaaatggcatttcttcgaattaacatcgtagaagcaaaaaagacaaaatagctgctggattgtgcatctcctgtgaactagtcatttttgtaaagttcagcaattccactatgcagccatgaaaaggaatgagatcatgtcctttgcacatggatgaagctggaagccctcatcctcagcaaactaacacaggaacagaaaccaaacaccgcatattctcactcataagtgcgagttgaacattgagaacatatggacacagggaggggaacatcacacactgaggcctgttggtgggtggggggaaaggggagagaacttagaggacaggtcagtaggtgcagcaaaccgccacggcacacatatacttatgtaacagacctgcacgttctacacatgtatcctggagtttttttgttttttgtttttttttttgagaataaagaaaaaaaaattcagcggttccctggatggccctttttgctctttcttgtgtgtggggggtggtgggtcagtttatgatgttagttggaaagtgatgattatgatgatttaagatgaaacgattttcattttctatatgctcatgcagtttttgatcagtttcaaaatccttttggtgtagaaacaagggaatgggagtctgctgtttgtttccttgttagaactaggctgcagtggtttctcttgtccgcctcagggttactgactcacgtgtctgctcatgtccatgatctttttttaactctgtttatcatttattagtgataactacttttttttttcaga

SEQ ID NO: 31430 - DNA, 2047 bp, Homo sapiens
tggaaaaaagctattattacaagggtagggattaaagaagtacaggtatcaaatttttccttttaggaatatgttaattaaaaatcactgtttccatttttctgaatgtggaagtaatgctactgcatgaaacgattatctaaatggcgtctaatttgtttaaaaaggttagtgctattaacacttgatgaaatagtggctgtcatttcctgaatgcctcctctgtgccaggcacttccttgaccacttttccttcactgcttatagggaggtattctgatgaggaagtggtgacaaagctaagtggtttgctagtggtagaaccaggttagaattcaggcctgtttgattttgaaggctgtgcagtttttcctttatccccgattgagtcatcttatttcacattttgtattggaatggagacgagagtctattttctaccatgttctgcacattttagggctagcacctaactttctgttgagttttttaaaactttaaagctagaaatcaggccgtcactctgacctatcggggcttctgctatgtgcaaaatcatttctgttttcatgtttcacttaatgagcatttaatttttcttaagaaaagaactcactgattgccaatgaaattaacatgtgattaggctgtgattactcagagcctgctctggctccttcagccactttggtgtaatggtttagatgtctccgatgctgctgagattttccaggcagggagcagagaggcgttcatttgcataacgctggggttcctgaggtgctgagctccctgaggaatgccacccagaagaggatctagggggcaaaaggtacagctccccagggaagctaagccccagtggtcgactggaaagtcacatagacacttcatgccactggtgctaattctcctcccacttagcacttgttgcagttcctaattttttcagcggtgctgttgaaagttaagaggcagccactcttgagtaaactgatttacactgaaggataaatgatggagaactattagacttggaaggaagtgtttgcctttcggagcattcggcattgtaaccgagagactggtaatttggagctggctagggttgggggaagcaattcgtagaccctttacaattctgttgctatcagctgccttccgatgttattgatttacctaggtctgtcttctctttttgagaattcagaaatttctgaaagctccaaatactcctccctcccacactgttttttctcagagagggcatgaggggaaatcaagctgttggagagattgaacttgttgtatattgcgcctgatatactttggatgtttgtcccctccaaatctcatgttgatatgcaaactgcagtgttggaggtgggacctggtgggaggtgtttgggtcatgggagtggatccctcatgaataccttgtgggggaaaagcatatcccagataaatacccagatattgggtgcttatgaggcaaatgttagtaagttggcaattttatttcccccgctttgtacagagggagttagagataggcaatgacacaaattaatcaagtaaagagcattggatgagaacccagtttttctcaccagaggactgctgtgcctctggggtcttggtagttattttagggagtgttttgatgtctctgtgttctgagcactctctgtagactaactaaataatgcgtcatgccctgatgagatactgctgctttgtaaatattttagatgctataatggcttataaaattaaattcatttaaagacacttctgaatccagagttgcttttggtcattacacttgttaaagcataattttccaaaaggcaagatcatgactttcaggtaaatgtaaaatgaacacatatcacagattttaaaaaactcattaattaatgagagaatcagtcagatgttactactggtttaaaaacatttgtggaactaggatatttaaagacaatttcaaaaagaaatgttaggatgagattgccaggttaggttaaaaattagtcagtgtctg

SEQ ID NO: 31431 - DNA, 1032 bp, Homo sapiens
tttacaatcctttagctagatgtaaacgttctcgaagtccccaccagattagctagacacagagtactgatcggtgcatccatgaaccccaagctagacacagagtgctgattggtgcatatacaatcctctggctagacataaaagttctccaagtccccacccgactcaggagcccaactggctttgcctagtggatcctgtgccagggccgtgggtggagctgcccgccagttccgcgccacgcgcctgcactcctcagcccttgggcggtcgatgggactgggcactgcggagcagggggcggtgcccctcggggaggcttgggccatgcaggagcccaccacggtgggggctcaggcatggcaggctgcaggtcccaaggcctgccctgtggggaggcagctgaggcctggcgagaattcgagtgcagtgccagcaggctggcactgctggcggacctggcaccccctccacagatgctggcctgggtgcaaagcccctgactgctgagcccatgctcacccagaactcagtgctggctcgcgagcattgtgcgcagccccggttcctgcctgcgcctctccctccacctgcgcctctccctccacaccttgcaagcagagggagctggctccactctcagccagcccagagaggggctcccacagtgcagcggtgggctgaagggctcctcaagcgtggccagagcagatgtcacggtcgaggaggtgctgagagcgagcaagggctgccagcacgttgtcacctctcaccaccaggtcccacctccaacattgggggtcacatttcaacatgagatttggaggggacaaacatccaaactatatcaagtagtaaatagtgagatgaactaagttcatccccctagatcaggagccagcaacttttttctctaatgaaccagataatacatgtttcaggttttgtgggccatatacatgtctgtctcatattcttctcccctttcttctccttggcagtacaggaacaggttgtgggccagatttg

SEQ ID NO: 31432 - DNA, 1116 bp, Homo sapiens
tgataaatgctgacaattatcaagattaactgtcactttaactgtggtggtgtcagcatttatcaagattcatagcccccaaatttccgtcatgcccttttcagtcaaccattcctcaaccccagcttctagagtgttttctgtccccatagtttttcttattcagaacgttacgtatatagaatcgtacactatattgtgtagtgttttgagtccggcttccatttagcgtagaagcaatttaattttaattagtttttttccaatttagaagataatacatggtcactgaggtaattttggaactcagcaaaaactagaagttgccttgagatgagagctgttaacattttagtgtatttctttggttttttttggtggtttttcaatgtacaggtgatctgaatttcccttttttcccctcctcttaccccgtataggcagaagacacacatttggccgtaagtgtgaattgccattgatgagtttcaaagtcagttatcatgccttgaggcagtactctgtagactttgattaaagtttttgtagtagaactgaaacttcatttcacaaattaattggaaccagtgaaacgctgaagatctgaatattttacctaaaattagggtagcctttaaaaaatagtatgtacacaaatggtggcatgctaaatacattgttctgcatttaacagtggctctatagttagagatattagaaacttgatttgtgcatgttcgtagccctataaatctgcggggatgagagagaatgggaagatgttaattaagcatttgttggtgggctatgctgttatataaaataacattataggctttgtacttttgtacttctcatacctaaagtagcatcttaggttttatactactggacatttaaggtgtcttgaaaaagaaagttttaatgaggtagaatgtatattctataaaacaaccttttttaagtgtacagttgaatgacagtgtatttacagagttgtgtaaccaccgccacagtcttccttcagaacgttccattaccccacagaaacctccggctcatttgcatcattaaagtgctttttaactgatgtataaatatatattagtctttgta

SEQ ID NO: 31433 - DNA, 1143 bp, Homo sapiens
acttttgggaaggagtgagataaacagatgtgttcatttttgtcttactttgaccaggtactatacatgtgtttatatagctagtgtgccttggacattatggagtctagtgtgataaagatgttttagaaaagtatttcctatgtacaccatggttgaaagtgtgtgtaagcatttgactaacattcagtaatttgcagttctgattcatagtaatataaagtcatttaatgttaattgtaattatataagtgccaaggactgcttgcctatggttacacagtggtggaatcaggatttcagcaacagtaattctacacccaagtcctttgctctttcttgagtatgtcagatcttatggtttctttcagctgtattaatcaaaggaagatagaataagaaggctaattttaatagtaattttaaggctgaaaaatgaccgccaattgttattgagaatctgtattcattccaacataatcgtgaacagtgtactcactatagcccaattttcttttaagggaagggaaagagaagtatgtaggaaaaataagattaagttaatggcaaagatagtattcaaaatggagtcatgcattttactgaaggtgaactataatgttgataacatttataacaaaattgggttcttactttgtgccaggtactgtgctaaacattacttcatttacttctgataaatttttcattaggtggatgatactgtaattaatttcattagatcaaaactgtattcaagaatatacaagtgatagagcttgggtatgaatcctggcagccagtactccagagcttgaactctttgtcacagtagtaaatactgaactcttagtcacaatactaaataactgccttgctgaactaatacctgaggtgttccagggatgtacatttacttttgctaattcccaggtagatgacaccgggtgaaaaatgaggttcagagaggttaagtaacttaaaagatcatgtgtctcataaatagaatagatggaaatcaaactcacatctgcctaattccaaaccttgtgttcttttagtactccctattatctttgaactaatacaaccttttagagttacgaagtgctttaatatctatgcttttataatgtttttgtg

SEQ ID NO: 31434 - DNA, 1017 bp, Homo sapiens
acccaggctggagtacaatggtgccatcatggctcacttacagccttgacctcccgggctcaagggatcttccctgtctcagcttcttgagtagctgggatcataggcgtgtgctaccatgctgggctaatttttgtattttttgtagagatgaggttttgccatggtgcccaagcgagtcttgaactcctgggctcaagcagtcacccacctcagcctcccaaagtggtgtgtgctaccatgcctagtctaattcagtattttatttatataaaagatatacatggattatttactctactttttaaaaagttttaagtttgattcttttggccagtctgaagtttttagctgtctgtatttagatgtagtttttctcatcataccaagataccaagaccattgttagtcttactgcttgggaaacgctcgcacataaaggagagacgaacatattctttgttacttgtttttgtcttgcagagtggccagtttctaggacttgatatagtaaagaaagctggtaggaaactgatttgttaaagtgtcagccttaaaggtgaatgagataatactattatttaggtagagaaatcatacatgttcattccagatgttaaacttttctaatgcgcattttcttcttaaaatgtcataatacaaaatggcagatacataatagcagtactcaataaatgtatttcacatgttgaaaatgggtccttatgattgattatttagtttaatagtaaataataggaaaatttctttggaaaaatggaaatatagttaatttactgaagactggtaaaaattctctgtctttgatacttattcttaatttggctacttgaaaggcataggttgggccaggtgcagtggctcacacctgtaatcccagcactttgggaggccgaggcgggcagatcatgaggtcaggagattgagaccatcctggctaacacggtgaaaccccatctctactaaaaatacaaaaaattagccaggtgtggtagc

SEQ ID NO: 31435 - DNA, 1054 bp, Homo sapiens
ttccattttagtctttatttaaagcatagctgagaataactgatgaatgttgatgaaattgtaaagtgtttcaagatataggaaaaataagatcactagattctaccttacatttataaaagggcccagtggatacatataataattacagaataagggtgagttctgttctagtcttagagaagtaaactttcttgttttttggaatatgtcgtaaggaagaatataagtcatgagatattgatccctttgaatagttagatctgtttataaaagaaatggaaaagctaaaattgagtttaacggaccctgattggtatattggacttcctgctttttctcatagcttttttctaatcatggtatacgataaagttcattagtaggttttggtttattcatttccagttccagtattcctaccacttccaagattactctcaaatcatcctgatagaagcttcaggctttctaaaagtctttgtttttagttgtttgtgtttatctcccagatggctgttaacagccactgataggtttccctgatgatctctgcaaggacagtcaatcttggtttttattggtttttagtttcttctcagccccccttttctacctttctctatactgaaaatataatacgttaaagaagctctgctgtgtcataagaaataactctaatcccaagtgaaagcttctgtgacctattacgttaataaaactgatatttatagatataaagaatatgacttgtttttttgtggatagtttttattttgttttttttgagatggagttttgctctaggtgcctaggctggagtgcaatggtgtgatctctgctcactgcatcctccaccctctggacatgattctcctgcctcagccctccgagtagatgagattacaggcacctgccaccatgcccggctaatttttatattttagtagagacagggtttaccgtgttggtcagccttgtctcgaactcctgacctcaggttatccacccaccttggcctcccaaagtgctgggattacaggtgtgagccact

SEQ ID NO: 31436 - DNA, 1026 bp, Homo sapiens
tgttcagttaaacaattttagtacatttgatttaggttctttagcacgggatctaaatgtcatatcctcgatggaatttaaaaattacgttaatcactttctgagaacaatttttaatattaacaatgttgacagaaacaggaagacctgtgttttacattatttaaaactcctttgtaagagcatttctttaaaataatacttatgtttagtaaacctcatgaatatggaattaatttctaagaagctaaattgcccaaaaaagtagttttatttttaagtagtaaatttaagttacatatcactttctttaaattgcatttaatatgccaatttaaataaaatagcatttttcattcttaagtttattgggattgggtattaataaaaagtcatttacagcattgaaatcttttgggatgaatggatataggcatttttttttcttctcaggtatattcaagagcaaatgaccaagagccatgtgggtggtggttggctaaagttcggatgatgaaaggagaagtaagtactcttcacacttgctttgtgactagtttctaaggaagtacctcagtgcttggtttttgtaaatcttatttcaactgttagttttatttctaaaagcctacctgagaaatagttgatcagacatttccattagcattaatttctgtttgtgttctgtattggcaaacaccaaagctgctctccagaggtacacctcaagcatgtaaggaccgccaaggttcatgcttgtaagaacctataatctagtttaggcaaatcagattgatgtagctaagctgtgcttagtattttatgccacatgggggagggtccgttggttaagctgagcaaggtaattagaacttcatttaaacttcattatttttgttcagatgggatttttaaagtattttgatgtcttttagttttatgtcattgaatatgctgcttgtgacgctacttacaatgaaatagtcacatttgaacgacttcggcctgtcaatcaaaataaaactg

SEQ ID NO: 31437 - DNA, 1021 bp, Homo sapiens
aggactacaggcatgtgctgccatgctgggctaatttaaatatatatctgtatattttgtagagatggaggtttcctatgttgcccaggctggtctcaaactcttggccttaaacgatcctcctatattggcctcccaaagtgcagggattacaggcgtgagcccactgcatctggccttatctgtggttattaaagaacacacgttaaaagtgaaagtgactttattgagaagtagaaagtctgtgtagagactcactcccaaccctctagttgtttaaaattgtactcattagaaattatgaattttgataatcttaccagtaggtacttttaaaaaatgcatctctgcaaaaatagctttttaagtcatatacctgattttgagaataaataaatcagacaattttaacaatttgtattgttaacatttaacatgagaatttcaagcaggaggtatagactagtatatttaggattgggttaaagttttggctgttcagcagctgtgtaatttaaactctgacactaaatttctcagcagcttaaagattttagagatgttattttatttttggttttaatagtactgactgatttggggtttttaaaaatgatttttttttaagtactttgtgaatcacttcacctgaaatctctccccagtggaatgagcataatcttttagtagaacataatcattcagaattttctcttttctcatcttcttgttttggattatgggttgctccgagattgaaacaggatttcatttttacttttcccctcatctacagagtgctgatgctgtaaaaaaggctagaggtttcttggaatttgtggaggattttattcaggttcctaggaatctcgttggtaggtacttttactaaatgttaaataagttaataaacattatttagttacatatagcgacttaattgaaaactagtcttgtagtctgataaccttattccagttatgtgtagatttatttagatagcaatacttcttttcttttt

SEQ ID NO: 31438 - DNA, 1761 bp, Homo sapiens
aaagtaaaccaagtctggcctaatactttgatttacttgaatacctctacgtatcttaataattcctttaattttacattgtgtaaatatttatgctctggaggtgatatttcttttagtggtcaggaagtacctcttgtagtacacagacactcaagattttgttacctgagcacatactgtagggataactgggttaatgtgctttattatgctttaaagctatacctactaaggtgatgtatctatctagtctgtaagtttatagacagtttgaaggaaaatcgttgttttttgtttctggagacagattcttgctctcttgtccaggctggagggcagtggcacagtcttggctcactgcaatctctgcctcccaggctcaagctatcttcctacctcagcctcccaagtagctgggactacaggcatgtgctaccctgccagctaatttttgtatattttgtagagatgggctttctccatgctgcccaggctggtctcgaactcatgaactcaagtgatccacctgcctcagcctcccaaagtgctaggattacaggtgtgagtcaccatgacctgccagaaaatcattttaactttaaaagttgatttatatacttggaaaattaaattaattataaatcagaaaacttgatataaactgattttttaaaattatttttaaagtgtttagcacacagaagacaatttacaacagtaaattggggtgcaaatatgacaagttattgaaaatctgagtatttcaacttacatggattttagcatttttttctccttaaatcttgaagtttagtacatgtaaattgctgcgtgtttcagaagagttttcctaattatatattggggctgggtacagtggctcacgcctgtaacctctttacgaagtcaataatcccagcgctttgggaagccaaggcaggaggattgcttgaggcaaggagttgggcaacagagcaagaccctgtctctacaaaaaataaaaagtaatagctggttgtggtgacacgcatctatagtcccagctactctggaggctgagacaggagaatcacttgagcccaggagtttgatgctgcagtgagctgtgattgtaacactgcactgtagcctgggcaacagagcaagacgtcatctcaaaaaaaaaaaaaaaaaaaaaaaaaaaaggtgtgtgtgtgtgtgcctgcctgtcagtttcatgtcacttttaggctagaactttgttaaaatattaaacactgaatacttttttttttttttaaacagggtatggttccatttgtatttgttggcactaaagaaagcattggaaatgtgcaggttcttctagagtatcatattgcctatctaaaggtttgtatacggttcatactatattctgatattgttgctgcatttactacataaatgttgtacatttgctacaaatttaaaatgtcctcacattaaacattttatatttgaagtaaacttcaaatctttaaatattttttgttaattcagcttcagatttgccattgttctacatgagaatttaaaaagtcctttgtcatcataaaatgattggccttgtgtgcataatttctcttctttctgagcttttatatttctttctttcttaagaaatgattcctttgtcttcatgcaatttgactctcagatcacttatgtatctgcatgttcatactggagccattttgtttttacttttgtactttacatacaaatagggtacagaac

SEQ ID NO: 31439 - DNA, 1050 bp, Homo sapiens
ctggtagtcttttctatactctgtcagcatccattatttgtaaacagtttaattttacaaaagttaattcatctcccagggccacccatttttggaagtttctcttgctactcattgtcttagagaaagtagtggaccatatagcagtatcaggaaaagccctcgtagagtgtttctcagtgaaggtttacttagaatatactggtcagaactttagttggcagcttttctttatatgatgagggtcagatgtttctctcttcaggttttggaggcttatttaattagaattttttttgttttccctagaattttggggttatgtttttttgtttgccagacagacccagagatttctaatgcacagagagatgtcagtacttttctatacttaatattgaaaacgaagtgaagagcattcttagctacactatgtagtactttgggaacagggaaaaattgtggaattaactaagttttttaattgttggaggaactgtgctgtaaagaggagtgtttggatgactaaagatttgagggtgtaggaaacgttttacttaattacttctgtcttctaaaatttttttatgctttacattaagttgtaggagtttccagaatatccttggttaccataacgggctagggagttaattgccagggatagatacatagactatattaaggatataactttaacatatcattatggtataccacgttaagaaacccgcaccttccttaatgttatacccatgaaaacttatgtagtattttaatattatagaaagtgtgtgtagatacattaaatatagatgccaactgtgcttacaaattacaaaaactggaacaaatcagggcaaaaattaggaacttgttctttgtttgtttagattttctccctttccacagtaatactctttgagccttaagtttagtttacaggctttcagggtaatagtttttatattttagtacactttgtacagttaccaaggtgtttaaaattacagtatactgaattgcaaaataaatgtacttgacctagtg

SEQ ID NO: 31440 - DNA, 1050 bp, Homo sapiens
ttctgggccactgagaccctctttaaagagaaggaaaaaaaggtattctggaagatcttgtgcagttgcaacaatgtttcagcatatatatgtgaattcatatatgacacctgaacggaatcatgaagtaacagctgagattatatggtggcaaaaatgacctgcttttcctgaagctttgggaggcctaggattcttgctttaggcatcacctttgttaagccttaaagggggctacaacttgtgcaaaatggtgtctctggtaacacttcagaaataattggcaaaagtgtaataggaatacacaaatctttattttgaaataatcttgtattttaatgtggaattagaagcagcacatcaaactggtgagttcacagaaacttacctgagatgatgctgggttccattgctgttgtgctaagtcacgtatttttgtagctgctgttagctgtgtctagcgttttgtaacctaaggagggtcttatagaagttggtatgttaactaaatcttggactgggaaacagcaccatttgtatcctctgcaaacagatttacgcttttgaggctcaaaccaactagtgttctcatgggctgttgcctaaggacagataaacatggaaaacaggctatgtccagggacagatgattggtggttaagaattacagtaaaggaaaattacacctggattttcttctgtaaagtttcaaggaacttggatttgaactgtgaatctactgttttggcaaaaaatctcaaagaaaaggatgtttgttactgtctcagtcttcctgtctttgctacacgatttggatcccttacgctttttcgttaagaatatctgtctgctatagtgaatttgctagccccttatttttttttttaattttagttctttattagaacgtgtacttgaatggactgtagttgctcataacccatgttaatctctgatagtatttgggttttatttcaggagcttttgcaataaagcagtaactgcaatctgctaaagtcagactgttagcaagtggtgttaaaactgatt

SEQ ID NO: 31441 - DNA, 1056 bp, Homo sapiens
ctgctggggttggtgtgttttttcctttccttttttttgctgaaacagtatatggtcattgaaatcctgtatgtaacattattcctttgctacaggcagtagtcgttattttagctttatgtcattcctgatttcaaatgatggagaaatggctagaaagctatcagctacttcattgtttaccaaaagtagcaggaaaaaccatatcaaaggaagagctgtcagcatgttttctgagccttgtttttctccagagtaacaatgtggtgttaagagtgaagaataaattcttttgatggcacagccaacagccctacaaatgttagtcatgtatgtgtatcacgtatgatatttactcctcgtgtaggaacagatgtatttacaaagcttgtcctgtgtctgtctcttaggtgatgaatacagctcactgacttgttgtgtgtccatcccttttctgtccacttatagatgtactccaacacagttgctttaagtgacgagttcatcgcactgcagccattgtcgagggcaaggaatcagctgagcaaacttaggtagagtaggaggagtagagcctcattaactcttctgcatgctaaaggtcaattaaacaatatcaaaagatgggcagaggcataaataaagagcggggcatttttgttagcatggccctgtctctgaataatttgacctttattaacatatacgttaaaacctaaaaaaaaaaatccatttcttctttgagaagaaaattcagataaaaattcaacgtgatcacagaacagagatctataccttgttaatatatctttacaccttaactaccttttctagtacaattctaatgcttctgcttgtcatgttattcatatttatgaatgctcctgcatgttgagtaattaaagctacatatttggaagtgagagttgcccattttttttatcttgccttaatctgtattgtaaatacatgtgcatatttatgtttgtgtattgtaatggctgctgaagcatttcatatcctggctactatttagtgcatctataaatcgaacaa

SEQ ID NO: 31442 - DNA, 1720 bp, Homo sapiens
ggtggggtctcactcccattactatgctttttttttcttttctattatttaaaagtggtctcccaaaacatgtaatgatttcccccaaaaatgtaatgatttcctctccttactttgaatgaaatgggctctaaatgctccactcccattctcctcacccaattatactggcaactatgtctatacaggtactctggcccgagctcccagttcctgaatattgagatcaaagatgtatatatgggaaagtagtagagcttggaggtttgctagagaacagtatagcattttctatagatagctttacagaaacacagccaacattcagcattttaaaagcagctgaggctggccacggtggctcatgcttataatcctagcactttgggaggctgaggtgggcggattgtctgagctcagaagattgagaccagcctgggcaacatggtgaaacttcatctctactaaaatgcaaaaaattagctgggcgtggtggtgtgtgcctgtagtcccagctactcaggaggctgagtcatgagaattgcttgaacccaggaggcggaggttgcagtgaaccaagatcacaccactgcactccagcctccagcctgggcaacagagtgagactcggcctccagaaaaaaaaaaaaaaaaaaaaaagcagctgagttcttttttttctttagagaaaaaaggaaacatatacatacaaactatatattcacatatatatacacttagttcaaaaagtgatctgaagaagtcatttcttaaaatttttgacatttcaagatgtttaccttctctgttgggatgtccatattttaataactgtccttcagttttaaagcaaaggatggccaggctcagtagctcacacctgtaatcccggcactttgagaggctgaggtgggaggaccactggaggccaggagtttgagaccagcctgggccgtatagtaagaccctgtctctactaaaattaaaaattagcctgacatgatgacgcacacctgtagtagctacccaggaggctgaggtggaaggattgcttgagcccaggaggttgagactgcagtgagctaggatcgattgtgccactgcactccagcctggatgacagagcaagaccctgtctctaaaaataataaaaataaggtgaaaggtgatgaatgcaaagcaagatgattaccagggtcagatccagaccaaggcagtgtcttgcacatatatggatactcaagcgctggctaccttctgggtgtcatctcgatgaatttctcccagttgattgagcaccagctttgagcaaagcacatgttgttaaactaaagtgtcagacaagatccttgctcttttgagtttctggtttagttctctccaagtaaatgtggtgaaggaccagtttgttattttcttgttttgttttaatttccagtttatcttgagccagtgcttttacaaatacaataaaaatgaattataggaaaattaaatctaaaagatatataaaataagccccaatttttaaattattgaatttaacagttataaacatactttgtccaactgctgtaaaaatttctaagctcttattctcacagattagaaatgcttatttcttcatgggccagtaatagtgtttatggatcagcattgatctatggaccacactgtgagtcacaactggtctttttgcaaggggacagtaccactccct

SEQ ID NO: 31443 - DNA, 1035 bp, Homo sapiens
tgaacctgccccaggagttattgaatttacttttacatgttctcttgaaggtagctattatcatctatacttcttttcacttaaaattgcgccatattgtttttttctgaatttttttattctcctaataaaatgtttaacttagtaattaatatcatattagactataaatgcccttccaggtttctccaacatcacaggttatattattggttactattattttcttaccctttttctcatgtgaataatctagaaggtcttttcagacctgttcattcttttctaggggataaagtcatataataacaccaagctacctggtgcttttcaagggctatgtgaaaattgccatagatgcatcaatattgtatttaaacttgcaaagtcattttgatacatagagttctctttttgtttacatataattgtatttgtgaaatgtgttgggcatttccattgtgactttagagtagcatctattctatgtttctatttcatgtctaatttaagaggtggggcaagtctgagactgccattccaagatgtagaagcccttagctgtgtgttccattgacatagtaaagtcaagagtaatgggcatcacttgagaaatgccaccagtgtttttatgtgacagatttctttggtgattacatttgtaccatccaggcacaaaaatttgacttacattttattaattgatgttgtcaatgaagtatcccatattgcaagctcagtttcaaagagagcatcatggtgctatataaagaatatgccatgttgcaccctaaagagctggattttagcaataaaagattttctgttcgtgtattactaacagttaagctactgtatcctcatcaaaactatcttctaaatagaaagtaatatgtagttcaagtgtttaatgttctgtcaaaaattatatttaacatatgaatgcacatgtgtgctttgaaaaaaaatttaaaatgaaggagactttacctaataagattattctgtgtaagcaatgtggaaagaagaaaaact

SEQ ID NO: 31444 - DNA, 1477 bp, Homo sapiens
ctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctctttgtctggtttgtcccttgtgcttatgggactcctaatggcatttcagtctgttgctgaggccattatattttaatataaatgtagaaaaaagagagaaatcttagtaaagagtattttttagtattagcttgattattgactcttctatttaaatctgcttctgtaaattatgctgaaagtttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagcctgtaaagttagccatataaatgcaagggtatatcatatatacaaatcaggaatcaggtccgttcaccgaacttcaaattgatgtttactaatatttttgtgacagagtataaagaccctatagtgggtaaattagatactattagcatattattaatttaatgtctttatcattggatcttttgcatgctttaatctggttaacatatttaaatttgctttttttctctttacctgaaggctctgtgtatagtatttcatgacatcgttgtacagtttaactatatcaataaaaagtttggacagtatttaaatattgcaaatatgtttaattatacaaatcagaatagtatgggtaattaaatgaatacaaaaagaagagcctctttctgcagccgacttagacatgctcttccctttctataagctagattttagaataaagggtttcagttaataatcttattttcaggttatgtcatctaacttatagcaaactaccacaatacagtgagttctgccagtgtcccagtacaaggcatatttcaggtgtggctgtggaatgtaaaaatgctcaacttgtatcaggtaatgttagcaataaattaaatgctaagaatgattaatcgggtacatgttactgtaattaactcattgcacttcaaaacctaacttccatcctgaatttatcaagtagttcagtattgtcatttgtttttgttttattgaaaagtaatgttgtcttaagatttagaagtgattattagcttgagaactattacccagctctaagcaaataatgat

SEQ ID NO: 31445 - DNA, 1048 bp, Homo sapiens
caccctttaagccagttgaaatgctccttgccctactcctcccttctccttttctttctcccatccaagtactaaccaggcccaaccctgcttagcttctgagatcagccaggatcaggtgcattcagcggggtatggctgtagacttctctttctgagctgtgtcttcctcctttcctccccaaacccacatttgaattctgttctagctcctgctcatttgccacctctcccacaaagccttccccagtttccatcttctccctgcttccctcatctcagaggaaagctcttcattcacagagcacctggtttggggtccatagtttgttgtccctcagtatccttggggaattagtcccaggacaccacccccccgcccctgatatccatgcatgctcaagtcccttatataaaatggtacagcatttatattataacctatgcaatattcccatgtactctttttttttatttttatgtgtttagagatgggtctcactctgttgtccaggctagagtgcagaggcatgtagccttgagctcctgagtcaaatgatcctcctgcctccgcctcccaagtagttgggattacaagtatgagctaccacacctggcccatgtactttaaatcatctctagattacttataataactaatgcaatataaatgctatgtaaacaattgttacacggtattgtttagtgcataatgacaagaaaaaaatgtgcatgttcagtacagacacgaccataaatttttttttcaaatgtttttgatctgtagttggttgaatctgaggatgcggaacccatgaacgtacacgaccaactgcatatgggtttctaataacagatttgtggatgaagcccacccaacataatgcaacatttcaaatgtatcttagtcagtttttctggggcaaagccagcctaacaaatctcaagaatgtttgaaaaattctagcttgagtgaacgttgttcttctagtgactcaaataaagcagtcattgtgtctgaggagtcctagtggggtggcaggggtgg

SEQ ID NO: 31446 - DNA, 1074 bp, Homo sapiens
atgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcaaaactacagtgtcaaacattctaggttgtagttactttcagagtagatacagggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtctctggccatcaaagtgatcttgtttacagcagtgcttttgtgaaacaattatttatttgctgaaagagctcttctgaactgtgtccttttaatttttgcttagaatagaatggaacaagtttaaatttcaaggaaatatgaaggcacttcctttttttctaagaaggaagttgctagatgattccttcatcacacttacttaaagtactgagaagagtatctgtaaataaaagggttccaaccttttaaaaaagaaggaaaaaactttttggtgctccagtgtagggctatctttttaaaaaatgtcaacaaagggaaaataaactatcagcttggatggtcacttgaatagaagatggttatacacagtgttattgttaaaatttttttaccttttggttggtttgcatcttttttccatattgttaattttataccaaaatgttaaatatttgtattacttgaattttgctcttgtatggcaaaataattagtgagtttaaaaaaaatctatagtttccaataaacaactgaaaaattatcatgagatgtgtatttaaactttttcatgaacattgcttatataatcattccttctgtcttaatgtactacatggtctt

SEQ ID NO: 31447 - DNA, 1030 bp, Homo sapiens
taggaaattttatgtatatatatatgtagagagagagagatgcaaacacacatatttatgtacatatgtgtgtgtatgtacgtatatatacatgtatatttatatgtatacacacaccctccccacacacatccatacatgcatcaatccaggcacatctatatctgttttatatctatctatctacatgtatgtttaaaaaacagctgacttcatactgttaactcagttccagtgcagcatctcacggttcaatcagatttgccctttctgtaattgtaactgttttctgagagtgagaaagctggctctccttatccacaagatattcacttttttgctcaatcgtgtgcaaaaagtagattcaaaattgctaacccataccactgtgtaaaaacagaccaactagccagagttcaatattggtttacagttatgtttgtctttagtttctgtaattaaaactgtattatacaggttatgaaggcagtcatagaggttttatgactatagaggttacaaagtctctataattaagatgtggaactagtgtgtgaataatataaaaagacaagtagaatagaatagaaaatccagaaataaccccaagtgcaggtagaaagttaaagataaaggtgctatcacatatcattggagcagagttgggctttgtaatacacagagctgggccaactggttggccatttggaaaaagataaaattagatctacaccttatagcgtaacaaaaatgaagtctaaatggatcagggatctaaatgtgaaaaatgaaacaatacaagtactaaaaagaaaaaggctttctaactatgactcaaaaaaccataagcaataaaataaaaagttgataaatttgaccacataaaacaaatagcatggcaaatacatcataaagtcaaaagacaactgaaaaaaaaaactggattgggagaaaatatctgtagcacgtatcacgggtaaaggatgaagatctttcatatttaaatttgaattttaaaacttttccaaat

SEQ ID NO: 31448 - DNA, 1111 bp, Homo sapiens
tgaccataaatattaaagaagacaaaaggattctttgtgacactgagaccttctgcagtaccacagtggaggaaatgccagtgtacacaactggcctcatttaattcctgggaggagatagtttgggatgcagtgcttgttgttgctgagcaggcgatcacagcatgcactgtgtttctttctttgagaatatttgaatcctgcctgaatactcgtaacagatgagagacgcaggttttgatagcatagatttacgctgtcattagtcatgagctcttgggacgaaagtaattggttttatcctgtttagagttagaccctgtggttgggtatgaaagatgagtgtctgtaaaaatccttcttagaaatgtatttcctcaagactctgtctcaaaaaaaaaaaaaagaaatttatttcctagttctgtaaaaatcgctatattgagtgttctctatcacttaataatatacttattattaagtggacttaaagatatgcagtgtataaaatcagctaattacgttaaaccatggtatctccctttattgtgttagactgaatagaacaaactttaaaataattttttaaagaatatatttgaattcattttgtttgataatatgtttttattcagaaaagcattttattagcgctaggtgtgaacccgagccttttgctaaataccagcagcaatcatgtcctagagttaaatcccagaaaaattgccatattatatattaaaggttcaataaattacaataaagtattttttctttaaagtgatttggtccttattccttaaaaatcatactttttgccataactccatatttgcaaaggaagaagatgaaatgaaatagtactctatagtaaatattttattccagttacaaaattacatacaaatgtggctttttataaaaaggtttaatagttccaaattgggctgggtgcggtggctcataggccgggcacgatggctcatgcctgtaatcccagcactttgggtggcccaggcgggcagatcacctgaggtcaggagttcgagaccagcctgaccaacatggtaaaaccctgtctctactgaaaatacaaaatcagccaggcgtg

SEQ ID NO: 31449 - DNA, 1049 bp, Homo sapiens
ctcccgcccctgctgcgggcggctggtagcctcggtggccgccgccgccgctgctgctgcctgatcctgcaggcagttctgggcacgcagagatcggctaccgtggcctgccctccgaggaccggaaaattaacaccctttaactagtgtcgcgttatctgccgggtggttcgcaggaagtcctgcgaacacgttgttgccagttctgtaaacgtgtttagatagctaaatatagatcacagtgccacatcttagggggccccacggtcacccctgaggcagtggctgttcacaattgattttagtggattttaatgattaatcacttgctcttgtgggcagcttttcaaaaatcacgtctttgtatttgcagctacagactgggtccaccagctaagaggttggtttttattagggttgtaaaatagatttaaaatctgcttgttgttggctgagatttaaaagcagatttctactatttaaaaaagatagtttgaagatactcccctaaaaagtaaagattcttccatactcggctcggatgagttgttttccttgtttgagggattctaggtcacacacttctatgttttaattcccgtggtaattcaaaatgtttgagaagtgggttgcgactgtgtcgttttaaaattgtacattaagctgacggtaataaaatcttcaagaccaatcatttttagccatagtgtgttgaaaatggtttttctaatcgcttgagttaatagggtatttgcgttttgtcagattttcttctgcagatataggaattcactcaagacttaatacacttgttttgtttttgagacagggtctcacattctgtcacccaggctggagtggagtggtctcactccgtcacccaggccatctcagctcactgcaatctccgcctcccgagttcaatcgattctcctgccttagtttcccgagtagctgggatgacaggcgcccgccaccacgcccggctagtttttgtatgtttagtagggacggggtttcaccatgttggccaggctagtcttgaactc

SEQ ID NO: 31450 - DNA, 1119 bp, Homo sapiens
actttgggaggtcgaggcgggtggatcacaaggtcaagagatcgaggccatcctggccaacatggtgaaaccccgtctctactaaaaatacatggtggcgcacacctgtagtcccagctacatgggaggctgaggcaggagaatcgcttgaacccaggaggtgaaggttgcagtgagccgagatcatgccactgcactccagcctggcaacagagtgagactgtctcaaaaaaaaaaaaaaaaaaaagatttactatattgcaattattttctgactttctttcttttgagttactatatatctttcaagataaacctcttggttaacctttcttttcatctcctgtggtgttctttcaaggttaaatttgagaaaatggagtagcgtagaacatagtatgcagcagttctctactacaagttttaggggccatgctagtcaggatgttgttggttcctttgttttctggtattagtttttagaagcccctcattaatccatactatctttaaggatgttagtaacctcatcgtatagaatttctgcattctaaaggaaacataagcttgtttcagtacactcacgctgtagattaattctgatattacatatctccatcagactttgtaccctctctcttccatcccttacccttaccgattaggttggtattacctaaaaatccatagaaaatgtccaggtgaattgccttatgctttctaccccataaggtataattctagaccagatcggttatgagaggctctattccagtctgcacctgctaagaatttgaatctattttagtaccaatcttggagttcttgtttggctctactcttagccaaccccacagagtctaaaattggatctgaatccagtatttgccagccagtgacagacataaactaggttctttataaatgtttcatgaattgacctgcatccctgcattgattcaggatcttattgtccattgggaaggaagatttacttagctaggagtaacaattcccaaatttgccctagttgcaatatttttttaccaagggtacatacaagtcaggttcacttctgaaagtaaggaaacacaggatagcattcacttgatgatcata

SEQ ID NO: 31451 - DNA, 1045 bp, Homo sapiens
tttttgtagagacagagtctcactttgttgctcatgctggtctcaaactcctgggctcaagtgatcctcccaccttggtctcccaaagtgtgcatttacttttttagtgtagatgattgagcatcttttcctgagtttgaaagccatttgtaggttgttgatttttttctgcaatccattgaactctaatgtatccaaattctgattgcaaatagaaacaaactcaccagctcaagcataaaagggaaatttattaacaggatacaagaggccaggcacagtggctcacacctacctgtaatcccagcaatttgggaggccgagatgggtggatcacttgaggtcaggagttcgagaccagcctgaccaacatggtgaaaccccgtctctattaaaaatacaaaaattagctgggcatggtggtgcatgcctataatcccagctgctgcagagactgaggcaggagaatggcttgaacccgggaagaggcagagattgcaagatcgtgtcactgtactccagcttgagcaacagagtgagactccgtctcaaggaagaaaaggatacgagaatcagtgtcttgtaggacgtaagagcaaaaattcaataagacctcaaagaagactggaacaggctactaaaaagctatcagaaaccaagctgtgccttctctctacctcttgcctctgcttttctctgcatgtctgcatcattccctcccattagtctggcagaataatatatgtggcagaaacacataggtttggggttgacatattacaagttcagtcagtcagagagaatgaatctctccttctcttggggagacataatctctgatgtagccagacaacattttgtggatatttacctatggtcatgggagcagaatcacatagcagaaatgtgatgactgaaaatcccatcctgtgctaggttgagcagatgcccaatagcaaccgttaatagtaaggtggtggtggtgtttttttttcttttgttctttcttaacttgcagcagggtaggaaaggagcaatatgttaa

SEQ ID NO: 31452 - DNA, 1204 bp, Homo sapiens
taaaacatagtcaaaactttgtgttatgttttgaattatttaaaatgttgtataaaattaccttcaggctctgtgtgtaagatatttatgaagcgtaaatgaatttcatgtttagatttgggttccttcccaaagatatcttactatgtatatgcaaatattccaaaatccaaaacagtatgaaatctgaaacagttctggtcccaggcatcttgggtaaggaatactcaacctgaataaaatatttctaagaaaaaagtcttcattcctcttcccagtcagtccctaacaccagcacctccaactatgattctcatttctttcactatagattaatttgtctcttctagaacttaagtgggataatttagcttgtactcttgtgtttgccttctttggcttgccataatgattttgaggttcatttctgttgttgcctgcatcaagagttcattgagtataccacgatttgttcgtccattcctctggtttggacttttgagacatttttgaaatgtcattggctaatggaaaatggattgtagagtcttattcagatatttaataaaggaacactggttgtcttgtttacaaaagagaatgtattttcttttaagactgtagaaaggacagggccaggaactatgaaatcattatcagcatcttaggaatgcctgtctgtatggaagcagatagaaaatgattgtactactccccttccccacctatttttttttttttttttttttttgagacgaagtctcactctgtcacccaggctggagtgcagtggcgcaatctcggatcactgcaacctctgcctcccgggttcaagcaattctcctgccctgagtagctgggataacagtgcatgccaccatgcccagctaattttttgtatttttggtagagacggggtttcaccgtgttgatgaggccggtctcgaactcctgacctcgtgatccacccgccttggcctcccaaagtgctgagattataggcgtgagcagccagcatgcccggcgtccccctccccaactttaaaccagatgggaagtcttgagtgagagccccaagttcagtggttctgatattcaaatgatgtgaggcacatagaattattgagatgatacctcatatgatatatggcaaatctttcaagtgtctaatttatcagattttactcctttctcctcaagaatt

SEQ ID NO: 31453 - DNA, 1063 bp, Homo sapiens
tagggcataatggtcatagaaacttaacatgttttatacaatatgtgatcatttctatatgtatttatatagcaaacatttagcatttactatgtaccaggcacttatttctcattgaacagttttgaatattataaaaggttaaaaagagggtaaattccattgacccctttctctctttctattcctgtttcccagaagtaaccactgtaatagttttttgtgtatccttccaaatcctatttgcatattcaaagcagatgtatgtgactattaaaaacacaccgggagttacagtatataaactttgtataaattaaggcagcatttatagtaacttttttaatgctttgagaggtgctacaaagccagaaaattttgtaattttttaaaaaaacttagttattccatttatactttttacaattttgtggtttctgtcctattgaaagttgttcaaaatgagaatggatgttgattatgatttttttcaggatacttctagaattactggctcccataaaacagaacagcggaatgctgatctcacagatgagacttcacgactttttgtaaagaaaacaatagtagtgggcaatgtgtccaagtgagtatccagttgaatttatttttatttgtccatttgtgttaatattttggcattaatactcttacagtgttacagtaggaagcagcctcagggattctttttcccaagcccttagttgtttaaaaagtaaaccacagtctagagactttattagggtaattttgctccttagtgagcaaagtcagaatttgaatctaggtctcctatttttcttttcctttttttgagacagagtttcgctcttgttgtccagaccagaatgcaatggcatgatcttggttcaccgcaacctccccccgcccgggttcaagcgattctcctgccttagcctaccgagtagctgggattgcaggcatatgccaccacgcctggctaattttgtatttttagtagagacggggtttctccatgttggtcaggctggtcttgaactcccgacctcaggtgatccat

SEQ ID NO: 31454 - DNA, 1098 bp, Homo sapiens
acaggtgtgcgccactgcacctggccgatcttcatttttaattagggaaaaaattagtgttagtttttttttttaaagtttgcctttctgtgttagtccattctcacactattataaataactaccgaagactgggtaatctatgaagaggtttaatagactcacagttccacaggcttaccaggaaacttgtggctcctctccccttgtctcccctccctcctcttcccttccttctcccttccctttccccttccccttgtcccctccccttcccctcctttttttttttttttgagagggagtgacgctctgttgcccaggctggagtgcagtggagcaatcttggctcactgcaacctcctcctgggttcaagcgattctcctgcctcagcctcccaagtagctgtgactacaggcacgcgccaccacacccagctaatttttgtattcatagtagagacggggtttcactatgttggtcaggctgctctcgaactgctgactgctctcgaactgcctgacctcaggtgatccacccgctttggcctcccaaagtgctgggattacaggcgtgagccaccacaccaggctttctccttttctcttctcttttcttctttttctcttctctttttttaattgagacagggtcttactctgtcagccaggctggagtacagtaacatcatggctcactgcaaccttgaattgctagactccagccattctcccacctcagcctcccaagtagctaggactgtacacctgcactagcaagcccagctaatttttacattttttatagagacagtgtcttactatgttcacaggctggtctcgaattcttggcttcaagcagtcctcccacctcagcatccaaaagcactgggattacaggcatgagtcactgcgcccagccttggttcatatatatatgtgtgtgtatatatatatattttcaaaatgtatatatattttcttgagacagagtctcactctgtcgcccagtctggagtgcggtggcgtgatctccactcactgcaagctccgcctcccgggttcacgccattctcctgcttcagcctcccaagtagc

SEQ ID NO: 31455 - DNA, 1594 bp, Homo sapiens
cctggagaagggattgcccagtcagcaaaggttcagccctccaaggtttgtgttgggtagagatgggaaatttcacatgtaaatgatgttgtttgcctaaataattgacaagtgctgaaaagattcacggtgacagggttgatgatcccataagaacctgtgggtgaaagcctagttggaaaaacaagtctgttggtgtgaaactcttctactcctgtagtaatcattggcaagagccgcgttatgtattgcaaaggatcccggaatgggccaagaggcaggggaacactgctgtctctggcagtggaggcagagctgactcatgggcacagctttctacttgattcatctctaaaagggatccgctgttgacttgtttatttatggtaggagaatgctgtagtttatacctctgatgttcgggctgttacctgtttaatgattcttagctttctgtagagttcttttttttttttaataatttggaggtacaggagaattaatgtattgagagaattttaaaatagcacatagaggccgggcatggtggctcacgcctgtgatcccagcactttaggaggctgaggcgggcggattacctgaaggcaggagttcgagaccagcctgaccaacatggagaaaccccatctctactaaaaatacaatattagcggggtgtggtggcacatgcctgtaatcccagctactcgggagactgaggcaggagaattgcttgaacctgggaggcagaggttgcggtgagctgagatcgcggcactgcactccagcctgggtgacagagagagactctgtctcaaaaaaataaaaattaaaaaattaaaaaaaaaaatagcacatagagccatgttttcctgaatcaattggaaatgtagccatgcatcacctgatgatggtacattctgagacgtgtcattaggtgattttgttgtgtgaacatcgcagtgtacttaaatccagatagaatagctaactacacacttaggctgtatggtgtggcctattgctcctaggctgtaaacctgttccgcatgttactattgaatactataggaagttgtaatagaacaataagtatttgtggatctcaacatatctaaatatagaaaagatactgtaaaaatacagtgttataatcttatgggaccactgttaatatatgcagtctgtcattgactaaaacatcgttaatgtggtagatgactatggtatcaatattgagtgcttttgtgtatgccatgcttgtatttctacattttctataatccacacacaaccctggagggtggggattttcatccctgttttacaaatgaggaaactgtggctcagaggttaaacagtttccttgggagcattacagctaataaatgacaaagtgtttaaagtcaggcctgctaactccaagctccccatttcagaactaatgaaaagtggttgtctctaaccttggtatgctttcagagcatcagggttaaattacctcaacttttggcaggtatactctaaagctattaagtatataatatgggctcggcatggtggctcacacctgtgagccacctaacactttggc

SEQ ID NO: 31456 - DNA, 1044 bp, Homo sapiens
ttttttagacagagtctcactctgtcacccaggctggagtgcagtggcatgatcttggctcactgcaacctccacatcctaggttcaggggattctcctacctcagcctccagagtagctgggactacaggtgtgtgccaccatgcccagctaatttttgtatttttagtagagattggatttcaccatgttggccaggctggtctcgaactcctgaccacaaatgctcctcctgccttggcctcccaaagtgctgggattacaggcatgagccaccacgcccggccaaacttttttctttatacttctgaatttcccaaattttctattaaagtaaattataaaaagtagctgaggcaagacaacaattgttaagcttctattattgtaatacccaagtgtaagaaatacagttgccgttcacacctgtgtaggtagctttcctagatgactgaattaggctgcatgtattatgtgcaggcctttgttttgctctctgccaaaacggtgactgctgttctaagagctctcgaagcaccgttggactctgctctgttttgaacaggttgtcggggtaccagttgggtctgctttaccttcaacagtgaagcaggctgtggcgatcagtggtggccagatcctggtagccaaggccagctcttctgtctccaaagcagttgggccaaagcaagttgtaacccaaggagttgccaaagcaattgtgagtggaggtggaggaaccattgttgctcagccagtgcagaccttaaccaaggcccaggttactgccgctggtcctcagaagagtggatcccagggttcaggtaaaacggatcatcactgggagccctttcagcagaagctctgtccaaaatttcctttgctagtgattttatttgctatttgatctggtctaggaaagcctagttaggttgatgctgtaagaagtgtattgaaatgtttgttcttttttatgggacattttacataaaggtctgtgagtatttagctttaaatttacacacacacacacacacacccaca

SEQ ID NO: 31457 - DNA, 1026 bp, Homo sapiens
tgcatttatttatttatgccttttctggtttttttggatttggcgctgagaggagtattgctgtccacaatgaagataaaatggcacaaatgtttatgcagtgaactctggcagcaaaatacataaagtgcaaagactattaggaatatgaggagaatttgataaaactgcagtcacagagaagaattttaacatgtctctcagcatttagctaatcaagtggataaatcttttttattataaaggatttgtattggaataacagtactaacaggcttaattctgtatcattgagacacagaatacacattttgcttgtatatctgtggaacattaacaaattgattatatacttggccacaaagagaatctcttagcatatttcaaaagtagcatccaatgtgcttcattctgttactcaataaaaaagtcaaatcaataacaaccaaaaaacttgacaattaaaatactcttctaaattcttgggttaaaaaaatccaaataaattacggatgatttagctgttaatacaaatgacaattttattagggttctccagagaaacagaacaaatataatatatatagatattaagaggaaatttattatgagaattggctcctgtgattatggagaccaaggagtcccacgacatgctgttagcaggctggagatcaggaaagctagtggtgtgattcagtctgactacaaaggcctgcgaactggtgggcatgggagtgaggggcacactggcattaagtcctggagtctgaaggcctgagaaccaggagctctgatgtctaagggtaggagaagattgatgtctcagcttaagaagagagagagaattcgcccattgtccgcctttttgttctattcaggtccttgacagattggatgatgtctgcccacgttggcgagggcggatcttctttactctgtctgctaatccaaatgctggtctcttgcagaaatattttaccaggtatctgggcatccctcagcccactcaagttgacataaaat

SEQ ID NO: 31458 - DNA, 1047 bp, Homo sapiens
ctcggcttcccaaagtgctgggatttcaggcgtgagccaccgcacccagccagagtgattctatttttgttccatgattccactttcctgttgatggacatttggattatttccaggtttttttgtttgtttttgctgtcatggataaaactgccataaatattcttacacagatatttttctgcagaacagcctgatcatagggtacatatatgtttataagaaactgagaaatggtttagtaaaatggttgtactgtttgactatcccagagtaatatgaggaagtctgatttgctctacatcctcaccaacacggaggattgtcattctttttaattttagccattgttgtgagtgcaaagtcatatctcattgtggtctttatttgcataaagctccaatgcaaattatgccatggctattacttgtggaatctagtcataactttttcagatagtgctagctgtgtgaccctggtaaattaatctcttcatctctaagacaggactaaaacctactctatacagttagtgaaaataatgacttacgatgacataagatatgtacaagtgctttctgttcttcctggcacatagtaagatctcagaaactaataaatggtgtctgcttgtggagtgcattaatttgggacactgagcagtcacttagagcagatttcagcaaactacagccaaggcttcctgtttgcgttgttgctgctgttttttataatttaaacttttattttagattcagggggtacatgtgcaggtttgttacatgggtatattgcatgatgctgaggctagggtcatgattgatcttgtcacccagggagtgagcatcatacccaatagttagttttttaacccttccctccctgccccatgtcatagtcctcagtgtctattgtggccatctttgtgtccatttacccaacgattagctcccacttgtaagtgagaacatgtagcctttggttttctgtcctgcattcattcacttaggataatggcctccagctgcatctgtgttgcttcaaaag

SEQ ID NO: 31459 - DNA, 1028 bp, Homo sapiens
gttctccagtactaaaatgctaagcctatatctaatttagaagaccattaaccttacccatttaaatctggccctgtctagggttgattctcatgtttaaagattatacgtacatttaagagcatgttgtaatcaagtattttgaaaacaagtgacctgttacctttaaagatactgctgccaaatagtaacttgcaaatgcatttatttacttgttctatattggggtaaagggatatttataggtgaaaggtcataaaatttggagcttgttagaaaggtgtgtaaacacctcatgtaggttggattggtaagactttcttggttattctccaagtcatggggcgtatctcagctgtcagtaaggaatgagttatgtctattatccaaggcaacatgattatttctgcccatcttgtttctgcaggcagcccatggaggacaggcatctctaatgaaaatatccgatagcaccttgaagactgtgccagccacctcacagctctcgaagcctggaaccacaatgctgagagtagcaggaggggttatcacaactgccacttcccctgccgtggccctctcagcaaacggtcctgcacaacaggtgagaaatagcatgtcagtagagaatcctaatgagacatgaaagtggtgtagatacaaggaaggtgtccagcaggcacaccagtggaccttttaaaaatactcaactattgcttttttttttaaagaaatattcacataccataaaagtccccattttgtagtatatagttcagtagtgcttgtcattcacatggttgtgcaactgtgattaccatcatctaatcccagagcattttatcatcccagaaagaagcccaatacccatcagcagtcactcccattccatccttctgttctaggcgaccgctgacctactttctttggatttgcctattttagacatttcatataaagggagtcatataacatgcccttttgggtctgcttctgatgcttagcattacagtgcagagttcatccac

SEQ ID NO: 31460 - DNA, 1048 bp, Homo sapiens
cacaaaattcaagcctttgttttcttctaagttttatacatttagctcttatatttaggtttcagattcattcgagttaattttttttttttttttttttttttttttgagacagagtctcgctctgtcacccaagctggagtgcagtggcgcgatctcggctcactgcaacctccacctcctggattcaagtgattctcctgcctcagcctcctgagtagctgagattacaggcacccaccaccacgcccagctaatttttttttttttgtattagtagagatggggtttcaccatgttagccaggagggtcttgctctcctgacctcgtgatccacccgctttggcctcccaaagtgctgggattataggcatgagccactgcacctggccgctctagttaatttttgtacgtggtgtgaggtagacaccaaactttattcttttttatgtaaatatccagttggcctagaaacatttgttgaaaaaccatctctcaatcgtcttggaagcccacagacttgaatgatgtggcttgacttctcaagcttcatctcctgcagctgctgcttccccgtgcctcttcacaggtgacaccactctgctttgcagcttcttgaacatacaatgttctttcatgcctcaccaactttctacatactctcctctgccaggaaacactgtcatctctccctttctctgtcttaaatctggaagattcctctaaagtgcctaatgttttacctgaagctttttcctgtaccctcctgtttctattcctaggcagaagcagtgcctttcttcttggttgtgttggtgacatttgcctgtgcttgccgtagcatcattatacttaggtgactgtttccttggtcgcttttctctcagagccttagcacttaaccattatgccggccatgtagtagatgtttgttcaatgaagtgacagactgtagatgtttgttcaatgaagtgaatcattgtcatgtgttcttaataaagctcatttttagtccatgtgtatattctgagaatatgtcctcctagt

SEQ ID NO: 31461 - DNA, 1034 bp, Homo sapiens
atgtaagagctggaaggtagttcagaaaccatcttcccagctttctcagtttatagatgagaaaaccgagctgggcttggtggctcacgcctgtaatcccagcactttgggaggttgaggcaggcagatcacctgaggtcaggactttgagacctgcctggtcaacatggtgaaaccccatctctactaaaaatacaaaaattagccaggcatggtggtgcctgcctgtagtcccagctcctcgggaggctgaggcaggagaatcgcttgaacctgggaggcagaggttgcagtgagctgagatcacatcaccgcactccagcctgggtgacaaagtgagacaccatctaccacaaccaccttgtgagttaatggcgggtccagggctcctagtggagcaccagttccacagactttaatagtctatggcagtgattaccttctctaccaaagaagcaaagtgcccaggaaggtgtgttgctttgagtacacacggcaagacaccttctcttctgaggagacgccctcctgtgttaggctgcatctgagcttgcccagtaaggaacatacatgcgataaagaggtctgaagaagtgactggcttgcctccagcaaatgacgtgtggttggaatcgtaagagctttattcaggctttgctgggtgtgtgcattctaggtgaagatgccagctgcttttctgcaaagtctgtggagcagtactatggctggaacattggaaaaaggagagccgctgaggtaacccacatctgcctgtccactctggctgcctccagaaaccttgtcttatggaacagggataagattgcagcatatttggttgaaatatttgatggcagaatattttcctcagttaaaaaaaatctcatttttcaaagacctgtatccagctgactttcaggcgtgccttcttttcctgcactggcagaaacatccctcacagtttctaaatttttttctgagtttcagagttttaaatgaactcgagtattgagtccttacagtgggaaggtgct

SEQ ID NO: 31462 - DNA, 1105 bp, Homo sapiens
gggctggagttaccagtagctccagcagttaccctgaagagagattgggcttcagccttcagcaggtggttctctcccatgcctggccttggtgtggaggggctgtactctgagcccaagtgagtcagctataggaagaggccatacctagagccaagaaccatgaaggcctgagagacggcagactgagcagaattccttttttgagcacgagagcattactagaaccattgtcaaagcagtggcaagggacggagaggtcccaacaggagtcaggaagaggtttgattataaccaagaaaactcactatgctaggaatagactgtgtgcaccagtcccagacacttggcagaagtgtagcagcgttacacatgtgtgcgaagcagatcgcaggttccacgccatctgcatggcctgcaggagcttctgctgctgaccccatgctgagtggccagtggggagcggcgcccggcaggctcttctggggtcgtctgtcctatccgtggattgtatatactcttctctgttaaggagtttttcccaagaagaaaagtatttaaaagaaataccagtgagtgccttaaagttggagaagtaactgcccatgcccagaaataaggatgccagtgcccagaagcagtgagattagtctgtgtccacaagcagaggccccctcgatgggagggagtggcaggcaggagaaggtggcgctgccaggtgcccgggtctattggaggcgccccatctcagacttcctaacacagcctgtgtggaaggcagaacaaagaatgcatgcccagtcagaaatctgttctattctgctccaggaaaatcggaaacctgtgagtcagagtcagagaaacttacccaagcaacgtaattcctgttttcatgggtcctgtagatgtttgagtcaggaaggtaaggcggggagtgactgaataaactctgccttttaaattgagcatctgggccgggcatggtggctcacgcctgtaatcccagcactctgggaggtcgaggtgggtgggtcacctgaggttgggagttcgagaccagcccgaccaacatggtgaaaccccgtctctactaaaaatacagaaa

SEQ ID NO: 31463 - DNA, 1061 bp, Homo sapiens
agcccagaggtcgagggtgcagtgagtcatgatcatactactgcactccagcctgggtgatggaatgagaccgtgtctcaaaagaaaaaaaagacttggtttctaaaatgtaccagaagaggtggaattatttggttctgcttgtaggcgtggatatgattctaataaggttttttgagttcagagggtccccagaaatcctgaaggttctcgggttcttaagctctgtgtgtagtctataattgttgtaaacttggtgaagtatcttctcaggcctgggcttagggggtgagtgggtgtttctggtgacttgcgggatggggaatgagagctaggtgggagctgtgctggtgtcagtcagccctgtcctctatgaagggctctgctctgcggttggaaccctgagttacccagaggtcttcccatcctgagccaggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtgagacctgatctatactgtgcacaggccctgaattgcatggcagtcacactgagccagaaggggcattatttccacccataatcctgtctaaaaaagttgctctcattatcaggatgcacttttcctccacaccctaatggttctgtgttttttttccccttaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggtgtgagactcaacaggtgtggggcatctgtgtgtctcgctgcctcatagaagaaccagtgtttcctcctggagggattggtgcttccgccgggccctctctatagatcattgccttttccaggttacaatccagcagaagtaggagctgctggcaagggctacctctgga

SEQ ID NO: 31464 - DNA, 1170 bp, Homo sapiens
aggatcacttgtgcccagttcgaggctgcagtgagctatgatcacaccactgcactccagccaggaagacagagcaagaccttgcctccaaaaaaaaaaaaaaaaggctgggtgtgatgtgactcacacctgtaatcccagcactttgggaggccaaggttggcagaggataacttaagcccaggagtttgataccagactggccaatgtggtgaaaccctgtgtctattaaaaatacaaaattaggcctttcctttcagtggagcgtggcggcaagatggctgtgcaaatttccaagaagaggatgtttgtcactgatgacatcttcaaagctgaactgaatgagtttcttactcaggagctggctgaagatggctactctggagttgagatgcaagttacaccaaccaggacagaaatcattatcttagccaccagaacacagaatattcctggtgagaagggctgacggattcgggaactgactgctatagttcagaagaggtttggctttccagagggcagtgtagagctttatgctgaaaaggttgccactagaggtctgtgtgccattgcccaggcagagtctctgcgttacaaactcctaggagggcttgctgtgtggagggcctgctatggtgtgctgcggttcatcatggagagtggggccaaaggctgcaaggtcatggcgtctgggaaactccgaggacagagggctaaatccatgaagtttgtggatggcctgacgatccacagtggagaccctattaactactacgttggcactgctgtgtgccacgtgttgctcagacagggtgtgctgggcatcaaggtgaagatcatgctgccctgggacccaactggtaagactggccctaagaagcccctgcctgaccacgtgagcatcgtggaacccaaagatgagatactgcccaccacccccatctcagaacagaagggtgggaagccagagccatctgccatgccccagccagtccctacagcataacagggtctccttagcagctgtattctggagtctggatgttgctctgtaaagacctttaataaaatctcatacaaagacaaaaaaatatatacaaaattagggctgggcatggtggctcacacctgtaatcccagcactttgggaggctgaggcgggcagat

SEQ ID NO: 31465 - DNA, 1082 bp, Homo sapiens
gggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaac

SEQ ID NO: 31466 - DNA, 1112 bp, Homo sapiens
ggtgggctctcaatgtttctggccaggcctgtctttttgtctcttaactttttgtcctgtctgcttccctcagttattctaggcaaatcacactatgtattgtatgggctggtggctgccatgcagccccgaatgctggttacgtttgatgaggagctgcggccattgccagtgtctgtccgtgtgggccaggtgagaggctgagtagaggggagggctcaggctgtattctcaaactggagaatgtacatatacttgctttgctgaaactggcgtgggcggtggcttgtcgctacttttccatctctcttttcaattttcttaccctacaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaaggtctctctgtgtctgttttctggggtgtcatggctggagtctaaactagagtaaggagtggaagtgagagggcattgttaggagcaacgctgagtttaggttagcagcactgccctggatggaaagaactgagccccttccctcccctgggtggaaaaaactaagcccctcctttctaatcatcttctctttgcattttcttagaacccttgagaagccaataaatgtaatggatcttctttttgttttgttttgttttgtttgagacagagtcttgctgtctcccccaggctggagtgcagtgaggcagtctcggctcactgcaacgcctgccttccgggttcacgccattctcctgcctcagcctcccaagtagctgggactacaggtgcctgccaccacgcccggctaatttttgttttttgtttttgttttt

SEQ ID NO: 31467 - DNA, 2477 bp, Homo sapiens
ttttagtaaagacggggtttcaccatgttggccaggatggtctcgatctcttgacctcgtgatccgcccacctcggcctcccaaagtactgggattaaggtgtgagccaccgcgccccgcttattttttttttttttttgccgagactttgatttcagtttctcagccctcaaccagcacttcgccttgtacttagcatgcactcaataaatggttgcttaaaatatgaatgaactaaagaatcgcggaacagagagaaacacagaggggaatcggtctgggagtttcaaagttcgggaggggacacgggggcgggctgtggctgtcacgtgacggggcgggggcaaatcccatgtgctcggcggcgcagatcgcccggcgcggctccgccccctgcgccggtcacgtgggggcgccggctgcgcctgcggagaagcggtggccgccgagcgggatctgtgcggggagccggaaatggttgtggactacgtctgtgcggctgcgtggggctcggccgcgcggactgaaggagactgaaggtaaagccgccatgtccgggcccgacccggcccccccaccccctccccccgcatccgccgccatccgggccgggaccggccaccctgcgccgccgccccggcgccctggccccgcggcccgacccagggccccggcccgccagggtcccgatccccggcccacgtgtgcctggcccggccgggcctggctgctgggtgggggtggggagcgcagggccggactatgcgggccccgcgggctggtagggcgccgggttcgtcgccgcgaaatgccacctcggcctgacccgaggaggcccggcagcccacgggcgcaggcaccacggctcccggcccgccgccccctccccccttcgcggccaggccgccgggaagtgacacgttgttctttggcactggcccgcgctgcgcagggagggcgcaggggagggaggcggtggcggcgggcagggaggagcccccggccccgcccgccctccgggccgaccctcacttgcctgaaaccggctcctcgacggccgccgcccgcctggccttttagggcctgactcccgcccttcctggcctacactcctgggcggcggcaggcctagcttctggcccagtgcgggttccccggcggcaggcgtatcctgtgtgcccctgggccaggcccgaacccggtgtccccgggtggggggtggggacgccacggccgaagcagctagctccgttcgtgatccgggagcctggtgccagcgagacctggaatttccggtctggttggtctggggccccgcggagccaggttgataccctcacctcccaaccccaggccctcggatgcccagaacctgtaggccgcaccgtggacttgttcttaatcgagggggtgagtgaggggtctgtttcagtaggtcaggggttggttggaagtgatgcgggtttgacagcatgttggtggggacaggctgtatcttttctgcttcaccctcttggcatctctgggactccgtatgggacccagcccttgcatcaaccctttcaccgccccatttgccttaagcttgggtcccttcctcttcctgagcgccactctttcccaacaggtgctggggggaccctgatgtggcaccaaatgaaatgaacaaagctccacagtccacaggccccccacccgccccatcccccggactcccacaggtaattagggaggaattagcaggggtgggggtgggggagaccaggcagtctccagcctctggatcttcctacccccatctgtgtcagggcaaagtgcagccgcctgctgccaaattgagacagggcccctgggctgtccccgggggctgtcacggggagggggtatgtggattgttaaggctcttgccgcagatctgctccccttatttcaccagcttgggtttctgccccacctgggcttcccctcttgctgaactctggtctcccctcttcagccagcgtttcccccggggcagacagcgccggtggtgttcagtacgccacaagcgacacaaatgaacacgccttctcagccccgccaggtgaggggctgtggggaggggagtaggggacctgggtgggagcagtggaaagctttggccagtttaggtctaggatggaaactggaggccccatacctggccttaatcctctgtgttctttcatgcggctctgcgccttgccctgttgattactcacggtggctggtcccttggatagtatgttgtcaatgagggtggcattactgggatcctagtgcctctgagaattgggggcagtgctttgggccctgctgccagctcttgctttcctatttgctccttttaccggaggctgctattgctctattgctctctctgctttctctttggactgtggtgaggtaaacactccagctggtccttgcctttctctgttccccagcttcttccttac

SEQ ID NO: 31468 - DNA, 1088 bp, Homo sapiens
ctcacgcctgtagtcccagcactttgggaggccaagacaggcggatcacttgaggtcaggtgttcgagaccagcctggccaacatagtgaagctccgtctctactaaattttattgttattattttaattttctttttgagacggagtctcgctctgtcacccaggctggaatgtagtcgcacagtcttggctctctgcagcctccgcctcttgggttcaagtgattctcctgcctcagcctcccgagtagctgggattacaggcgtgtgccaccacacccagctaatttttgtgtttttagtagagatggtgtttcatcatgttgaccaggctggtctcgaactcctggcctcaagtgatccacctgcctcagcctcccaaagtgctgagattataggcgtgagccaccacgcctggccctgtctcaactaaaaatacaaaaattaggcctggtgatgcactcttgtaatcccagctattcgggaggctgaggcaggaggatcgcttgaacccgggatgtggagattgcagtgaaccaagattgtgccactgtattccagcctgggcaatagagtgagactccatctcaaaaaaaaaaaaaaattaaggggaaaaaagaactcacccactttggagatagtttgctttaaggaattaatttttcttcatcttgagcctagttcataatgttactttgtttctttgcccctttgtaaagggctggagacaggaactagactcaagttaaatggaacagggttggcagatctctttctctcattaccagccaaagacctggttctgtttcaggttcagagtatgtgtgtacatgttgatagcgggtggggtacacacacgagagtaacttgtacggtggaaggacagacataagtcctcctggtcactggtgtgtggtaggaaagagtgcctgcctacgaggggtgtgtgtgtgtgtgtgtgtgtgtgtgtgtgtgtgtgtgtttgtgtgtgtgtgtgtgttaggaattcttgtaaacgcagttcagactggttccccagctttgacagacacctaattccctgggggaggagggcagggcagggcaag

SEQ ID NO: 31469 - DNA, 1980 bp, Homo sapiens
gccccaggttgctgtcattgtccggccaggtaagtaagccggtgggacggagcttttatggggaaagggaatgttaacagttaaatgctgaggtggtggagtgacttgaactgggtaccagagaatgatgacttagatttcaggttgtgggattttgagggtgaattgggttttggatgaaagtggaagtatagcttaggtggggagaagatgatgcggggttattaagttgggaatgcctgggctggaggatggggaggaacaacagcagttaagcacttgcctttagttgctcattcttccttcctatggtgcagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaaggtaaggtgtggttggacggtagaggtagggcgggctaggggatatcgttccttgccctccttgatgaccgcccatttttgacatgtttctgggtccctgcaatggaatctaagaactagattaaggacttttaagcctaaaaagggtgatgcaaaggggaaatactgttctttggctgctttctatttcccagggattaagggtactccttaaattattggcaaagatccatgcttttatttatttatttttaattagtggcagtatctgtgccaaagaggagacggaaaattaaggagctaaataagaaggaggctgttggagaccttctggatgccttcaaggaggtaagggagcagaaaatgggaggggagagggccaagttgaggtatggagcagtggtcattctgcaaccaaaactggatgttctgttgttctaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcaggtatgctgaagaaagggttgagaatggcttgagttttcttattagggccagaggaggcagtatgattgcttcattctgttttccttgcagatcagtggaagcctctaaacctagaggagaaaaaacgttacgaccgtgagttcctgcttggttttcagttcatctttgccagtatgcagaagccagagggattgccacatatcagtgacgtggt

SEQ ID NO: 31470 - DNA, 1044 bp, Homo sapiens
atggattggggaggagcctgaggtcctgaaagagtagtcaaccgctctagcctgcttctgagaccttttcctgtcctctttgcaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggtgagtggggctgggtaaagtggcaggtgggcaaggagtgggagtggatgattccgtgtctcagtgcccgcggggaggggtttgccctggaggcgtgtagtagtggtgtcacatattgtgctgactagttccatgtcccctcttgtcttcatcccttgcttagcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggtactggcaagtcctgcttttggtctctctccatttcttctccaggtctgccatctgtgccctctttgcttctttttgtccttatcactagcatctgtcatgcctaagtccccaccaccctctcctgtccctcccaacagcctgttctgagaccctcactggaactcttgtctcttctccctccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcggttagtttccagtgggttctaaatctaatggtctggttgcccattcctattcccaagactcctt

SEQ ID NO: 31471 - DNA, 1893 bp, Homo sapiens
acttacctccttcccttacccagatgctactcagctgtagaatttggaatggaggtagtggtgtcttggggatttctctggctcaggacgttttttttcctttttgagacagtcttgctctgtcacccaggctggagtgcagtggtgtgatcttggctagcctccacctcctgagttcaagcgattctcctgcctcagcctcccaagtagctgggattacaggcatgtgccaccatacctggctaatttttttgtatttttaatagagacggggttttaccatgttggccaagctggtctcaaactcctcctgacctcaagtgatccgcctgcctcagcctcccaaattgatgggattacaggcatgagccactatgcccagccagccggcctcaggactgagtgcttattgctaggtttggatatccaggtagaaaagggttttagccgagtggctggttatctttttgacacaatccctgtcctgtgaatggcaggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaaggtagaggtccttgcatctggagggggatgggctgaagcatatgtggggctcactgagcccacaatgatggggcggaaggcctgaggaggggtggggcctgcagttataggtgggacatgagaagttcctggtctgatgcctttctccttcctagccccgaatggatcagtatttcaaccagatggaaaaaatcattaaagaaaagaagacgtcatcccgcatccgctttatgctgcaggacgtgctggatctgcgaggggtgtgtgtccccctcctccccactgccagcctgctgcctccagtttctgacactgccttgtcttgccttccctgacatcatcgtgactggccctctgtctccacagagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagtgagttccaagctgggattgagaagggagcagtgaagggaccgggaggttatactttcctctgatgacttcctgttagtgccacgtgtctgggccactgagacaccatgatggaactgaggatctgaggaagggaggctgggggtggcccaaggggaaggggctgctaggatttattcattattccagtatgcccctctttttgtgtcaggccgtggacttccccttgtggatgatggtggctggaacacagttcccatcagcaaaggtagccgccccattgacacctcacgactcaccaagatcaccaaggtaggggtgtgtgtgggagtgggtgattcagctcaggtttagatcttagtcccttcacttttctaaagttgagaaggtgacagctgaatgtttcctcttagactaactggttggattgctggagacaggactgccagctgtagagggagggtggtactcccattagtctggaccagtgtttggcaaacacacacacacacacacacacacacacacacgtgccagatccagcccattcatacatcccaggacccagtagtggtttttacattttaaagttgcgaaaaatcaaaaagtgaatggtaatttatgctgtggaaat

SEQ ID NO: 31472 - DNA, 1091 bp, Homo sapiens
aacctggaggaatcacacttgggatttaaaggaattgttatgtcaacatcatttaattcttttaaatagacgtgtaccaggacaagttgttttttaacaacaaataagcatattgaactatttgtgtatttcatcaactccaaggtgccatagattataagacattctttatgcgctgttaagaaagaaaagactgggccgggcgtggtaatcccagcactttgggaggcagaggtgggtggatcacgtgaggtcaggagttggaaaccagcctggccaacatgatgaaaccctgtatctactaaaaatacaaaaaaattagctggacatggtggtgcgcacctgtagtcccagctacttgggaggctgaggcaggagaattgcttgaacccaggagggggaggttgcagtaagccaagattgtgccactgcactccagcctgggcgacagagcaagactctgtctcaaaataaaaaaagatatatatcggctgtaagacaacttttagttaaaatgtgaaaaaatgggcatgttttaaaatctgtgaactgcaataatcttgctaagagccagtgccattagtctgttataaagaaaagagtgatgtcttcatagtctattgccccttacagaaaatgcactcagactgctggttttatgaggattttttatttgtgttagggatggggtatatttgtgtcttaagattttctgggtttaggaaacaagcatacttgttagaagttgtcccttcctagaggcccttacatcatttttcctaccctagtgtcatagcactttggtggacaagttctcttttattttattttattattattatttttttgagacagagtctcgctgtgtcgcccaggctggagtgcagtggcgtgatctcagctcattgcaaccctcgccttgggttcaagcgattctcctgcctcagcctcccgagtagctgggattacaggcacccaccaccacgcctggctaatttttgtattttctgtagagacggggtttcaccatgttggtcaggctggtctccgactcctgacctcaggtgatccgcccacctcgacctttcaga

SEQ ID NO: 31473 - DNA, 1039 bp, Homo sapiens
aggggttataggacacgttgcttgggaaggctacccagcagctaggggttgaggagaaagagggcccgaacaggtgatgcttgagttgagtcctgaaggaacaagacacgaggaagtttccggcaaaggatatagcatccacaaaagtgtcaaggccagagaaggtgtgtatgtacaggaaatgtgtggggaaggaagggaaattgagatcaggagttgtcaggatctgtttggggggcagtgaatgttcaggttacatgtaggatatatataggactttatgtatgatatatataggacttttagcgatttcctgaattcaggagtaccaattctgaatatagttttctccattaaatacatcatgggcagagaggtttcaggctgccaaggtgaggccaagcaagtttgtaaggtttttctgatggccaagtgactcattgctgtgcagcagtctcagatcatgagattagcatcctgtcagaggcctagtcactctggaatggccacaaatgtcaggctggtgcatcagggccttgtttgaacagtggaacttgggagggttccctggggtgggctggggtggcggtggccagtcacctctaactgctgtcccgcctgcttgcagacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatatta

SEQ ID NO: 31474 - DNA, 1047 bp, Homo sapiens
taagaggcggaggccgggtacgggttggggagtcgggctgcggccgccggtgcgcgggccgcgggtgggtgggggccttgaggagggggccggtgtcgggagagggaggagcctgcaccgggaggcgggccaggcaacaggagggagcgggaatgagcagggaaggggccagaccgactccggttcgctcccacggcctgcctgccttggggttttgcagggcagacgcatggtctcgccgctggctgccgtgtgcccactgctcagggtggccggagacgcacagccccgggaggggctgggcagcccgatgcccccaccactccagccctcggcgactggccttgcgcgcccacacacacactcccctccgcctacacctctgccttcacagtcctgggagtggccctgtgctgggaacctgcttctcccagccgtgtccccatcttcttaaagaggtagcctttcggtcctggctaagcaccctaccacagaatttttgtcggacattgactcccctcttcagtcagtcggcgaagggggactgaggtcccgtttggggcacctgtgaacactgaatcacctctcacctattacagttgttttaatgtcctgcccccactcagcaaaaacaaatcactctactctgtggagggaaagaggaacccagaggcaggccatcagggcttccttcccacagtgctgacccctgcctgggcctcggtttccgtgggtggccatgcacaccgggcctggccgtagtcctgtgcatcagaggtcggccagcttcctttactccggtgtggtggatttctccacgcataaggcaaggcaggactgggtttgggatgggtcctggaccttcagggcaggtggtcagtcacacaggccttggtgtggttggtacttgatgttctttggagctaagactggctgagatttgtacttcccttgaggaattctgggatttgtagtcctaagttaacctcgtggcttttgaagctgaggagcagctgactgctctgatctctctggccctatcaaggc

SEQ ID NO: 31475 - DNA, 1048 bp, Homo sapiens
gaacgccagggcctcggcggctgctgaagggattctatggctcagaggtaaggatgtgatggtaggcggcagcttggaacatttctgttttttagcttgaagggctgtgtgggcctgtgttggggaaagcagagagcaggcagcctggtatagaagagctggcataaataaaataaattaaacagtgatttgtaggctgggtgcagtggctcaagcctgtaatcccagcactttgggaggccaggtgggtggatcacctgaggtaggaagctcaagactagcctgaccaacatggagaaaccccatctctactaaaaatacaaaattagctgggcgtggtggcacatgcctataatcccagctactccagaggctgaggcaggagaatcgcttgaacctgggaggtggaggttgcagtgagccgagatggcgccattgcactccagcctggacagaaagagcaaaaatccgtctcaaaaaaaaaaaaaaaaaaaaaaaaaaaaagagctggcatgggcttgggagtcagatagacctgggcatgactctgactggctttttattattcattctcctttctaagtctttttttggtggggtgtcttggatagtatgtaatatcctggacctcaggggggtaggtgggatggactaagcccttcaagtggggtgagttctcatggacttggtcagagagacctggcttccaagctccacactattgccaatgggctttgctaccatgaagactttatttaacctccctggctctcagtttcttcatctgtgaactggggacagtaggctcagccctaaagtgccttattcctatccattgtcctgtctatgtgcaggcccagggtgtggtgaaggacctggagccggaactgctgcggcacctggcaaaaggcatggcctccctgatgatcaccaccaagggtagccccagaggggagctccgagggcaggtaggtggcgagtgtgggcagtgggggcagtggggagggtgcagagttggaggggcactgtgtgccattgcactagtcac

SEQ ID NO: 31476 - DNA, 1013 bp, Homo sapiens
cttgggataggcccatggacagcatggaaggagttctcatttccctagctggtgatagagtctggcccttctgaaggcttttataattacaatggggcaataactaaatccaagtagggtaaggaagtggagagaggaacaaggcaataccacacctacttagcagctggtaagctcaagtcattcttttttgctcaagctgattggatctgggtttctaccacttgtttctgaataaggcctgaacaataccatttatcttggctcatctgctacagtcccttctttttatttgtttgtttgtttgagatgaactctcactctgtcgcccaggctggagtgcagtggcgcaatctcagttgaccacaacctctgcttcccggttcaagcgattctcttgtctcagcctcttgagtagctgggattacaggcgtgcaccatcacgcctggctaatttttgtatttttagtagcgatggtgtttcaacatgttggcaaggctgttctcgaactcctgacctcaagtgatccacctgcctcagcctcccaaagtgctgggattacaggtgtgagccaccatgcctggccagtcccttgtttttgaatgcaggtctttgctgcttttccaagtccagaagggtgtgtccactgcctggcagtttctagatacccagtcccacccatgctcagagacttgctggttgtgtttgagtcccaaattcccagagaaggaatttgcttagagaatggaatcacacaggaatatgatggctgccaggggcccacctttgtggaggtgtggaagtgtaggtcgggagggatcacagagagagaaagaggactgttctgagccagacaggcctcctggagggatttcttaagcgtcactttgcatatttttgcgtgggcggccgtgatacagtgccactgattccttagtttctcttgccctgaagatgtcaggatctgccttttgctctgggccccctgcctcctgtctcctactctgggcct

SEQ ID NO: 31477 - DNA, 1031 bp, Homo sapiens
gttagtgatgttattagggctgtttggggccttgatcacagttttgggattcatgcatggaaaacacttggagagatgaaatttttgcaattgtgaagctcattttttaatttgggatccttttcaaagtagtatgacatgtgactatactttaaaataattcaaagtaacttttttttaaggatctttattatttttatgatcaacttgaaaatactagagatagcttagtgtagtgttttttttcaaaatgcgtccactgtataagaatctcctagggtactgattaaattgcagattcctggggctcaccccaaacctacagaatcccgagcatacaggcatcccaggtgattcccatgcattttgacttttgagacccactaccctcagatattgcaacaccagtactaaaattctgtaatctctacaatgcttcctaatatctgtgttttttttagcttttgaagtcaggtgacttctgattccattattcaggttctattttgaatatagaacagaccttcgaataacatcattttgttcaatgtcattttgttataatgttaatgaagaaaaaacaattggtttaagttgttttgcttaaagtcagtttctaagaacttactgacaacattaagtgaggtcttactagagtttttgaccttcatctgctgtctcatttctctttccctgtctagatgcaaatcagtcatttattaactatgtattacatgcttcttaattgtcgagcattatgttaggcatgtttgacacacagacatatacactcaaagttggatagatgctgctatccagagcattgtgtgtagcagccttgctcattgcttttttctcctgtttccatgtactggagtaagtttaagtgagtgcccaggaagctctacagagtttgttaaatagagtctgtagagtctgccttctgagagatgataataattgaccacgctgacaaggacagacatagaaaagaagatgtgtaagtgatacaaggagcctgtcctgggatt

SEQ ID NO: 31478 - DNA, 1062 bp, Homo sapiens
cagagtagaggtatatatggaatactgttgcccaaccatcatatcatgacagtttgcaaattaaggtatgtggagaatccactaactatacagcgtggttctgatgaaataaggatcatgcaaaacattattttaggtaggtagttttggaagagcaaaataaaatgtgatgttatatttagagtcaggaaaattatagaataaagggaagttttataatttggattaaatcgaggaagggtgaaaaaattgtaaggaggagaacagtcagaatgtattgaaaaatatctgtagttgtaaaattctagatgtgaataaagacagtaacttttaaaatacatcagaccttgtatatttatgagttattccttttcagtgttcaccttggaaggctaaaatccaaaatgattgaaaaaaatagagtattttctatgtgctatgtagttatactcattgtttcagaactcttttttgggaaggagggattactatttaagtcattttatgagcacagaaaaggactcttacagtattcactctgaatgggcaaaaggactgacctaatattattccctagacctgagaatgagtgactgtgtctgataactagatttacttttatagaaggagaactggcaaatgtgaaagctattcagatgattgtcagatgccttctaagcacaaggcattaagcaaggtgctttgggagtgttaattcactcatgatcttagccctcagagaggtcatagtgtaataggggaggtaagacataccccaaaattcacatgtagataattaagggagacacaaacagtgctggggaagttgcgaaaactccaagttgtggaaatatggtgttttttgcatttttctaaatagttaaattttgtaggcatgcattctgacatttaaatttttaatttcattgttttcaagtgggtataataatgaactctagacaaaataagcattgcctaggagaaaccctagagaaatttcttttaattattagataacagaatttaataaatatttgagtgcctcctggagaaatcagaggt

SEQ ID NO: 31479 - DNA, 1064 bp, Homo sapiens
attttaagagagattttgaaggaagtagattgttaaaatagcttctattttaaaatatgtattgtttcagtgctaacaattgtcctctgaccagctaggtttatcggctttactttgttcttttgtttcagcaatatcagaaaaactagaaatgcagagtttgtcatgataatgaagtcatttgtgccaattgctttaaaaaatcttttataaaaaacgatatgctctaatccacctacagcttttagtcttcttttacactatgaaagtgtcattttaacattttcaaaagtcagtagtatattgtacctactgttctctggcctgtcactgagtagttcttgctttgattgtgttgccatgtaaattgttaaatggatcaagtcctcaatgtaatttaatcgagcagccaagctttcttcttgacccaaatgatgaagcgggtgtggtctcacttttgttttgttgtgtgcttgaattacagtggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggtaaggataatcacttatcttgctatcctagaaaatactttgataaacttggtattttgttatagttgttttagaaataggaactctggggagttacctttttctgtcttgaggtgtttctttacaagccactaggttgaagtgggtgtggatgtgcttataagtgtttgggaatacaagctaaaacaatcatttttcttcccttctattcagaaatgtgacttattttacttaataacaaagagttttaatttttatactaaaataatgacgtataatggaaaatttgtgagaaaaattgtaaaaatcaaaatatttttagaaagcttaatttggcagtaataagcctgatagatttaagggataaataactacagacaggtactctatgaggctttggaaatatttg

SEQ ID NO: 31480 - DNA, 1026 bp, Homo sapiens
caaagatggctttgagagaaagaagatattctagaaataggtgatagatgagatgcaggagcctagagagaaggaggacgcaacaaagttatggccttagcattaattttattgtatcattaagcaactacagtaatggccttaagcaatttccacagatagtttatagttcagtcaccttgaattgtgatctcatgttcctaaaccacaaatctttaagtaggaaatttagaccattgtgcgaacttccttggataattttttgaaaaaaatagtaatgatggtcatatttaatgagtgactacagcatgatgtgtaggctttgctcaaatctccttcatattataacttcagagcataaaatatatatgaaagggtcttccagcctcccactttaaaaaccaagaaaagtcagaataagaaatgatagtgtaatataattcactaagtgataataataattactgttccatactttattttcttgtgtttgaatggtattaaaaatactagtggactttgaacttgtacttttagccaagagggagttatggggaatcagatttactctcctgcttgaaataacccaggaagaggaaggagaaggagaagggagggggaggggaagggggaaggaagaagaagaagaaaagtaaacagcagttcttaagacactggacatctgtagtgatggacagcaatctctcaccaaatggggaacaaatgctgtgaactctgtgattgtcctagcttccagccttgagagagcatctgggctgtggaggaacccaaatggagcctggaagactccatgatttgagaagacagagccaagttgcaggaagacaaaattgggttgagtttgcaagagagagtactggagaaaagagcactatgaaagagtccctcttgagtgttcctcagactcctaatcagcaaatgcatagaaggaaattgcccaaggaccagggaagagccatttgaaaggtttagagggaaccgtatctagtgctcacacagggctga

SEQ ID NO: 31481 - DNA, 1054 bp, Homo sapiens
tatggtggtgtgcacctgtagtcctagctacttgggaggcgaggccagaggatcacttgagcctaggagtttgaggctacagtgagctatgattgcggcactgcactccagcctgggcaacagagtgagacctgtatctaaaaaaacagtcaggttataattccctgtgtcatcttgaatacttttaaaattccttcttaatcaccttttcttttttcccttgctcactcttttatgaagataataaagtacatagccaaaagacagcaggaaggaggaggaagaaaacctgggaatctggattatttctgaaccaagtaatagcccacagaaaattgacatttgttagtttttataaacttactagtaattatgagaactagtgtatgtgcaaatgtttgtgttgcccagaactagcagagaggattaatgttttaatgttattattaattagcatcaatataattgatgctaatatttaatattgaccttctgttcctactctagactgggctgaattaattgactataggattccctcccttttgttgtgtaaatgcattggtaaaaattatattccaaattagtataaacatttgtggaaaacctggatagaaattggttactccttagactccgaatgatttgctcatctgtgctctttagggaaacacctacagcgaggattactgaagaacttgaatgtttcatttcctgagcagtatagatgccactgaggtctagaacatggagatatttcttaagaaagattagcaaattagtactagccctgagactggaagaaatgaggctagagttttaaaaagttggtaaataaagccactaaaattttcagttaaattttaataacaaattctaattatgtattatttaggagagccacatacatattgaaaaactttagagatatattttaatgtctatgccaggctgttttccttacagatggtagaaatcctattccattatgcagatcgagctctgaaaaagtgcccagaccaaggaaaaatccaagtgatggagcagcattttc

SEQ ID NO: 31482 - DNA, 1029 bp, Homo sapiens
gggaggctgaggcgggtggatcacttgagctcaggagtttgagacagccttggcaacatagtgaaaccttgtctctacaaaaaaaaaaaaaaaaaattagctgggaatggtggtgcacagctatagtcccagctactctggaggctgaggtgggaggttcacttgagcccgggaggttgaggttgcactgagccaagatcacggcactgcactccaacctgggtgacagagcaagaccctgtctcaaaaaaaaaaaaaagagttgtctccatttccttacctccttctcatcccttaacctattccatgtctataaattctgtggacccttttatttctcatcttactggtcctcagcagcattcagcacatgaagacttcttgaaatagtctgtccatttttggcttccctgatatcatgcattccagttttttccctacctctctgactgcttattgattctctttgtttattcttcttccttttctttacttaaccaagaaatgttaggattcttcacaatacccttctatttttatatcaatgtttgtcaagatgtctgtgtaccatttacttcaaaatcatttgaagatatttgttaaaaatgcttttttttttttaatttcccaggcctactgaatcagactctctgggattggtgaccaggatttgtagtcagctttcaagatgtcccttaagcacattaaagtttacaaatcactgctttacattcttccctaggtgatataggcacatggctatctaaccagtgttaacaacctagattgctcttctgaattctgaggtctatagagtaagttgcccatttacatttctgcttggatgttttgtaggtacctcagactctgtttcctcacaaagccttttctgaggattcctgtgttagtgagtggatccaccatgcacctaatgcaaattgggtgattcttgtcttttacttgttcctggctattctgcctcctgacagtttctctcatctgtttccaccatgctgttaattctgccac

SEQ ID NO: 31483 - DNA, 1040 bp, Homo sapiens
ttggttaaaaggcattattcagaaagaatcaactgggaaaggatgtgcagacagaaacagaagttctcactccaagttgcaggtttcatccggaccagtaatctggtctttcagccttcaggctgttttttggcttgaaggtggggtttcacaagggacccgcccctatctgcctaggcatttgactaccccctgtcgctatcaaacccactgtgttccacttgttttcacagctgcccaagttgtaaggcaatattggttttcaaaactacagtagagctggagaaagggagatggcaatacataaagttaaaactctaaaattcactggtcttcctgagattcaggcatttttctgaataaacattcctcagattatggcaaatttttagttaatttcaagagttctgaaaaagccaatttgacagtttttaccagtgtttgtattgcttttatggaggagatttttgcaggtccttactccaccatttctgaggtctgtttctctgggttttgattgtgttctgtttggtcttttttcctctctgtttttcaccttggatgatttctattgctcttccttcatattcatttgctcttaactccttcatgtcaattcaactgttaaatctgctcagtgatttttttattttcaacagttatatttttcggtctaatttccatttagttcttgtttttgttttctctgctgcaactcttcatttatctgttgaaattttcatgcactgaaaccatttcttttgcttaaggataattataatagcgctttaaaatctttgcttgttctcacattttgttcatcccaggattggacttgattcacttttaagaagaatatattttattttcttggtttttcatgctggataattttggactgtatctggatattatgaatgttacattgtgtggagagtatgggttctccagtgagtatttttctccattgctctatcaggtatttttcaccactgagtatcgtcttccattgttttatcagataattttcttggtgggct

SEQ ID NO: 31484 - DNA, 1005 bp, Homo sapiens
atggaagttttcttctatttctactatgccaagagtttcctcatgaatggattttgaattttatcatgttttcttccttattctgtttttgtgttaaattttattggtattaaaccaaccttgatttttgcagataagtgcagcttgatcctgatatattatttttatacattgctgaatttcatttttatttaggatgtttatatcaatatttgtgattcagattgatctgtaattttgtcctattgggtttaaggtgtcaaaatgttactagcctcttacaatgagctgaagaatttttcttttttctattctctgttgtaagaggtttagttaaggctggaattatttcttccttaaatggttgctagaacttaccagtgaggctatttgaccctacagtttttcatatggaaagtttttaaactactcactcagttattttaatggttaaaaatcaaatcagggtcagacacggtggctcatgcctgtaattccagcactttgggaggccgaggcaggatgatctcttgatcccaggacttccagaccagcctgggcaacatagcaagaccccgtctctaccaaaaaaaaaaatcaattcaggctatttcttctcaagtcagtttattaaattatactttttaggaatttattttgtctgaatttccaaattcttggcataaattcattcatcgtagcttgtttttgaatggctacagatcagtagtagtgtctcctttgtaatatttagttataccttctcactcatcaggagtattgcattaaagttatgtaaactacagttatttgtggcagctaattattatgaatctacaagtactacctaacacaataattaagagatacattgtgaatgttgcagtcatagtggtttgtctgagttttatttaataatacctattttggtctacatttggtctttgtgttttagccgtgtattgtggttgtgtttgatcatagtgtccccacagagaaggtaca

SEQ ID NO: 31485 - DNA, 1024 bp, Homo sapiens
agatgagcccaagtctttgctctgtttacttagtgtcagatccttacttacattctatttttcagaattaggagtccttggtggtttttatggaagggactgatctgtttgaacttgtgcttaagagaaccctagtgacagtatataagaggatgagggaggcaagattgggatgccaaaagttcaactaagagactattgcagtagcatagacgaggtgatgaaaagctccaccagggtaaaagttgtggtcatatgcaagcacagaagtagaatcaacaaatattcgcaagttatctgaatgtgtggggtgaaggagagggaagcaccaaagatgaagatttataaactggttgacttaaagattatgattccattaacttggtttgtaaatggaggaggaggagcagatttgaaatgagaaaaataagttgggttttgcacatataaagttgaaagtgcttgcaggacatccatgtggaaataaatgtcttaggttcattagaaaattcaacctgtagattttgaatggaataaagattggagatgtgtgtttgaaagttatgaacaaagatatgagagttgaaacaagaatggctgaaatcattgagaaaatgaagagagacctaaaatagcatcttgggggaaatatctacatttaagaaataggcagaagaagagatagtataccaagaaaggtgaatgataatctctctagtaactaatccttagacagatgattggggattttccatatttccatagcatattgaaatgctaagtgtgatgtgctttatctgtcctacgaatgtaaaacatttctgtgggaaactcttatttcacggaataatctgttttttaatctataaaacattagcatcaggttttattaattattatatactagaaaatgaaggtgatgcaaagaaaaagaagtttaacttttcacagaggctctgagattatcagcaacatatccttaaatgatgtttacactttttctaaatctagataccaaagagga

SEQ ID NO: 31486 - DNA, 1053 bp, Homo sapiens
atactgatatcaaactcccgattctgttcacatgtgctattcatgcacatacccttggtttctggagccaagtgcaaggcattgcttatattgtttcagtttctgacccttgggaatcatttttttcctcccaaggataggcctcttttccctttaagccattgataaaatatttgtatataaaaaagccaaggttggccaggcgcggtggctcatgcctgtaatcccagcactttgggaggccaaggcgggcagaatacctgaggtcaggagttcgagactagcctggccaacatggtgaatccctgtctctactgaaaaacacaaaaaattagctgggcatggtggtacgcatctgtaatcccagctattcgggaggctgaggcaggagaattgtttgaacctgggaggcggaggttgcagtgagctgaggtcatgccattgcactccagcctgggcaacaagagcgaaactccatctcaaaggaaaaaaaaaaaagccaaggatagagccttacagctcatcatcagagacttagctaacatcatttattagctcccatgctaatgcaactgagagctaatggctgtgggttttgcgcttgttaatatgacacttcagcttgagtagttgtctgttcccactcagattgtcatatgtgtgtcttattatggggctgtgtgtgagaccatctcggtgccagtagttctctatactatcctatgccctctatggaagggaactccctcagcaaaacaggagttgcctcacggctaccgtcttcttggatgttgagattattgatcgagttacaaataggcctttcccctccaacatgtttcctgatgaagcttttaggcacttcccaaaatacatggcagttatcttctttctcttcagtatgtgtgacagagccactagcagcctgttactgtgcattaaaagaactcagtaggccgttcttaattgtgctgtgctgaattatcacccgtttgtaaaggtcatggaatttgaacagagcttcgcagattgtgctgctctaatgtgtgtggt

SEQ ID NO: 31487 - DNA, 1047 bp, Homo sapiens
cactttaaatatatatctcatttaatttttggtaatctcaaaaggtaagcattaccccttccttcccacaggtgaggcaattgaggcttagagaagtgaggtgacttgcctaaagttacatagcaggttactgtcagaactagtatccagattctcctctgactccaaagcttatggccgcctcccccaggatcccatttcttctctctgcatatgagctggatcaggtccactgagagaagaaccgcagtttggcaggtcccaccacaataacaggtggaacaaaacatggctgctgtaagagcaggctagaccggcccttttcccaaaagcagcagacgaatcttgcaaccccataggtggcgaccagctttataatgagacagggatgagatttttaaatgacagtgcgtctcctgttaccatgacagagaaaagcggtatctttgctggccgtatgaagtgatggacatgggaatgcaaggctggaaggaactaactagctctgcataatggtgccaaagagggatcaagaaacctgaaaggaacctatacatacgggacatttggagactccattgggaaaagggtccacagacaggtcaacctgcagccacaccaaggagggatcttaggggacgtgccgatttctaactcatgttcagtatatatctcactaatagctggtagcatggattgttttcaggagaatgaaggaagcaccatgttatgcttcagcatcgtgtagagcaagttgagaggctgcctagccacgtgatgttgttaatcgtatcggtttttatttttcagggaacctcagaacctgttctggatccacagcaaatccaagcatttgatcagctttgccgtctctaccgaggaagctccagggtaatgtttgcgtggttgtttatatttttatttccctatttatagtttactgctttagacaggcagtgtcttggaacctccctctagcctccttctagcctggaaggtgccctggcatccctgttatggctacatggacaacagaccctggcccca

SEQ ID NO: 31488 - DNA, 1047 bp, Homo sapiens
ttgagaataggctttataagatacatacctatatgataccacttattgtgtgtctgttaaaattaataatgaaggctgctaactaggggttgagtcatgattagtagaataaaagaagttataggctcatgcctgtaatcctagcactttgggaggccgaggcaggcaaatcacctgaggtcgggagttcgagaccagcctgacaaccatggagaaaccccatctcaactaaaaatacaaaaaattagctgggcatggtggcacatgcctgtaatcccagctacttgggaggctgaggtaggagaatcatttgaactcgggaggcagaggttgctgtgagccaagatcgcgccattggactccatcctgggcaaacttggcagagtattttgcatatagtcatttctgttaaatgatgctttgtttcctaatgtccttgggattaatcactatcatcatgaaggggaaatcagtgagtgggatgcctagattaagactccttattcttgctaagtgaatggatagcaatgaattgaatccaaggacagattcttttcctaaatcaagaggatagaatatggtaaaggtgacatggaaagaaaggagatgaacctgaatgtaaaagttacatgtagaaaacacagaaatgaggaaagctgcttctgtatgtgtgtgtatatatgtgtgtacatagatacatagtatattatacctacatctatgtatattacatacatatatatgttccagaaatatatatatttatatagagagaatatatatattccagaaaaatatatataatttatatagagagaatatatatattccagaaatatatgtgtgtgtatatatatagagagagaaaaagagaatatgtgtgtgtgtgtttgtgtgtatatatatattccagaaaaccagataggaagttattgagttagtcaatgagaaaaaataaataaataaataagtgcattaaggccttagagctgggcctgtcataggctaattgatgattttgcgagtagcttaaataattttcgaagt

SEQ ID NO: 31489 - DNA, 1035 bp, Homo sapiens
gtgatccacctgtctcagcctcccaaagtgctgggattacagacatgagccaccacgcctggcctaccttcttttttaaggctgaataatatccattgtgtgaatataccaaattttctttattcatctgttggtggacatttaggttgttggctattgtgaccaatactgcaatgaacatgagcgtgtgaatatctctttgaaatcttgttttgaattcttttggatatatacccagaagtgggattgctaggtcatatggtaattctatttttaattttttgaggaacttccctactgttttccatagcagctgcactattttacattcccaccaacagtgtacagagactccaagtactctacatccttaccaacacttattatttttatttatttatttatttttaattaattaattttttaacagtggtcatcctaataggtatgaggtgatactattctggttttaatttccctttccctgatggttattgatgttgaggatcttttcatatgtttgtcggtcatttgtatctcttctttggagaaatgtctgtcaagttctttgcccatttttaaattggatttttttttttttattattgagttgtaagacttcattatattaatatattctggatttttgtcaagttctcttgagaaactttttaaggttgccttttcactcttagattatttcctttgctgcatgtaagtttgtaagttcgctgtagtcccatttgtctaatttttgcacttgttgcctgtgcttttcatgtcaatatccaaataataattgccaaacccaatgtcattaagcttttcccctgtgttatcttccaggagtgttatagtttcaggtcttacagttaggcctatgatccattctgagttcatctttgtagtcaaattttataggacctttgtatggcaagggtccaacttcattcttttgcatgtggacatccagttttcccaatgccatttgttgaagagactgtccttttcccattgtgtgacctcagcaccctt

SEQ ID NO: 31490 - DNA, 1034 bp, Homo sapiens
gacttttgcttgttgaattctttaagttccttatagattctggatattagaccttttggtggttgaatagtttgtgaatattttctcccattctgtaggttgtctttttactctgttgatagtttcatttgctgtacagaagctctttagtttaattaggttccacttgtcaatttttgtttttgttgcaattggttttgaggacttaataatacatgctttaccaaggctaatgtccaggatagtgtttcctaggttttcttctaggattattacagtttgaggtcttatttaaactccttcagttttgaaggacagttttgctggctacagtatttctgattggcagttttttcttttagcagtttgaatgtatcataccactctctcgtctgcagtgtttctcctgagaaatccaataataatctcatgcgagttctcttgtatgtgacaagtcacttttctcttgctgctttcaagattctttgtgtctggcttttgatagttcggttacaatgtgtctctgtgggcctctttggattcatcctagttggagtcctttcagcttgttcaatttagatttccatttctttcttcatgtttgggacattttcagccattattttttcaagtaacctctctgtccttttctctctctctctccttcttttgataatccagttaatgcatatattggtcaactagatggtgttccataagtcccttaggcattcttcacttttcttcattctttttactttttgttgaattatcaagcaggagctggataattcttaatgggtttgctgattttgtcttctgtttgatcaagtttgctgttgaatctgcttagtgtaatttttaattcagttttatattcttcagctctataatttccatttggtgcaccaccccctcccccgccaccccgagatgcagtcttactctgtcgcccagagctgtagtgcaatggtgtgatctcggctccctgcaacctccgcctcccaggttaaagcaattctcctgcctctgct

SEQ ID NO: 31491 - DNA, 1034 bp, Homo sapiens
attttgagttctttgtctggtgattcatagactttcatttctttggggtctttttttttttttttttttttttgagacttactttgttcccttggtcgggcccttatttctttgtattcttgattattttttgctgggatttgcacatttttaaaaaacagccacgctcccagtcttctggactggcttcatacagggaggaagagatgttaagactctctttagcccagctatagagtcttagggcctctcaaacctttaatggggttgtatctcctctgaactgtgcctgtaatttcccaattacagaagtttgctggtttcttttttaggcacttgctccctctggtgtctttccatggtactgctggttttctggtgttcctacaagctgcctaggtctcttttgttctcagcagttcccaggcatgcaaaagttgccagttctgtcagcattccaagtcaggtaagacagaaagccatctcttaggcagtccccagaaaagctgaaaggttggatatactttctactcttctcttttcttcatgagagaaaggccatgagttgggcattttctcccaataacactgagttctgttgtcttctgtcggctgtgctgcaggttctcaggtgctgcagttagctgctgaactctccgctgttctcagtggaccccaagcatccaaagtattctggttctgtcagtgttccacatcaagctggacagtaaccattcccttgggcacttccctaaaaagctagaactttggatgcacattctatccttttctttcccttctgatgagaagatgcaagtttggcatttacttgcaattatgtagggctggactggcttggggaaggcctattatgggtgaaatgcattagcttttcttgcctgtttcaatgtggctgttcttggctttgagcttgcctgggatactgtgactttttaactggtttctggagttctcataaagtctttttgggccatatgttgttgttaagtcagtatctctgtgggggaatgagg

SEQ ID NO: 31492 - DNA, 1076 bp, Homo sapiens
aaatcgttgtatgacaactggtgtcattaaaatttatttccaaccataggaattttttgaatagatgatatattcacatttccaagaccaaaacatatcaacttcccactccagccagttctccatccattcagctcccattcagggtccccaaaccacggctattatttttccatgtatctttccagagtttcttgatatatgtagtaaggaaatataaaagtataaatagattcttatttccctcctttttacacataacattatacgtaatgttctaaatgttttcagttgtaatatatgttgaatctctttccatgtaagtacatagagagtgtcctcatttttaaatagctgcctactaatccattgtacggatgtactgtaatttatataaccagtcacctgttgatagacattttggttgtttccagtgtcttcctattgtaaacaatgctgaagttcatagccttgtacatgtatcattttatacatgcatacagtatatccatatgactaaattccccaaagtagaattactggatcaaaaggtatcataaatattgcctaactgccttctttagggattgtaccaatgtgtactccccccccccattataagagtactgtttctcatatccttgccaacagaatcatcagacttttggatttttgccagtttgataggttaaataatggtttcagcatagtgtttgttttttagaatttacaataaaatttgtgttgaagttttaaaaactaattttcatttttaattgtggttaaaaatcctataacataggtaaccatttttaagtgtacagttcggtagtgttaagtatattcacgttcttgtgcaacagatttccaggacacttctgtcttgtgaaactgaaattctatactcattaaataacaactctccacttcctcctcctgctaactcctagcaactaccattctactttctgtttcaatgaatgactagtagctatctcatgtaagtggaatcacacagtaattatccttttgtggctggcttatttcacttagcctaatgtcctcaaggcttatcc

SEQ ID NO: 31493 - DNA, 1056 bp, Homo sapiens
cagctaaaataggtgaaaatatcaccattaaaaatatctggctgggcacagtgggctcaagcctgtaatcccaacattttgagaggctgagcccggaggatcacttgaggccaggagttaaagaccagcctgggcaacatagcaagacttcatatccatttaaaaaaattaaaaatatgaaaaaaatagaaagaaaaagaggctgggtgtggtggcccatgcctataaacctagcactttgggaggctgaggcagatggattgcctgagctcaggagttcaagaccatcctaagcaacatgacaaaacgctgtgtctacaaaaaatacaaaaattagcccagcatagaggcacgcacctgtagtctcagctactcaggagggtgaggtgagaggatcgcttgagcccaggaggtggaggttgtagtgagctatggtcatgccactgcactccagtctgggtgacagagtgagaccctgtctcaaaaagaaagaaagaaaataagaaaaaatacctaacacacaggaataaatctttcaaaagagcacaacacctctatactcaagactgtaaaacattgctgagaaaaacttaacaactcagaaatagaaagtgcaatatatatataccatgatcatggatataaattgttaaggtgccatttctccctaaatcagtctgtagatctaatgcattcccaatcaaaatttcagcaggcaatattgacgaaattgacaagctatttctaaattttttgtgaaaatacaaaagatatacaatagctaaaacaatcttgaaaagtaacaaaaaggtaaatgacttataatacgtgacttgaacacttaactctgaaacaataatcaagacagtgtgatattgccttgaggacaggcagatttgtcggtggaacagaatagggaaatcagaaatagattcacacatataaggtcaattgatttttgatcaggtggtgagtcagttcaatgaaaaaagagtagttttctttaacatgttgctgaaacaatggattttctttttttttttttctttttttctt

SEQ ID NO: 31494 - DNA, 1042 bp, Homo sapiens
caggatggtctcgatccctgacctcgtgatccgcccaccttggcctcccaaagtgttgggattacaggcatgagccaccgtgccttgcatgttcgttcttaaataatgtggtacactgaggcctactgggcgtgtaccaatgccgtatttgccttgagcactcccatgttacatgtgtaaacttctttggtctatcttttttgtagtgatattccacaataagctcctttagagaagtttgttaactatgttgtttgccaacgatattctattgcttcaatatagacagtacactgaatatctttgctgtgtgtaaaattatcctgaaaagttttccttttccaaatgagctaagaagtgtgcaatacttactagtggtcaggtttagaccctccagaaccacttagaaacaggccaccactttccttctctcacagttgtataaataatctgattgagaaatagagcagatctctgttcagaatgttcttggtcactggacacctcataactgaggctttatattaaccacgatcgttctagtttcaaggattgaggccatttcccaagttcagaaaaatcatgatcagtatttgtcaagtattagtcattgtgaagtgtagtgatggggagtagggacaataaatatattcatctccaattttgtataactgaaaagtgtaaaaataaagaagaaagagatgcctcttgagtgaatttaatacagctgtttttgctgttaataataaaacatcttactgaaaccaaaatttgttcaaagtttcattaagtgcccttttggagctgtgtcttaatcgactgccagaagttgaataaaccaatgaggaaacactgtaccctacttaaaagtagcagtaaatttttcttccatatccacttttgatacatcatgaaggtcagcaagatgttactgctgtgcaaaacagctacattcgtgtaatattattttccatatgtctgttttcttagttactagattattgttcccatgcgttcttcccgacaattttgcttttacaag

SEQ ID NO: 31495 - DNA, 1072 bp, Homo sapiens
aactcgagctgaagttagatgaaggatgaagactatattaaattgaaaaaatgaagacccactaaattcataaatattataaccagcctttgtaaaaataagatattattctgtatgataattgctagcttttgaaaattgttctttcataattttcccaataacaagttggtcgatagattggtattttaaatttgtagattttgtcaaaaaaaaaagataaattttaaaattacaaaacaaaaaactcccttttcatttgtatgttcatttcatcagtttggaatttttcttacacccttcttcatttgtataattgtcaagccaagagggctgatgtctagtcctaacagctataataattttcatatagcattttcatttagtaacaatacatatctgtgtagcagtgtggtaaaaacatcttacaaaatgcaatcatgtgttgcagggcaaccctaagagaatgtgcagtaactgtacaattttaattgtttaaaaattttcaggaaaaacaatgtagaacatcctgctgacagatggtgattgtcttcagtgtgctaatttgcattgtgaattcctgggctggggtaatagtagaattgagcaattctgaggacattttagtgaaattctggattcacaaaaggccagagaagtgaaagaatgaattgattcaaggttaaggtagccaaagatgaaggactggagaaagatgacagaaaaaaaggagagcagagcccagggagacggtagctcagctgatgaggcaggtggcagccaggacagccgtttccaccttaaacagaagggagtggatctgggactcagactgaaaaagactctttggagtcctaaaggggggctgtcacagttgccattactaaagagggctcaatttgcaaaataagcccactaaggctccttattaccctgaggcattgtgcctgcatttttagtagctggcctgcctgcctttaatgggacacattaggctatctgcaggcttggataaccatggataattgagactagtgagataaagctcaccaaaatgcaaagccatgattgc

SEQ ID NO: 31496 - DNA, 1016 bp, Homo sapiens
tcccggattcaagtgattctcctgcctcagcctcccgagtggctgggattacaggcatgcaccaccatgtccaactaatttttgtatttttgttgttgttgttgttgttgtttagtagagatggggttttgccatgttggccaggctggtctcgaactcctggcctcaagtgatccactcacctcagcttcacaaagtgctgggattgcaggtgggaaccaccatgcctggctgaattctaccaatcttataaagaagaactaacacgaattcttctcaaactattccaaaaaaaatgaagaggagggaattcttcctaattcattctgtgaggccagaattaccctgatatcaaaaactaggcaagaacacaacaaaaaaagaaaactacaagccagtatctctgatgaacatagatgcaaaaatccccaacataacactaggaaaccaaatccaacaaaacatcaaaaagttaatacatggctgggtgtggtggctcacgcctatagtcccagcactttgggaggccaaggtgggctgatcacctgaggtcaggagttcgagaccagcttgtccaacactgcaaaattctgtctctactagaaatacagaaattagccagtcgtggtggtgggtgcctatagtccaacgtactcaggaggctgaggcaggagaattgtttgaacctgggaggcagaggttgcagtgagccagtatcacaccgctgcattccagcctgggtgacaaagcagaccctatcttaaaaaaaaaaaaagttaatatgcttaatacacatgatcaagtggaacttattaagatggatcagcatatgcaaatcaataaatgtgataccagcaaaaaaaactgtcaacagaataaacagacaatctacggaatgggagaaaatttttgcaatctatgcatccaacaaaggtctaatattcagcatctataaggagcttaaacaaatttacaagaaaaaaaacaaacattcccattaaaaagtgggcaaagga

SEQ ID NO: 31497 - DNA, 1023 bp, Homo sapiens
aaatgccatctcctctaaaagtacaaaaattagccgggcatggtggcgcatgcctgtgatcccagctactcaggaggctgaggcagaagaatcacttgaactctgatggtataggttgcagtgagccgaaatcatgccactgcactccagcctggaaaacagagtgagactccatcttaaaaaaaaaaaagaagccgattagtttgatttgcatctacaacaaccccaaaagggaggtttagtatatcctgtatacaagtgaggcaactagaattcagaatatttacataactgtcaaagacttcacagcagataagtggctaggaatcaaacaaggtatttctgatttgaaaacctgcactctttgcaattacagcacatcataagcattatgtaataaacatgggacaacaactatttataatataccaggcttcattacgatctgatttattacagtcctagggcaaccttgcactaatgggaggttagtcatgaaatttgctctgtgtgctgtttttggccaactcactaccacattgggcatcatcagaaggcgtctaccaatgaaatgtataaataaataaatatatatgtatataaaaaggtggactagagttggacatagatcaaacaagggcaactgagatgattcaaggagcgtgtgtcctgccttagaattgcagactggaggccaggcctggtggctcatgcctgtcatcccagcactttgggaggccaaagcaggcagatcacttgaggtcaggagttcaagagcagcctggccaatatggtgaaaccccgtctctaccaaaaatacaaaaattagccaggcgtggtggtgtgtgcctgtagtcccagctacttgggagtctgaggcagaagaattgtttgaacccaggaggcggaggtcacagtgaactgaggtcacaccactgcactccagcctgggctacagagcgagaccctgtctctaattaattaatttaaaataagcttaatatctctgattatcagggaagt

SEQ ID NO: 31498 - DNA, 1071 bp, Homo sapiens
aaagctatcatcggaagcaaagtgttaggtaaaagggcccttggtttttcctggcttcttcaagtagagttgtcttttcttgtccttactttatgagatgtcctaactgtagattataccatgattcaagaacagctagacatgcatacacatgaatttgcaatcagttatttagaacacagaaaaaaaaatcagaaaatgaagggaaaaacatttgcacatagccagaatgtacgtcacaaaacccatgtacaaaacctcacagtttactcatatgaagagtcatcaagcctttgtacaaaatcttattactgttattttgcacacagttctaacatgtttgggcacatggtttccaagcccatgacaaatactgacttctcaggtagatttgctggacataccacctactcagggaaatttattgagagctatgaaattgacatttaattaaacaactaataccagacattgaaacaacagaaaattcaaattaagcaaacaagtacaataataaaacaatcattagcatttcagaaggattcttcattttgcaagtagatttatcagtgatacttcaaatagtaatttctattagtgatttttaaatgttattttaaaaatgtgatttatatgcaactttttaggagcacttaatgaaaccatgtgcacttgtaatgaattcaaattatgattcctaaagggaggcagttatgtctttttttttttttttttttttgagacagaatctcattctgttgcccaggctggaatgcggtggcatgatctcagctcactgcagcttccacctcccaggttcaagtgattctcctgcctcagcctcccgagtagctgggactacaggtgtgtacaacacgcccaactaatttttgtatttttagtagatatggggtttcaccacgttggccaggctggtctcgaactctggacctcaggtcatcctcccacctcggcctcccaaagtgctgggactacaggtgtgagccaccatgcccagcctaaatatgtctttaaattctacctttgtaatattaacctttgtattgaggg

SEQ ID NO: 31499 - DNA, 1037 bp, Homo sapiens
ggcccactgcaacctccgcctcccaggttcaagtgattcccctgcctcagcttcccaagtagctgggactacaggtgcccaccaccacacccggctaatttttgtatttttagtagagacagggtttcgccatgttggccaggctggtctcaagctcctgacctcaagtgatccacctgccttggcctcccaaagtgctggaattacaggcgtgagccaccgtgcccggcctgggtctccatttttaaggaccttatatgataatatggtagggggtataagacaatcacataataatgctaatgtcaatgaaaatataaaaaataaaaaaacaaagatagtaacaaaatcctatccaattttcagctcatcgagtctcagtaaatgtttgcgggagttagtatgagttagtatgttagcccaggtcttgaaggatggataggatatcaaaggagagcaataggaaggaaaaatattctaggcagagggaatagtatgggaaagttgtgtaaattcaagaaatagtgaatagagctcagggaaaaaaaatggctgaagacaggtagatcaaattatcgttctgttttgttttgtttagttttttaatagagacagggtcttgctatattgctcaggctgatctcgaactcctgggcttaattaagtgatcctctcaccttggctttccaaaatgttgggattacaggcgtgaaccaccatccccggccaaggattttcaaatgacaggaatttatactaaattcattagaacagtatttcccaaagcacaggatagataccaatttaggaaatgattttaggggattcaacattcacagcattatgtaacatttgaatgatgattatgtactaagaaaggtgtatccttttcagttatttatttgaggtgctcacatcctgtttatttcacacagaaaatcttgatttaatgctagtatatcttcaatacttgtctaatatatgctaatctcccattttttaacaggcccaactagaacttagtattattgtgtttt

SEQ ID NO: 31500 - DNA, 1033 bp, Homo sapiens
cggccttcttgctctttttaaaaacattttttactaattcttttttgactgtcagtttttaagttagaaaagttctccccctgcctattcccagtgttttttttctttctctaagcatcttgttcttataaggatgcaaaatctttccttatctctctaaagctgtttattattttaaaatatgttttgagtgctcccttctggtttatgccgtctccctccatgtttgtttattttggtctgatctttgaagttagagtctttattcaagtacttggtactccttggctatccacttatatttaggaatgagaaactaaaaactagcgccctctggaattgaataaatggctgattgtagggctaggaaagaaagtataaagtgagtctgaacatcttgtgccagaaagtaaaggagtgttcaaaaactgggcatgccaccctgacagaggaggagatttcaaaggggctttcactggccagatgggataatttaaacatcaaaatgaataaagacagggactcagatgctaataaataaatatatagtgtcgaggagggaaagatctttatagtagaatgccaactagtaagtgtggaaggaatgataaaattagaaaatcaccattttgtaactgtcatggtaataactgatatgggcaggaatcatcaattgagccaaaactagtaaatacaagtttgcagcctggccaacatggcgagaaatcccgtttctactaaaaatagaaaaattagctaggtgtggtggcacacacctgtagtccctgctacttgggaggctgaggcagtagaattgcttgaacccggaagcagagggtgcagtgagctaagattacaccactgcactccagcctgggtgacagagtgagactctgtcttaaaaaaaaaaaaaaaaaaaaaaaaagtttgatgaggcactggtatttacataaactcaaaatatctccttacacgttactttttttttttttttttttgggatggagtcttgctctgtcacccaggctggagt

SEQ ID NO: 31501 - DNA, 1041 bp, Homo sapiens
tcttggctcactgcaacctccctctcaggttcaagcgattcttctgcctcagcctccccagtagctgggactacaggcatgtaccaccatgcctggctaatttttgtatttttagtagagacagggtttcaccatattggccaggctggtcttgaactcctgacctcaggtgatccacctgccttggccttccaaagtgctgggattacaggcatgtgccaccacgcccggtgacatcactagtttatagtaagggacatccaactatttataatgatacatcaggagtgcctcaataatgtgaacttctttttttgtttgagacggagtttcgttcttgttgcccaggctggagtgcaatggcgcaatctcagctcactgcaacctccgcctcccgggttcaagcaagtcttccgcttcagcctcccaagtaaccgtgattacaggaatgcgccaccacccctggctaattttgtatttttagtagagacggggtttctccatgttggtcaggctggtttcgaactcctggcctcaggtgatatgcccaccttggcctcccaaagtgctgggattacaggcgtgagccaccgcgcctggccaagaatgtgaacttccgtatacactagaaggactagttgtactacgggtaattttggagttgctttttgtgttgctgctttgcaaattgcccatgtagtgattctcagttaaagcagaatcatttattaagcaaaacatctcattgtttcatgttgccaaatagcaaagcagttggctgttctctgaacctaataagatgagattttaaagggagaagttgctgtttgaacagaattggcaatgtacaacgcctggtagagcagaaagaaacttgtagattttgttgttttttatttaaataaatacgtttttctcataaaaaaacagaatatgttcattttagaatgttttgaaaattcatataagtagaaaagttgcctattgtgccaccacgtggatatttgcaggactgtgaagttgtactatactgtataattc

SEQ ID NO: 31502 - DNA, 1880 bp, Homo sapiens
ggcttttgcctataaataatctcagcactttgggatgctgaggcgggcggatcacctgcagttaggaggtcaagaccagcctggccaacatggtgaaaccctgtctctactaaaaatataaaaaataagccgggtgtgctggcacatacctgtagtcccagctacgctggagactgagggacaagaatcgctcgaacccaggaggcagaggttgcagtgagcagatcgcgccactgcactccagcctgggtgacacagcaagactccatctcaaaaaaaaaaaaaaagtgcttatggtacatatcatgtaattatgaactgttaaaaatggttttataagtatgttccatgatgtaaaaatgtcaacacttagaaaaagcacatggacatcctgctttattacatgattacacctgaaggttgtgctgccatgcacattaatatgtaatgcgggcgttgtttatggggttctttgcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacctaaaaaagtatatgctgaaatgatttctaaccctctccctacttaaacctcccagacttgttctggttcataaaagcaagaggtaaaac

SEQ ID NO: 31503 - DNA, 1027 bp, Homo sapiens
cactttgaaattttttttttcagagaaataattgctctttgctgcagttgtcagctgtcctgctggaattttggaaacagcagggctgcagaaggagggcttgaactgtaagtgtgatggagggcatgcttccactacacccctggtttgcagcatctacagtgccttatcttagaatgcagagttatttttcacatgatagagaaggggttggggacctttgaagacaataggggacagcctccaagtgcaaagtcagaaattcagaggccttgctcctgccaggcaaaacttattttctacctgttttctctcgagttcccctacttatccctcccccagagagctgaaacagagaccatcttgattgatctagacttggtttacacctgataagccaagattttatgaatgtttaacagaggtcagaaatttggagaaaatcttatagtaggcatattaccttttaaagcatgaattaactaatgttttcctcaagagtttcaaaggcagtacagatcctcattgtttcccagcgattcttttgggcaagacagtgataaggtggctgggacaagctttcttaatccttcttttcaggtaagaaaactgaagctcaggaaagtataattttttcttaatcacatggagggcctgaaacacacctggaaaaaacattttagtctaacaacaaagagttcataagtgttaagtctttttcttttctttttttttttttttttttaaaaaaagtcttactgtcacccaggctggagtgtggtggggtgatcatggctcactgcaatctcaaacttccagactcaagcagtcctcccacctcagtctcccgagtagctgggactacagatgcatgccaccatgcccagctaaaattttttttaagagatgggatctcactgtgttgcccaggctggtctcaaactcttgagctcaagcgatccttttgaacctacaaagctatagcggaatgtttttttgctcaactgataatgtagtcagtataacc

SEQ ID NO: 31504 - DNA, 1030 bp, Homo sapiens
atacagaataaataaacatcatcctgatctcaaggaatttatggtcagtggaggaggcagatatataaacagaccatagcatggcattagaggtgccacagtagactttgtgagcatacaagatagagcatcccattcagcccagtgttggggaagggaacatcaggaaagaattgattttggttttgaaggataattagggatttactagaatacaagacgtaagagaggaaatacatcctaggcagaaagaatagcatatgcaaaggcacagacacacaaagtatctgttccacatttgaaatccaatccaaatgttaactcagaaatgtttgagaacaagacagaagaaataatgcaaaacaaaaaagattctcagaatcaaagacatggatctccagatcaaagagtttgcagaaggcccagcaaaatgaatgatagaagatctaaaaatcacatcatcatgaaattctgaactcaaattataaaagcatctggacaaaataggtcgcatacaaaggagttggaacaggaatgagaatgtattttcctaaaacaggaaactagggagtcaatagagcaatgcctttaaaactgagtggaaattatcttcaatctagaattctaaacctagtgagaccatcagtttaaaaagatatgcaagaattcagacatgcccgttttggggaagctactgggagataagtgccagcaaaaccatggaagaagattacatgggatttgggaaataaggaatccaacatggtagactctgaatttaaaaatccagaatgcctgcaatgcagccatcccacgagcaaccagcacagattggaacaagaggatagatggctcagaatgaggtcttcaaggaacaacaacaaaatggaactcatttctgtgagtgcataatgattatttctgataggatagcagacatgttggagcatttggaaaaaattaatcacaagtatatggaaagccagacaagtgggaaaacaaggaaatcattaactgaaggaaaaatacg

SEQ ID NO: 31505 - DNA, 1047 bp, Homo sapiens
gttaagacagtgtgtcagtatgtatcaggtttcttcattgtaaaattactaagtatctcttggggagatactttgaaactatgtagatgctctgttacccatcaaaatttcaaccacgagttttagtatctagtgttgagtcttgcttggattattattagggttgacaagcggtgattctgatttaatcatttcttttatatttattagttgactttctactgtaagagctttcccttcatcccatgtattgtatcactgtggacaaatggattcttttttttttttcctttgtttgttttatgatggagtcttgctcagtctggctctgtcactctgaaccacgttggccaggctggtctcaaactcctgacctcaggtgatccgcccaccttggcctcccaaagtgctgcgtgagccaccactcctggcctggattcctattgtatttaaagtgacatcaatgtttactattagtaagtattttgatgctcaaattgtctcagatttggccagcaacagccccttcaagctggcacgtgtgaacttctgttactattttaggtttgtactttatctgccttgcctataatcaaccacttatccaaggagtctaggtactttttagtatttataaaccaagatctgcatgctacatatgctcactgctacaggaatatcattgattctacaccctcttagttgaaggaggtaggtaatagattatatacataaacacacacatagacctacacctgtctattctggctagtgctgtattaaaaatcacaagtttgggctgggcacagtagcccacgcctgtaatcccagcactttgggaggccgaggcaggtggatcacaaggtcaagggttcaagaccagcctggccaagataatgaaatcccgtctttactaaaaatacaaaaaaaaaaaaaattagctgggcatagtggcaggcacctataatcccagctacttgggaggctcaggcagagaatcgcttgaacccgagagacagaggttgcagtgagctgagatcatgccac

SEQ ID NO: 31506 - DNA, 1319 bp, Homo sapiens
gaactggaccacactgtaaaagggaagatgaggtagactgtagaaagattagaagcttatgggtgcatgtctaggatgactggttgagaagagggccccactgggggtcctaaatagtaagagaaaggagagcaatgaaggaggtaaaaactgaaaagaggatacagaagaaggaatggaagactgagctgaagagttttctttcccttttgattgcctcttctcattcctcatttcatagagctttgtgggacatgtatgtggtatgtgggcctaaaagacaagggatcatcctggacacacatgtgcatgtgtggggttacctacatgcaattacgttggagattggtagttatttaattcacatccatgtttgtcataaggccttttatgagctttttcttgaaatatgctctttaaacgctaggaaagtaacatttttttgttaatggagtcatttgttcattctttcttcaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttatttttttcatgactcctgtttcttctgtgagctatttgggttgtcctcccatcaagcaagatggatgcacacgcatgcaaaagagtgatatagatccagtccccatgcccaattacacatacggcatctgctagaaaggagcttggaagaaactgaatggttgattggggtccatgaatgaaggttacacaaagatctaattgtccttgaagtatattttctctcatttaatttgggaataataatctgatatggacactttactgtttagaaagcacctttcatgtatataatttcagttgacctcatggttagaaagcctttggtttgtttaggaacaaggactaccactggttctagaaaaggaatttagagttgcaaattatgtttgctcatc

SEQ ID NO: 31507 - DNA, 1286 bp, Homo sapiens
aggaccggtgccggtgaaccgttggcatcgccctcgccaggccgctccgcccgcgtcaatcacccggcttgcgcattgttgggggcggagttcggcgctccgagctctcgcgagacgctccgcagttgaaacgggatcgccatgcgctcgggcctggggggctgcctttccgggcatccgcaggccccaacctttagggaaggcgcacagtgtggatattcgccctgaggctgctgctttagcttgtgcaggggaggctaacgtgctgagacgggttgcaaagggctatgcgcttaaggtgcagttgaggtggcctggaaggggtgtctgactgcagtattcttgtcagcagagaacatggcggcccagagggaatggaccccgatggtgtcatcgaggtaagaaacggttgtggatcttgaagctttggaaaggtgagtgtgttcatctcatttatgcgtgcattattttttctaacttacagagcaactggaatgagattgttgataactttgatgatatgaatttaaaggagtctctccttcgtggcatctatgcttacggttttgagaagccttccgctattcagcagagagctattattccctgtattaaaggtaaaagaaactggcatttttaggaaattgttctacatagacatgaaccataaaagggaaagtaacctctgggggactagcacctgtttgtattccttaaagtgaaatgatggcaatcatctttcgggactgacctgaaatgaagagaatactcattgctgatcacttgattatttgggcataatgttccaaatggaatacatggtgtgaagtagaagtgacaatttgatgtgggatcggtaaatgtgtatcctactttttttagggtatgatgtgattgctcaagctcagtcaggtactggcaagacagccacatttgctatttccatcctgcaacagttggagattgagttcaaggagacccaagcactagtattggcccccaccagagaactggctcaacaggtattgatagtgtagttcaaaaaaactgcttgcgtgttgcataggtttcaggtttcacaactgtgaagaatttaaaacttagtataaattggtcctaccagatccctccttttaattgtccatgcatgcagggagtttttgttgaaagttttaaaagaactgggtatgcaggtatggtttgtagggttgtatactaatagattgagaatccgaagcgctctcttggatgtactagatctgtccccattttttaagtttgaatgc

SEQ ID NO: 31508 - DNA, 4090 bp, Homo sapiens
atcaaaatgtttgttttggatgaagcagatgaaatgttgagccgtggttttaaggatcaaatctatgagattttccaaaaactaaacacaagtattcaggtaagcattacttcacccccctcttaaaggtagagatggggtttatttaatgcaggtactgttacaatacaactgatgtgttttgttgtcgttccccctgcttaaagcacttgatgcataactctgtctaccttcattccgtagtaagacagagacgcttggcttcagacattttcctttgggtattaatgtgtaagttgtgctacaacataattttctctttttaaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggtaactgtctgattgttagacattattttaccttcttgtataagcactgtgctaaaattgcagacactaggaccatgtcttggtttttgcaataatgctagcagagtacacacaagaagaaaagtaacagcactagattgtaaagactggggtggacctctttcttaatgtccaatgtcctttgtcttaagatttggtgcaatatctcattagacctaacagaatgaagttaatttttataatttctacgttttgagactgggttatgagactggctaagactggccaattttggtattttgggtagagacagtttcactttcttgaaaccctggtctggttggaactctgggctctaagtgctaggatcccaaagggctgggattacaggcattagcactgtggctggcccagaatgaatttttaactgaagagttggaaaaactaaatgactgttaactttaacttctaaacattacaggaatggaagttggatacactttgtgacttgtacgagacactgaccattacacaggctgttatttttctcaatacgaggcgcaaggtggactggctgactgagaagatgcatgccagagacttcacagtttctgctctggtaagaggtgttctaaaatgtctggatttccactaaagcaggattcagactacaatatagctgctaagtgctgtgttgtcgttccccctgcttaaaataaagttgtttcttaactatacctgtctgctattctcctgtagcagccagggacgcttggtctcatacatgttgattaaaattaaataccgacctgactggtgattcttgaattaaggtttattaatttgcagcatggtgacatggaccagaaggagagagatgttatcatgagggaattccggtcagggtcaagtcgtgttctgatcactactgacttgttggtaagtctcttaatgctttttaaaaatctaccaaaagttagctttttggggggcaggtttttaagtaacctttgccaacttgggctatttggaagagtaaaagaccacactccacagtgggctataccacttagtatagttcgctactattttgtggcctacatgacaggtgtcaagtttttttgaatcaatttttaaaacatgccattgtgtttcaggctcgcgggattgatgtgcaacaagtgtctttggttataaattatgatctacctaccaatcgtgaaaactatattcacaggtgagaagccagcatcttggctgtattgaaaaaaattcatacgtttttctactgtgatttgtatgaaaggtaacatcaaatcaaggaatagattcagtaaagtcagtagtgttcagtaagatgatgtaattaaatttgtactagggaaggttgatgagaacaaagtgggaaaacttgtaaacattgcccagattgtggacatagggtttttttccacaattgttggtcttaccttatgcttgagcttttagtgatgttcttgtgtccatgtgtttttcttggtgattttttctatagttgggattttcttggtgtcgcctggtagcaatttgagtgaaccctggtttagttatagtggctttatccctaaataaattgaattgtactttgttatatgatgtaaaaaaagactttttaaaaaatacaggagtcgatagcagcagttggtgacgagatggcactcagaaacggcgttgacgtaatttaggacgtggaatcataagcgaaacagcacactgtttgaataaagagcgagtcggtatttatatttgtttttcttttgtcatgattatttgatttttaagttgctccagctaaggcatttttttgtattagtatttctattagggaacctttcttattaggtggtttgtattgtctggtttctaacatgcaggtagctgtttggcagttaaacacgtttagagtaatttgagttacaacgtgtgaaactgagcaaaaaagcagtgataagtttgggttaccataccaaatatttgttttcccactggaaaaaagtaagttttagaaaatagttaacctttgcagcatttgtttacagtttacagttccagaagtgcgtcgaaatggattacataactgctcttttattcctggtgttcacatctgtcccaggctgacacctgctcttggctggcccactttggtatgggctttaatttcactaccccaaacacgatactgtcatctgctttataataatgctcaagatgcctgataaaaatctcattttgcagccagacaagccttgaatccttttggcactaactgcaaaggaagatttttttctctagatatgcattagcagctagtgctccagttagaagcacgaactataaccttgataagtaaacagcagctggtggttaacaagtggatcgtcatgttcagtagtttatacattatgtgagaagtaacgttctgattctttttcttacacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcactttaaaggtgcttttggtcattttatttttattacaacttcattatttacaaaaccccccatccagatatattcacgttaacaattctgagataactgctgcatcacagttgcacaaaggctgatgagttgcaaatgttcatcagcaccatctgctaggcatttgtcaacttcctacgagaaaaatttaagaaattagcatccttcaggtagttaaatgttccattgacatgtgcaaagtacctacttacggcaagtttttctgtgataatagacttctgtttatcagataagttattttctacaaccacatcatggagttgattgacgagctgagttgctgcatgaccctcatctattaaatcctataataa

SEQ ID NO: 31509 - DNA, 1050 bp, Homo sapiens
ttagatctttgctgttgtgaatagtgctgcagtgaacatatgcgcgcatgtgtctttatggtagaacaatttatattccttcgggtatttactcagtaatgggattgctgggtcaatggtagttctatttttagtttttcgagcaatccccacactgctttctacaatggttgaactaatttacactcccaccaacagtgtatcagcattgccttttctttgcaaccttgccagcatctgttactttttgactttctgataatatccattctgactggtgtgagaccagcttttaaagtggtagggaatgttagtgggagaatgaccccgtagggtaagctcatgtgctcagattagaagacctcacctgtcacaaagaggtgtaaagcaaggcctgccaaactatcaagggaggctttgagcagttgtgaagtttgtgtgactctaaggtgactagaactagtaaaaaaaaaaagaaaaaaacccagaaccttcacacataagtgagtaatatctcaagtcattctatttatgtattctgtatttaccgacaaacaggtggtgggagtggagggggtcttgtgcttagcctgggattacaaagagcatggagacccacccattctttgtccgagggaagtccagcctagctccaccacccttgcttaaaacacttttggctctcccttagaaattgccctcaggagctcagagaaaattgatctaatttgtctcagtattgacctctggggtccccttctcttcatgaataaagggaagagcaggtggtaaatgacagaatacaagagggaaggcttcagagaaaatctggccctccataaatatgaggacatggttgcattaaaaatatacaggaataattcattaatgaaattcacagtaattgttctggaccattagattcctgagaatttagacagggaattagttgctctgatgtagtatcagtgatttgttccataagaactgaattagaggcaaatgaattttttcttgcttgtctgcagaaaactatacgatggcagtctg

SEQ ID NO: 31510 - DNA, 1055 bp, Homo sapiens
agtctgtgactatggggcaagaagcagaaaggtgcaaactagaactaaaggggtgggacaagttatagacaatgtagtgaagtagttttcacctgctctgaaaaggtggaataagatggaagccatcaaaggaggcttaagccttgtttcccttggatcttggcaactctctccctgttctgtccttggcttcagctccctttgaccttgtattcttaaattatttccacaggaataaataccttacgtacactttagatgatcaggaaatctggcacctggaaaagaactgcatgtcccaggaggatggttgtaagttttttcattgcagtctttgtaaatctgcatccgtctgttggttgatggagttttccttagtacagtgccgagcttccagctttaattttaggaatgctgtaccctttacaacctctcgatggtcctctgtgctggaatcgagggcacccaccgtgtttaaggctgatccctttctttcctgcaagtgaagaagaatgttttgacttaagtcttaaccaagtctggtgaaggaaacgtggcaaaatttaccatcttctgggcttttgctgtgtgcctggccctgattaggcatgttgtgtgttctctcatccaatcatcacaggaagatctgctgtgtcggtatcattagctccattttgcaaataagaaaaccaagcttcagaaagggctagaaactcatctaaagtttcaggtgcccaccactacgcccagctaatttttgtatttttagtagagatgaggtttcgccgtgttggccaggctggtctcaaactgctcacctcaggtgatccaccgacctcggcctcccaaagtgctgggatcacaggtgtgagccactgtgccgggactgcagtgctcatttttagaacatagatccaaataatccccatagtctgttgcttccagagcttagttgaaggcagatatgcacatattaattacaatatagtgtgataaatattatgatttgggtgtgcacagatgatgggaagaagatccagtaagtttgggaaaga

SEQ ID NO: 31511 - DNA, 1042 bp, Homo sapiens
aaacgggacatgtgccttacccaagttcagtcagcgaagagtgtccattcactcattcagcattcaatcgactttttaaatgaacacctactgtgtgcttgcctctgtgctgggcactgtgaacacatgagccatggcgcttgacctcctgtagcatgtgagctaaagagagagagacaaatgctaattaaatagtaacacaatcaaatgtgaaaccgtgaattgtgggggttgctgtggaggaagctctgtggtgttgcgtgaatgaaccacagcctgggaagccagtggatagatacttcctcgggaaagtgatttcatcctggggtttgactctctagctttgggccactggagaggccagtgtggaagattcagtaggatcagtccactttatgctatatcctgactataggctgaccaggcgcctggccaccccagggccctcaccccgcctccaacagcctagaccgttccttgagattacccatatccaaccatccacaggtgctgccgatactgcaggaaccgactgagcttggatcccacaccttacagacccggagcatcttttctgttgtttatttttgggttagctcataactcactttatcactcagccgaacagtgagccaccatggaccatggtggttttgatcatcatacagatatttaaagacaactttattgaggtacagtttatattccatgaaatcaacccatgttaagtatacaattcagtgattttttttagtaaacttactgagctgtgcagttgtcaccacaatccagttatagaacatttccgtcattagtggggtcagctttagatgcaaaagacaggagaattatttttgtttttatgggattagttctgtgctcccagcaggaagatctcattaattaattaattaattcaattagtatttactgagagcctggttggggggggggcgcccacagcagggttgggtgcaaagggaaataaataaataaacaagtggtgggggctgcttcactgtggctgatgagcttccactgt

SEQ ID NO: 31512 - DNA, 1027 bp, Homo sapiens
gaacccgggaggcagaggttgcagtgaatcaagatcatgctactgcactccaacctgggcgacagagcgagactctgtctcaaaaaaaaaaaaaaaaaaaaaccttcccatgagaggttcctaccctatgccctgggggaagaaatgctgacgtcaaggaagcttctataaaaacccaagaggacagggttgggtgaactttctgatagcttaataggaggaggttcctgtagggcggcacaaccagggagggcgtggaagctctgcatcccttctcccataccttgctctacacatctcttcatctgtatcctctgcagcatccttgatgataaaccagtaaatgtaagtagggtgtttccctgagttctgtgagccgctccagcaaattaattgaacccacggagaggggaaccccaatggaagctggttggtcagaaagaagttctggaggcctggacttgtgactggtggaggggggatgtcttggacactaagccctcaatctgtaggatctgacactatttccaggtagatagtgttggaactgaattagaggacaccaagctggtgtcgctgcttggtgttggggtgggacccccacacatatggtcacataagtcatcttctgtgttgattgttgtggtgtgagagcagaggaaagatggctacagagagttttccctacacagggacttggggggtagagggttaggggagggctgaggggccttacaagtcttaagtgcgttttagggattctttagctaacagtagctgagagagtcaagttattgtctagtgacttgaagtcagtaggaaggaatgcctgagtaagataaggaggttgtgggggcctaggtccttggagcctcatagatagcagccctctgggtgaatagatagtgattgtctcttctcagacctttgggtgtctgactctcagttagaatctctcctagatctgggaaaggcctagcaagggaagagacattaatatcgattctctggagatgcacgtttcccc

SEQ ID NO: 31513 - DNA, 1029 bp, Homo sapiens
ttctccttgagaactgaaacaagacaaggatgcccactctcaccacttctattcaacatagtattggaagtgctgtccagagcaatcaaacaagaaaaagaaataaaaggcatccaaataggaaaagaagtcaaactgtctctctttgctgacaatatgattctatacctagaaaactataaagacactgccaaaaggcttctggaactaataaacaacttcagcaaagtttcaggatacaaaaccagtgtataaaaattcatggcatttccataaccagtaattttcaagctgagagtcaaatcaacaacacaatctcatttataatagtcgcaacaaaattttaaatacctaggaatacatctaatcaaataagtgaaatatctctccaaggagaactacaaaactttgctgaaagaagtcatggatgacacaaactaatggaaaaacatttcgtgttcatggattaaaagaatcaatatcattaaaacagccacactgcccaaagcaatctgtagattcaacactgttcctatcaaactaccaatgtcatttttcacagaactagaaaaaacctatcctaaaattcatgtgtaaccaaaaaagagtacaaataactaaagcaatcctaagcaaaaagaacaaactcagaggcattccagtacctgacttagaactgcactgtaaggctacagtaaccaaaacagcatggtactggtaccaaaacagacacatagactaatggagcagaatagtgaacccagaaataaagccacatacctataatcatctgatctttaacacagtcaacaaaaataagcaacgggggaaagaactccctattcaataaatgatgctggaataactggctagccatatgcagaagaatgaaactagatcccttccttataccatatacaaaaattaactcaagatcaattaaagatttaaatgtgagacctcaaactataagaatcctggaagaaaacctaggaaacaccattctggacatcaaccttgggaaaggat

SEQ ID NO: 31514 - DNA, 1089 bp, Homo sapiens
tggcatgatcagatttgcattttgtaaccatcactggctttcatctgagcagaggggctgcagtagatgaagacacatagttaggaaggtcttacaagtagtctgggttagatacgctgatagcttgcacaagagtaggggtgaaggtgaatgtgagaaaagaatgtatttaagggctgcttgcgatttgcagtcaacaggttttaatgtcgcattagatgtgagaagtaaagggagaggggccaaaggtgcagctcagtttctttcttgtgtaacttggcagctagaagttgaaattagaagtcagccccttatccatggtttcactctctgcagtttcatttatttgtggtcagctgcaggctggaaatactaaatgaaaaattccagaaataagcaattcagaagttttaaatgacacgttgttctgagtagtgggatgaaatcttacacatcttactttgtcccttcctcatcacaggaagaaggatgggtacagtacaataaaatattgaataaataagcaaattcaataaagtagcaggatccgaagtcaacacccaaaaaatattcattttttctattatgtgcaataacaatgaatgatctagaaaggaaatttaaaaaacaattccatttacaatagaatagcataaaaaagcataaaatacttaggaatgaatttaaccaaggagttgaaagacttatacaatgaaaactacaaaatagttctgaaagaaattaaaggagacacaaaaacctggaagacatcccatgttcacagattgaaaaaagtattgttaagatgtcaataataccgaatatgatatgcagatttaatgcaatcgttgtgaaaatccaaaagatatttctttttttgcagaaatagaaaaagctatcctaaaatttatatgaaacctcaagggaccccgattaaccaaacaatcctgaaaaataagaataaagctggagttctctcacttcttgatttcaaaaaatacatatgttacaataatcgagagagtgaggtacaaagacaaacatataaaccattggaatagaataaaagtccagaaataaagtcttgta

SEQ ID NO: 31515 - DNA, 1034 bp, Homo sapiens
aaggtaagatgatgactctcatacagatattaaaaatgaattcatcatgaagattttattttactcgtatgatggaaccaggcagatattacaactggttcaaaggaaaagtcaaagcaacacaaatttggagtaaaggagttgaactagtttttctgtgagataaggcagggggaggggagaaatcaattgaaactctcctgggcagcatcctgcccagtaggcacatgtattagttgcctacaattcacaaagggttgcgaaatagctcccgtggaatcagaatctgacagggaggaagagtgtgctcagaaaatgcatggctttctactgaagcagatttttttcccattacacttctagatctctgtgcaccattgtgccagggctgcgaggaaggtggcccacttcccgggatacactacccaccctcaagagagcctttcctgctgcttcttaggcaagtcagctctcttttctcacctcctgtaagcaacactaagtatctggctgttcctttcgtactcgagtcctggccgctccatgacagcacttgtggtggtactgaactgtgatggacactttctatcattgccctttcttaccttgatatcctaaaaagctggtggtctgtcttctctatcttttgtcctggtcagttatcctaactattttgtgtctgtttctgtggattagtaaacggggtccccacccccactccacaaggagaacatctggcacccagaagtcactgagagaatagctgttgctttggtagaattctgcctctgagtggcttgttcttttcccagacggagaggtctcctgacagcagctctcttctttttctttttttttttttttgagacagagttttgctcttgcgctcaggctggagtgcagtggtgcactctcggctccctgctctgcctcctgggttcaagtgattcccctgcctcggtctcccaagtagctgagattacaggcatgcaccaccatgcccagctaattttttgtatttttagtagagacag

SEQ ID NO: 31516 - DNA, 1024 bp, Homo sapiens
cgtcaggctaggaggcgcccccagatctcaccagcccttttacgcaccattagcctcgcaaaatcaatcacagaagacaggggaggtgacaagatctaaagtggcttacttaaaaaaaaaaaaatactgcacacgcacaggcacacacaattccacatgccccacgatttatacaatcttttattttcactcagtgctatgagcatacacattccacaatttcactcccacacatgcacactcaattacacacaaacagaggctcaaacactcagctcttaaagagcaaatacactatcacccttaaatgcacacaaatgtacccagacaactccatctgtcatcatactctaacattttaggaaggcccaacaagcaacagggcatgtgtatggtaggtggagatcagaatcattcctctaataacagatttgagaatgaaatatggacagtagaaggactgagccctctttatttcctccattatctcataaaaagccttgaagatgtaacggggctctaaaagaacttcacttttctctacaatgggggagaaggtacctctggctcaccctccctccctctttctcagcaactgagacttctgatctacctgcctttctattgtgaccatatatatgtatgagtgtgtgtatatgtacgggagggaaagagagagagagagattgaaatggacttcattttggtgctgagaaatttagagctggaaggcaatctaagaaattattcaataaacctcagaatttgaatcagtaaggcagagtaatggtcagtaaattgttctccttcacatactgcacactttgagcaaaaccagacctccacattccaaagccagtgttccttctactgagctctgagttttctaacagattcctggccggtaagcatagttttatgtcaggaagccccagtttagacatataaggtctaggaactcccagaacatatgtgaccactattgtatatctatatgtggaaaggatcaaaagattcttggtta

SEQ ID NO: 31517 - DNA, 1960 bp, Homo sapiens
aactggatcatcacccttattcactggaattgtttctcggtgactttgggaaaaaccagattcattcttaaaactcaaagaggaattcccattgagaatatgctacaagatctacaactgcttctacacgtggtatataaggaagggtttgaggaatggcaggttgttagaatgaatggactgctgggaagaaatacatagtgatgggaagcatggtaattgatgtattgaagatgctgcatcattgttggtcaccctgcaccatggtattactataaaacttcatcaggctagcaacatttactctatggttatggatgaaatctgcatcacataattacacaaaaataggatccttgtctttgaaaagcttaacaattcatagatgaacactgatcatactaaaagaatatgtacctgttgccctatggaaaagacctaagcttaatgactcacagtctaattattttggttagtgggtgataatgtattggaggtgatgatgagacacatacatccaaaatctcacagcttggagaggatgtggtccaacagtgctattttatttatttatttatttgagacagggtcccactctgtcacccaggctggaatgcactggcatgactgaggctcactgaagcctcaaccacctcaggctcagtttgtcttcccacctcagcttcctgagtagctgagactacaagcatgtgccatcatgcccagctaagttttgtattttttaatagtgacagggtttcaccatgtttcccaggctggtctcaaactcctgagctcaagtgagcctcctaccttggcctcccaaagcactggcattacaggcatgagccaccgcactaggcccataaggaagagtttctgagatgtgcgagagtgataggcaggccagggccctctctcaggatataattggggccacgctgtggtttctgatatttgaggaatttggaattctgatttatttttgcctaagacacctcattctctggaatacaaattccacatctataaaatgatagggttgtatctgatggcctgggctttgtaaacccttctgttctgagttccataactctgtgattctgggttctgtcccaagtccaagatgatttgaaaagaataaaaaaaaaagaccttgctgaatcagtaccagcgtcacctgcttcagtctggctgggaagtaggtcagaacttggcagacacgagaatgtggttggctccaactgtgagctctgccagggtcctttgtagacacctgccttagaaagggtctgtgaaagaggggggtgctgacactcggaggtggggaagggtttatttttggctgtagatgctgcaagcgaagaggggtgattgatgagaggaggtattgggggacagggaatgaaagactgaaagaaggagaggagcaggcacgtattgggtgcataacttgtgtggagaaatggccaatattttttttactcctcccacacacactgtaacgtaggtggtaggtgtcattctgtggattttttttttttttttttgagatgaagtttcgctctgtcacccaggctggagtgcagtggcatgatcttgactcactgtaacctctgcctcctgggttcaagcaattctccctgcctcagcatcccgagtagctgggattataggcatgggccaccatgcctggctaagttttgtatttttttagtagagacggggtttcaccgtgttggtcaggctggtcttgaactcctgacctcatgtgatccgcccgcctcggcctcccaaagtgctgggattacaggcctgagccaccgtgcctggcccattctttggattttaattatgaggagattgaggcttggagatgtttaggtacctgtccagctaggctgctggtaagtgagggagaaggagtcaatgtggggtctgactccatgtcgcctcttcc

SEQ ID NO: 31518 - DNA, 1011 bp, Homo sapiens
gcagtttgtgtgtaacataatgaatggatctaattttacttttttccaaatggttatctgctgtctcaacaccatttagtatgaaaatatcttctcatacttcccgtgtgatttgagattggtggttactttttaacctacaccatgactaggtgtgaaggagaatgatggtaaacagtggaacagggtagttagaggaaaatgaggtcccaggtagataatgactgaaacccaataagaacatacatatttttgacttcaacacagagctctttaccttttacaagtcatcctctctggtccatttttgtcaaaaattaacgtatttaatagagaaggtgtttaaaacaaaaggagggtttagagattatctgtgctttccctcccctcagtaaaacctgtaatgccccttcttccccaaataaattatgagaatggggctgcataaattttctgtgagcatgtgtgactatgtttcctctggttcctcgccgcatggtaattactctgtgctctctcctgcaaactgcccatgtttcactgcttgtaggtcaaagctgtattgagtaagaagtgaatttgggaagttttgcaagtaaagtgctacctgagtcagtgactgtgtcttaattcacctttttgcttccaggttcttgctcagggccatctgtgcacatggttttcactcaataagtgcctcatgaattttaatgactacacattaaactaaaacaaggtctgcccacctattcttaagaaattaaactctacaaatgatgtattccaaaactgcaaaagagagtgaaagccaaaacagatgaagctgtccttatatgggcaggaaaaactcagtaagattttatcagttcagtaggtgttgcatatggtgatttggaactgtctgccagttccaagatggccttactttattgtatggtcagtacagtttgtatctagtcctcatcaggttaggcctggaactccccaacccctgttaaaaacagcaaatca

SEQ ID NO: 31519 - DNA, 1035 bp, Homo sapiens
ggtggtggttgtttacatgtctttaaatgaccttcttttttttttaatataaaggcaatatattctcatagaaaattcagaaactgtaaacagggttaaagaagaaaataaaaatcaacactatcactttcacctatttattattcttattttatttatttatttatttatttttaaggcagagtctctttctgtcacccaggcagtggcacgatctcggctgactgcaacccctgcctcccaggttcaagcgattctcctgccttagcctcccaagtagctaggattacaggcatgcaccaccaccaagtccggctaatttttgtatttttggtagagacagggtttcaccatgttggccagactggtcttgaactcttgacctcaagtgatccgcctgccttggcctcacaaagtgctgggattagaggcgtgagccactgtgcctggccacttccacctattattaatgaaacctgtcctatttaacaaaaacgataatgtggggtgtcttgtgcttggagcttggagaaaggaatttgcctctgtttttttaatgacttatggcaaggccagtatgaccagtaagtgggctgtttattattattattattattaatcaccattgtcactgatagaaattgtcactattgtcactgatagaaaccaagatagaaattgtcactattgctatagccccaagaaggacctcatggctgcataacgattgagcaccttatatttacacaatgcttggttgttgttttttaaggcaactgtgactcaacaacagctgtttgagaacagctccatcccagatgaaatcagaggaaccgaagtttaaaaagaaagtgtttctgggctgggcgcggtggttcacgcctgtaatcccagcactttgggaggctgaggcgggcagatggtttgaggtcaggagtttgagagcagcctgaccaacttggtgaaaccctgtctctactaaaaatacaaaaaaattagcagggcgtggtggtgcatgcctgtagtcccagctac

SEQ ID NO: 31520 - DNA, 1024 bp, Homo sapiens
tcggctctctcccaggctggtgggaagaggacacatctagaagccagggtatataccccgaaggggtttgaggcagtgcagagttgatgatgatggtctccagcctgcctttcctttacaaaaatgaggagactgcatctcacattgccaacgagctgcttgactctaccgatattccctaccaagcacgattatgggtagtcttaaaattcttaataataaaatagatattgaaaatagtgtttttttttttaacagtgaaagtaatatgtactcatgtataggttttcaatatacaggaaactataaaatgaaaaggattgtacctgtaatcccaccccttacagctaactactgtgacattttatttgtagaagtccattttgctatcagacctcaagttttaaaatcttaactcaccctctgtaacctagttctcagctctattttatgtaacgtttttaaaggattcaagatttaaaataaacttatctcaccccaaatgcacttgtatatttttgacaccccctcatctctctctctctcttgtctctctctcttctctgtctctcactctatctcagttctctttctcctcttctttctctctctcctctctcctctctctgtctttctctctctgtctcacacacacacacggggaaaaaaaatcactcgagttaagaatcagtctctcattttacagataggaaaactgaaatctagaacttgtctgaaatcatgttaaaaaaaaaaaagtggtaatctgtgctcgaacccaggtctcctgaattttcgttcagtgctttttccattctacagtgatgcctccttactaggtcatagaaacagtggcagagggagaaaaggaaaaatacgtcagctccaaagagtgcagtttttttttttctgtgtcctttagctgagctatttttgtgactattcagtacatgtacaatgctgcctcttggagtgttccggctagactaagaggccattcactgctgactgcagccatgccatc

SEQ ID NO: 31521 - DNA, 1032 bp, Homo sapiens
ctttgttgagatggggtctcactatgttgcctaggctggctttgaattcctaagctcaagtggtcagcctgactcgacctcccaaagtgctgggattacaggcatgagccactgtttctggcctcctttttaatattctgccctgtgcaaagcaccagcaccaacagcctccctcccacaacccccaacagctgtgcattaagtatcactttggtttgaggatttcctagcttgctgtttatcctgggagaatttctgagtttcttggtctttgtttctttacccaaaagttggggatagttcagctttgtctgcattgtggacactacctccagaaagcaatgggaagaccctttgtaagctgtaccgaactctttgtatttttggagcacattttgtcttttttctcccttcttctggtggctgaggtacctctttggtcttgaaaagacccacttatatggaggcggaaatgggcttatagagggaagtgactttccaagggccctggaatgaattggattctgagatctgtgcccgtccttgtcacaacgtgtcagattccattatttagtgtgggcctgatttgtccatgcctgggactttcccagaggaagtcatactttctggaaactctctgaggtcttgaaggggtgggagaagtctctgacacaagtgctgctgtggtcatggaggcttccattcctctctccttgtgttgagcagggaattgctccttggatattttaggtttgagtgactcaacatgcttatgacccagaggatgctgtggtgtgtttggcagcatgctggaattagtcagaaggcaaaactgcttgtcctgaccccagaacccacttactctaggtggatgagaaagtcctctcggatcctctatttcctaattcatggcaacttctggagaacagtattttctctgttactgctttatggggtttagtgtggaaattaaagaagagaacttcttattttttgtaaataataatacaatattcagatactgttagtttc

SEQ ID NO: 31522 - DNA, 1055 bp, Homo sapiens
ccaagagcatcagcaagtttagtttagaacataggagttgtatttacacagctactaatgaccttggaaaagttcttggcttctctgtccttgacctttgtttatctgaacgagtaaacttcagatgacagagtgtgtggggaatggaatgcatccgcatccttgataagctgccctagtggaatgttgccatgtggctactgagggtcaattcactggtcaaaggtggcctgctggttggtattttttctgtgtcttccgggcaagttctgtctttcctcagtctgcacatgcctgggtctgtcctcagagctctctcccatttccctcttctctagaaagcattgatataatggggccacctcttccttggactgtttctgtagcatcagaaggaggtgggtgggaatttggcataccactttttgaaaggtaatacattctaacatatgtatttcacccaccttcaaagagtaagaatacactgaatgatacttaattttaaagatgtgttgctgaggtgaactctaagacgaacaattcttcagaatcttttactttcttgggcttcttgtcccaaacaacaattatctttataaagcctgtgtgtgtatgtgtgcgtgtgtgtttgtgaaacttcctggaattggtagtgttgattttgagatgtttctttggcttattcaaaatataaacagaaaggctaaagtgtttttcatgtcattaagaatgtctttataagaaaggacattggccgggcgtggtggctctcgcctgtaatcccagcactttggcaggcccaggcgggtggatcacgaggtcaggagatcgagaccatcctggctaacacggtgaaaccccatctctactaaaaatagaaagaaaaaaaaattagccgggcatggtggtgggcgcctgtagtcccagctactcgggaggctgaggcaggataatggtgtgaacccaggaggcggagcttgcagtgagctgagatcatgccactgcactccagcctgggcgacagagcgagactctgtctcaaaaaaaaaaaaaaa

SEQ ID NO: 31523 - DNA, 1027 bp, Homo sapiens
agtgagattatttgaaaattctgtgtgtgtgtgtgtgtgatcgagaccatcctgaccaaaatagtgaaatctcgtctctaatgaaaatacaaaaattagctgggcatggtgtcatgcgcctgtaatcccagctactcgggaggctgaggcaggaggatcgcttgaacccgggaggcagagtttgcagtgagtgagattgcgcccctgactccagcctggcgacagagagagactccatctcaaaataaacaaacaaacaaacaaggaagcttttcttttttctttattttgaaatagtttgataacatttacatgggttatttctttaaaatatggtagaattcccttgtgaaaataccttcacttattgccttttttggagtgaagaacggagtgaagaaagttatttctttaaaatatggtagaattcccttgtgaaaataccttcacttattgccttttttggagtgaagaatgtgtttgctctttaaaattttttacattttttttctgtagtaattggactaattagcttttatatctattctgtgattacctttgttaaattatagtttttttagggaagtcacctatttcaaattcatttgcatggtgtaaaataatttctcatgattgttttcatttcctctgtatttatggttatatttcacattattatttaaagttttatggatttctgctatgtgtatccatctttctggctaaagcatcagagtttaatttattatttatttaaaaaatagcttttgcatttatgtgttggctctaccactttgtaattctttattttctctttaaaatcttcaataataccttctactttttctaggtttattttgttgtttttctcattgtttgaacttggctcttaatttccatatttttatttctgcttttttattcatataaataagatataaattttcctgtaagagatgcttatttgtatgccttaagttttgctaaatagtgtttttaatcttattttttagttatttgactatgc

SEQ ID NO: 31524 - DNA, 1034 bp, Homo sapiens
gcatcttcacagatgagggcctctttctcacatcttcactccaaacacattactgtgtagacagccacttattttctgggaagaaaactttgcaaagcagtagcagaataaagtcgagggtaaacagaggccatggaaaagcactagagtttgagtgcagagacatgagtctgagcatgagcagtgaatagctcatgaaacactcaagttgcattctccttatgtggaaataaaataagtcatggttgttctatgcacgtggcacctgaccttgggtccttattgctatgctgctagagtctatgaatcaagatttgccagttgtgatcttgaaatttagtcagattaaaagggaactctgactttgagggtgaatgccccaagtgggcatcttattctcctatggattcagcttgttaggcagaatggaagtggaggtcatagattttagggttttctcctgggattgaatccagctgaagcaggaatgattctgggtgagctatataacgtctctgagcattagtttgtcattttcttacataggaatagagttattgccagatttggagatagtacatgttgcaatgtggttgacacagaataagctttcaataaatgattggtattgttgttgttgtcgttattatctataactacaataatttccctagccttattttatagggataggttgtggcaacatgaaatgtgacttggaaaactgatttgcactagatagatagaaaccatgtttttctatctatataatgaacaatgtcatttaagaaagcttagaggcaattccaccagcaccatcttcttttttatttccattcctagattatttgccctcaagtctttggtaatttctttttgccacatctcttgaatgtttcttctttactatattccatctattattaccataagtccaacgttcatcacctcctgctccactgttgttcctgtctcctggctctcctagagccttggttctcaaagtgtcattcacagagcagcagcatcacccg

SEQ ID NO: 31525 - DNA, 1048 bp, Homo sapiens
cacttacaaaatatcaagtattttgagttagctttacactggttcaataacacttagaatttttgttcataatactaagataatcatcttagggatggttacattttgttgtgaggtgtggtggaaaattcaaaggacaccatggtttgtgaaaaacccattgcagctgatctctgcacttttcatttccatgtcattccattttcttctgctttttctttaccccctgttattttcttgcttctctctctttattatcttaccttcatttactccatcctgtttttctccaaaatatagttgcttctgtaaaattgcttctgagggtgagcatatttttgaggggagagaggatggatggtttgacaaaggatgcagacatgtcaggttctgggtcagcagttagttataaaatacacagaggcagccaaggataactggcttcattaccaaaaggctagagtgggatttgtcagttgtcccagatgtctgtatggaattatggaaaactccattgcattatgaaacactcaggagctactcaggacacatgccactcaatccacgtgaagagggctggtgaacttcttagctagaaagacttcagctttcctattgcttaaaatgagactgattggtgaaggatttgtattagtccattctcacgctgctataaagaactgccagagaccacgtaatttataaagaaagaggtttaattgactcacagttccacattgctggggaggcctcaggaaacttataatcatggtgaaaggcaaaggaggaacaggcaccttcttcacagggcggcaggaaagagtgactgccagcaggagaaatgccagatgcttataaaactatcagatctcgtgagactcactcactatcatgagaacagcatgggggaaattgcccccatgatcggattacttctacctggtatcacccttgactcatggggtttacaattcaagatgacattttcggtgtggacacagtcaaactgtatcacactcttcacaaaacttcactggtacagacttgc

SEQ ID NO: 31526 - DNA, 1028 bp, Homo sapiens
acagagtgcatagagagaaggctgggagaggaggtcaggtcttgtttccctgcttgttgatgttccagctgcatgcacggcactgagccctgcctgagtgcgcacttcagtcctgaaagctgcagagggatgggctggtgacactgccgtgcctaggagtgggcagagaaggtgaagacacggagagtaactcagtgcagaggcagcgacgggaaagtgaaggagagtaagaagcccagagtaaatggccaaggtgccactaacatgtccatccacagaaacttttctgggggagaatgtttcttatcagattccgcagatgggttccttgagaagtgagtgcttaaaggggctgggatagataatcataatgccatgttctcactgctctgaacccttttctgacctcacgtaagacctcacctaaaacttccacaagagccgttcattgtcagtaccatgctttttttggagtactgtataatgtcaagtatttttccaatagtttatatgtgaaatgtggtctccgccacaagattacagggtcctcgggagcagaaattgtgacttaaatgggcctttctcccttccactttttattcttgccctaccttttaatcaggcacctggaagagatctaaacacaggatgagcatccagtaagtttttgttgagttgaacttagttggattcggatgacctctaaaaaatgtttactaattgctggtgaaaattggcaaatgattattttgtggaaaaatgttctcaccgaattagattttgttaagaattcttatgtgtgattatttttcataaacccaatacactgtctattattatccttattttacaatgaagaaaaaaaattcaattgactgctcaaatttacctctaggaacaggtgatggagatttgatttgcatttagatcttttgtctccaaatattgtaatgttacttctgctttcccccactacataccgaagaggtcttacttcattgacagtggttcagccttctgctgaggag

SEQ ID NO: 31527 - DNA, 1031 bp, Homo sapiens
catccacttcttaagcctggtaaacacttttattagataagagagacagttttgcataaatgaacaaaaatctagatgaaaagttctcgaatcctgaatcacatcttgccataacctcttactagccgtgtgttcttggacatcttatggactggagtttccttgtctctaaaataattattccatttccttgtactgcagaagctcatgaaaaaggtcaaatgagatagcgggtgtataaagtgctacacaaatgcaatgatgctaatagtaaattattgttgatgttttctttgtttctgtacagttgactcatttgctttatcattaatgatgaggcatgaaagaaatgctgcttgtttttaatgaactatggaagactaggtggagctgacgggatgttgggatttcaggaaagctcttttaggtttctggaaatgatactcataccaatagttgtgagcttaggttgaagagcaatgttgtatttatactataatttttcttcaaataaactgtgataaagattttgaatattactttcatattctgaacttctcatgtacacttgaaaagagtcatgaaatagtagtagcggttgccatttataggggtcgtagggtgttgttatggttaaatttataaatccttaaaattatgatttctatcacaaaaatgcctaaaagggtgcattctctaggttttttccttctttcattcccttccttccctcccctccctccctccttcccctccctcccttccttccttccctctcctttcctttcttctcctttccttttccttttccctctcctctcctctcctctcctctcctctcctcccctctcctctcctctcctctcctctcctttcatttttcctttcctttctctcgctctgttgctcaggctacagtgcagtggcacaatctcggctcactgcaacctccacctcccgggtccaagcgattctcatgcctcagcctcccaagtagctgggattacaggcgccctgccaccacaccagga

SEQ ID NO: 31528 - DNA, 1030 bp, Homo sapiens
ttatttcggctcactgcaacctccgcttcccgggttcaagtgattctcagcctcagcctcccgtatagctggattacaggcatgcactaccatgcttgactaattttgtatttttagtagagatggcgtttctccacattggtcaggctggtcttgaactcctgacctcaggtgatctgccagcctcggcttcccaaagggctgggattacaggcgtgagccaccgcacctggccctcatttatgttttcaatgtttccctttgtcagcttactaggggcattgttattttgtctcctaacttttggggaaagcttcagtggacctctctctaatctgaacagaatacagacatggccagttatagagcagaaggcaaaggtgtgaggaagtctttgtaggtatgagagttcttataggcctgagcgttatggtgagggcaggtcctatattaagtgggctcataaatggcatatatgagataggtagaagagaagcatataatggcctcgctttagactcctttactgtgaatttgacatgccctccttgtactatgtgtggttcacccactgtcttactctctaggaacactgaagtgatttgtttgcgtgccctgcagcacagtccttggtcccctctcaacatgccaccccacacgtttttgttacctgaaaattctatttgtatcactttctccaaaatggctaggtgcagcctaggtcagaattaatcgctccctttcccgagtttccacatcttattctttgacttatccaaatttctaccacttttgttattgctcctgcttacattctgtcccatattgaacatgtagtatatgccaggctctatgctttctctttattattttattgccttcttatgtaaccctacaaaatgtttttttttttttcttataaagaaatggaagcttaaaggaggtgacattctctatgatttgcttggagtatgtttctgaactaaggctgctgtccatatccagcatgcggtactgcctgtccttctat

SEQ ID NO: 31529 - DNA, 1099 bp, Homo sapiens
tttgatgggcagatgtttcagtgaagtctggtacagccatacaatggaataataccattcagcagtaaaaaagaatgaagtattgttggtatatgcaataacctggacatgcttaatgaaaaaactgtctcgaaaggttacatgtattatatgatttcattttaagacaaagctctagagataaaggacatattcatgattgctaggggacagaaatgggtgggtcgggggggggcaagtactggtcattcctacaaagaggacgcagcaagagtctttgtatgggtggaacagatctgtacctcaattggagtgatgattacatgaatctatacatgggataaagttacatagaactgtatgcacacacaaatcaatgcaggttataaaatggtaaaaactgagtaactcctagttaacaataaggtaacaatgtcagtttgctgggttttcgaatgtattacagctttatgagcattaccatttagggaacctgggtaaaatgtacatggaaactctgtactatttttgcaactttctatgagtccatatttaaaaaaaaattaataatagtaaaataaaggaatgcatatagatatcttaatgtattcttctcttactcaaagtgctatcttacatgccatctgaattgcttgcatgatactttgaaagatcactgctatatgtatccctgccaaaatgtatggcttaaacctgtggttttcaaagctggccagtcatcagaaagacttggagaacatttttcaaaagaaaaaaattaaagcaagtcctaggtcccatcacaattttacagaatcaaaatatctggccatggggcccaggaatctgcattaaaacaaagcaaaataaaaaataaaacagaacttcccgggaattgtgattgatgctcaaccaacgtttgggaaccactcatttatttcattaacttcagggaccagtgccttaatctcctttgaaccttctccaagtcctgagagtgtactcttcctcccgtagttaatgatggtagcttttgaagtcttgagagtctttatcttgtgaacattgtacagattcagagacctagagcatctttcat

SEQ ID NO: 31530 - DNA, 1042 bp, Homo sapiens
gtaagggtttgtatcattgcatgtatatgttaagaggataagaggtatgtataaaagtaaattttgagaaattataagtataaaccaaaaagtcttatacctttagcaatgcctttaaatcttgaacttgaaagaaaaagttatgcccgactcgttgattgcatattaaataggaaaatacatttgttatacttgaactagattgttcttaggattttgtgaaagaaaatatataagcatgaatttattatagaaaataaaaatgaccctagaagaaaacctaggcaataccatttaggacataggcatgggcaaagacttcatgactaaaacaccaaaagcaatgccaacaaaagccaaaattgacaaatgggatctaattaaactaaagagcttctacacagcaaaagaaactatcatcagagtgaacaggcagcctacagaatgggagaaaatttttgcaatctgtccatctgagaaagggctaatatccagaatctacaaagaacttaaacaaatgtacaagaaaaaaacaaacaactccatcaaaaagtgggcaaaggatatgaacaggcacttctcagaagaagacatttatgtggccaaccaaaatatggaaaaaaaacctcactatcactggtcattagagcaatgcaaatcaaaaccacaatgagataccatctcacgccagttaaagtggtgatcattaaaatgtcaggaaacaacagatgctggagaggatgtggagaaataagaatgcttttacactgttggtgggagtgtaaattagttcaaccattgtagaagacagtctggtcattcctcaaggatctacaaccagaaataccatttgacccaacaatcccattactggatgtatacccaaacgattataaatcattccactataaagacacatgcacacacatatgtttattgtggcactgttcacaatagcaaagaattggaaccaacccaaatgcccatcaatggtagactggataaagaaaatgtggcacatatgcaccatggaatactatgc

SEQ ID NO: 31531 - DNA, 1044 bp, Homo sapiens
aatataaagataatttttataacagggtctatattggattgtaaaaagagggtcataggatttggatctttagggctctgtaattcaaaatttgggatgttcattaggactatttgtgttatgttgtaaaacaattgtacttgttggcagacgtcttgggttcaagttatgattttgcatttaggaggtttgggaacgtggacaaactcccttttgagttttccttcaccccgtctttgtaatggagataatattctcatttccctgggtttttaggaaggttacctgagatgactcgtgcaaaagctaacacataatagataataatatctatctatattgagatatctatatttagataaagatatctatatttagataaagatatctatatttagatatctatatttagataaagatctatatttagatatctttatctaaatatctatctaaataaatgttaatttattctgaagtgtggtaagtttatctaacatttactgtagcaaccaaggtggggctaaatatggggaccaatcagaaagacgatctctgtcagttttgcctaggacgttcagtgggacttgggtaggagactgtggactaatctcacctctggaaatttgtgtggcctgtgctataactgagaggaaccaagtaagcctgtgtatatggcaaatggtagtcctctcccaaacaacatttgtaaagaaaatgcattttgcactatttcttagtgtgtctgaggctttttatgttcataaaaatcttagtgagttgttgaaacgtgcttttctgaaaaaccttggaatttacctggtttagaattagaatcagaaatgtgtctttttaaactgtattctaccttcttaaatcttttgccttctgcagcaacatggagcaactctgatacttttttctacttgagggcctttcgtagtcagagattatactaagatagcaaaaaatagaaagtgacacactagtcaaggttggtttattgtgtggtaggaaatccaaaagacgttggaagcaacaaca

SEQ ID NO: 31532 - DNA, 1883 bp, Homo sapiens
cctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaagaaagttggcgctctactgaagactggagcccaagaagacatttatagggattgtttattttcatgttgttactacactccatggtctgcaaaaccagagtgccagatgttaaattctatcagcataatgcatctttaattaaatattatatacgccatacaattaataatgtggtctgtttccaaaactttattaagaaattaccataattttgtataataggctaataaaaaggcactgtactttgaaacagcctttcgtaaagtggttatatgatttgtatctgttgaatttggaatttagattaagagattgtgggccagaattatctgatgcaatgtactcaggactttaaataagttgcgaatcttgtagggtctactattatttggcttcctttaaaataaaataggtttcttatttgtcgatgagctcactctttaagaggtttagggaataatttacctactcgctttgtgtcccccaaccctactttgtaaaaacctcaaacaatacaaaacatgataattccaaatatacagtacattgggctatgatatttcttaatgaatggaaagtcatgcatctggttctgtggtcatcattgatgttttaattttcacaatgtgttaacctgatacttaaattcccctagttgtcctgtgaagaaagaattttaaattcacatttcacatgcagacaaactctgatatttaaaaataatagttatcttttaaactgagatcctatgtggatatggaatagcgtatacagctctgacaatagggcttcagtaaaataacattttgcaagctgtgtttttcaagacaaaatgtcaccctcagctaaacagaagtaatttgcatcagaggtgtgtgtgtccttactcttaatgaaaaaacggtcccctctcttcagaaagtatttgctatctctacaatgtattattttcatcactgtgtccctcccctgcccttcttatgccctaatatttgtcccttaattctattaaattagttgtcaactaaaattaaaggtagatgttatccttcacaatctgtcctggtctaatttttcagtcttgattcgtcttctttactttatggagtgtagaggtggctaacagaacaactctggagccacaatgtgtagattcagataccaacagtagcttatgctgaaacctgggtcaaattacttaagctcacatacctcagtttcctcatctacaaaatgaggataataataggttcttcctcacttatatgtaaagcatttaaataaggactagtagattgtatgtactagctgttattaaattctgccacatttgtttgttctccatacacaccttagccttttgtctatgtctctgttcacattgtttgctggaaacaggatccacccttctcctccaaggccagtgtatgtgtgtccacaaacacacagccatccatgtgttgtgattccacgcacctccgaagatacggctcagagagccaccctctgcttgccagattgagcatagttcatctggaactttcatacacttctctgtcttacttagcatttgcaactatactttatagttattttcaagtttattttgcctcttttgctggtgtgtggacttcttgagtccatggactt

SEQ ID NO: 31533 - DNA, 1055 bp, Homo sapiens
ttcacatccttccctatattggttaaagcttccctctgttgtgcagaaacttcctctacaccttgcatttgcttggacattaaacaggtctgtagtatctcaagcctcagcaagggtagtgatctatgggtgagacatgtggagggcaaaactgagtgaactgctgtcaggctgtggccctgtgaaggcgattataactcccgcaatgttggtaccacagcggttgctgggccagaacaagtggccaaggacccaggaaatgggtgaggccaagcaggtctaagataatgcaaatgccttggacagtttctcctttgagaaggggctgcagtataatgcagcttgtttgtgaccccttgtttattcattttactaatcctccagaaagaatcttattcttcagcctttagcactattaagcaatgtttaaaaactccttatgagtgacagttacttcttatttgatttaattgtccatatgtggaccttttaagttaacactctctgttacttcgtctgaataggtaaggtgtaatactacacatgcccactcaccacaacttggatttttcattagtactggaaccaacacgatgttgattcctcccattatgactagaggaaccaataagaataacttggaatcggtgaaaatagaggaactgagccagtttccagccacttgggttggaagagtgcccttgcttcttttcagttagaactgtgagaaatcagaaatttgagagccctcaattagctagaagttcaatggtagttttgggggatggattgggtagaagtttggactgtatttttaaaaattctttccacatttttacaagattgtccatttcaagacagatctattcacatattcaacattgtatcaaaaatttccttatagggtatttactaaactgtttttcttatatgaaagcgtctgccatattaatggtgtcctatgtgaatttcacattctataggggaatagagctcttcctgacagtggggactgtgaagagctggagaaatcctatagccttatgtgtgaccac

SEQ ID NO: 31534 - DNA, 1070 bp, Homo sapiens
ttttgtatgtttagtagagatggggtttcgcattgttagccaggctggtctcaaactcctgacctcaggtgatccacccactctggccacccgaagtgctgggattacaggctgggattacaccactattttttaatggcattttagcagttaaaaactgaatgctctaaaagtcagggatggcatgggcacaggtgaaagatgaaagttttgtctatttctatttctatgatgaaatcagttgggttaacaagagcattcttctaagcagctagagattctgttggtctcatccagccatcacccagatggcaatacaaccagtaaaaggcagataatggtatctgtttttgcagactttatgttcacaccagtgtcactcatcttaacctggactcttgtcatcagcttgatatttcctcactttcctctttctccccttttcaagttatagctgtgccttgacatgacttacccaatactctgtattctcttcgtgttcattaataggctcattttccagaactaacattggggcatttcaaggactttttacgtagcacatgagctgcttacaacgtaattctgtctagttgggacatatgtcatttagccagattgtttatggcattaccacagccaagcatatattagtttcatagtaatttctagggaaaaaaatgtggaggaaatatgtggtttttgttatacttgcaatgttactatattactgcttttttttaagttttgatttcaataaatacctagcatatattttcagatgccaaaggacatacaatgatgaacaaaaactcagctcgtcctcaaaatcgatatgtattattggtgatgctggactccacccactcatagatgtttctcattattgtgaaacattactttttggaaaaagagagctgggccaggcacagtggctcacacctgtaatcccagcactttgggagaccgaggcaggcagatcatgaggtcaggagttcgataccagcctgaccaacatggtgaaaccctgtctctactaaaaatacaaaaattagccaggcgtggtggcg

SEQ ID NO: 31535 - DNA, 1055 bp, Homo sapiens
acagaaacagcttgtacagtaggaaagtgtttttatgcatatcagactgaaaatctaggtgccttatttttatcagcaacttgtccacactttgggctctccaatctctcctaggttcatacctgaaaatactaaagaaaagtctggaaccccatgttttataaagtatgtttcctgttattttctaagagctatccatttttataatattctgtttagataattttaaaattataaagagaaaaactcaaattaatcataatatcacaatcctgacataagtcttgttaacatttggatatattcacttctagtagctgtttgataatacttacataggctaacatatactggcccttttgcatatatatttttatacatttgtaattatcagatgtactattttcatatcttcttattttttggcactataatggcaagaattatgacaatccaagtatctaaaataacagattaataaaatcttattttgagcagacaggaaattagaaccagtcagggctggagccgtggcaaccgaaactctgtgccgtctttttgatagtgctttattaaaactgtagcttgtaattgaggatagtttttctatgggacaatgcatagaaagctgtgcatggtgataaaacctttttttcccgacattagagcaactagcccattgcattcttccaggcaaccaaatgaagatgaaacgtgtgcctggagtcactgccaggcatgtggggcacagcaaaggccaaaatatggttttagtttgaaaacccaaccttgaataatggttcattctattcatcaaacttttaggtcatgggtcttgcctaggtgaagccatccaatggaaataatgtcttggaattctcttgcctttattatgtcaaatctctaatatataacatccataaagcctaattaatgggaaaaactgagtgtatgttttagccataacattgtggaaataggttcttttagtttcacacaaatagagatcttctcaccccaccgagaaaactcgctttctcctttacggagggccc

SEQ ID NO: 31536 - DNA, 1023 bp, Homo sapiens
tttaattgaccgattctttcctctacaaatatttattgagtgcctactactcaccaattattgtagtgtatactatgggagataatggaaatgatataatggccaaggagagaaagcatttgtcaaatcctctagggccaagggctttgatagagaacagatttcacaactggcagtggaaaatgtattcttttccatcccggttcagaggattttgccactgtacttgtgccatataaaatgctgaaatagttcatgagaagaggtacaggcatacatcttcctggtgtgtgaagatgagtggcaatgcactgtctctggttagagttcccaccaaaaattgtaaaatacttaaaaagaaaaagcaaaaaatatccgaggcaattaaaaaaaaaaaaaaaaagggaaatcacagaagcaggtccaagttaatgaccttatcccaattctgttcctaagtctgactctgatgttagtcatgttgtatttaattcttccagatttcctatagtactgtacagctctgatctcagtcctcacttggttctaaggtttgaccatcaaactttgagcttgcatgagccttgaacttggctctactcctatctggcagtgagcatcatttgttaaaattcaacaagagcaaacagaaacagtgtacactagtgacttgctgaaagagcctaagaagatacagtaggcaggagtaatggaaatgagtttttaacctccactgactcaccctttctttcctagtcacccttagggtcatggcaaagttacagaggcatttagaaatcatcttgcttgaaagcttccctttcttcagtcattagtgagcatcttcataattttttttaccatatatgtaaactatccatagtattatttgcctaatatttttatttaaatcaattaactttttatccgactttgtcttccttcatgtcaataacatctataatttgattctgtgggttgaagtactaagttgcttctttcctgtaaaagatattaaactga

SEQ ID NO: 31537 - DNA, 1004 bp, Homo sapiens
gatgccagccccttcttctttggtttgttgttactatactatgcttatgagaaggaaaactatccgggagatatttaatcgcgtacttggaagaactgggtgaattcaaataatggaaattctaaccatttttttttttttacttctttccctcataagaacatttaatcaaggtttttctttaatgagatctattcgtggtgactctaaaatgtaatttaattcttatcagaattcagttaagctttaccaaagacccttgttcaatattgattcgagttcagcacagtcctcaagccctcagatggatgtatcagaactttaatttcttctgaacttttatatgtccaataagctgcatactagaagtgtaaggaggttgaggaaattgggcaaatgaaataaaacaagttggctttgaagatagtttgcattaaggagaatcctagaactatgcgtctctcttggaaccaaaagccttagaacaggaagcatattctgtgtgatccagcaaaattgcctttggttacactgttgaaaactgatgtctaaaaggtattccatacaaaccagagcaaacctagcccttggccatcagtcagtgtgcctgtcttttttttttttttaattgatggaatgagaatattcaagatagtggcttaattatttttgtataaggaccagcatgtttgatactctgagttcaggaatgagaccagtctaatgtaaattaaatttacttctgcctaaattggttgttgatcaacttaagatcctattaaaattaaaaatttacatgattttgagggaaaatgcaccagtaatgtctgcagctttggttcaatgatttttaatattttcctgtggtttattgagtttgttcttaatctttgtgcttaagtagttatgattaaacagtttgattcagtatagcattgtaattctctttaatcattttacatattttgttttctattttttatttattaacataatacaaatgt

SEQ ID NO: 31538 - DNA, 1049 bp, Homo sapiens
tcaaaaaaaaaaaaacgctttagaaaaacactttagacactttagatttatgtgacttcaaaagtcaaaaatggtaataatcctgcttaggcagaagccttgccctcagtcccaaaacatgatggacaagcgggtgacttacctgtggcttttcttgtatcttgcagtctgtcagcaatcatgaaatgtaggcctcagagtggaagggcccctagagaccatccattgcctctcaggagcatggtcattctgcagatcaaggtcctgctctgggagaaatgggtgcacactcactctgcgttctgtccagcccttctgccacctacatttctatgcttttctcttactgctaaatagcttcctaaaggaaaagtgaatggtctttgtgaattcaaacctcattctgttgcttccctatttaaaactcttcaatgagtccctcttcccaatgctctgtctctagttgttctgtatataaaagctaaacttcttcacatgtttctgtttctcttgtttatgcgatcgtttgtcattggccttgtgttggtgatgtatgttctgaatgaataggctccagcaattaagtgactgagatgaaatgcttttgtatctctctagcctcatttcttttttttttttaccactgtgatgcaaacacatggaactactgttctccattgcaccatgattagtctatccgtagtcttttgtgtgtgatctttctgtacctagaacactcgtcttgggcttttgcctggccagtacattgccatccttcaggtctcagctgatttttcacttcttccatggagccccctctgacttcacaagattgcgttgtcctgctcatatgtcctgctcagagcatgctgcatgtctcacttcatagcacctgttatttttttagtatagattttggttttgtttgcctgcaccccattccttgaggacagggaaagtttctgtccccctgttgtgttgaggacactattaagttccctgccattacctggtgcttaacacatagtagatgctctattagtgttgga

SEQ ID NO: 31539 - DNA, 1052 bp, Homo sapiens
atggaaatgaggccaattggtaggaaagaatcattactcagcaagaatacagtttatgtcttcccaaagaggaagaaccttgagattgaacataaagcccaactaatatctttttttatacagaaatatggcagattcatttcattagatacagcccaactttttttttctgcaccagtcacagtggttgttcctggagactcagagatggagcaaagtcctatcttgtggaaacttagagtttagtgccccataaatatatccaaataattactaccaaaatggataaattcaatgacagaattcttatcttagaggagtaaataattctatttggggaaattggagaaggcttatggatacactgaaaaggaaaacatacttctgctcccacagagtttggggaaaggaaattttgcagttgatcccagaagcctacttatttcaccactgatgacccagatttaaaaataatctggtagtccaaagcaattttttgccactgaatataaacttcttgcataaaataccaattataacaactctgattactgctgcagtggtaccatgatccttctaacttttctttcacagcaatcaattgatctgctgcttaattcatatttatttagattgcagccatacagatgctttttgggtgctgccaggaaaattaattacctacatatagaatataatgtatgtagaaatgctttgacaaccgtaacgtgctctgcaaagagttagattattatcattatttctttttaagtctcactacaaatagataaatttttaacatcgtttatcttaaaaccagtaccatgaaaaaactgagtcacagtctgtttttctttttttaaatctcttcagttcttatccaggtccatttcaaataatatgtcatttcataccttcacaaataccatctccaatttccagaagatacagagagatacatggcttatattttcagccaattaacctgtcatagaaaaaaaattgttaggtaccattgatcatattgagaaatactaagaaattaataagta

SEQ ID NO: 31540 - DNA, 1050 bp, Homo sapiens
aatcgccctttaactgcacctgcagctgcaattgcaggagcaaaacttaggaaagtgtcacggatgggggatgcctctttcccaagcagagggaatgctactggtgtgaactcggcctcatctaaaacagatacaggcctacaggccatggaaatggactccttcctttaggtggtagtggtttagtgaaataaatgagtgccctgctgccaggaggaaaagaattgctgaaaagggatcaaaaatagaaacagaagaaaaaggacaaaggtgaagattcagagcttgtaacttctaaggcctcttcaacaagtacacctgaaccaacaaggaaaccttgggaaagaacgaatacaatgaatggcagcaagtcacatgttatctccaaaccaaaatccacacccttattacagcccagtggcaatggagtccagatggaaggacttaactaccacaggctgaagcaggacatcttagatgaaatgaaaaaggaatgaacaaagctaaaagaagagctcattgatgcaatcaggcagacactgagcaagtcaaatactgcatgcagaaacagagtaaggtgagataggactttaatctggaggaaaaaaaaatcctactaaccgcaactgttcacaacagcaaacctctacattttatgagctgtgagaagaaaatggagacaaacagaaggagggaaaaatcaacctactctgaaagtcttcagatattatgactctggcgataagctctttccctcacagttggctgcttttttctggcctttacaacagaatggaagagaatcatataagaattcctgtaacagttacgcagaaaatactaaaacccatcaggcaagatcactgtacattgaaatattttcatgtcaagataaaattgcacattttccacaattcagtgctaaaataaagaggaggaaagcttagaaagttttttttgcagagagtgctgataaagaattgagcaagtttgctattgtattgtaatgtttctctcaggtttgttcttcctatcatgtgtgatattcca

SEQ ID NO: 31541 - DNA, 1024 bp, Homo sapiens
acagttttaaagctattttccctttagtgagcattagaattaaacaacaaatttcattaacagaattgcctacaattatatactaatgttattttctatttttaggtaacatagttttatatcaagaaatatttagttatttggggatttaggtacagattaatgtatgaaaaggagaaatcctaaagtttagaggaatgattatttgaggttagtgatgcatgtaactttcattagaatgagaatctgtgatgttaaatactaatggatgtatcaggattccagcatgaacttcatcacattttactgtagctgtagaaacataggctaatctcttatcttccctctaccttggttttcgtatcaagaaagctgggatattagtatctgccccgcattcctgtttaccttccacataaggctgctccatgcattcattcaacacacacatttgaccctgtgccaggcattctgtaaggtgctgagatgcaatggtgaacatgacatggtctctgccctaaacgagtttataacaactaaaccctttgttaaacatccagatctgggggtttaaaataataatggaatctttctctaaggtggcattgtaggtttctggcttcttaatttttgcaagaaagagattagtagcattaatcacaaatccaaatagaggaaaaaaacagacagagatagttaaaaataaaattttaagattttggaaggcaaagtatctaaaaaagagtgaaaatggtgccaaatagaataaaatcagttaacacatgttctagtaacttatcattcttcctaatttgttgccttcagggacagtcattttaaaatgtaggtatctgccacattaataacactgcatccataaaaatattactttataaaaaatttgtttgggagatagaaaagggttttacacttacacaaataggttatactcgaaagagcatgaaactgggagtctgaaaatgaaagttgttgttctggctcttcttctaactggctttgtgac

SEQ ID NO: 31542 - DNA, 1061 bp, Homo sapiens
atcgtttaaagttgaaatgaatttactactcctaataggaaggaaagtgctagctaaagtatctagttgcaaaagagaatttgaaaatggaaatatctgactcaaaggataaatagaacttgcagtagctggtgcttaaggaagctcttttgtcatatgaagccaataaactaaaatggtttttcttcccctggtgtaaacttgtacttaagctgggctggaagtgatctttgggttttaatgggcatggctgggtttatcctacagaggtttaaggagatgggtggcttttctttctaggctaaggcaaacagagtactggctgccaaaccatttgagggcttgtgtaagtgccaggaaaagtgccattcaagtagtgaaacaacagaaggttggagtttctttagggatacatggaataaaaataaaatgaattcttactatctggatatgctttgtgaaaaattgttttgaaaaaattgtctactactgcttatataatggtatttaccctgttgaggatgccttatgactatcagtggcctgtttttttcgtagaatgtctgactacctccatgagaataattgataagtacctttaaaatatcctgcagtgctcaagtacagttgacccttgaacagtgtgggtttgaactgtgtgggtccatttatacacggattttttttcaatcaagtgtagatcagaaataacagtgcttggcgggatgcaaggcctgtgtatactgagggacttttcatatacctgagttccgcagggccaactgcaagaagtgagtatgcacctattttggtatctgtgggggtgctggaaccagtccccctcacgtatacccagggatgactgtacttatgatggctattatttctctcatattacaggggcgtaaacataagtgatgttagtttgtttaagattatttagttggtgagtgatggagctagggttggaatcaaagtaagagttctcttggttacaccatgctgcttccttgtgcaataaatattcactgaatatctcaaagagccagtgttctgtgcag

SEQ ID NO: 31543 - DNA, 1050 bp, Homo sapiens
cttctgtggaacaggtttgtttttacatattagcccagaagtctatctcattaattaaaatgtaattaaaaatgactttaaaagagcttaagagttcatttagatttgttttcccaagttatgtagaacattaattacctgagtttttttaaaatgtgaacagaagcttctgtcataaatttggaaaattataggttactggaagataacaggttttttttttcttttaaagttttaaaatgtgctaatatgcatcttaaagagttatatatgctgcatgctttctattgaaaggtgtgttttttttggataaagttttgaggccagtgttctcaggaagaggcttgggaagtgctgttctagacttatcattaacaggaaggaagctgaggaccaaggagattgtttatatcaaaggtgactaagctggttagctacatccaagtactgtgactgataattgccatcgtcagcttgtttcagggggatttactttacactgaaattatctgacaaaactcattgcatagtaatgttggaaagctgggaggagaacggacttgtgctaaacctcagctataatatagtggcagttttccattgaatttttgtcctttctttcctcaagcctagtagaccttttctttcaaaaaagagctgagagcttagaagagcaaaaaggtttgggtgctaaggtgcatgacatgttatgattattattatttttttacttgattaaaagcactttctttgactagctaatgcattacaaagaagggctgtaattcttttttctctcctggttctttacactgagagagtggcgtattactatgcttccattaggactaaattcagtagcaagagggcagttataagcaattctatgaataggactctgaatttttaagactttgatggaaaaactatcccctaaatctcaatgttaaaatgaatctctcttttctccaaatgttaaaatgaatctcttttctccgaatgttaaaatgaatctcttttctcctacagttcaagttagacacggtttta

SEQ ID NO: 31544 - DNA, 1058 bp, Homo sapiens
cttgtctttgcaggacatagctcgccttttgcaagaaaaggagttacaggaagagaaaaagagaaagaaacactttccagagttccctgcaacccgtgcttatgcagatagttactattatgaagatggaggtaacaattcctgcatcatgatctattctatccttagactcaaccataaaacactcctttaattttgttcataaagtgaccttagggacctgggactgtttctcttatccccaggcactgggtacatttagatgtgtggcaggattctatttgaatctaataaattcatgttttgttttgttttgtttttattatactttaagttttagggtacatgtgcacaacgtgcaggtttgttacatatagatacatgtgccatgttggtgtgctgcacccattaactcgtcatttaacattaggtatatcgcctaatgctatccctcccccctccccccaccccacaacaggccccggtgtgtgatgtttgccttcctgtatacatgtgttctcattgttcaattcccacctgtgagtgagaacatgcggtggttttttttgtttgtttttttgtttttttttttgttttttttgagatggagtcttgctctgtcacccaggctggagtgcaatggtgctatctgggctcactgcagcctccctctccaaggctcaagcagttgtcctccctcagcctcccaagtagttagaaatacaggcatgtgccaccacgcctgtctaatttttgtatttttagtagaggcgaggtttcaccatgttggccaggctggtcttgaactcctgacctcaagtaatccgcccacatcagcctcccaaagtgctgggattacagatgtgagccaccgcgcccggccttatctgttctttagttggacaaccagagccactttcatgatggctaaaatttgaatatgattttatgagaattggcatgcattctttttaaactttagcgacttggaatgctttattataatctaagcacataaatggggtgtggaaaatggtcgatgagtctctggacttaac

SEQ ID NO: 31545 - DNA, 1051 bp, Homo sapiens
gtggcgtatatgcttgtttctttggggagagacagactttgagggagttttgaggaacaggaagtggtgacctcctgaacatgtgtatgtaaatactgaaatttctcttgcctcagctgtgttgttattgggaggttatgttttgttgaacatggagtcctcattaatatgcccctgtgttagaccaagtgcagttccacagaaaccatattatagttcagctcatatttacaaaataatccttctggtctttgcagtggtccttttccaacacacctgggatattctttcattgtacttctctgtatgcctttgtatatctatttgattttttgccttacttgcacggtaatcacagtatatcattacagaaatggtcagtttttcaacttttaactcaaactttaatacattatctattagaatgattatggattttctacaaatttgaaattgtataaaaacatttgtcaaatttatatcaactcaaatgatatatattatttattaatgaatccatgtttttctttcaaagccacttattgaagtcatattagtgattttttaagttgtggtctttggagtcataggactgtggttcaagtcctgtcccctcctaagaacaatattaattttaatgaagttacgtactaaataaaatggagattataaaagtaaatccttcatttggatttgagaagatcaaataatgcaattttggtgaagtacttatttatacatatatcggtgttatatgtgtataatgtaatattttgtgtatcttattttgaaagccaaacatggaggcactcatataaaatgcagatatatatgtgtataaatatgtgtgtgtgtgtgtatatatatattatgtatatgccaatacataatacctatgtatgttttggcagtgagggagtaagttatatttgccaaataacttggtctcaagaaacatacaggtctcagtcctcaactgtatgaggttttaaagcattcagatagattcctcacattatctttttctttccaagatttaaagctgtcacag

SEQ ID NO: 31546 - DNA, 1066 bp, Homo sapiens
aatatcaaatgaaacagtttaaaggaaaacgtatagttttttattttctttacatctcatcaacttacggtagctctttcaaatgcagttcagcaagtggttaattccatcggggaatcttagctttcatagcaattttccatggaattgggatttttcgttgttatttccaaaacgtagtaaaagttttagaaaatgttaaaatcagtatattcttataaagtgcatatgcatttgctgcctttgtcttcacattatacttgtgcctaaaaaagacctgaaaaagaattatttttgtgctgtttttgaagtttatattaaatttggggacatatacttagcatatattatatttttctacaaagaatacaatatcatacagttttttgaaatgtatttaggaagcgactcctttttatatattccatcaaggcaaccctttaaatttttttcctttgccaagtttcaactaagattgagaacagaattatctacagataacagggtcatgaactcaaaattctcatctacttgatcctcttttatattgaactgtaatagagggctaatttctgaagtgactgggtatgtttgctttggccacataaagtgggcagatggaggcatataaaaatctgtggatcattcctctgaactcaagagaaactagcaatattctgatagttttattggcatttccagtaagaatatttgaaagcctctgtctgaaattacaaagcttaatttttttgttttacaagattcctcaacctctactttttactctatactagtttcaaattggtttataaatagaacttaatgtttaatggctataattttgttattggcaaatattaaagtgttgttagctctacctaatcgtgatcaagctcttctttcacatttgtttcactttagtttcttaccattttggctatgtacccagaattctttaggtatgcatgaactgtttcagtaatgctcatcccctcttctcaatttaagttgaaaaagcaattttctccatttttaaagtacgttaaactggagcccagactccccc

SEQ ID NO: 31547 - DNA, 1958 bp, Homo sapiens
ttacttcagtgaacccagaagagctgatgagcctgtcttgatagtgtttgtctaactaaaaggccgatagagccggaaatactgtattttttagacctcatctttctcatttgtaaaatgaggagttggataggcagtcttttaagaaagtatttttcaaataatatgcctcagttcattttcatcagaatcagctgttaactaacaatggaaatgtctgggtttcacatgtattatcatctctggagtgaggcctggcagtttggacatgttttagacctggaggtggattcttaggaacttaaaagtttaaagtcattgcattaagttactttttatgctgtaactttctccagctctaactctacagttggtgttctaaagtaccaatacaggtaagttcttggtacctatataagaatgaggtaaatattatagataaacctcaaatttctggcacccctgaggcttaactctgaagtccatcattgacgcagtaatggctctattttctataaactgctgaggtgatgttttccatgtgtctgtaacactaggaatcatagtaccaaggagccagtcaagctctatctgtggtcagagaacttgtttctaggttgcggattcaggttaagttggtttttcctgtcatgttatttcttattgaaggacttggttatgcagaaaattaaaatttagttccagaagccattctgagtagctgccacaaatatccttgtcttaggctttgtgcttggatttcagccagaaagatggctttgtaaacaattccaaactagatccactttgttaggaagacataaagagctgcggaaaaatagaggaaagtgtgatataatctgtcttgagtaggtttatgaggaggttacacccctagcattttgaggtttacaagttccaaaggtgtgggggaagtatggaggaagaatgatgtacactgacctctacgtttctgcttctgtgaatctgactttcacgagtgctctgagggctagttaggctttatggcttttagttatgctccaggatattttaaataggctgaggaagcatgacactaaacgctgactcacaggctccactactggaattgcaaatgttttgttttttattttgccagcacaagggattgaaaaacaatgttaccaggcggatattaaaacgactacaacatgagctgctgcttttctatcattttatattcagcttgctttttatattttacctttctagcccccgtaggcatttgattttgtaactccctggaacaggtcagaggattacattaaaatataattactaggtagtggcatctattcttgctgttgtaaaagcacaattcttaaagttgttaggacaggccaaacttacattaataatgaagaaactagcaggatgacacggagctggttctaagagcatttgcagagcagcattaatagaatcagttgaaagggactgcaaaataaaattttaaattaagtataagataactttctacagggcaatgggtacttaacctttcggagttacttctctattggactataaattcttaatggctcatcattttctgcaggttaacttctaaactcacagggccataaaatatctgcactgttctgctgtgaattgttagtcagatatactgtggcattccctaaatgtcagactggcttattacaaatactcttacatgatatcaaaaagaatctatcattttaccttattccaagctcagaataaatttatcttgactgtcagtactttcaacaattttattctgtaaatttatttaaggctgaagttttgtgttcatttaaggatgttcttgtgttctccatctgaaggatgatgaacagaaaaagacaaggaaatgtgaaattaagatatatatggaacttgaaaataccactcacctgattttttgaaagcta

SEQ ID NO: 31548 - DNA, 1059 bp, Homo sapiens
gacctcaagtgatccacctgccttggcctcccaaggtgctgggattacaggcttaagccaccatgtccagccagccaagtatttggttttaaacatttgtattcctttgtgcaagggattgtattcctctgtacaagacctttaagcacctcttcaagaaatttagtctttgtgtagctgctaaccttactgcaatatttattttcccttattttcccatactacttagttgacaaatggcaatcaagctcacttgttctccctctctctgtctcccccccatgtacacatatatatatcccttcagcttgacttgctattatttttcattgtataaatatgaaattcttggcatttcaatatggcatttgtttagggaaaaaatatgtaggtcactagagaaaaatgttaatttttttcccactgtgaattgccttctgtttgccttatcttttcagatagtctttaaagttgggcaatattcaggcagctatttagaacagtttctcagagtggatttgggtctctcatttgagaaagatttgtagtttcaatgaagtttgtatattataggaatttaagtaaaatcatctgagttaagttttgggcaaatgttaatcagaaagataatctacatccctactttatgtagtcattttggagaaatggaggaaaaggaaaataacaggactttttatagctgtgataaaatgggtaaagaaaaacctccatttaaataaggaaggggagacaaaatggaaggtcctggccttaagtcaaattccagatagtgctttcaatatccaaagcttaggccttgtttacttatagtaatgctatatttttctttatctgccctgtgatttcgcttcgtgtccttcaaagtttttttattgtaattttaaaggaaaaaaacaatgtatttttatttgataactaggcaaaatcatttgccattttttatttcataaatatttatttttctatctcatacaatgatcagttttactttaaaaattctgcatttctcttgcctctcatgtacttcatccagttatt

SEQ ID NO: 31549 - DNA, 1052 bp, Homo sapiens
aaacattccatgctcacggattggaagaaataatattaaaatgttcatattgcccaaagcaatctacagattcaacactatttctatcaagctaccaatgccattcttcacagaattagaaaaaatattctaaaatttgtatggaaccaaaaaagagcccaagtagcaaaaactaaaaaaaagctgcaggcacattacccaacttcaaactctactagaaggctatagtaaccaaaacatcatagtactggtacaaaaacagacacacagaccaagggaacagaatagagaacccagaaataaagccaagcacataaaaccatctgatcttcaacaaattcaacaaaaataagcaatggggaaaggtcttcctattcaataaatggtgctggaataactggctagccatatgcataagaaaaaaaactggacctctgcctttcactatgtacaaaaatttactcaagatggactaaaagtttaaatgaagaactcaaactataaaagtcccagaagaaaacctaggaaacactcttcttgacctcagctttggcaaataatttatgtctaagtctccaaaatgaattgcaacaagaacaaaaatgacgagtgagacctaagtaaacaaaagagcttctgcacagcaaaagaaattatcaacagagtaaatagtctacagaatgggagaaaatattcataaactgtgcatctgacaaaagtctagtgcccagaatttacaaggaatttaaattaatcaacatgtaaaaaataatctaattaaaaaatgggcaaagacaggaacagacacttctgaaaagaagacattcaggcaaccaacaaacctatgaaacaatgctcatcatcactaatcatagaaatgcaaatcaaaaccacaatgagataccatctcacatcagtcagaatggtgattattaaaaagtcaaaaaaaaaaacagatgctggtgatgttgcagagaaaaggaaatgtttatacactgttggtgggaatgtaaattagttcagccactgtggaaagcagattggagatttat

SEQ ID NO: 31550 - DNA, 1072 bp, Homo sapiens
cctggtggaagtatactttggcgtaatacattaaagccttgcagtatttagtcatatcagagtttaagagagcaggagaagcatgagatgctattattagggacatgggcctcccagtgactatttcataaggggtcaatttatgttttccaacaggattgaatctgattgccattaaaaccaaaaggtagtacctttggccaaggcaactcaattgattcagttaacttggacagtttcagttttcaaatgccatttgttctttcaagctttcctgaagactgagggtaataaggacaatggtaatgcaactgtgtcagtaacaccttatttaactgctttataacttgctcagtaaaatgagttcctctatcactggagacttttagagggatcccccataaaggaaaaacattttctaataatttcttagctatggtcacagcatcagctttcctacatgggaaggcctttatccaaccagaaaacatgcaaactattacaagaacatactgataccccattgagggtggtaactgaatgaagtccatctgtaaatgttcaaatggtccatcaggtggtggaaatatactgcctctagtttttctgggattatgagtttgacaagtcaaacattgattataagccattttagtaatgtcagaatagtcaccccaccagtattttttcataatttggatcactttgtctgttccatgatgagctgtggagagctttcaataatggaagcttcaaagattcaggaaggaccaggcggccgtccgggccctttgtgagtctttgcttcacgttaaatttacatccttttagataccagttttgtttttgcaaatcagatgcgttgcactgtttattaaataggtcatcgtaaggaaattggcttggattaatcttatggagttcattcagattgcgtatcttgatggttccagcactagctgattgagcataaaaatctgctaaagcatttcactgatatttgggttcatttctacaagtatgagcttcagtcttaataacagcaatctgcatttgtaacaggatagcagaa

SEQ ID NO: 31551 - DNA, 1048 bp, Homo sapiens
taatctgaaactggttcatcttttcttttcttttttttttgcttacaagattgtatgatggaccaattttttgtggaaaaattttaggaactgaatgttaaaaggttttcagcgatttttctagctatttttggtccttcttgtgaggagctcttagagggccctttaaaatgtcctcctcaggtttgtcccattctgctgctgccatccatttctgagcttcaccagcccccagtatcatatgaataaattggtaaattcatgaagtcctggatcgtaagctcctattaggattctaaattcctcagtaaatttttgagacttttcccttggaccagggaagtccttcacaatggggctaagctcagttttagaccatggagtgaaagtagttacagcaggcaggcctggctgatataaggtctcactttgtaagacatctgtctaacttccttttttttttttttttttttttaaatcatcttcagggtgaaagtgtaatttaacaaaaagtttagtggactcagagtatgtaggtagagatggacaaagaaggaacagtccgagttagatcagtcaaagtacagtcctctttcttcatgtccttggtctgttgcttaagcttttcatttggtttttgcaaagaatcttttaaggaggcactttttgattcacttagtcttttggaggcctttgcgtatccatgagacaatacatcccactgtatttgtgggggctttgatcccctttttctaatatgccttgcaaacaattttatccaaattaaaacttctccattgtggccattttaattctaagttttctttagtgaggttaacccattttactgaaaatgcacatgttctgggcccataatttttatacgtaaaattagctggagtccctgaagatggagtcccagactccttggattgagatgatcccattattaaataaggtacttatcagaggtctgaggcctctaactgaatccaatccagttaattatcaaatccaatttgatcttggatccagtccaggctaagta

SEQ ID NO: 31552 - DNA, 1051 bp, Homo sapiens
ttatgtatggggttatttatggtatgttattttcaacacatattcattaacaaaatccatatgaaagttataggagaattgctgaggtagaataacatactttgtttgtatttataatactcatatatttacctgacgttttctgagtcttcacttttttcattcttttggaattggtaaaataactgattccttgaaagtttttttctaaataatacctagataatagatttatagaaaaaatattgtatgaatgttttaacattcatgtaatatggaacatgtaatttttatactggaggttattatagttttaatacatcaaagaaataatgtttattttggaagcagaaagaagaaataatttctatgaataggttttcatctctttccttgttcttcaactttgaactttttatattccaaattttaattatatttcaaaagatttttttcttttgccttttaattttatcttttggagaaaaatgtatgtcaaaatgtatgtacgtgtatttgtcttttgatttgatcttttttgaccctcttttgcattgacattattttaaccaaaggacactcttgattgttcatgctactgggggaaaaaaaaataagtagaaattagcctaatagttgtggcttattttgagtgaaggccttagcccttaaggcaattaaatttactgtggagagaagagctaatctaatggggagaaggagcctttgttacaggtgtggtagtgtggttctttgagtgacaagatttctgtttgccagattggttaggagaagtctgtgtgtctgctttctctcttatggcctaggatcactgtggtgaatgaaaaacctgtctcagggcctgactcagataattcccttaaaacccggctaaggtcatagatgaataatcagtaattgaacagaagctctgcaatagaaaagaagccagataattatttttggaaatttaattatatttacagattttattttatacagtagacatggaattaaatttattacattatgttctaatttactctttgct

SEQ ID NO: 31553 - DNA, 1027 bp, Homo sapiens
aaaggccccacctctcaatactatcacattgtgaggctaggtttcaacatatgaattgtgggagacaaaaattcagaccatagtataatatttcaagattacttaaactcttctctaccaaactcattaacttttaggttagcacagtattttcattgatattttggtttctggagttattactaattttcttgatctgatgttataattaaaaaaaaacaggactttgtacgtgaaatgagactgagataaggaagctgattcagagatggagatttaaaaaaagagagatgagagattgagatctgcagtgtcaaactgacaatagccaggagtcaggagatattaagagactatatcatctgtgattgttaatgattatttattgttatttataaatactactgtattttatatattatatacattgttttaaaaattatttttgtaccatttcttgaaagaaaaatgtctaagcttgggaaaatatttattgaaaaatgtggtttgtacatctgaggagtgtatcttgcacagtaggtgcatagatttcttcctcttcctgttccacatggccttagcttagaggctgtgtggccatcacttggtatttagggtaagactggtgcacaaaatcaaagacaggtaaccttggtataagtgtagtatcatgtaaatagcttttctatgtctaattcttgttttcttcctactttttcaggaggtcaatttcagttcatttcaactatctttacataatagtgctttagtaacaggcatggaaggaaagagacatgtccctagagtgttttcttgaaatctaatagatgattggagtatttaccatgcagttgtgtatatacataagcagtgaattcgagaggaatttttaagctgtaaaaaaaagcattgtgtgccttatagacgcgagtgagaaatgtggaatatggctgatccaaagggaatgagttatctcaattgattaatcacagtcagttacagattgaactctttgttctactctttg

SEQ ID NO: 31554 - DNA, 1030 bp, Homo sapiens
atctgttcatggactccaaatacaagaaattaatttgacaaagtgaaaatataaaagatgcatcatataaatatgtaacttttctggagtgggtagtataggtaaagccaaaagaaacaaattcaagcagaggaattttggtttctgaaaattaggttgtctgtagggtccctgtatttatacttagaacaaaattaggaatttctgtttatgtggtccagttattgagtcaccctaagtttgtaggcatcttacctacctacttgctccccaagtttttatttctaaaatgaaaagcattgctgtagatgaccagtttacactaaagaataacatttatttatttgttttagctaaagtatatggacagggaacattcatattcttgtagaagaaaattattttgacttttgggcaaaagcatgtagttcttatacactttgacaaactcattgcgtacatttttcacattaatcaaagtcagcacaaataaattttcaccttggaccacggagggtttgaacactggaaatttgatataattctggttgctaaagaacaagttctaataaaagcttaagtgtataccaatatgtggctgttggtgcaatcagcaggtccgtaaaaatatgattttaatggttaggtaatcccacaacggagatcccaaagttcatgtttggaagagacttttgggtcaaagtgaaatcagtgtaatgaatttaaaattatactctgagatcttgaaatcagctaattatgttacatcttattagctcagaaaagttttgaagttatatacaaatgctagtcaggaaaaaagattcagtcatgtaattcttgtacattctactatttaaatcaaccaatattatagattatgatttagtgcagtaattctgctggctaaccttatctcatttggtggtggttagtacttcagagtactcaccatagtttcatttatgttttcagcatcacttcctggtttttctcaattccatggctgtggaatcaattcatatgtata

SEQ ID NO: 31555 - DNA, 1035 bp, Homo sapiens
tctagtaataatctaagttctgcattgctttctcctttccttttctttcttcctttaaatattcttctttcgagacatatctcattttaacttttattttcattttctgtcacttttggtttttctcatgccaccttggcaatgtagttaagtttgtgctaacgtagaagattagtgctcaaatctgaattgccatttactactagctgtgtcatcttcggcagggaatctcccagagccttagcttctttatttgtaaaatgactattatagtggttatttctcaggattgttagaattacttccgcaaacatttgcaagtccctggttcataatttcatgctaaattagtaccgttacaggaagtggtatatcattgtcacagtgtatacaaatatatttcttttatatccctcgtgatataattatcaagacagtgaaacaattcaatgaattttaccagcataacacatttttaagtgattggaaaatcataagtatcttttcttatgtttttagtagaggctttgcaaccccattactctccgctcccaatttgattatttaaaggaagtggattactaactcagatatgtacactgtcaagccaagttctatgttctactgctggttttcctgagaaagcagtcatataactcccttgaaatgatttactacttttgtacatataaaattataatggtgttaatgtaccaaataatgtccttggaagcaagggttttgccagtaactcagctgcatcagtcaccctcaaggagatgagccatgactttgttcattagttggaaaagagtctggagagtgccttttcgttactgtttatctttggtctgacacttgggaatagggtcatggatacttcagccagaaaactttccaaatttaagttattaatgtattataaggatcaaagtttctagtatagcctgttcaattagaacatagtgtgttggttgattggatttggagaaagggaggcaatcaaatttttactacagtttcagcctgttacag

SEQ ID NO: 31556 - DNA, 1032 bp, Homo sapiens
ctttcattattaatcccatgaagtccatgttacagaagattttgtctacaacagtgcagttacattcttctcgttagaaatacaaccaccagttagagttcctaatcagtataaggaagtagttgttaggagaggggatgggtttcttgtccaaatgaagttttccatttgagtttttgaagtagtgaaactaacccagcgtttacaggccccagaaatctgggaacctcagctttcaaagtactgtaccagtctttaacagttttcctggacgtgtgaattgatgcctccttctgtaacatgcaggagtgttctgtctgtcttcattgagtgttaaaaaataatcatgcctatttcaaggaaaaaatctacagaactaagatgcagaagataagtgctagatttaatcatattccttcatctatctgtttggttcaacctttcatcaactaaaagatgcaccttttttcttgtgctaactctaagattttagctacagttttgagaatcttgagtgtagtctcttgtttaccttttttcctttttttgtttcccccacaccctagattcatttaaatactgaacttctaaagggcaagtatatagtgtagtttaataaaaagcaaaccttttcatgaacaatatatattacataataagaagcgttcctttacttttcagtactctagtgaatagctttctacagtagaatctcacttagagggtgtcttaaagcttaacaccaagtgctcaggcagcatgttatacaacagttccattaaggtacatttggatctttggatgtgtggtttgcttaaagtacactgcattagtaagttggcagcttgctttctttaaaaacatcaaaagttttaaaaggtttatttcagggcatgtgttagtgttttgtgtgtggttctttgttcctgttctaaactgttattaaccactgaagtgaaccttctcccgggtttggccttttggtattcacagtgtattcaaaacctaattacagattagtctatatttgag

SEQ ID NO: 31557 - DNA, 1050 bp, Homo sapiens
tctaagacccttttcaacccttgtgacttaagactctgtgaacttttacaaagtatcttgtgatctggacagatgatctgttttgtaccctgcagatgcatttaaaagaataaatctggcagaatggtaaccttgcttcattctgaccattttatcaaagttaccaaggaccctaaggaatactttctcaagtatagttttaacacataggattcctaattaattgttattctaatatttgctgaaggtgtttatatgctatacagtcatacacagattcttcttcaattaattttagtatatgcttttaacttatgtttgataaaaaaattatgccaatattgttaggtcggtgatagactatataagtttagtaaaactagcaaaggtaagcggttaggcttcaacattgttgtgatcatgcagtcatcaactttgtttagaaattttgcatttatctcccctgacctcagtttgttaaatgggtttatttttacagaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaaacttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaa

SEQ ID NO: 31558 - DNA, 1829 bp, Homo sapiens
attccaagctggagaaggcggacattctggaaatgacagtgaagcacctccggaacctgcagcgggcgcagatgacgggtgagggcggctcgccgcgtccccctgtgcgggcgtcccgctcgcctcgcggtgatttcttccagacttccgcccgtggttgtgagaggcattcagctacattttactgccttggctcactcttgcgttcccacggtctggggcttatttatagccacaactccaagttgttactgttccggaaagggagggaaagaggttgcagccgcgagggtggcgggcgccgggtaggggcgaaaggacttaggactgtggcggtttggaactgcgtggagcctgggggtcactggtttagcactccttcccgttgcagaaggggaaatgaggcttggatgatggattgggaggcattgtccaaggtcacatcgcgcgcgggggtgggggtgacagatctggggctgagataggtttaaatgcagctacagggaatcgggaaggagtggctcggcttttggcagcaacgctagtgtggagaggtggctggttttttctaaacccatctcaccctccctgccggaggcagtttcacgggcgcatggtcagggaggcgcgccacagggacctcccagggcggaggcagtggccacggggccagggccgttcggtgacccgtctgtctctttctggcccgcagctgcgctgagcacagacccaagtgtgctggggaagtaccgagccggcttcagcgagtgcatgaacgaggtgacccgcttcctgtccacgtgcgagggcgttaataccgaggtgcgcactcggctgctcggccacctggccaactgcatgacccagatcaatgccatgacctaccccgggcagccgcaccccgccttgcaggcgccgccaccgcccccaccgggacccggcggcccccagcacgcgccgttcgcgccgccgccgccactcgtgcccatccccgggggcgcggcgccccctcccggcggcgccccctgcaagctgggcagccaggctggagaggcggctaaggtgtttggaggcttccaggtggtaccggctcccgatggccagtttgctttcctcattcccaacggggccttcgcgcacagcggccctgtcatccccgtctacaccagcaacagcggcacctccgtgggccccaacgcagtgtcaccttccagcggcccctcgcttacggcggactccatgtggaggccgtggcggaactgagggggctcaggccacccctcctcctaaactccccaacccacctctcttccctccggactctaaacaggaacttgaatactgggagagaagaggacttttttgattaagtggttactttgtgtttttttaatttctaagaagttactttttgtagagagagctgtattaagtgactgaccatgcactatatttgtatatattttatatgttcatattggattgcgcctttgtattataaaagctcagatgacatttcgttttttacacgagatttcttttttatgtgatgccaaagatgtttgaaaatgctcttaaaatatcttcctttggggaagtttatttgagaaaatataataaaagaaaaaagtaaaggcttttatgtcttcgaactgattcttccagaatatgtaaaaaggcttttggtggaatttgaattacatgtaattggtaattcaggaattgactcttttgttattaaaagaacatttgtaaaaatccatcaaacttttcaccaatcctccatgaactaaaaagactaaattccatttactttacaagcagccatc

SEQ ID NO: 31559 - DNA, 1096 bp, Homo sapiens
atttaaaatagttggcatgaatgaatatgtaacttcttggtacttagaaaaataatttaggccattctaaaagtacaactaacctctattagaggagaagggctgacttagagtgaacaggattcccaccctctacggacagattcgatttcacttgctggttttcttttcaggatagcgtcaaataatgtgcaggaaaaggaataccgtgtgtgggagtgtgagtcttatgtgcacgaagaacaggacagttagcatcgttcccacctccagagatcctcacggtggtcatgcagcctcgtgtgctcagaacagtgtgaggtggatgaggcactggtggatgtttgcgtggcaaggatggtgggaccccaggcccacgttcttcccgttagctttctctggtgttaactgtttagcatcatttctgctgtttttatagaacaggcgctttttgctttttgtatggactcaagtgaaataaaaactagcaccgccgtaccttataaacatgacccttttctatctgtagttagaaaggtacaggcagtattaaaagggtagctacttcagacactgtgtctctgtggatctgacgacagctcaggaggccagcacatgcagagccggcgtctcatccccagccgttgctgatcatcggcgaaggcggagttcaggtgcctcgctcctgacgccacaggttgtgcttgtctcactccatagccctgcactttgtcgcagtgaggtctgataccacttctctcagagcagtgtagaaattttgagcttctctttctttgaaaatgcagaaaagaacattttgtgagaataccctatacttgacatctgagaaaccgctcacacatgcagcatctcacgcagaatgctgtggagtcggactcaaaaggctgcacgcctgtggtcctgttgataggacattctggacaaggcacatctagggaagaaaagggattggtggttgccagaggctgtttcctgattgtgctgaggcttacagacacagctctgtgtgtgtcaaagtttgaaaaacctacattaaaaatgatgagtttattttactgtatctttacgctttaat

SEQ ID NO: 31560 - DNA, 1041 bp, Homo sapiens
gtgtatttttagacatagtctccctctgtcacccaggcttgagtgcagtggtacgatcaggtgcacgccaccacatctggctaatttttaaaaatgtattctagggacagggtctccctgtgttgcccagggtggtcttgaactcctgacctcaagtgatcctcctgtctcagcctcccaaagtggttacatgcatctatccatgtgttaaaatcggtagaactgaggccgggtgcagtggctcacacctataatcccaccactttgggaggccaaggcaggccgattgcttgagctcaggagttcgagaccagcttgggcaaggtggtgaaaccccgtctctaccagaaatacaaaaattagctgggcatggtggctcacacttgggtagtcccagctacttgggaggctgaggtgggaggattgttggagcctagaaggcggaggttgctgtgagccgagatcacaccactgcactccagcctgggcaacagagggaggagacactgtctcaaaaaaaaaaaagaaaaaagaaactgtagaactgtccaccgaaagaaaaaagtcaattttaatggatgatcaatttttaaagcgttataaacaaaaggaaaagagacaccagcaagcctagaagcatttgagcagaccgtcaagagacccacagcctggtcccgaggagaggcggtaggcgggacagggcctgtttgactcctgcatttcatacctcctatctcctgcatgtgttacctattgaagaaaaaatacatataattttataaaaaaaaaaaacctttaaaacttttttcaagacatcttggaaacacaagagttgcaaatcttggccgtgcgcagcagctcacacatgtgatcccagcactttgggaggctgaggcaggtggctcacctgaggtcaggagttcgagaccagcctggccaacatggtgaaaccccatctctactgaaaatacaaaaattagccaggtatggttgcaaactcctgtagtcccatctactccagagtctgaggcaggaggattg

SEQ ID NO: 31561 - DNA, 1049 bp, Homo sapiens
tttgaggtgcactggaggaagcacaccctgtcctatgtggacgtcggcactgggaaggtcagtgtggagctcgttctcaccacagcccagcacccacacggccccgcccaggtctgcgggctggccttgctgatggtgaacgcggaggagcaggccagatttaaatcaactcccgacagatttgaggcaccgctgaaaaaggcactctgacagcagtcgggcttcgggctggaaacagaatccagtgcctgcaggtggttcagaggagccttaaggaagggttgctctgtggtgtgggccagatggaagtcactgggcaggagcaagtgtccaaggcctggtggcaggggaggagatgatgattgtggacctagcgagaaagtcagcatctgtgtggtggggacagagccactaccagaaaccagtcccgagccaagggagcccagaagagacccctcccctctcttcccatgggctgggccaactggaagcatctgcaggggagcagaggggatgtggtgcagcccttagcatcccctgggcactgagcaagcagagaagggcagaaatggaggcagggttggggtaagcagcgtcctgggaacagccagccgagggtgtggtaggggggttgcagcttgttccacacaagcacagcgtcttgggaacagccagccgagggtgtggtagggggttgcagcttgttccacacaagcacagttcacctgtgtggcatttccactgggcattgagattcagaaatcatgaagatagaaagcttttacccttaagcttttcataacttgtaagggagagtcgtataatcacttagctgtgtctgtggaagttacctttggactctcactatcatctagtgtgtctgtgattcaggcagtgggtcattttcagaatttatcatgaaggccatttcctgatagtatagagaggtcacacttcactcgcttagcacaagtctatttttaatgtttccgggttcaggttttttgttttgtttttgttgttctgagatagagtctcatctcttttgc

SEQ ID NO: 31562 - DNA, 1027 bp, Homo sapiens
agatcaacatcttcaatcactggaatgatggcaataatctaattgggttcattttatcctctatctaacaatgacaactcattgcctacacagcaggtagaaggagtttgttttcagaattgccctctgacctatttaagacgctcagatattccctgaggctccttggcctggccacaaaggccctacacattctggctgcttcctcctttccagcatcctctctcacgtctcctctcctcagttccaccctcaggaggcaccagaattcctcacttctttgactacaaggcaccgtcttactcccaagaccagtgaatccgaaggtggaccaccagctgagggactagattccagactgaatagaacaactttccctgtctctccacataaagtgtgtttgtttttcctcttacaggtttccttaatgacaacaaaaaagggagtaatcctacccactgtaagagtcatgactcttgattgcagctgacagaaactcatgacagcctgctttagatgaagggggagagaaggactggaagaatcttggagttgggaatgtcacacgtaattgaaggaagaacaagaaaactatagtaaagaaccctggggtggtgatgtagtcatgggccaagtgtcctggaaccctggggtggtgatgtagttgtgggccaagtgtcctggaaccctggggtggtgatgtagtcatgggccaagtgtcctggaaccctggggtggtgatgtagttgtgggccaagtgtcctgggttttgggtggagaaagagtcccctagataagttattaggtgggtgcaaaggtaattgcagtttttcccattattttaattgcgaaaacagcaattacctttgcaccaacctgatggagtcccccttgccatgcttctctctgtgaaaaaccccaagccgaagtcagcataacatccacaggactctatgtttgcaaaagccagcttagctatattacatgtataagcacattttttcaataagtcagccttagcttactg

SEQ ID NO: 31563 - DNA, 1044 bp, Homo sapiens
ggtaagtagctgaactgaggttttgtcttggctgaaggttaacaaccagctggtctgaatttcttcttcccattagagcagtctgtggtcatatcatttgacttttgttgttgttgttttttctggtctttctctcatcagatttgaccaactctacctgacttggtcaaatccaagtgagaattccaaattatgggtaacaaagcctctctaatttggctaaaattccttgcagctgcaaaagaggaaaaaactaaacgaaaacaacaaatcacgtgcttggtttctgtgtttgctttctgtcttaaaaaacaaacaaacaaaaacaacaaatgctctttcacttacttttcttcctccctatacctcctcctgcctttgccatctgcgggaccaaaaaaatctagagaaggcttccaatgactcgagcccctttaaaggatccggaacaaaggggccactcaccccttccagggtgctctgttttctttgtggagtttcaagagtgatgggcggattcttcttaggtctaaagctctgctgtcttcctgtacggcatgacctgacctctttggctttgggggaaccagagatgaccctgcactgtgagaggatttgaccttggcgtgtgtaatggcagacgagaactacaaagaaggggtggctgagcacagtttacagggaatggtcttggctgtttttttgtttttttttttttctcttctaggaagctgtgatttaaggatcctaattctagttcagagatgcatcctaaagggtcttctctattgctttttctcccaaaatgaatctcagtttgggttgtctatgtatttgcatgaggaactgaactgttgttgtcataggtaaatgagagattgagttttctcagctccaaagagaaagggcgtttgctcctcccagccgagtactccatagggttcatggcgcctctacttgccagagtttatgtaaagtggaagtaatatggtctttctgcacatttacattaaaaaaaaaggagccctgaggttgacctgcaaa

SEQ ID NO: 31564 - DNA, 1028 bp, Homo sapiens
gccaactgccgatgacagcatttttctgttttgcggttgtaccgcactctattaggtttcctgcaggtcccatcaaaatgcaaaccctacctcctcgctttgaagcgactctccccgtactcgccccccagcctctaaactaatggcttagctaaccgattgcgacgagtgaaataccagaacccttcatgccaaagaaagcacttagcgcggggttgccacccagtaggttttcataaacgattgtttagtctgctttccttaaataaattggccatcacgtctcccgttagggtcttaatgagaccccaagaggcgtcatttgtataaaaagaaactctgtatatgcagtagaggaaagaaaacatatagaaaggagactggaaaagtgtgctcaaaacgctggtaacggttacctccagagaagagaacgatcgggacgatggtcaaagcggaccttacttcgagtttcttatttatctttttatttttaaacaaacattattggccgggcgcggtggctcatgactgtaatcccagcactttggaaggccgaggtgggagaatcgcttgaggcaaggagttcgagaccagactgggaaatatatcaagaatccatctcaaaaaaaaaaaaaaaaaaaagatattcgtgtgttccttgaataattttaagtattttgcaaaacagttacatgagtggggtgcgctcaaatccaataatcccccaccttgcccataaagttaaaagagattccaagtgattccgtttgttttagcctcccaccttccaacctccacccacatattttgcatcttcataggaaaatggcccaataaaagatgggatgagctgtctgaagaattgacacatcctaagagtaaacatgctattggggagaattaagaaagagccatgtcaaatcaaggggtatagttttttgttttgttttgtttgacagggagtctcgctctgtcgcccaggctggagtgcagtggtgcaatctcagtttactgaaagctccgcctcc

SEQ ID NO: 31565 - DNA, 1024 bp, Homo sapiens
ttaattaattaaaaattagctgggcatggtggcacaggcagcttgctcggagggcttagatgggaggactctaaccacccagcaggttcaccttgcccactgcctagatagagctgatttaccaagacaggaaaatttaaacaaagaaacagcgattcacagccggctgcatgggagaccagagtgttgtgttttattgtgttttgttttgttttgtttgagacggagtctcactctgttgcccaggctggagtgcagggacacaatctcggctcactgcaacctctgcctccagagttcaagcgattatcctgcctcggctgccctcgtaactgggataacagtcgagcgccaccacgcccagctaattttttatatttttggtagagacggggtttcaccatattagccaggatggtctcgatctcctgacctcaagatccgcccacctcggcctcccaaagtgctgggattacaggcgtgagccaccacgcccggcctgggacgggagatttattactactcaaatcagtttcccctagcacttagagatttttaggataatttggttgggggttgggggttggggggcagtgagtcaggagtgctgattgattggttcggagatgaagatgtaagaagtgggagctgtcttcttgtgctgagtcagttcctgggtcggggccagaagatcagatgagccagtttatccatctgggtggtgccagctgatccatcaagtgcagagtctgcaaagtatcccaagcgctgatcttaggttttacaatagtgatgttatctccaggagaaattcagagagggtcagaatcttacagcctcctcggaggttgcagtgaaccaagatcaaactactgcactccagcctgggtgacacagcaagactccgtctcaggaaacaaaagaaaaagaaaatgaaaaaaaacccacaatcttacagcttccagcttcatggctcgtaaactgtaatttctatcttttggctaatttgttagtcctacagaag

SEQ ID NO: 31566 - DNA, 1048 bp, Homo sapiens
ttgtagaagagtttaacattaactcctattttgacttacaaatcttgtttctcatcactaaaatgcttttgaattaataatccaacccacatgagctgagagtttttcttttgttagaaaagaaacagacatctttctgtatgaaagtataaattgtatggttttagatacataagaattgacaaaagcgagcgaaatctttgtacttctgagttcttgctgtatgtatgttttgttttaaatctgattagggacacccagcagctggccgggattcttggattgctccttgggagttaagattgtcaatactcctgtgaagcaagggatttcagccatagaacaaagatttattgttgccacctgaaaagtttacaagtatttattgtgtatttgatacattgcttgaaaagatgaaatctgttaaagattcttttcgatgtccaggttaagaagaaacctccttgtattgagtgaaattatatgttaaatgtattagagaatgtaggtggtatagaaattgatttttcttggtgtagaacaactcagttcggcaaagtttaaaatttgattaaacaagagaagtggttcaggttgaagatggacttgttaggaagtgatcaagtcctttaagtacttgtttctttttcaggttgtgatgtggccattccgaattttgttgagagtttggtttataattgtctcttttgtcttgttagtaaacattcatttgcaacagttttgaaggtgctgagtggaaaaccgaaacacatggttattgcgtattggacctagaatgaaataattgcctcaatatttaacaacaagccattcttatctcaaagatttaaattcccgaatgtcccattcgcaaatcatatgcaattgaagtgagcagcatgagcatctgggtcatgagggccttcatttacgtaaatttgtcactaaaacccagtagtagctctacaaaatcttaaactgctgcagtgctcaaggagatggaatatctttgtcattggtgctgaggagagcatttcggtagaagaca

SEQ ID NO: 31567 - DNA, 1281 bp, Homo sapiens
aatatatttaaaagaaaaaggaaataaaaatatccaattaaaaatcaaagaaatagtggtctcaccttatgacatttattttattttactatttttatttatttatttatttatttgagacagagtcttcctctgtctcccaggctggagtacagtggcacgatctcagctcactgcaaacctccgcctcccgggttcaagtgattgttctgtcttagcctccctagtagctgggactacaggcacctgccaccacacctggctaatttttgtatttttagtagagatggtttagtagagatgttggccaggctggttttgaactcctgacctcaagcgatctgcccgccttggcctcccgaagtgctgggattacaggcatgagctaccacaccgggcccatgacatgcattttcaatgtctaacttctctctctctctccataggtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactacagcctgggcgacagaacgagaccctgtctccaaaggaaaaacaaaaaagaagaataaaata

SEQ ID NO: 31568 - DNA, 1027 bp, Homo sapiens
tactcaggaggctgaggcaggagaatctcttgaacctgggaggtggaggttgcagtgagtcgagatcaggtcactgcactccagcctgggtgacacagtgagactccatctccaaaaaaaaaaaaaaaaatacagtcaaatacatagaccttaagggtttttattttttaaagcatatgtacacaaaatggaagacagaaaaatagcaaaacattttggaagctggaatgcagattgatttaagcagtctgcccgccttggcctcccaaagtgctgggattacaggcgtgagccaccacacttggccgatataactttttcgtagtgaagcttcagttaacctgtacggtggctgcgctgtgaactttcacccaaatattgggctccttaaggggctgtttaggcttggggctgtcctagggtcggtgagtatctagtaagagtgtaaaccttctatttcccttgtgtgcgtgttttatctttgaaggaatgttgatatttggtcagtatgaacatacagcagcatggctgggaatacaggggcagaaatgtaaaggaaacgcatgtgaagtttgcttttaattactggaccgttgtattcaagaaccttcaatggcagtatcttgtctttgctccagggtcagattccctaaagaagaagggatctcctacttggagagtacaaattgggcttccagcagtctggcttctatacttagggaaaggctggaggtcttagtattcgttatgtaaacactcattcttgttcatttaactcaactattttcagtaagatgacctcattctcaactggaccagttgaaaagctttccagtccaggaattctttgtttttacataggattgttttaagctgctacgtgtggttagtggctaccatattggatagcggagctgcactatccagtgtggtagccactagccacatgtagcagcctaaatctaaataattaaaattaaaggtttagttcctcacttgcactagacatgtttcaagtgctcaatgg

SEQ ID NO: 31569 - DNA, 1034 bp, Homo sapiens
agaagaatgggaaaaggctagtgtagctgaaatgcagagagttaagaagacagtggcatgaagtgtacctgatccacagatcagggccttgaggtttgtattttggattttatcctaaatgtaataggaaaccattgaatggtttttagtgacattatccactttgtagtctttgttctaacagtactgaagaagatggatgggtatgggagcaaagttgatgtgggcagaacaggagaccatttcagattcatggtactttgaagtagaatgatagcaggagagatggaagatgagtgtgatgtaggaagtaaaattaacaggatttggtgataagttggttatggagatgaaggacaaggaagtgtgaaagatgacttccaagtatgtgacttgtatgactggacggcctatggttgtatttacattagaaaaatgtaggacaactagtagaggattgttcaaatttaaaatgtacagtcatataattggatgctacttaagcaggaaaagctgtgtagataatgaacgatgggccgggcacagtggctcacatcagtaatcccagcactttgaggggccgaggcaggcggatcacgaggtcaggagatagagaccatcctggctaacacggtgaaaccccatctctattaaaaatacaaaaaaattagccgggcgtggtgacggatgcctgtagtcccacttactcaggagactgaacccaggaggcggagcttgcagtgagccaagatcgcaccactgcactccagcctgggcgacagagagactccgtctcaaaaaaaaaaaaaaaagataatggaagatgcttatattccatttggggtgggaaaaattacaagcagtgtgggcaaaaaatatacattcatggaaaagtatctgaatgataaacatgagagtgaaagaataaagtcaaatatgtgagttgtttcattaaataataaactaaattattccttcctctagatcaggggtgtccaatcttttggcttccctgagcctcactggaagaagaa

SEQ ID NO: 31570 - DNA, 1128 bp, Homo sapiens
gctcaaggaagtaagagaggacacaaacaaatggaaaaatattccatcctcgtggataggaagaaccagtatcttgaaaatggccatactgcccaaagtaatctttttttttttttttttttttttttttttgagatggagtctcgctccattgcccaggctggaatgcagtggcatgatcgtggctcactgcaacctccacttcccgggttcaagcaattctcctgcctcagcctcccgagtaggtgggactacaggcatgcaccaccatgcccagctaattttttgtatttttagtagacacagggtttcgccgtgttagccaggatggtctcgatgtcctgacctcgtgatccgcctgcctcggccttccagagtgctgggattatagatgtgagccaccactcctggctgcccaaagtaattaatagatttaatgctattcccatcaaactaccattggcattcttcacagaattagaaaaaactactttaaaattcatatggaaacaaaaaagagcctgtatagccaagacaatcctaagcaaaaagaacaaagctgtaggcatcacatacctaacttcaaactatactacaaggctacagtagccaaaacaacgtggtattggtaccaaaacaggcatatagaccaatggaacagaacagagacctcagaaataacaccacacatacacaaccatctcatcattgacaaacccgacaaaagcaatggggaaaggattccctatttaataaatgatgctgggaaaactggctagccatatgcagaaaactgaaactggaccccttccttacaccttatacaaaaattaactcaagatgaattaaagacttaattgtaaaacacaaaatcgtaaaaaccctagaagaaaacctaggcagtaccattcaggacataggcgtgggcaaagacttcatgacaaaaacaccaaaagcaattgcagcaaaagccaacatggattctaattaaactaaagagtttctgctcagcaaaagaaactatcatcagagtgaacaggcaacctatagaattggataaaatttttgcagtctacccacctgacaaagatctaatatccagaatctacaaggaacttaagcagattt

SEQ ID NO: 31571 - DNA, 1066 bp, Homo sapiens
gacagggtttcaccatgatggtcggactggtctcaaactcctgaccttgtgatctgcctgcctcagcctcccaaagtgctgggatttgagtgaccacacccagctgagattgacatatttttttaaaaaaataagcagaggctgggcacagcgactcacacctgtaatcccagcattttgggaggcctaggtgggtagatcacttgaggcaaggagtttgagacaaacctggccaacatggcaaacccccatctctactaaaaatacaaaaattagccgggcgtggtgacacaggtctgtaatcccaggtatgcagaacgctgaagcacaagaatcgcttgaacctgggagacagaaattgcagtgagccaagatcatgccattgcactccagcctgggcaacagagcgaactctgtctcaaaacaaacaaaccccaacaaaacacaaaaaacaaattctggagctgaaaaattcagttgacaaactagaaaatacatcagaatctctcaacagcaaaattgatcaagcagaagaaagaattagtaagcttaaggacagactgtatgtaaatacacagaggagaaaaaagaatgaagcaaacctacaagatctagaagtcacagggcaaatctgagagttattggtcttaaagaggaggtagagagagagagagagggtagaaacttcactcagatagtaacagaactttccaaacccagagaaaggtatcaatattcaggtacaagaaggtcctagaacaccaagaagatttaacacaaataagattacctcaaggcatttaatagtcaaactcccaaaggttgaggataaagaaagaatcctaaaagcagcaagagaaaaggaacaaataacatatgaaggagctccaatacatctggcagcagacatctcagtggaaactttacaggccaggagggagtggcatgtcaagtgctgaaggaaaaaaacgtttatcctagaatatcatacccagcgaaaatatacttcaaacatgaaggagaaatactttcccagacaaacaaaagctgtgagggattttgtcaa

SEQ ID NO: 31572 - DNA, 1028 bp, Homo sapiens
caataagaaatcatccaaaggtacaaaactcactggtatcagtaagtacacaagaacagaatggcttgacacactaattgccgtgtgtaagccatattttgagtaggaagactacaaagcctatcaaaaattataattacaattttttaagcgataatataaaaagataaatagaaacaatggccgggcacggtggctcacacctgtaatcccagcactttgggaggctgaggcaggtggatcacgaggtcagatcgagaccatcctggctaacacggtgaaactctgtctctactaaaaatacaaaaaaattagccgggcgcggtggcgggcgcctgtagtcccagctactcgggaggctgaggcaggagaatggcgtgaacctgggaggcggagcttgcagtgagccctgattgtgccactgcactccaagctgggcgacagaacgagactctgtcaaaaaaaaaaaaaagtagaaacaacaaaaagtcaaagagggggatggagtttggagttaaactgtagagttctgttttcgttttctcttgactttttttttttttggtaacgagttatcagtttgaaatagttgtttataagatgttgtttgcaagcctcatgaggcttttattttgaggtaaccatgtaacctcaaaacaaaaaatctacaacaggtatacaaaaaatgaaaagcaagaaataaaactatactaccagagaaaatcatttcaacgcaaagaaggaagggaggaagggaagaccataaaacaagtagaaagcagataacaaaatggcagtaggaagtccttacgtatcaataataacattgaatgtaaatggactaaagtctctaatcaaaagacacagattggctgaatggaaagaaaaataagacccaaccatatgctgcctacaagaaactcacttcacctataaagatatacacagactgaaagggctggaaaaaccagaactcctctttttccatacaaacagaagccaaaaaaagagagcagagtagctatact

SEQ ID NO: 31573 - DNA, 1055 bp, Homo sapiens
gtctcattatgttgcccaggctggtctcaaactcctgggctcaagcagtttttccgcctcagcctcccaatgtactgggattacaggtgtgagccaccgtgcctggccccttataccattttctaatactatgattcctttctaaacaagagttgaatccaggttaaatatgtatatgagaaaatgaggtaaacaaggagccaagtcttcaggcacttgacacacaggtttagtagattaactggaaaactgtactttgtatatctttatttttgtattattgttgtgtattatagcttaatagttacaagcatgggcttagagtaagacctgggttcaaattctggttcattgcttcctacttttttgcccttgtgcaggtcaaaggtcagcaaatggaagctgctggtttttggtggtttggatagcctgtggtgatggctgcatttctttctcttttcttgatcaggtggatttgtttaaaaagagtcttctgttgattcctattcacctggaagtccactggtctctcattactgtgacactctctaatcgaattatttcattttatgattcccaaggcattcattttaagttttgtgtagaggtaagttaatatactgcctattttttcatttattttgtaattggccaaatagcatcttagctctagatagaacagcagcagtcaaaaccatataggaacagtttatgtcatgaaaatcctccaaagtgttagctgagaaaaggactagaagaggaatctctggctgaggagaggatctgtctaggatccagatccccctctgagatactccacttggattttctctgcttttcccttaaaactacatcttgaatgtggttagaaattgtttttctttgatcatcttagagctaaaattggcctgtatctgcaaaataactcctgtagaataaactataacctaatggaatcaattgacaaaatattagtgttcagctaataaacagatggtgggatacaaaatcaagaaaaatgagtaggtttccggattttcctgcactaccaagaa

SEQ ID NO: 31574 - DNA, 1026 bp, Homo sapiens
agctgggattacaggtgtgcaccaccacacctggctaatttttgtatttttagtagaaatggggtttcaccatgttggtcaggctgatcttgaactcctgacctcacctcatgtgatccacctgcctcagccacccaaagtgctgggattacaggtgtgagccaccgcgtctggccctggtccacttttgttggggggtggggtgggttattcacataacctctgacttcactcttgatgtggagagagacgcacagaggttgagagcactggggacattttgaaactccagcaggcttcatcttggtagatagttcaacagtggacttgagcatatttagtattcagaaggaattttagtattactttccagaagctgaatgttaaccttttctgcagccctcaaaaataaggagtgtatcagaatatctaaggctggaatatttttcatttagttttagttattaatgatgtctgccatgggttcctttcctctgttgagcatgggcaatgatgaagactttctttttgacttgccagtatgtaagtttcaaatgcagcaagctgacttactgctgggaagggctggctaaccatctcataaaacgttctgattacacaaatgccagcgtccacagtcttgatgcataccttgaatacagaaggtctgactcccccttaacaatatgaaatgaagagtctgaaataaagtcccggctttagccgggagcggtggtgtacacctatagtcccagctacttggaaggctgaggtaggaggatctctgaagcctaggagttcaaggctgcagtgagctatgatcacgccattgtactccagcctgggtgacagagcaagatcctctctttaaaaaaaaaaaaaaaaaaaattgttccagcttcttaatgcatattctgcccagttatggggccacagcctcctcctttccttctgtctgctatgggcatgttccatttttcaccaactgatggaacacagcatctgtgttgtggtttctttttaacc

SEQ ID NO: 31575 - DNA, 1043 bp, Homo sapiens
cctggtgccaaaaaggttggggtcttctgccttagacactattaggtctgcatttagtaaaacagaatgggctggtccacaactccaagtgccactgaagtgtttctgggacctttttttttgcagtactgcaagtgcctcgccttagagcagcctttccagttttcacaagaagacatgccccgagtgcggaagaggatttacaaggagctatgtgagtgccggctcatggactgaaactcagcagggactctgggaagtctgaccaagttggagcagatggtttgttacttgaatctccaaacacttagttgaatttttacagatatttcagatcagtggtgttgggccactattgttacctcaaatttattttttgcccttattcatttctccagctaccatgtactattgtttaatgttcagtttggtttcatttttaattttatggttctgtgcgtcccccatatttaatatttattattcaaacgcatgcatatagacagagcatgcagtgaagagtattaaaaaaaaaagcttagtagatttggtgcagcttttgaaacttagttagacgtgaactgaatacaggtttcaaatttactcccagaacctaaaaatgcaagatgtttttgatacaacataactctgagaatagtaagtgttccctggggcattaagggtagctgggggtggttttgacaaatccagtcctgttttactttaccagcggcaactttcaccaacttccctctccaagtgagtcttagagagtgcagtccattccttttgaagggtgagatggaagtggtcgtaaactgactggtgtcttctgtttctggaggcacacttgtaagcacagtggctgctttgggaggagtaaggtgtgagaaaaagcaaccttggaggccagtaacaatgacagatttcaatcgtggttttaggaattataatacgtggcatacatctcataaaggcttttgctgggatattgaattccctgaatttttctgttttcgacctgttaaaaaaatcttaacatc

SEQ ID NO: 31576 - DNA, 2050 bp, Homo sapiens
ccagctactcgggaggctgaagcaggagaatcgcttgaacctgggaggtggaggttgcagggagctgagattgcaccactgcacttgagcctggacaacaagagtgaaactctatctcaaaaaaaaaaagtccacaggacaatagtcattgtatgttaaaaagaggttttcggaactttggagtgagacattagagaaagtaaattcctttcattttactgctgttactgatttgtgaacatggaaaggaggcatcttctttttctacttttctcacacatgtaagtaagatccaaataaatagcctacagtttaagataactgtggtgtaagtgcttaaagtatattaatatggattccattcacagaatgctagaaattccacatgacagtatggcattagcatctaaaaaaagctacaggtttagactgaggagatgaataatagacaaagtcagaaggttccagttttcatctcacaggatgctttaagttcaaaatggtcaggatgtggaactgtctaaagtagtaactaaaagtggtagaagtgcaaatcatgcctggcacttaggcatcccagcactttgggaagccccaggcaggtggatcgcttgagtcccagagttcgagactggcctgagcaacacagggagaccctgtctctacaaaaaattagctggatgtggtggcgcgagcctgtggtcccagcttctcaggaggctgaggtgggtaggatcacttaggctcaggaggttgaggctgcgtgagccgtgattgcgccactgcacttcagcctaggcaataaagcgagactctgtctcaaaaaataaaatacattaactgaataaattttttttttttgagaaggaatatcgctctgttgcccaggctggagtgcagtggcgcgatctcacagcaacctccacctccccggttcaagcgattctcctgcctcagcctcccgaatagctgggattacaagcgcctgccaccacgcccgcctaatttttgtatttttagtaagacggggtttcaccatcttggccaggctagtcttgaactcctaacctcgtgatccacccgcctcagcctcccaaagtgctgggattacaggcgtgagccaccgttcccagccttgactaaataaatctaagagcttccctaatttagcgtcaaacaaaatttccctttccctactctagtaacacatttcacacattctccacacttaccctctgctatatgcgccccttcctttcccagtcacaaggggatttttcccttttctgaatcctcactacaggggattatgagctcgcagagcgcagaaactgtcttccctctccctctagggtttagcacaaggatttggcgacagcactcgataaacgtttactaaataattgggttaatgagtcccgccccgccaacccccaaccgtattccatccctacctccgctgatactgaaaagtctactttgaatatctgctgcctcccctttttccacaaaatatactgtgatatagtccggactaaaaatttccctcttctgaaatccagcaattctccgatctttacatccgaacaccctcaaagtgccgagcttggcgggtccacctccccactccgaagcttccccgagggcggagtgaggactccacttgtgtctcccacgcaccgcgtacagcttccgtaacaccatcctcccagagaaggggcccgaatcgccgaagggcactgcttcgccgatttaaaaaacaaagcaaaaagccccgcatctgcatcaggaaggcgcctctgcctactctgggagagagaagggcacccctcccccttgctacgtagtcgtctgcggaggcacaaccgtggaaacgggagccgccaccaccaccaccgctcaaacctctcggcactggctggggtacagggagcggctgcgagcgaatgggataagcgagcctccagttccccgtcttccagagcaagtggcttcagtgatatccaagcgcccttccagcacccattccctgcctcgccagcaggcaccg

SEQ ID NO: 31577 - DNA, 1050 bp, Homo sapiens
gtgttcctcagtggtagaatgtatagagtgttcttcagtggtagaatgtatagagttgttcctcagtggtcgaatgtatggagttcttcagtggtagaacatacggagttgttcttcagtggtagaatgtatggagttgttcttccgtggtagaacgtatagagttgttcttcagtggtagaacgtatagaatgttcctcagtggtagaacgtatagaatgttcctcagtggtagaacttatagagtgttcctctgtggtagaacgtattgagttgttcctcagtggtagaacatatcgagttgttcctcagtggtagaacgtatagaattgttcttcagtggtagaacgtatagagtgttcttcagtggtagaaggtacagagttgttctttagcggtagaatgtatggagtgttcttcagtggtagaatgtatagagttgtttttcagtggtagaatgtatagagtgttcttcagtggtagaatgtatagagttgttcttcagtggtagaatgtatagagttgttcttcaggggtagaatgtatgagttcttcaggggtcttcacgggtagaatgtatagagttcttcaggggtagaatgtatagagttgttcttcaggggtagaatgtatagagttgttcttcaggggtagaatttatagagtgtttttcaatggtagaatatatagggttgttcttctgtggtagaatgtatagagttgttcctcagtggtagaatgtatacagttgttcttcagtggtagaacatatagagttgttcttcagtggtataatgtatggagttgttcttcagtggtagaatgtatagagtgttcttcagtggtagaatgtgtggagttgttcctcagtggtagaatgtatggagttgttcctcagtggtagaatgtatagatttgttcctcagtggcagaatgtgtagagtgttcttcagtggtagaatgtatagaattgttcttcagtggtagaatgtatagagttgttcctcagtggtagaacttatggagtgttcttcagtggtagaatgtata

SEQ ID NO: 31578 - DNA, 1027 bp, Homo sapiens
tcccatcttttcttaccctcaatagcaatgtcttataagaatttaactcgttatttgggaataaacctgtatttgccactcgttctcatgtaggaattccaacagggaactgttgccagaatagcgtgggcccctctgctgcactcacgcacacaccccactgggttaggaagttctagaatagcacgggcccctccgctgcactcacgcacacgccccactgggttaggaagttctagaatagcgcgggcccctccgcagcactcacgcacacgccccactgggttaggaatttctagaatagcgcgggcccctccgctgcactcacgcacacgccccactgggttaggaagttgtagaatagcgcaggcacctccgctgcactcatgtacacgcaccactgggttaggaagttccagagcaggatcgctctttggattcaaatcctctgctttctgtggtacctactgctttttttttcccttcaggtgcaggcccagttgaatacagaacaactgctagacgatgtagtagcaaagagaactcgtcagtaagtttccatttgttttttaagatgttatttcaaaactcccagaatactaactacccaaattatcatgtacctcagtccagaagaaattaattgaaacccaaaataaaattcagtctgaaagctgggcatagtggtgctacacacctgtaatcccagctagttgggagactgaagcaagagaattgatggagcccaagagttcaaggctgtgaagtgccataatgtcacctgtgtatcgccactgcacaccagcctgagcagcatagctcgatgccactgcacaccagcctgagcagcataacttgattgccactgcacaccagcctgagcagcatagctcgatgaccagtgcacaccatcctgagcagcatagctcgatgaccagtgcacaccagcctgagcagcatagctcgatgaccagtgcacaccatcctgagcagcatagctcgatcgccagtgcataccatcctgagc

SEQ ID NO: 31579 - DNA, 1094 bp, Homo sapiens
aaagtaaaaaaactgcccttaaatagcttaatatctttcgaagaataacagttttaggaagcccaggataacaaaaagctatatatgcattggataaatgttatttgctggggatgacaaatacgtcacctgccattgtgacccacgctcataacatgtatgagctcataacatatgtatggttatgtatcatggaacttgttgctgaagtaactagaatgtattgagagtttatagaacagctctctgggcagctgttactaatcaactttggcactgggattaaacatttttataccttctagcatttagcaattcatgccaattgaggtgtcattgaagagttggggcttgaatgagaggatctctccatccttatttttcttttgctctctgacacgaactttctgatctgtggccttcgtatcctccacatgttaccactttaagtcgtatctggatgtgttcatgctgatccatcttctagtctcaccttccagtttgtcctactttataatccttcaggtttaattcaaaaccgaatttatccatgatatagctttcttttctctggactcataagtaagccccatcactcttagcccttttttgtgggcctgtctgggttccataattagattgtgatcctctaggaaaggattgtacctgacagcctcttctatttcccatagtaaaactagttgattaattgttggtaaaatttacatcatatagcagaaatggcttcttcagtaaaacagactgaagaatatgctagagactggctgcaatataagtgaggtctaattggttttaaatgaagtattttccactctttcatttcttgagtggtttcaatttagagcatctcttcggttctacctttaattcccacatttagattacagtgagatcattttctgttcctcaattttggttccagaccaacattttagattttaatactactataatcttgctttatccaacaataaaatcttgccaaaagtacaagtactattgaagatatttgttgtattttcattaagaaaagctattttataaaagggatggatgatataaaataatacgtt

SEQ ID NO: 31580 - DNA, 1069 bp, Homo sapiens
cctggtacactgagatcatactggacaatgaaaatgtacaaatgctgattgaatttatttaaaaaaggataggagtccaagatcactgttaaacctgtaagactagaaagatggtaatgctattgcttataatagtagctaacatttattgaggtcttaacatattccaggtattgtgctaagctgtgtgtgtctatatataacatgaacaaaaacaaccatagtaagttgtaaatactatttttgaccccattttacgtgtgagaaaattgaggctcaggagattaaataatttgatcaaggtctcccagctaataagtgacaaaactaggattcaatttctgatacatttgaccctaaaatttgtgttattgatcaataattataccgacaagttggtttcctgtaatttctttggtttgcccaatatctttgaagggttggtagcacatctagtgaatcatgtgggacaaatagaaacaaatagaaactagagctttagaatgtagagtgacactttaggaggctgaggtgggtggatcacgagatcaggagttcaagaccagcctggccaacatggtgaaaccctgtctctactaaaaatacaaaaaaatttgctgggcatggtagcacacgcctgtaatcgcagcactttggggggccgaggcgggcagatcacccgatgtcaggagttcaagaccagcctggccaacatggtgaaaccccatctctattaaaaatataaaaaattagctgggcgtggtggtgcatggctgtaatcgcagctacttgggaggctgaggcaggagaatttcttgaaccctggaagtggaggttgcagtgagctgagatcacgccattgcactccagactgggcaacgagcaaaactccatctcaaaaaaaaaaaaaaaaaaaagatgtagagtgaagttaattaaggctatggaataaattcaagagagtcatagtgagagtttataagattcttggaggaaggacgtagagaatggaaaaggtaggcactgtcaactcagggagataccagcattttaaaaggtggaaagagga

SEQ ID NO: 31581 - DNA, 1051 bp, Homo sapiens
tgatggtgaaaccctgtctctactaaaactacaaaaaaaaaaaaaattagccaggcgtgctggcaggtgtttgtaatcccagctactcgggaggctgaggcaggagaattgcttgaaccccggtggtggaggttgcaatgagccaagatcacgctgatcgcaccactatactccactccagcctaggcgacagagtgagactgtctcaaaaaaaaaaaccccacagttttttaaaaatgattttcatatcatagagagtgggaaggtaagccacagtcttcttaagatttccaataaatgcaacagattagatccagaatatttaagaatgtctatacacaagtaagaaaaagacaacccaggagaaaactgagaaaacacttgaactagtactttactaaagaggaattccaagtggccaataaatgtttgaaaaggtgctgaacctcatcagtaatcaagagattgaaaaataaaaccacagtgggtactactttacaagttgatgattccaagtactggaaagaacgtggagcagtggagacactcatacgatgctgtgggagcttgtgggagtgtgaattggtgcctcaactttgaaaatgctctggaacgatccaggaaggtttaaaatacacatattctgtgactcagaaattccactcttgagataaatctctcagagaaagttgtgtgtatgtataccaggatatatagtatgataagactgtccatagcattattcatatttgacaaaatagaaacaacttaagtgatgatcaccagtagaatggataaatcaattgtgtgaaaatgagctggccaagtgcggtggctcacacctataatcccagcactttgggagtttaaggtgggtggatcacaaggtcaggagttcgagaccagcctgaccaacatggtgaaaccccgtctctactaaaaatacaaaaaattagccgggtgtggtggcgggcgcctgtaattttagctactcaggaggctgaggcaggagaatcgcttgaacttgggaggcagaggttgcagtgagctg

SEQ ID NO: 31582 - DNA, 1033 bp, Homo sapiens
catatcattgttgatgtgttagggcctaagtctgccattttatttgttgtttcctttgttttcctttctgtgttctttttcttgccttcctgtggggttcgtgaacattttttagaattccatttttatttctctgtagtgtttttgagtgtatctctttgtgtagctctctttgttgctgccctaggtattacatgagagaagtccaacttgtcagtctattggtatccttattttatgagtttgagtgacgtatagaaaccttacccccttcatgtcccttttctttccctgttatagttgtcttaaatattttctctataaatatttagaatcacatcaaacagtcttataatttttgcttccaatataatttggaaaactcaagagaaggaaagtcttttatatttacccatatttttgcttagtgttatgtactgaattttgtccgtcacccacaaattcatacattgaagtcctaactctcagtatctgcgattgtgtttggaggtagtacttttaaagaggtaattaagttcagatggcatcatttggctgggctgtaagtcaatacaagtgatgtccctgtgagaggagattaggacaaagacaaagaggaaagatgatatgaagactcagagagaagacagcatctgcaagccagtgagagagacctcagaagaaagcaaccctgctaacaccttcatctcagacttctagcctccagaatttgagaaaatacatttgtatcgtttcagctgcccactgtgtggtattttattgtggcagctctagcaaactcatacgctgtgtcctttcttggtgttttaagattcctttctttcaccacttactttctatttagagaacttccattactcattcttttagattacatctgctgctacagactctctcagttttcattcatctgagaatgtgttgatctcctcttgattcctgaaggacattttgctggatatatatacaattctgggtgaacagtctttcttttagtgattggaagatgttg

SEQ ID NO: 31583 - DNA, 1041 bp, Homo sapiens
actcaggaatgtaaatgaaggttagcaaaaccaaaatcatgacctctaggaccttataaccccaaatttctccctagggttacctctgtactcaggactcgcctactgtggttggtcttcaaagacttactcctataataatatttagtgtgaaatcaattaatgagaatattagggttttaatcaaaatgaaaattgagcatttcagatgacaatggaagcttaatagttttatcaactaatttatttctgtatcttattttgattgtagactgctgacaaaatggtttatcacacaaatagtttcaatttttttaacagtttattttataatctcagcacatatagttgaactgagttagcaagtgaagctttattccaacagctacattcgttcgtgtggaagtttgtgttacttaattggtaatttctaacattgcaatttggtacatgtcatatatcttttgttatattgccattttgatttaaaattaatttttaccaaataatatgttacatcattcaaaaaatattaaaaaatattaagaatcttttttttttttttttcttgagacggagtctcactctgtcacgcaggctggagtgcagtggtgcgatctcagcttactgcaagcttcacctcctgggttcatgccattctcctgcctcagcctcccgagtagctggcattacaggcacacaccaccacacccagctaatttttgtatttttacttctttttttttttttgagacggagtctcacactgtcgccctggctggagtacagtggagtgatcttggctcactgcaacctctgcctcccaagtagctgggattacaggtgcccgccaccatgcccagttaatttttttttttttttttgtatttttagtagagacggggtttcattatgttggccaggctggtctcaaactcctgacctcatgatccgcctgcctcagcctcccaaagtgctaggattacaggcgtgagccaccgtgcccggccttttttgtatttttagtagagacggggtttc

SEQ ID NO: 31584 - DNA, 1034 bp, Homo sapiens
tgtgtttgtatgtcttggtgggtgggttcataaatgtggctgtatcaatacagatatatatgtagatattttaaatctatatatatataatttatggagtcatgaatcttttatattttttgagacagagtcttgctctttcacccaggctggagtgcagtggcacgaccatggctcaagcagtcctcccacctaaacctcctgagtagctgggactacaggcttatgccaccatgcctggctaattaaaaaaaatttttttttagagacatgctctccctatattgcccaggctagtctcaaactcctgggcttgtcattcccatcttggtctcccaaagtgttgggattataggcatcagccaccactccagaccagatttttatttttttgaaataggatctcgctttgtcgcacaggctggagtgcagtggtggaatcctgtctcattgcagcctcgaactcctgggctgaagcgatcgtctcgcctcaacatcccaagtattaggattacaggcatgtgtgagcacatctagctaatttactcctggcctcaagtgatcctcctgctttggtctcccaaagcgcatggattacaggcatgatctgccaggctctaaaatgattgtttttaatgtttctgcttcttttttaagcctacagatgaattttcagatctgcctcttcgagtagcagagattactaaagaacaaagactacgaagagaaagccagtaccaagagaaccgcggcagtttggtagtaacaaacggcggaggtaaacataattccggtgacagctaaagtgtttgcaaccatttaactttttaaagttgtctttttcatacccactccttttgttggtgtatctatagcttcttcactcttcttttaaagacttcttttcatatatgattgaaaaatactattttccattgggatgaaactatgatttctggtttcagtcagagttaaaatacactatttctcccttgtttttattttgggaggaaactttattagagacagtacac

SEQ ID NO: 31585 - DNA, 1031 bp, Homo sapiens
gactttgtcaaagtgagtcgtttgaatgatgctgttcaagctgctgactggctaagtgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataacaaaagtttgctagcctcacaggcttaatcctttgcaggaactttgatttgttcctttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtggtggctcacgcctgtagtcccggcactttgagaggccaaggtgggtgg

SEQ ID NO: 31586 - DNA, 1302 bp, Homo sapiens
aattctaaccatttctagaatttctttccccatcatgttttatgtgattgttttcatagtagtacgttcagaggtctagtgcctacagtgctagtaactgctgccagggtgcatcctgctgcgtgagctgcatgcctcagcatgacattcctgttacatcagcttccgtggtctgttcgcattgctgtgtattccacaaccttcatttcctttgagatggataaagcaccttttaactgggcggtcttataggtgaatacaatcatcacactctagagttttagtttaagtgaattggcctaagaagcgaataataagttaaaaatgtagacaaatattgagagcctccgacgatccaaacacttaccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtggcctcgaagctccctcgtgctctactgcctccctctccagtctcctctctgggcttgtgccataccagcattgtttccagctcttcaaatatcataagccctttcccatctcagacctttgcaaatgctgtttcttttacatagaatgcctttccctccctgcatgtaccccttgattaattcctactcacctatcaggtatttgtttaaatgttccatctttaacatgacttttcggcagcccaccacccttaaatcagcccacagtttgacagttaaataaactgacaggagctccagtgcgtttgatgaaaaggaggcccgggaagtatacatagtgtattactgttgtcacggtaatttttttatcatggtagtttta

SEQ ID NO: 31587 - DNA, 1035 bp, Homo sapiens
atttaattttattctttatttttatttatttatttaattattttgagacagagtctccctctgttgccgaggctggagtgcagtggcatgaacatggttccttgaagcatcagcctcttgagtagctgggactacgggtgcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctattttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgatttaaagaccttgaaacttacgatttgaaatgaagatttataacagctaatatcagtttacactgacattgtcttcgggctgcccctcaagcttctattaatatcagtttacactgacattctcttcgggctacccctcaagctcctgttaatatcagttacactgacattatctttgggctacccctcaagctcctgttaacatcagtttacactgacattgtcttcgggctacctctcaagctcctgttaatatcagtttacactgacattgtcttcgggctacccctcaagcccctgttaatatcagttacactgacattctcttccggctacccctcaagctcctgttaatatcagtttacactgacattgtcttcgggctacccctcaagctcctgttaatatcagtttacactgacattgtcttcgggctacccctcaagctcctgttaatatcagtcacactgacattctcttccggctacccctc

SEQ ID NO: 31588 - DNA, 1647 bp, Homo sapiens
aaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttt

SEQ ID NO: 31589 - DNA, 1052 bp, Homo sapiens
cgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatg

SEQ ID NO: 31590 - DNA, 1050 bp, Homo sapiens
gagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcac

SEQ ID NO: 31591 - DNA, 1031 bp, Homo sapiens
cagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgt

SEQ ID NO: 31592 - DNA, 1030 bp, Homo sapiens
ttcttgacttcttttattcatccctgaaaaaatcatgtaaatagtaaatgagaactggagaaaaaattcaaaatggaaacctctttcataaataaatttttgtcctcttttaaagtaattgaagatacttttggtctcttcctgtcattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtggaatatgggtcacagaactttttctctgggtattacacttgaaatttagttcattaattttaagtttggattgcagtgggttaatctgtatgtcttaaacagttttcaaatccgttccttttttcaggtcataaataaagttcatcttaaggcaaatcatgtggtcaagagagatgttgatgagcatttaagaatcaagactgtctatgataaaagtgttgaagagtaagtacaccattgtattgtcatctttttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttattagaaaagtaaaggaataaaagaatggctgctccataggc

SEQ ID NO: 31593 - DNA, 1043 bp, Homo sapiens
cactgtgtatctcctggtaacgcctcgtgttgttgtaagtattatcagacttcatgtctcatgagccatctgttcttttcctttactgtggtcctttctttactcatcattattgtttaagaacttataattagagcctatagtaggaaaagtcatataaagggaatgcaatgaagctacgggccacgagaaatctgaggaaatggaaacttggcaatggctctcacagctcctatcccacccagtgctttaggccagtgcctcctctgttgtgatgcctcttaggaccactggtactatttctataatgactgatcattttctttggtgtctgtattagtcaaggttctccagagaaacagaaccaataggatgtgtgtatatatctatacatctgtatacacaaagaaagaatacgagagaggaggggaggaagagatttctttttttcttttattttctttctttctttttttttttttttgatacagggtctcactctgtcacccaggctggagtgtagtgttttcggctcactgcaacctctgtctcctgcgccaaagtgatcctcctacttctgcctcccgagtggctgagactacaggcacgcaccaccacgcccagctaattttgtttatttttttgtagtgatgaggtctcgctatgttgcccaggctggtctcgatctcctgggctcaagcagtcctcctgcctcagcctcccaaagtgctgggattacagacatgagtcaccacacttggccaagaggtaacttttgaggatttggctcacatgactgtggaagttgggcgagttcaaatccgatgggataggccagcaggctggagactcaggggattgttgcccttggagtccaaaggcagaatgacttcttattcaggggaggtcagtctttgttctcttccggccttctcctgattgggtgatgcctacccacattatggaaggtgatctttacttcagagtccactcattgcaatgttactctcattccagaaaacaccttcacagaaacatccaga

SEQ ID NO: 31594 - DNA, 1089 bp, Homo sapiens
cccaaatcctttctcctgatattccagccaagccttttgcattttctgcaattgcttccaaagtctcaggatcatggtcaccaggtttgtctacaattctcccataaaacctacaagacaaaatcttcacagggtattacctctatattggcatatcacaagcaaaatctgtttttcatttttattggtactatcccatacatctgcttaatgaaaacaacatataattagttaggtctagaagggaccttagaaagcaactggtcatttctccacctcctctttcttttcccagataagaaaacccaggatcgaataaaatataagtagcctttttgaggttagcaagaactaaaacttcaaggtctccacctcacttccaaattactgactcaagacattccgaatggtcatcaaatgcaattcctgaattggcacttatactagatgaaaaaaaaaacagcattcttgtaaaggcagcaaaccaaaacaagactgcagtgccttaacagagtagtctgaattcctcaaagcttgcctgtctgtacacattagtactttcaaggaaaaccttcaaatacgactcatctagttgcgcaccctggagtatatttcgcggaatcttagaactggaagccctaacgtgcatgtgtttccctctcatgcccttaaaattctaatgaattcatcagcggtccaaagtgatgctaaataagtaaattaatgctaaatctggattagtgatacaaatacagctaagtcttaatctatgttctattatttataagacagactacaaatactcaagtttagagaaactacattgacaaaatatccatgttctgttatagaatattctgagagcaatcccaaccagtgaaaaatgaatattacttgacataaactagccaattcggatagttttttaaaaaggttagtgtgtgacatttaaacatcattgctacccacaaaactagtcatgcgtttcatatttaccaagtttatccaagatcttctttttttttttttttttttttgagatggagtctcgctctgtcgcccaggctggagtgcggtggcacgatctcg

SEQ ID NO: 31595 - DNA, 1076 bp, Homo sapiens
ttttgtatcttttatcattgaatgaaaggaagaaaaggttgacaactgcagttgtcctcagattactgtatccagttaaatccaaaattgtttttttctgtcagtcatgtaattctgaaaatcagctgtcttatgacccagtagaactttatatctggaccatattctgtagtaatgtaaaaccggagaatgtttacaaagcaatgatagactaagaaggtgcagaacccattgaatcctgcttttcttctagtttgccttttgtttgtttgcttcagcttaatgattctctatgatcctgggaacctgttcagttccctcagctgtactatcttcagttttcaaagagggatgctaagaagggattacatgctactctggggttaggactatgtatcttggattgccctatcttacttggcaccctatgtgaggactaaaactagaatacatttgttactataaataaatgtggcatggtatacctagggaaaaaaataaggaaacagttgcaattacatggtttatcttaagaacaaaataccatggtttgtatttctggttgcattatctgacaatcgttcttattttagaatataaatatttactttttgagacgtgtccttcctggcccatccagtttaactcagacagaagtgcattatttctgcaggtaattgctgttttctaacttgactgcaatacaacaaaggaaaagccagtacaagttagaatgtggtgccagtacaagttagaatgtggtcttggcaaccagcaatttctataaagaaattcttaagattactctttatttctatgcagtagaagaaaaatgtaaacatggcttaagagcataaaagtcatacatattacaaaattagaaaatgtttttagaaatgtttttaggtttcagggaactgtatggatcaaatctcaacttagaatctctaatccttagaatttgcctctaaagtctgtcttcatgataggtttatatgataggcttggagtacagaaatgtttccttagctgatatctttccttaatttcttaggtatgcctggactgttgcccag

SEQ ID NO: 31596 - DNA, 1036 bp, Homo sapiens
ctgccccatgcctttataactgtgataacatttccttagcctagaaccagaatctgtttgtttttgctatcttctataaaatgagtcagaactcatacccccaaagccatttttttggctcctgcaccttgtcctcattgttttcacagctgaatcttttgatattttcataaaaggtcctcactgaaatttaagttaattaattaatccttcacctggtatattggtgtgaggttttggaggtgaggaatctatgcatcttagttaatttcagcttcacattctaaatatttaataccatcacttagtcccaggagacttcaacggatgtgtattagaaagaagagaggcaaattgatagagttaaatgtctttttattggcaagtcaatgccagaatcaggactagtggcacagctacaattgctgaacttctaagttagctccttagagtcttactttttatgtaaaattccattatgcccacagtaagctctgggaagctgtgtggtctcataaataattccgttcagccttctactatgtacatgttggttctgataatagaactgaatcctgcctagcctctcctctttgtcttctcccatacacacactccaagaatggagccttctgtgaacactagttcctaacttggataccagaacatgcaacttgtgcttgatactgtcctcccacattgaccgccacattgctagatcctagaccttggtcccagtcagctaactggagtcgcgactggattccctgctttcttgtcctatactcattgacagaaaaggaccttttgcattattattagcactgtcttcccaaagtaatgaacctttgagaagtcaaaagcaaaataattcagagatgacgacactgaaaataagacaggctttatttgcctgttggtttagtagtgtatttctaaacctgactaatttttataatgatctagtaaattgttcagctccatttaaaaggtgtaccacatcagcaaaatgtctaggagatatagattcctcgtc

SEQ ID NO: 31597 - DNA, 1073 bp, Homo sapiens
tatgcctcaatttatccaaaacttcttttatatgtttttatatattgccagattgtatggaggttttgtttttaatttttggagaaaactctatattgttttccataatggatctgccaatttacatttccaccagctgtgggcaagggttgcttctggcagtttgtcagtgatgttttgcttttcaaatattataatagtgtcatctctgcttgattttttttctctatgtgtattcactttttctttgatattatattagttagaacttgggacataaggtagatagcagaggtcatgtatgtcttggtcctatttctgatccccaaaataggatcaaaacattggtaaaattagttccatgagtggggctttgctatattttctctgtgtgactcttggtttgaaatgttctatgtaatatgtatctttttatttctagtttacaatactttattaagaatagatattacagtgtcacaactctttcagtaatattttacataagtacttaaggcttctagaaatttaacattgatatacagtcatgtgctgcataattgtgttttggtcaacaatggactgcatatatgcatgtatgatggtggttctatagattacactggagctgaaaaattcctattacctagtgatctcttagctttcataacatcatagtgcgatgcattatgtatttgtgtttgtggtgatgctggtataaacaaacttgtgatgccagtcatataaaagcccagcccacaccattatgtatagcacatggtatttgataataataaatgactatgttactggtttatgtatttaccatactttttactgttattttagcatgtactccttctccttacataaaaaataataactgtaaaacagcctcaggccgatccttcggaggtattccagatgaaggcattgttatcttaggagatgacagctccatgcatgttattgcttctgaagaacttccagtgggacaagatgtggaggtggaagacagggatattgattattctgaccctgtgtaggcctaggctaatgtgtgtttgttttta

SEQ ID NO: 31598 - DNA, 1077 bp, Homo sapiens
ctaactcagaattcctgagtgatagattattttctactctgtggttattgaagtttcacctgttctcatagttgcagctcagaaagcaggttcaggtggctttcaatttaggtgaagagtaaagaacttcatccctgaattctggaatttcacagtttggaatgtttacaaaagcattatttgagttattttttttttagtctgacaataaaagcatttttattgcaattatgtttctggtccaagatgaaacttttcttttaaaagttccaaacgaagacattttgggagcttttttctggagggtggggtaggcgtgggggtggggctgggcatttatgagttgtaagaaaagaggttggtggagaacagatggcctcctccaaccatacatattcatgagtgcatttatttcattatgtcatcccctgggaaaccctatacttcagcttttataagttcgaatgccgtcaaattgagcagtcagaaggccctctgtcaaaaactgtgttgctgaaaaatttgaagaaaagtatgtgaaagccttcacttcacgcttttgtcttgactttttaccgctgaaacaactgttatttcgagagccaagactagagtgtcattgagcataataaatgttaagtgttgatagctgagctgacacgttccattaatcagatggtggtgtgttatgtttagagtattgccaagcacattgtttgctaatgtcgtatgaaacatgagatgaaaacatgtctgtgtgtctgttggagcatcttcaaagttgattccaggccctctccatttgcagaaggggaatgggtcatccgacgggttgaaaaatgttcattattaaattccctgtgtgtctaatcatttggcaggaagttctctcttatgtgcttcatgcaatcttttccactggaccaagaaagagcagcacaggtttttttccccctttcctgctgagtgagctcctgctagtgattaatgaaggcatctaaatagcctttggtttaaatgatgttatcactgtctccatttaactccacatgtctttacctcaaacaggaataagac

SEQ ID NO: 31599 - DNA, 1027 bp, Homo sapiens
aagatgttgcacaagtaaagcaagtgagggtctccagcagcccagagaaagaagaagcagaaggaaggtataaaggcattgagctgggcaccataggacttgaactctattcttgtctctgcttgtaactgatatttaaaaagtggggactagccagcgaaggcatctcttgttgcgaatcctgttcactgagtgtcactgcctggagtgtagtactaggaagatgccctggccacatgtgggcccagtggtgaatctgtggatatgggcagtgtgagaatgctgtaagggccagggatggaaagactctaggtagctgaaagaattccagctgtaacattcaagctccaacatttggaaactgtggttcttcccatcatcttcttggacactcataggggattccaggagccatcacaattgagaaatggtgtgattttcttctacactgacctctcccaggactctgagaaaatggcatacaatttagctagttagctctgttgaattctgctaagtggtcccctaagaggagcactgtggactagcacttgaagacctaaaaggtttaaagtctttaaattcttgagggcacaatccatgttccaatttcttttgccttcaaccattgccagcaccataccaagtgcatactacacaggccagatacaaaatcatttctttcacgggagagacaaaagccctggaaatgctgaggggttttcccctccctgttgccgatattgttagctagaagttgaagaccatttcatagcccgagatatttttgcttagtcttccctctagccttttagatgttcttttcctagcacgcatttgccctttggcccttgttcgtatctgtcattgactttgggacccttttcccatcatagagcaggttctttttgcaatgggatgggggcccctttgccctctataacctcatatgacattcaaagcccatgatatagcaaaacacaggggagttgctttgctgtgactgactctgccaacccagggaccc

SEQ ID NO: 31600 - DNA, 1050 bp, Homo sapiens
atcagccccatcatgtcccttggtatgtgggcttgatgcatcttgaaggcctgccctgtgtctttgtaatcaataggtccattgcttattgttttattatatacaggtaactttttaataccttatattcttattcatttaacacattgattgaaaacttgctatgttctggacagagtttttaggcccttgaagtattttaggcatgaatttgacatggggagatttgttttgaaacaggatgaagaaaagagaaaaactgtggatagaagagcaatggcaagggccttcttgcacctgtccagctaagacattatcagagcctgcatacttttctattgtgcgtaacaaattgtcacaaacttagcagcttacagcaacacacatttattaccttacagtttctgtggatcagaagtccaggaatgacttagctgggttctcactgaggttgtttcagggtctttcacaaggctgcaatcaaggtgtcggctgggttgcattgtcttctggggcttgactggagaagaatctgtttccaagctctcacaagttattggcagaatttacctgcttatttattttgcaactgtagtgctaagagctgccctcagctcctgcaggggattggcagggtggcttgtttccctgccacgcagtcctctccataggcagtttattatctttcagctcacctttttaggccagcagtgcagagacttgaagtaagtctggcaaggaatcttataaaatgtgagcacaggagagacctattttgatatatactctttgttagaagcaagtcacaggtccaccttcccacatacactcaaggggagaagattacacaaaaagattaccatagcatgtggagactagttggggtcagcttaccgttgttaaagtaggttcttcaccaggcctgaagaatctctgagcagacaaagccagtgcccttaactctgattacattgcaaacgtaagtgaaacataatttgagctctttcttgtaaatgtctgtattaaagaaaggcagaacttaagctcaac

SEQ ID NO: 31601 - DNA, 1037 bp, Homo sapiens
tcctagcactttgggaggccaaggtgggtggatcacctgaggccaggagttcgagaccagtctggccaacatggcaaaatgcagtgtctactaaaaataccaaaattagctggctgtggtggcatgcacgtatactcccagctactctggaggctgaggcaggagaatcgcttgaacctgggaggtggaggttgcagtgagccaagatcgtgccacttcactccagcctgggcaaaagaccaaaactccacctcaaaaaaaaaaaaaaaaaaaaaagaaattgagaaatgaataaaagctaagaacttattccttagacaaataaacacacaactaaaactgtctttattttcagcaggttagtagatgccttgctggctagctgtggacctggcttagggaattctgcctcttagttcttagtacaagatggacgataaagaacagatagctaagagattgtaggcagttattttttacatctacttatagctgtatgcctaatacttagcatttcagctggcaggtagaacgtgttcagtagatatccattggatgaatgaattaatgaaaatgagactgtatttctataatttgactttcaaccaagcatcttaaagtgttattatggtcatcccttgattgctcaaggctagttgtggttttcaggaatatcagcaggaaatattcaattcaggtcacttttttttttttcctgctgtatcctcttgtctgacttctaaccaagtgggtactggttcttatgtctcataagcagctttgtgactttgaacaaatcttgtctttgccaaagttgagatgctaatttaatagcttttctcctgatcccactgggatgttagagaaaggaagtaaaatatgtgtgaattttgttttaaaggggccaaatattttttaaagtattctaacttaccattggtgtggtgccagaggtaagacttcaccctgtttgtcgttgtgggaggatgtacaatatgctattaaacatcaggtggccaaggttttgtcagccacac

SEQ ID NO: 31602 - DNA, 1089 bp, Homo sapiens
tactagagctgtcacagggaagggagatgctcgtgttctgcaaagccaaattgcagtgtttccattgaatttcacagcaacagaagacaggagcgttttctctagttatactttgctttaaatcctgaaaaacctggagatattacacatccacctaactttttgaaaacggaggattcctctggggtgtttatttctttcataaccacaagatgaattgatagtgtgtgtgctgcgagagaggaaacaaatagaccatttccaaatgcttttgcaatgaatataactaaactgtcttaaaaagccagcctagtcaaaataagtgcaattattttaaaaaataagtcatctttataggagaagcagtctgaaagtgtaagttgggaaaagctgtgtgtgtgtatgtgtgtgggtgtgtgtgtgtgttcccgcgtgcatttgggtgtcagtcttcaaaggctgcaattatgtgacagtgcttccttaaattcttcagagaatttttcactgtagtgtatatcaaataaagaaggataagaaaatctagcaaaccattgtgtagttcaggatctagcctatacattgtgcccagggttcgtatgatgaaaagcattaatttcccttagttcctaagagggtttgtgaacataggtgtctattcccagctctgtggggatgcatttttatgtatttattatattcgtaaaagccatgaaaacctggtcccatttagcctcaggatgtgctaatgtcatttaaaaatatgcagaattaataaccatttaaaaatttctattgtttttgtatcttaaagaaaaaagaaattcaggaaggcaggatggaaggaaagaaaaataggaaactaaaaacatatcaaactcgctggccagtgggatagcttgagagctgagtccctcttccctcacttcataaatgactttgtgtggcacagtgacatctttgcaacacagtggctgctcattcaatatttgtctttctttggaactgttggaagaagaaacctacaaattgagtagtaatggccataacattaactattatttgtatatagtcctttagagattacaa

SEQ ID NO: 31603 - DNA, 1087 bp, Homo sapiens
tgtaagcaacaaaactccaaaacaacaaacaccaaaatcatgataaattattccattctgtctttaccaattgctgtgagtgctaaaacctagatttgagcttctgttctaccagtccctggctgtgtgactttgagcaaatggccttgcctctcccactctctgcttcttcagaggtcacatggattaagtgctttaaggacatgcagtgaaggtggcacagctgggactttatcccatgccttcattggtatcaaaacacacattgctccctcttagaaaggggtttggtgcatagtaagggctcaataagttaagctctgggtcaccgcactgccactgtggggaatctgtgaaggaggtatgaagtatgtgctcattgctctcagcagctttctttctgtcctaaacttcacacactcagaatcctttacatctttcccctttaccccatcacacctgctccttcaaaagagcctggaatttggactccaaaattcagaaattcttggacgtgggttcctgctctgccacttactggctgcataatggtggttgcatacttctactgtctgcttctccatttctcattctttaaaaagaaagcattggtctaaatgatctatacattcctttcttagtttaaaagataaatctgatgtcaggtgatcaggatgatagtttccaggtgtgtgcactggggcacgcctttaccttgcctaagtctgcagtcacttgtagaatgggaatcatgaaagcccttgcctcataggtagttgtgagaatgacttagtgtaagtgaagcatttgttaggatagcacctggaccgtactatcgtcagtagcaccagtagctataatattctcaatctaagattctataatctaggatcaggtggatcatttccaccttcaacctgagtttcagtcatggtgttttctttccctgggggcagttgctttatagagacattgttagctgttaaaaggatttcagtcaaaaggaagtatttcagaggttttccaagctccctggaaatcatgcctcttgggcatctgtccacctcaacaatctgtaaaacctgtt

SEQ ID NO: 31604 - DNA, 1030 bp, Homo sapiens
atgtccttgttctttcctgcttcccaataaagcaaaagacctggccttcgagcaaacagtgttgagagatctctttccaattatttaatatctcaagtcttcttagttttctgggcttgcctaagatcttgaatataagtgtccctaacaaaaacgagcccttggtgagaagggtatagtgagggtccatatctcctggccatctaactcaagacattttctggatttcaccacctcttgataggaggtatgacattggcaaaccatttcataagaccttccttcgatcacccttcctagccaccttccatcctgccctcttttgttgcaaaactcatctgcagagaccaaatccctccttaacattttattgcacattgttttgttttttatcatgtttccccaaatagaacctctgtccctggagaagaagactttatttcactcactgttgtatcctcagtacctagaatagtgtcgtccatagtaaacccttgctaaatatttgtgggatgagggaatgaaaacataaggcttagttagacggttccattttcttgtgctcataggcatttgaaatttagccaagagcctctctctttcacatagcgtatatgatgagctgtggatacatttttatgtactctcgggtttttgttttataaaataatttaatgcatcattagtatagtaatgtttcatattcaggacatatctatctgtaagccctgtccttttgaaaactcaagccaatttgtaattaaatacgcttcagaaatattgctgtgatttatcaagcaacatcacagagcttgaaaaacatgttttcctcacctaccctctcaaaatgcaaaaaaaaaaaaaaaaaaaccccataaaagatccattctgttgcattgcttgagctttctgtgaaacctttgaaacattcattacatttaggcagaatgtgtacatgttatctcatgtcaataggtccagatttcccaagtccaaaaggtagaggagaagaaactcatgcttctaccag

SEQ ID NO: 31605 - DNA, 1063 bp, Homo sapiens
ttcacctgcttccatcccacttgatcctatgccttctactcaattcagtccacctgtaaatcttacctcccctgtcatcacatacttgaatctctcaccactccctccaccagcagggctcttagtcagcctagggatggtgttgatgatggggatgggagctcatatgtactgagtgcttactaatggtcagtcattgagctaagggttttacctaatttatcccacttaatatatatagcaatctcaagagacaaataagattattatcctcattttcccttaagtcattgaatttgctgtgaacacactcttttctaggtttctgctcaggtatttctcccgttgtgaggcactcctggctactctgtggtcttggtgatgtgccttacctttgtgctgctgcaacgtctgtgctaactggggttcttccatatattattgggatgataatacatttaacagctgagagtgtggagttactctgccacttcctggcaatgtggctctgggcaagataaacttgctctgcacatttttttttcgtctgtaaaatgaagattaaaatagcacctcctcttaggtctgatgtgaggaccaaggcacagatgcatgttaaacacttagaatagagctgggaagagaataaatgtcccacaaatgttacctataatcttattataccaaattttaaccgtccatttacttgtctttcccctttcataggctataagcttcttgaaggcagagattatatctcattcaatcttctatctcaagtatctactgcaaaaccaagcaaacggtaagagctcaataattggtggttcttcatgtcatccttatctataaaagggctcaaaataaaatatcataaagacatccagcccacacacttacttatttctctgaacatttacaacatttctaaatgataccactctactgtcaattaataagaataatttattttattgtgatttaattacatggtcctatacatttactcactgctttgcctaccagacaaacctagatttgaaccttgcttgcttgcttctct

SEQ ID NO: 31606 - DNA, 1033 bp, Homo sapiens
attcaacgacagatgtaagctctaggcattattaggcaggtattgaagactaaaacaagacatcaattcagacaggtgggataatgattccgcatgtgacagaatatctcaaaggcactagctgctccagtggaggaaatggactctgtctctccactgttcgattcatttcttttcaaattagcatatcatttatttaaactaatttccctcttccccaaggcaagagtgagaaaggcagcttttcccatttctacttgaccactgcatgcatttggttccagacagagagaagagcattatcattaggaagaaatgtgtgtcagggatgggggaaggaatttgggtgagaggatggggcttgctgtggacagaagaggaaaaatgagcatgacaattatgaaagagtctgaaatgtggtgtaattattagaaatttgctgaattgcctgaattggtaattggtccaaattttagaaattacccttttttaactctgcaaaggggtttcgggactgtcttgttaactgacacttaaaagctccttgtcattgggatggatgaagaggaaacacgcatttttgcatcattggacgaagaggaatcaatgaaccagcataaccaaatctcttacttgcttcttgcttaaagagctcaaatccatctgaattactcctaatgagctcacccagtcctgggatcctgaatttattagttagtaaaaaagcacttaatagttatttattaaggtgtggtagaagaccttggaatttttgaaggagaacggaattggagacaagagcccaagagttcccaggagagcaaggtcttattgttgatgtaaagagttcttgcccctcgattggctgtgttgagacactacaaacccctctggattcccctaccagccccttgaggttctttagctttggtttgaaggaacattatcattggtgttagcctaattgtactgatctatgtggtaaatgaggaaaaaaaagaaagatgaaacttcagaagacagtcgtatttga

SEQ ID NO: 31607 - DNA, 1053 bp, Homo sapiens
gattaccctgagtgagagtcttgtcttctgtacagaaagagctgaaactgtggaaaaacagacacaaactcttatcatgcgagtgggtgacctgcaatgaaaggtgcatgcacagcctcaccaagtgtctactgttaaagtgagggcactgattggaaaagaatgcaaccctgcaacttggaatggggatgtgtgggagcaccctgatgaagctgaggacactacgtttgtaaactctgatgcaccttttttgccagaagaaacagcttccccatccccagtagtggcaacatcccctccccaacacatgctgccataggcctttccgcctttgtctgaggagacaaaccctgcgctgcctgaggcaacagtgatggcctctctcctgaggcagttgccaggcaaaataatgttgattctcctccggagccacccctaatacccctgtttgcttctagacctataactaaaatcccgatgggcccctggaggtgaggttgagagtgtgacccacgaggagctgcactacactagaaaagaactgtttgaattctctaattatataaagagcaatctggagaacaggtttgggaatggatattaagggtatgggataatggtggaaggaatacagagctggatcaggctgaacttattgatttgggccgactaagtaggaactctgcatttaatgttgcagctcaggaagttgaaaagattctaatagtttatttgcttggttagctgaagtatggattaaaagatggcccacagtgagcaagctggaaatgcctgatctcccttggtttaatgtagaggaagggatccaaaggcctagggagattgagatggtggagtggattagtcactttagacccactcatcccagttgggagggcccagaagatatagccttgaccaatgccctgcaaaatagatttgtgagggcagcacctgcatctctgaagagccctgtaattgctcttctctgtatgtcagatctaacggtgggaacagcagtcactcaactacaaaatttaaatacagtgggaa

SEQ ID NO: 31608 - DNA, 1044 bp, Homo sapiens
taatttttctagttgccttttgtgattgttattgaggaaggggaggcagaagagggagagagatgagaaattccctaaagtagaagtggggcagagaatgacattataggtcccaagtgtatcggagaccagcaccataaagcttggcagcatgccaagtagcaggatctggaaagagaatggtgttgtgtccagactgggatccctaggtaagctggtcaaaggtgacccttttttctaggctcacttctctggggtcagtcccctggcttggcctggtttttatactggagtctaaagacatctccagagcatgatgagggaggggtggaaatgtccctaagggttgaaattccacctcctaccaacttggcagaacaggggcttgtattagatttccagggctgccaaaacaaagtaccacaaactgggtggtttaaacaacagaaatttgttcttccatagttctggaggccagaagataaaggtatcagtagggttggttacttctgaaggctgtggggaagaacttgttccatgcgtcttccttagtttttggtggtttgttgttaacctttgataatttttggcttgtagccccatcaccctgatttcagtccttggcttaatcaactacgtacatagtgatgccatttgctgagatggggaagattgtgggagggacagatctacacaggaaaaatcaacaatcatattttggccaagttaagactgaaatgcctatagacacatagatgaggatgtcaagcagttagctaaacagataactttggggctaaattaagaggtcagggctagagagtccttgttatacatattatatttaaaacacaggtctagatgaggattaatgtagagtttgaagaatgtagggacagaaaagaagactaaaggaaagcttggtgtattcacacttcaatgattgaaacaggagagagaactagcaaaagtgactaagaagtaatggccagtgatatggaaggcaaatcgtgagaaatcaagagaagggaatattttaagaag

SEQ ID NO: 31609 - DNA, 1049 bp, Homo sapiens
tgtacagtgatgataattgcccaaacaatattaatcccactagtaaagggttttcacattacaggtattttttttaaaactttcatcttaggttcggggtacatgtgaaggtttgttacataggtaaagtcatgttatgggggtttattatacagattatttcatcacccaggaattaaacccagtacccaataattatcttttctgctcctctccctcctcccacctttcccactcaactagaccccagtgtctgatgtttccttctttgtgttcataagttcttatcatttagctcccacttataagtgagaatatgcagtatttggttttttgttcctgcattcatttgctgaggataatagcctccagctccatccatgttcctgcaaaagacaagatttcattttttatggctgtatagtattccatggtgtatatgtaccacaatttctttatccaatctgtcactgatgggcatttagattgatttcatgtctttgctattgtgaacagtgccacagtgaacatttgtgtgcatgtgtctatatggtagagtgctttatatccctctgggtatatacccagtaataggattgacccaggctaatttccagcagcaatgagatctttttttttttttttttttctttttgggatggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggccagcaatgagatctttaacaagcaatttcgtctcagtgggccttgatttccttatctgtaaagtgatcagacgagcctagggatggcagtctaatttagcccatgga

SEQ ID NO: 31610 - DNA, 1035 bp, Homo sapiens
agggctacaaaatatctttttcagggaggatggaggaaacacaagtcaacccataacagcccctaacagatgaaaaaaaaaaacaaaaacaaaaacaaaaaaaactagatctcttcatgggaaagaccatggggttcagaatcagagagaggtcaatttgaatcccagctctgcctgttctgcttgtactcacagcagaaaggaacatgtgggcctgcattccaagccaccttagatagcgtcttgggctagactgaaattaagaacggagctatagacaagaaaggatgatatggttttaatcaggacactgagccacaatttttcattatagactaggctgggcattactccaaactctcctgataatggaactgtgacagcaaggctgattttcagcacaatatattgcaggaagtgtgtgtgtgtgtgtgtgtgtgtgtgtgtgtgtgtgtgtgtgtgtgtgtgtgttaaggggacctggtattgcccagatcagtaaaaaaacggggtaggatggaacatctaaatgaagttctttcccatctttgaagggttggggaagatagggaactgcacatttatgaactcttttgcaacaatcctccgagacacaaagacaccccctgtagatgctgcctctgctacaaaaatttatgctgccctgcttcgtctcccaggcatcctgctcccagtagtgtctacataggtggagccttgcagctttgaggatatcccatgctgacttttatgcagacatgaccaaggcctttaccacaggacctcaaaatgcctataaatataaatataaacataaatataagtaatacacacagacacagaaacacacacacacagacatatacgtatatatttacatgcttactccagagtccagaggttcatataatctgagaaaaaagaagaaatatcagaagttgtaaatatgcataaatgtgtacataaaaatatagacatttggaccttctttttctattttgtcaacttccaaaaagttatcaagaagtattattc

SEQ ID NO: 31611 - DNA, 1024 bp, Homo sapiens
cagagtagctggaactctaggtgcatgccaccttgcccagctaattaatttttttttgtagagatagggtcttgctatgttgcccaggctggtctcaaactctttgtctcaagcagttctcctaccttggctacccaaagtgctgggattagagacatgagccactgtgcctggctctgaagtttcttttagtgttgttaataatttttaatgtatctatttggaaattctgattttcagacttcttattttcttggagcagatcatacttgatgatatggcccataataattggaatttattaaatgtttactgtgtgtcaggcattatgctaaatgccaaacattatgtatgaattatttcatgtagtcctcacagcaacctcctaagcaaggtaatttcatagatgagagaactaaggcctggagaggtgcaatagtttttctcaaattacctggttagtaaggaatggtgctgaaagtcttaggagaaatgacatggctaagacatgctcttgtggtttctcttcttggcttttggggctgtggacatttataagaaaggtggattatcaaaggctcaccagaggatttcacaggaatggaacatacacacctagttgctagcatatgaaggaggatgattgtccgggtgggcagtggattcttgtgacaaccagggaaggatgcttctcttgagtcctaagtttagaccagccagtgagagattggccacacagagtgtgtttatttgttcaacattttacttatctgtatgtatgtccttgttttatttcacttggagtttatattcctggaggctagttgccgttttcatctaaattgcttcgtacatcactcagcacagtttcttgataatgaaggtcacataacactgtggttattggcacacactttggcatttgggtttgactctcatttcttacctttaccttctagccacccttagttacaataattcacctttttgagcttcaatttctgtattcgcaatttggaaaaaa

SEQ ID NO: 31612 - DNA, 1025 bp, Homo sapiens
agcttagtaattgctcactgaaagcatctaagttgactactttctcatggaataggaagaagagcttgtgagaaatttatattaaaaatgaaaacggctcataaaaaaagaaaatggcccactgtaggtcaaaactccctacaagaaatgttattgctataacatatacctcattgttcagtgaagtaggaaggtttggaatagatagatttttaaacacatcaactaacattgacctgctaggccataatgacatctctcataatgccatctgcggatctcagaataaatgctgaccaagctcccacagaaggtgtagcagtgatctgtaaagcgtctgctgctgccaaacatcccatttgtttttgggatctgaggatgaggcttcctaagtccagatcatttgttttgcattcactattgaaaacctggcttaggagtgggtacagatgtttgctttacttaacaccagaggcttttgttaactgcagctgcacatatttaaatttgaaagttagggactcctggtgagacccgtggattcacctgcattttttatccttcttcagatgagggaggaaaaggaggactgtaacccaatgactctgtggggatttgtctggcaacctggtgcttggacatttttgctttgagtacaggcataacacctgcattggaatcccattctttcttaacgcacaacagctacggacatctaaggtgctgagaatgtattagatattgaatttttatttttgatagtgagatcttctataccccggactgccttttaaaaaaaaataccatatggccttgaataatttattaaatgataaccaaacaaatacagatacaactctgttggttatagctttctttcatttttttttgttttcttttggcggcaagcaagcataaattcttccttttgaataattccctgatttcctttgagggaccattctccactgtttcatgtagtattgctgggagggtaaattttcaggtgcttgtctctctatgga

SEQ ID NO: 31613 - DNA, 1087 bp, Homo sapiens
cagtctattaggctactgaaatttctgctttgtgacattcgaatgttattactataattttactaattgtgagttacctgagtgagggaactgaataatagaaatctgttgcatataagattatgtctctcttggtagtaataaaaatgccgaggaaataaccaatttataaatggtcatagaagtgatttctaattctattctctttatcttttcgggcttttaaaaataagtgaatggaggcaacaaactgctctatgcctgtgccactcaggagaggcaaaataggtggctctttgaactccaaaaccttttagcttcagaatagaaagtcaaggaagttgtgttttgggaaattgagctttctttgcaacagtggaatggattttttcagtgtcattctaatctaatcattaggattagaacatattacatataatatgtaactcttccacttccagttacatattataactgcactatgtggttgatgaatgattggtcataacaggcagctctgaattcctttatcctgaaccctgactctagctttaatccctcagtttgaaagtctttcatttagttgttcatttagctgttctcttatcattttaatttgcagtttttaaaaaagtcaagtattttcaaacatctttgctttgttagtttgagctctggaagattaaatttcacgttctggaactcacccatgagcttagcttagaagaacattgaatataatttgttttttacagagcctggaaattacagggttaatgacacaggaaaccacttctcactgcagatgaaatatgtgtgtcttttttcatctcttagcaaattaggtaaagttttcccccaaagagcatttttgtttttagttggtaaattaaacaagcagttcagattgcactttccagaccctagattttgtaggtatttgttgctggggcttttgtcttaatgaagtctggcagtacctgttcagatgaaatagccaattttacctttgctctggcacttaatccagccatctgctctagctttggctttcaagcacaaagggaaagtacaaagtatagctaac

SEQ ID NO: 31614 - DNA, 1050 bp, Homo sapiens
taacaaaagtggtctttaattggggtgtttttatgcttttttgttcagggtttttatgaagttctgcatggctttgtattcagaagccattcttttatcaaagtttcactagcattatctgagcttaatattctgggatgtactttgtagccagtgatgaaaggaggaaagtcagcagaaattacttacatatttgttagcatttgaaacatcttagccttctaataagaactatcacggccaggcacagtggcttatgtctgtaatcccagtgccttgggaagctgaggtaggaggatggaggatggctcaaggccaggagttccaggcaagcttgggcaacgtagccagactccatctcaaaaaaaaaaaaaaaaaaaaattcaggtgtagtggcttgtggctgtaattctagggaggctgaggtgggaggattgcttgagcccagcaatccaaggcttcagttagctatgattgtgccaccgtactgcagcctggattgggcgacggagagagaccttctctctaaaacaaacccaaaacacctgacaccagtagataccaagtaggcatagtacaggcactggatcctctcatgaaaaaagattgttgcatgaagtcattttaaaaagaagcatggtaattgatccttttggggatttctgtccaatttggtgaccatttcccttgtgagaacatgccatccctcacccagcccgtctaacggggtgggctcacagacagttatgtttatattacacagtgatctcctaaaaagcctcggcccaagtttttagcttacaggtgcacacctttttcaatctaggacaattaggttctcttggtcaggagctgagaccaaatcacagctaaaactattatttataattcaggagctgagaggtaggtttatttggtatatagatggagaagcaggggaaagtccgtcttccaagagaaaaataaagcagatgagtgataaggagagaggacagctgtctatttctggtttcagtctctttttcgattcacattacataactatattat

SEQ ID NO: 31615 - DNA, 1049 bp, Homo sapiens
cccgtctccttctgtggtgtggacagggttatttttctgttatttatacatgaagtgaggctgtttgaagttttgaagcataacttcacaagatttggagtacagccaagtatataatgaaaatgaaaaatttacaatgtgtctctttttctgacttttggttacaacatgtaagtcattttcatagttatatttttcactactggtagtacttattagggttttagcaggtgatagttaataatgcctttttccttgatccatgcttagaaacaattaagtaggacgcaggagtcagacagaaatcaaaaagtcagctttattactgttaaaattggttggcaagcagggtttaggtatgcagccacaagggtttcttggatcattattaggttcgatgttagtgctagaaaacttacaataacagtgacttaagcaagggagagactatttctcacctgaaagtacaaaggtgtcagatcacgactgacaggatgttctacagtaccagacacctagactccttttaaccttgttgatttttctatgcaatggcttcctttcccagggtcatcctggggtctaggatgactgctccagttccagtcatcatgtatacattccagccagcaggaagaaagaggaggtgaagggcaggatatctccatttaaggacttgtcatttttgcttatatcctattaactagaacagtcactaagacaaatctaactaggaaagtgagtattctgggtagtcatgtacttttgttaaatggagaattctattacagaaaggggaaaggatactgatggacaacttgcagtctctgccacattcctgagttaaacttatgtaactaggcagaggtaaagctagccaaccactgtcttccactatagggaggggcaagctgcttatcactgaacagactcacctcaagggtcaatcgcttgcaggaggggaacacagaaggggctgagccacacatgctgggttccttctcatttccacaactgatgttcgacttttctacggggcagtacagaga

SEQ ID NO: 31616 - DNA, 1029 bp, Homo sapiens
gggtggtctcaaactcccaagctcaagtgttctgcctgcctcagcctcccaaagtgctgggattacaggtgtgagccactgcacccagccccatcttttaaaatttgaatcttataatttataaaaatgttattttatcatgggataatagtcaagtggaagtatatttttaaatgttttctctcaaaagaagtgtcaacattctcaaaaatatggcaatgaagcaaacaaatgcagttaacttgctgcttagaaaagacttggaataaagactctttgactcttaccttaggaatctggtttctaggattaagtgctatataataaactagtgcctgaggacaaaaaatttccaggggtccatattcagtcagttgtctctggcagaggcactgagttggagggggctgtttgtgtccttgtctctgaatggaagattgtcctctgggaatatctctgctgttcaatatagaaaggcaaaaggacatagaaaagggtatctgcagaatcaaatggtgagccaatcattttccttctaaccacttccatattgcgtctgaagcagctcagttattaggtgagcttgtgagcaagaaaaagcacattttggagtgagggatacaagctgccttattaaaagcaggactgcttcagaggcattgaagtaatagaggacagttggcatggagaaatgattaatttggaggaaaatttttgatactatgtatttgtaatttggggcattttatgtgtactctagtaccatttgttcacagggaaccattccatgtaatgttatatgaacattataaaccctaagatacttaaaaacgacctagctttattgagatataattcacacgctgtatatttcactcatttaaagtgtacaatgtacttatattacagaggaatagtgttatatataacatggattcctataatgttgaaagtgcagggcctcctagtggtagggtttaaatgtactagagaagaaattaaattacttaataatatcataggggctct

SEQ ID NO: 31617 - DNA, 1057 bp, Homo sapiens
tctgtatcaccatgaagccagtaatctaattaagaaaacaagctaagccaaaattccaaaatacaactttcaggcatttagctggctatctttaaactcctttgtaaaagaaacatctttaagaaaattcccattttgtaagggtgtctgccggtatacactagaaacatttaccattgttttaatgtgacaagtcatactttgcttaaggtggttttcctggtctcttaattgaacttttacttacaccctttaaaacccctttggtttgagcaaatgatgttacaatatttaggcctaatgccttagctctgtgctttgagatataaattttctaccttgtttcacataagagctgtccctttagaaatgtaaatttagggttgcctagctgacaattgtttagggcaggaaacaggtaatcaagagactgatagtctaaagtggaggtgagattttgagaactggcaaatgaagaatcttataaatatataagatctgctactgtctatgggtctgtgtgtttatacgtgttgtgtgtatgtgatgtttcactaccaaaatatgtaaaagggctctaattaattggcttaaagaaaaaaggaagtgcttaaatcaaatgtgttatcacaaaaatagaaactttaattcaaatgccttgtagttcacatgactttattaatctttagtaaattaagacaatttaaaaattattggtaaaataaaaaaagtcttcagaatttaatttagacattttgtctgagtctattgattagatactatctctaccagatgttttaaggcataaaacttgcttctatgatttgttttgatacctaacttgtctataaacttatgtctttagatttatttatttatttaattttttggagatggagtcttgctctgttacctaggctagagtgcagtggcgcgatcttggctcactgcaacctccgcctcttgagttcacgcaattctcctgcctcagactcctgagtggctgggattacaggtgtgtgccaccacgccaagctaatattttgtatttttagta

SEQ ID NO: 31618 - DNA, 1081 bp, Homo sapiens
ccttaagctgataagcaacttcagcaacgtctcaggatacgaaatcaatgtacaaaaatcacaagcaatcttatacaccaataacagacaaacagagagccaaatcatgagtgaactcccattcacaattacttcaaagagaataaaatacctaggaatccaccttacaagggacgtgaaggacctcttcaaggagaactacaaaccactgctcaatgaaataaaagaggatacaaagaaatggaagagcaatgtatttttaaaaagcaatgttgtcccacagcctttcctatgtttgatgttcctagacttgttgtttaattttttgccgatctactggcattaaatgatatcataaatatgatttagataataaataatatcataaatattatttaggtattaaatggtgtcttagtgttgttcttagtattttttcagtggccatctatcacttattacttggtttaatttcaaaaattaatatatattcttattgtattggaatactgaataggtttcatataggaaacatgaaactcagattgcttgagggataactactgtgcacattgtggtgcattcggaatcttccagtcttttcttcttggcacatgtagttatctacactgtggtcataccacatatacacctttatattctgcctttttcattttaactgtttttttttctttttttggacacaagatcttgctctgtcacccaggctttagtacagtggctcagtgatggtgtactgcagcctcaaacacccaggctcaagagatcttcccacttcaacctctagagtagctgtgactacaagtgcacaccaccatgctcagctaattttttgtagagatgggatcttgctgtgttgcccaggctggcctcgagctcctggcctcaaacagttctcccatttcagcctcccaaaatgttgggattacaggtgtgagccagtgcgcctggcctcatttaacattttatcatgaaaacttcctgtgtcattaaatactatgtaaagacatgactttcaatggctgcttacttttctattatatggatgtgcctaaactta

SEQ ID NO: 31619 - DNA, 1055 bp, Homo sapiens
tgtaccttctgttgatatgtcttcaggttccctattttctctgagagctcttatctttccattcgagaccattcacctttgcttcatagccgatgattgtaatagctcctttaaagtctttgtctgggcccggtggctcaagcctgtagtcccagcactttgggcggccgaggtgggcggatcacctgaggttaggagttcaagaccagcctggctaacgtggtgaaaccccatctctactaaaaatacaaaaatcagccgggtgtggtggtgcagcctgtaatcccagctacttgggaggctgagacataagaatcacttgaacctgggtggcggaggttgcagtgagctgagatcacgccactgcactccaacctgggcaacagagtgaaagtgtgtctcaagaaaatttaaaaaataaagtctttgataattccaacttctgggtcatcttggggttggcatctgttcatattcttttccctccagtatcgggtctctggggcttgttacaattctctagggaatttttttttccagcaaaatcaacctggttaggaacagactgtaagttttgtctcacctaaagctcgtgatcattctgcaactctgttcattcatttttttcatgccagcacaacattgtagttttttattcactagtattttacttgttttaatcaatctcttataataatgctaccccatagagctgttacaaagaccaaatcaagtaatgtatacagtaccacctggtacagtacctagcacatagaaggccttttagtaaatgacattgttctagtttcttccagtggactatctctttgcttgatataattgaaaattaagttaaatttcctttactgttgcgcatttataagatttggtaatgcctcatatagcattctgccaagctacaatgatgttttgaaaagatttactattgtggaataccaaattgtgaaatttactatgaaataaatcctcttagattatcttagaagccttggctggaggaatatactaataacatactttgtatgtgtgtgtat

SEQ ID NO: 31620 - DNA, 1055 bp, Homo sapiens
ccatctgggggtgatgggagacagtgagagatcatcaggcattagattcttacaaggagccagcaacccagatccctcacatgagctcttcacaacaggattcacactcctatgaggatctaatgccgctactgatctgacaggaggcagagctcaggtggtaacgcaaacaacgaggagcgggctgtaaatacagatgaagctttgcttgctcgcctgccactcacctcctgctgtttggcccggttcccaataggccacagaccagtactggtttgtggtccaggggttggggacccttgctatagataaccctcctttcttgaaaaaaaggatagtatttaagatatacttccagtatttaagataaagactgttttgatttcataattgtgttattaatatgactcgtaaaactttgacacaagggatagccataggctgggtagaaaacagttgctgttggtgggagcttgaggaacaaggattctctcttcatttgtagcttggcactttctggatcaacagtttaaggaaacaaattcctgactaagtatccttgacaaatgagaggagtaggctattttaagttctttcaactgaaagtcactttcattgaaggatgagaattaccaagcatcttttttccccctgcagtaaaaactaatttctaggcagtcatatcctgcccaagtggtgctgggtgctttgttatttggatgacactggactgggacagaaggcaaagaataatgcagtctgacccgctgttatttaatcacaactgcacgacaactctaaactagaaagagaactgttaataaggatgcgatccagttacctgaatgtgtgtgggttgtaatgagaaatgccttgaggtccagcggaattctaaggtcacactccccaaaataatttttagaaaagctttactaagttaacttcaatgtaaactaagccagaaagtattcagaagggcaagtttcagtacataggaaaagtaaattaaaataactcaaaacacatgtaagtcagataaatagctcagtatcttt

SEQ ID NO: 31621 - DNA, 1029 bp, Homo sapiens
gtatcacttcaggcattgaatttccttgaaagatgtgaagaaaattttgtgctcttttgaaattgtctatttaaagatgcctatgatccataccacatgctaggatactcttcctctttttaagtcagattcaacattaaaattcagctcagttgcctcctcttccatgaagctttccctggctatccccaaggaccctcagactccgaaccatgtctgcttcctctgtgctcccttgccctctgcatttcactacctttgcacttctttaaatgtttggtagaattcagcagtgaagccattgggtcccgggcttttctttactgagagacctttttattatggcttcaatctcattacctgttattggtctggtcaggttttagatttattcatagctcaaccttggtaggctgtatgtgtctaggaatttgtccacttcttgttggcacttatcatggtgtccatcacttatcatgaaatcattagcttgttcatctctctgttaatgtgcccaaccagattatagttagggactgtcctttgcttttgtttgtatctcacatgcataatatcatgctttgtactctgtagatgccctgacattgtttgttgagtggatgggtggatggatgatgaagaagtaaatgaactaatgaatgaattagaaaatcaatcaggcttcaataagaatatgatctataatcatggctgtattgaggactctaatatgtgtaaatgtaatggaataactccaatacgtaccgctgtgagggattttatgataagcctgtctcaagtcatgttcggaaaagtttatttgaattaagttgccttttccctattttctgttctctgccctacaggctgcctgagcaattgtgtctggttcgtgaagtgacttcccattttcatccaattggccctgatctcacatcccaaggtaggcatgcctgcctgcttctccctgcttattgggctttgcctgtggcttattgctctgtttattataactcaactgctgcctct

SEQ ID NO: 31622 - DNA, 1029 bp, Homo sapiens
aaggaggttttaatcttagtaatttatttgactgctaaatagggaaaccaaagctaaaatccagttgagtacattaggctaacatggttggtgtgcaaacacatgctaggggctcatccagctgtgggtttatttgtccaccagcctaacttcaggcagcacccaaagttcagactcaagttgtgggcagtctactgctttggtggggacggtggctgtggtgccagatggggccacttggctgagggagggcatcagggctttcagttcaggagagctgatggatgttgctcttctctgttgtgtcaccagaattctgtgccttgggttgggcttacttgcatctctgtgtatcactctgctgcttcaaaactcatcccttctgttgatgctgacctgaggaagcttgggaaatgtttgctgcattgggtgggattgatgagctggctttaaaaagaagcacgaatgctttaccaggactccaaaatcaacaacaacagaatgtctttctaggatcactcaaatggacccatttattctttgcatactcctccaatttttggatacacttttcagtttgggaaaaaagcacagaatcctgcatgtaaactttaagacaacgggatgtatcacagtgtttgttttcagacagtagtatgcctttaggatagtctgaagaactggttaaaatatagattcctgagtcccaccaccagagaatcttgctcagccagcttggaatggaacccaggaaacttcaggtgatataaggcaaggggtgtatgcatcacacctagaataatggtccctgctcctgatgaacacaccaagtacccaagaagggcaccagagtgtgaaacaagcatggttaggtgatgagatggcctgggtacagtcacctgttaaagtgcagattctcattcagcaggtctggggaaggaggctgatattctgcatttctaatgagctgtgagaaggcagttgttgctggcccctgcctcacaccttgagtagcaaagatgtaaaaga

SEQ ID NO: 31623 - DNA, 1071 bp, Homo sapiens
cagttaggataacaattaccaaaaacacaagaaataacaaatgctggcaagaatgtagagaaaagagaaatcttatacactattggtgggaatggaaactagtacaaccattatggagaacagtatagagtttcctcaaaaaactacaaatagaactaccatatgatctagcaataccaccactactttccttaccaaaagaaaaggaaatcagtatgtcaaagagacatcttcaccctaatgtttactgcagcactattcacaatagccaagatgtggaatcaacctagctatccaacaatagatgatgaataaaaaaatgtggtacatatacacagtgaaatactcttcatccataaaaaaagaatgaaactctgtcatttgtggcaacatggatggaactggaggacattatgttaagtgaaataagccaggaacagaaagttaaacactgcatgttcttaatcatatgtggaagctaaaacaaagtagatttcatagaagtaaaaagtagaatagcggatactgcaggctgtgaagagtggtaggagtgggagacaaagatttgttaaaggatacaaaattatgactagataggaggaataagttctagggttctataacaccatagtatgattatagttaaaaataatatagtatagaatttcaaatagctaaaggatgttgaattcttccaacacaaagaaataataagtgtttgagataatagatgtgctgattatcctgatctgatcactatatgttctatatatcccaacatcactatgtagcccataaatgtgtacaatgattgtatgtcaataaaaaatttaaatttaaaaattatgagttaactcctgatgaaagcagagtgttgcccatttttcttccagaacaccagcttctctcttttattattttggaaacactgatttctacctaaaataagtttgtatagattttgacctctttggggattaactggcaataaattaagtgttatcttattcaataatgaggaagagagaagaacttctgtcctgtaagaaatatcatggggaaataaacatc

SEQ ID NO: 31624 - DNA, 1019 bp, Homo sapiens
acaatttgctgaatgaagaatgatccctaatggcgagtctgtgacctcatgcccatcaccgacttccctttccaacgtccaccaccatctttaaatgatgtgcatatctcattgccctctttttaaatgtatgcattaaaattatttaaacagttgtggttgactttttaatggatattttaaggggcatgttaaggggctccagtgagatccaaaagattaatgaggacatacagatctttccaataaaaacatgtttttaaacattcataatattgggaaaaaaataaagcatagtcagaacttggaatgagatgctggagccaccgtaggtttctgataaaatgattagtgccctagagagtggtgaagttttgggttggaacaggaatttgtagagtcttgggactcggagctgagggctcctgttgaatgcaccagaaaccagggaggcaaataatattttgttatcatgattggctcccctgtggccctgtggtcatgaccttaaagttgacacagtccctgaggctgaagaagggaagggttgtccgttttaggcagcaaaaagctagggcattaagtcttgtgttttctgaacaacatgtggggaaaacaaacctcagcatgagaagggaacgtgaagacgcacccattccagagagagacacagataccaaccaaatgttagtttcctgccagttttgagcgattgctcctagtaacctcttgattcctcatattaataaacattggttagaagggcaaagtgcacagactagaactcgactgaaaacaattcggtttggtgtgggaacgtggggtgtgattattttctcatggatgatatttcttcttaaatttttgcttgtgacacaagccacgtgggtttgctttttctggatagctgcaagtcaaggaaaaggggtagagaagccacttgaattcctgggaaatgttgtaatgatatccaatttaatttgacacatttttattgagtacctactatgctccacaga

SEQ ID NO: 31625 - DNA, 1027 bp, Homo sapiens
agatggtgaaaccccatctctactaaaaaatacaaaagaattggctgggtgtggtggcgggcacctgaaatctcaggtactcgggaggctgaggcagaaggagagaattgcttgaacccgggaggcagaggttgcagtgagccgagatcgtaccactgcaccccagcctgggtgacagagtgagattttgtctcaaaaaaaagagagagagagagagattggagaggtaggctcagttccggagggtcttgtcagcgcatgagaacaatgagaaagcacaaaatgtttctaaacaccataataacattatcaatgttgttgttataatagagtttctgtggaggatagtatgggcagcaaaaaaagtgggtgaagtatggggctcgggagttcaggtatgtcatttcaacagtcaaggggagagatgatggtgacttggcctaggatggaggtattgaagagagaagtggagacattcaattccagggagatttaggaggcttcattgacagggcttggatatatgtatttttttcctttagagaagggagaagaggcaccagagatgaattccagattcatcacttgtgtgaataaatggatgttaatccgttcattgacactggggacactgaaaaaagaccagatttgtggagttcataagtcagcttaggctagattatgctgagataacaaatgacgcccagagctcagtggcttacagaaacaaaggtttatttctttcttgtgctctatggccacatggatcagttgtacctcttttccatatcatttttactctggcatccatgatgatggagtagaggcatctaagagggtaaaggagaaagaagtagggcaaccacatgctggttcttaaatctttggggatgacacacatccctttttagatttcctagtacaaatctaatcacatagccatgcctgggtatacaatcctcttataggtagggacaccccaggatgggtgaaaagtattttgaactacaataaaatttaccaaagg

SEQ ID NO: 31626 - DNA, 1037 bp, Homo sapiens
agggcttgttaacaaagattgctgggccccacctccagaatttctgatgcagtagatctggagtatggcgtaagaatttgtgcttttaacaaatttcttagtaatgctcatgctgttcatataggaactacactttgagagccacatctcaagggaaatgattactactgaagacaagcttacattagttgtggtcttacctaagctttgtctaactctcacctttaactttatgccaatcctggtccaagccttttgcctctcttggtcacttatctctcttttaactctgagcccctcacttacttccctcagagagctcctccttctcctgttctctagcaccttgacctgtgttcccctttttgctcctggacagtgctagaatccaaggtgtggcatgggtatgcccaacagacagactgcttataacccaggcaactgagtcataacctccaggaggaaaacactccatctttagaacaaagatgacgagtagacatgaaaataatatcctaggatgtatatgggtcccctggctctattctctgatgggtattttttttttttttgcatctgtattacatctttgtactttcacttcaaaaatatgtttggtgcttagggcagccatcataagacactgattttaatgacttgtgaagaatgaaaatggttactatgtggccataacaagtatgtctttaagcttacccaggagtttgggaaatggttgaacctaaaacctaacccactctcagaattcaccccagtactagcattgttcagaatcattgtatgacatccattgagccccactcaatcactggactgaagtgcctgagagaccaaggttatgggtgcccaaggatgcccttaagttcacgtctgagtcaagttagtggtctgaagatgtttttagctgattctcagagacagacacaaagagagagataaggtagctactacactgggatctaccagtggctcctttattgctaggcaccccctttacatttagtgcccatgttgtgcac

SEQ ID NO: 31627 - DNA, 1091 bp, Homo sapiens
ttttggttataattgacaaaatccccactaatgaaaagctatatgttgaagaaatatctcaaaatgaggaaatgtaccaccctacatagaaaataagaaaatcaattgtctcatgtagcaagcagtccagaggttagttcactgtctccatgacataacttagtacctgggctctgtttaactctaagcagcatcatggaaagcttattggcttggttcgcttgtctccttaaggttctaagatggtaccaggagttccaacacaacaacagccagattaagaaggaaccccttgagaatggctgatttcaaagatggggcaggaaaaatacaagatgggtatgtagcacgttattgtgccagatgtaaaatgtgtttaaagaatgatgggccatgtcaaaaggacatagcaaccagtttgaaggagctttctttggccataatttgggacaatttgagcattaaaataaataaggatggtaatcaattataaactatttaataaaatagaaatcaataactccaagctgatgtaaatatgtgaattaataaatggggagaagatagtgcttttccttatagtagaatgctaataaacactaaagaaatgattgaattagaaaaaccaacatttggcaactatcataataataattagttcgatcagtaaacgtcaatgaatactaagaatgagtgagtggaattttgatgaagaacaggacattgacatagtctcaaagtccctaaacatacttattaaatacaaaggacaaaggaatgactttacaatggaaaaatctggctgatactggcattatcaaatgttcaaaattcatgtcaacagtaatggaacaaatcaaaatcctgtatcatctgattggatgcaacagaaagaaaacaacatcacttctgtggtattccttccaaaaaatgcataagctgaatctaatttcgaggaaatatctgacaaacctaatttaatggatatttaactcaacaactttaaataacctttaatcttctaagatgtcaaggtcatgaacattcaggaaagaacaaagaacacttccaaattgaagaatagacaagat

SEQ ID NO: 31628 - DNA, 1044 bp, Homo sapiens
tataacatgttatattttgaagtcctaatctcggcatctcagaatgtaattttttttggagatgggatctttacattgataattaagtgaaaatgaagtcattatggtgggccttaatccaataggactggtaaccttactagaagaagatattaggacaccagtcatattagattaaggccaaggagagaggcctaaaacagatcctgccctcatggccctgagcaggaaccagccctgctaacaccttgatttcagacttctagcctccagaactgtgagagaatcaatttctgttgttgaagtcactcagtctgtggtactttgttatgacagccctaggaaacagcatgcatcagaattttattccttttttaaaaagaccaaataatatttcatcgtatatgtatatcatattttgtttatccattcatgtgactgtttccatctattggctattattaataatactgctatgaacattggtttacgagtatctactggagtctctgctttcagttctcttgggtatttacccagaagtaaatccatgtgctggatcgtatgataaatctatgtttaactttttgaagagtcaccacactgttttccacagtggctgcaccatttcacattcccaccagcaaagcacaagagccccaatttctccacatcttctccaacacttgttattttccttttttttggaaaaactcatatcaaggagttctacttctcaaatggcagaatacgctctgtgatggttaatactgagtgtcaacttgattgaactgaagggtgcaaagtattgatcctgggtgtgtttgtgagggtgttgccaaaggagattaacatttgagtcagggggtagggaaaggcagacccacccttaatctggatgggtacaatctaattaactgccaagcaggcagaagaacgtgaaaaggcaagactggtttagccttccagcctaatctttctactgtgctggatgcttcctgccctccaacatcggacttcaagttcttcagctttgagacttga

SEQ ID NO: 31629 - DNA, 1032 bp, Homo sapiens
catgtccatgactccctgggaagaggacaatgacagccctgcctttggcacttctcctacactctgttctatcagcttattctcttggctgattttaatctgtattctttcactgtaatataaactgaactgcaagtataatcgcttttagtgagtttttttaagaaaattattgaagctgagggttttgggaatccctctgagtatacaattggcgtgagaaatgaagatggtcttggggacagtgctctctaactttatggttgcctaaactaattgcagtgtgtggttttacctatgtatacatgtgcgtatttaaattacctaatagtgaattccattcatggtcctgggatttgaatttcatctttcatacggttggagaccttctttatgcctgttgtgcctcagtttcctcacaaaatggggttagtaacaggagcttcaactataggattgttatgaggagtaaaggaacaaatgtttgtaaagctgttaggttggtgcctgttagcacttagggttacaaaacagatgataatgattttcataccagaccatggaaatctaccttgttgcttttaataactgaatggatatcatttctattagttacctctgggtttcccacaaagaaagtagtaattagggaactaaaatgtgttgttggaaagtgactcttgttgcactacaaggttgagtaaattagtcagctagtctagaacaaagtatttatctagcaccaattatttatctagaaaacactaagttggcccacactatgtgcagaggcccagtgctgaaaactgtaaggctataaaaacaggtatattgagataagcaaaaagggaagggaatgaacatcctttgaggatctagtaagtggccagtgctattcatttgttattttatttaatcgtcacaccaacactggagaaaaatagtatgagctcattttcaagaagacaaaaaaagagtatcagtttaagaaacttgcttaagttgacaaggccacgatatgttgaaggtaga

SEQ ID NO: 31630 - DNA, 1021 bp, Homo sapiens
ccctggcacttcccaacccccagccctgtcttctcctggcctctgtggttttggccgctgtatcctgatggccacaaggtggcggtggtggctgctacatccccaggagcagccctgagtagccccttctgctgctgctgcagccagccaggggaccctaacgtgggaggttggcctgataatgtgctttgctggagctgcatgaagtgggacagcagccgggacaggaaccttgcagactgggctgagatcctgcgtttcctgcatcccaacatgatcctgggccagccacttccctccttcaaagccagtctctcacctgcgaaaaaagacactaaagcacctcagagggttttgcagcaaaaccctcgaaatgtgtttggcacccggtgctcaaaatgtccctttctgtcctttgcaatgggcatttccccttctctgtctctgtctgcacatctccctgatttgtaggagagagaagatgcatttttatctacatgaatacggatcatcttggagctggaagggggctgagaaatcatgcagttcaggcactgcaaacttacatgcctaccagggccaggcagtaaggagggtgacagagcgtcattcaaaggggcctgtcgacactcagctttctgtaggcacaagacccagtgtttccagactgtctgaagtccagatttttagatgaaaacttgtagtttttcaatattttggcagctgggaaaactgaggcccaaggaggggaagttacctgtcctaagtcacacagtttgttggtggcaggtccaggactagaactcaggtctcctgaggccctgcctctgccaatacagccattccgggagccaggaagggtaaaccagggggcaaatacacatttttctttaaaaaggagtataatgggagtggaggtcacttctctgaatcttttttctaattttgcctttggtcctagagctgtaacaaagattcatgctaatattttactcaagatggagaagttagagccgaaatc

SEQ ID NO: 31631 - DNA, 1014 bp, Homo sapiens
tgagggtttgaatctatcatcctgctcagaaaaatgggcatgataccagtgcccctctcaaaggggtgcagtgaggacatgagtaactagaagcatccataagagcttggtcagtagaaggctcttgtggaagaggagctcccagaacccggtggattgggtgcagagcagctgctatgatgaacgatatagatgtttccctttgttgtattccaactgggtaacaatgggcctgctgttctgggaggggcctgagggtggtccatcagagcacatcggtccaagcacactcgaagggcagacatctctttggcaggacgtctggaacatggacagggatctgaatgaagatgacagtaagtagagcctcaaagatggcacggaagactgtgtggagatattttagcctgcatttgaagaggacctaatctgacctctaatatgttggaagttatgtatccatagtcttttctaataagctctgtagctagcactgtgtgaactcttccatctgccctaaatgcagtcctgggtctgcatctggattgccgagagcaccccttccttccttccttcctctcgtgtgtaaagcctacctgtagcttgcgatctcttcttccgttatgagcctttggacaatggagaaggaaggtgaaagatgaaattgagaacttttctctctatcacagtgacaccatgcaaaccttatattcttttccctttttcttcttttctctagttgacagtgtctcctgctcccagccaaatctaagtgagattttcaggattcttatttcaatcacaattggattcagttcttagatgatgttaactctacagaaaggtcgggaaaaggcttcactcgtgatctttctctagcaaacggccagttcgttcattatcgcttatgaaacatagcccaggtgaccccatcctgtcactaccgggacagaaatacaatggattctcagagctatttaaaaacatgaaggaaatggtatttcaggaagaaat

SEQ ID NO: 31632 - DNA, 1037 bp, Homo sapiens
ccccaaatcccacattacattgagtcccatgtcccccgttctcctccgatctgtgacagttcctcaacctgtacttgtccttttatgaccctgagagtcttgaagagtacaggtcaggcatttgatagaatgtcccttagtttgggtttgtcatgttttctcatgctttgatagattgagattatggatcttggggaagaatgccatggtggtgatgtgctcttctctgctcaaaatactgcgggtatgtgctattggcacatctgttgctggtgatgttagccttgatcatgtgattggatggcatctgctttccccactcaaagttgctattttcccttttgtaaataatacatattttggggaaagttctttcttcttatcccttttcttcttagtatcctatatcttgtcaaacttttgtccactaattatagtattgtttggtgaatcttgcagcaattattgctgtactgctctgataaagtttgtctactttccttattctgtctctatttgttaactggaattcttctgttctcccttacttgttatttattcaatcacttttttatgttagcattgacttatggttattttattctttgggttataaaaaatgtttttgttacttattttgttgctcagttttgttccaactttggccactgggagctcttttaggttggctcctgtgtccttttacatgatgtattccttttatagtttaaaaaatacaacagagtacaaataattaaaattgttgtccaccgctttttattttgttgtttcatttgaatgagagagtatgctgagactagccaaggagcaagtgagattcatttggggtacgtaaacaaatctttaaaagagttcctccctcccttccttcctttttccctttcttctttcctctcttcctccttccttcccttcctccctttccttccctccctccctcccactctctttctctctctgtatgcacaattctttttggcatatgaggctgaatggttgtaaaacgtagaatcagg

SEQ ID NO: 31633 - DNA, 1021 bp, Homo sapiens
cgcgtggccctggcgcgtgtcagcagcgtcaagctcatctccaaggccaagatccgcacggtcaagatgactttcatcatcgtgctggccttcatcgtgtgctggacgcctttcttcttcgtgcagatgtggagcgtctgggatgccaacgcgcccaaggaaggtagccagggctgggagacccaggaggagggagcctggtggctgggggaggcccttatcttgctgcctcagaatgtccaggggtctgtggacttcctgggggataagcgggtttgaaatcccacagagtcactgctctgtcatcccttgaccaagtgacttagggcaattaacctccctgagcctccactttctcttctgtaaggtggcaataaggataaaagtaccaactgtcaccaggcataggggaatgccacgagaaaatgcagttaaagtccttagcacagtccttgggctgcatatgggctgtatggtttactgtggtggtggaaacaggttcaagggactccatctgctttcccacgtggttaggaggaggtggtggaggtaagtttggaacccctggccaagctcaagctccttcaactttaagttcacgttaagatgaacttccactttaagttcaagaaatccagctgaagccaagaagtctggtttggacaaggacagccttgcaggagtggcaatttgtccaaccaagcacctagtagttgaagggggtgttggggggcagaggagtccaagggagaggtgaagacaaatccctgaactcctcatcgagtggaggtgatgagtctccatgcagagaggtgagtactgcaaggagtggtgggcaggcttagggaggagagcgcccaggactgagacttcacttccacttggaggaaagagaagaaagccttgagggggacattcaagtttgagggggaggctgggtgatttctgtaggtggggaatgtgccttccaggtaggaggactgctgaggacaaggctgaaggtggggcaattgtccattct

SEQ ID NO: 31634 - DNA, 1033 bp, Homo sapiens
ttggcaataaaaagaaatggaatcctgacacatggtacaacatggatgaactttgaaagccttatgcttatgaaaaaggcagacacaaaaggccacatattgtctgatcccatttatatgaaatgcccagaataggcaaatccataagagacagaaagtagattagtagttgcctagagctgagaggtttggagagaaatggggagtggttgctaatggatatgaggtttcaccgtgaagtgataaaaatgttctaaagttgatcaacacaatgttgattgtgttgatggttagtgtattagtttcactcatgtgatggcttgaaataacataaatttattgtcttatagttctgaaattggaaatgcgtctcactgggctaaaatcaaggttttgacagaactgcttccttttagaggctctgggggaaaatttgtttcctttcagcttctaggactgtgcatttcttggcttgtgacttggcttcctccatcttcaaagcctgcagtgtagtaccttcagatctctctgactccttcactgactgcactcccacccccctttcaattataaggatccttgtgattacatgggtcccacctatataatccaggaaaatctctacctgaggtcaggagttcgagatcagcctggacaacatggtgaaactgtatctctacaaaaaaaaaatacaaaaaattagccaccacgcccggctaattttttgtatttttttttttagtagagatggggtttcaccttgttggccaggctgatcttgaactcctgacctcaggtaatccacccacctcagcctcccaaagtgctgggattataggtgtaagtcaccatgcccagctgactctggtattttctagctgtgtaaactgaaacaaattatttaactttccccagcctctgacttcttatctatagaatgaggataataataaaatttatttcccagaatttaactgagatagttcgtgcaaaggtctctgcacacagtgagcactcagtaatgattgccatg

SEQ ID NO: 31635 - DNA, 1080 bp, Homo sapiens
tatttttggcatgaggactattccttactagaggtaaagcagaaaagaaatgggagaaaatttttgcaacctactcatctgacaaagggctaatatccagaatctacaatgaactcagacaaatttacaagaaaaaaacaaccccatcaaaaagttgagttttctttttaaaccagaatggtgttgagttgcgtcaaatgttattttgcatctattaagatgatattgatattttgggctatataactctctgatgaaagggggttgtcctgtgcattatagaatgcttagtttcatgcttgacctctatcactagatgccagtagtaatccaattgtgacaaccaaaaatattctgacattgctaaattcccctgcagggcaaaatcacccgtggttgagaatcattgctttaatacatcactatgaagtttaaaaagtatgtttcaatctattttatactcctccttcattagttggagcttaattgctctgtcttgagtgtggactggcttagtaactacctctagttggtagagtgtggtggaagtaactgtgtgacacttccaagactaaattataaagggcattatggttttctcctagctatcactccgggggaagccaggtgccatcttgtaagtacactcaagttgtcctaaggacagatccacatggtgaggaatgaaggcctgctgccagtaactagcactgacctgccaggtgtgtgagtgagccatcctgtaagcagatcttccaagcacagtcaagcattaagataactacagcctctaacattatcttgactgcaatgtcgtgagagatgctgagccagaatcatccagttaagctactcctaaatcctgacccatagaaactgtgtgagatgataaatattcattgttgtaagccacgaaaggtttggagtaatatgttgtgcagcagtagataactaatacacttacactgactgattgtcaaatattaaaccaactttgcattactgggacaaaccccactcagtcatggtgggagttttaatccttttgtacaaaaaggattaaatatatgtgtatgtata

SEQ ID NO: 31636 - DNA, 1056 bp, Homo sapiens
tgcctatgaagtgtgctaagagaggaaccaggaagattccacctcagactcaaaaatcttttttatttctcccattccttaagttccttcaatgtagatggattgcttttggtcaattgcatcaattgcattaatctgtcacagagggtctatcatgcatggccattgtcatggataaagtaccttaattactttgctcagtgccttgcccttagaaagtgctcaggatatcttagttccctcctcccagttcattcctacttttcctgaggcttccgtcttgcaatttacgttacaccacaggagggaatagagtaagggtctatcacctccatgtaagtgagtttgttggttggttccttgaacaaatatttatggagtgactaccctgtgccaggcactgggactatgttcctgaatgaagtccctgcctttatggagcttacaacaacgtaggggacagagagacagaaaataagtcaacaacccataaaataatcacagactgtgataacactaggatggaaacaaggtggggggctgagactgggcagctggggaaccctgtatgactgatgatagctgcgaatgaggaggagggaagggaaggctggagaggaatgagaaaaggaggctgaggacaaacaggcttcctgtgcctcctccacgattttgccccatgactgtggaaaggacactttagttcaagtaaacacataaatctggagaaatatgatctgtcatagcaaatgcaacacatttagtcaggattccctcaaggattggagcaatagacttgggtgtcaggagccctcagttttaatgctagcatagccccctattccctgtgtgtctttgagagagtcccctcccttctctggactcctggatcctggagtctatactgagtgggtgggactcagtgctgtctgaccacctacggcttgatgaaatgaccagcaccttccatgggagttttagcatagctccagaaggcttatggctctgtcattgctgcccatagctgttagaattcctccttctctgcccggttgt

SEQ ID NO: 31637 - DNA, 1064 bp, Homo sapiens
agagccaacactcttatttcacgttcagtctcagaggggaaactttcatcatgtttgttccaggttaccctctatcagtacattttaacttattgcttttctagcattaaccaaacttgcattgctgtagcacccaacttgattgtgtagcatttttcctgattcttactattctcactggattaattttgctaatactttgactgtgattttgcatctatattaataaacaagattggcctgtaattttcctttctcatatctttgttgattttggactcaaagtgatgcaggtcccataaaactagctaggaagaatttcttcttttcctgttttctggtagagttcttgtaatatctggcattatttctttctttagtatttggcataatttactcataattttaggattcttcagaatttctacttcatcttgagtcagcttttataagttatatttttctgtactgtgtccattttatctaagttttgaaatttattgtgataaagttattaatactatctttatgattctcaagtgtctgatgaatctgtagtgatgatcactttcatgttctctaaattatctacttatgtattctctcttttccttaattagtttctctgggtttttcttcaaagaaccaactttggcctgttgattttctatattgtgcatttgttttctaatttattaagttcttctcttatcttattttcttccttctactttgcatttaattttttacgtatttattgaagtgtagtataccataaagataaaaaggcacaaatagtaagtatacaattaatgcattttcagaaaatgaacatatctacttaagaaatagaacttaacaatacaagcccctcattattctctgcagccattgacccctttctgtctggaagataaccactatcctgccttctaatactatagattagttttacctatttttgaaacttatacaaacgcaatcatgtaggtattcatttgtgtcttgcttctttccctgaacattatttttatgagattagcccattatgttgtacatagcta

SEQ ID NO: 31638 - DNA, 1049 bp, Homo sapiens
ccctgcttgaatttttattggaattacattgaacttatagatcaaattgaagaaattaaatgccatagaaaaatgccatagatattggatatatctatagcagttaattttctaatccatgtacttgatataacaaatctcctttaattaattaattaattagttaattgctttttgagacagggtcttgctctgttgtggtgcagagtcatgatcacggctcgcttgcagccttgacctgggcccaagcgatcctcccacctcagcctccagagtagttgggactacaggcatgtgccaccatgctctgtcaatttttatttttattttttttttgtagagataatgtctcactatgttgcccaggctggtctcaaactcctgggctcaaagattctcctgcctttgcctcctaaactgctgggattatgggtgtaagccactgcatctggtcagtcttctttaatttctgtcaataacattttatagtttttagtgcagacatcttctgtatctttctgtagatttattcttaggtattaaatactttttgatgctattgtaagtgatagctttaaaaatattttctaattgtttgtggctgctatataaatacacacttgattttgactgttgacccatgtccaaaccttgctcaattgactattaatggtaatcgtaatagtttatgcataaaaatatataatttttatatgttttttcttttctttcttttttttttggaaacagggtctcattatgttgtctaggctggagtgcagttgtctaggctggaacctctgcctcccaggttccagcgattcttgtgcctcagcctcctgagtagctgggactacaggcatgtgccaccatgcctggctaatttttttttttttttgtatttttagtagagatggggtctcgccgtgttgcccaggctggtctcaatctcctgagctcaggcaatccacctgccttggcctcccaaagtgctaggattatagtcatgagctactgcacctggcccattgatatttcttttatcctgt

SEQ ID NO: 31639 - DNA, 1099 bp, Homo sapiens
gcctctctctcctacatcaatgagccgaggcctctgagttctttatctgctctccaggggattcaggtacacatgaaagttggagaaccactgggtaagagaatgtctgacagcagggagtataaggatcactggccagaggcagctcactaatctgtgaccttttgggcctagagccaggaaggaaaacaggtattcatatataggtttcactgttgtgaaactctacatcctacattactgcattggaacataacgccttgtaaggtattattgtccccattttacagatgagaaaactgaggcacaaagatagaaagcaacttgcctaaggccacatgggattcaaactctgatgtgtctgacttcagatcctggggagactgagttctgatttctcttctgtgacctggaatctgttacaaggagcactagagaattctgttatctcttagctcaggtgatgctctcattgttctttagaagtgccgccagaagttcatgctcggagactattttgtgttcacaggaaactgctctttcattcatgccccttttgttctcccgagtcagggatctcagctccctcttttctcctggaaccctctaattagcctaactgtaaatcgaataagcagatttttcagtgacataatgcagtttggaactatatacctcttatgggctgcatctattttccctttccagtacctctgcaactacaaaaatcttatgttgacaatagagatcatgtcatgtttcctttggtttgagattctgtgtgacctgagtactttaggcaattatctatgaacatctaaactaagaaaagagcaaaaagggcaaaagagtgcaagattgttcccattcccattaaagaagacattctcttctgtgtttaacatgggcaaaataaaagtctgtttattagacttcaaacacgtattttcacaacacatttattgtgtgcagcaaagttcaactctattttgtgcctgtacatataagtatcaaaggaagcgccttcattcctagttgctgacaaatatgaagttgctttcaagaaaacacatgcaaaagcaattacgattatgaatgg

SEQ ID NO: 31640 - DNA, 1381 bp, Homo sapiens
tagcttggtgacctctctggtgcagaggctgtcttctctcatcctgctctttcccccagaggggcccagtgggacagtcctgaaaatgcaatgtagaaatcccagctgaggtgccctccagaatccagggctccagctgtgaatacttcagcaagaaggagccttgtgccagggaaggtggcggagggcggggtggaagaattgacagggctggtgtgaggaattagggcgcttggataaccaggtgcaaagggagttctgcacccatgcctttgcttatgtccttcccccagagcccagtccttgcccacctccttcatggtgctttcctccaacacccctgaatgaaagcagctggctcttgttgttcatgggcagtgggtttcagtgaaggtctctggagcagagttcaggaccccctaggtcctactttgtctagtaacatgctatgcagatggggcatgtcagttacttcctctaggaatcaaatttttgtaccctttaaatgaaggatctggagcccaggacctctagggtgtctgtcagtttcacatttggaaacgcttcaattccaaagacctatcttatcttattctggtatcttgcttttgtcccttctcctgctggccttgagctagggctgtgcatggcctcgagctagggctgtgcatggcctcagtgcttccatgtgggctgaatttcataccacagatgtttgctgaatgaacatcatgcctgggactactggttctatttttaggagcgtgctggaatttctaaccagactgtgagcttcctgaggttagggtttggagtgtgccgcacctcagaacccagaggagactgagaaaggacccagggaacactggggatgaaaactttctatactctctccatctacataacaaacagaactcattcctgtattttggaaaacacagacatctgcactttgtccccagagatcctgatttaattggcctatggttggacctgggaggtgatgttatccggaagctaccctagatgattgagctggggtgagaagccctgggctcagttaatacctgagagcagttccacctctgccattctgtgactcctgcactccccatacgtgctgttggtacagggcagaggagccctatgtgtgaaaactacttagggctttacattttttactggtaataggagttgtgaatcttcttgatgaagctcatattttatgcttggttctttgtagacattctcttttaattgagtcttcatagcaactctgtgagatcaatttcatgattgccattttagagatgaggactcgggagctcagagaggggacttgatctgcacaaggtcacacaacgagctaatcagtggctga

SEQ ID NO: 31641 - DNA, 1042 bp, Homo sapiens
gtatggttgcacattgtttgaaccagtttcctactgagatatttttagatttccaatctttttctattataaatatagctaaaatatacatatgtatatatatgtatgcacattgtgtgtgtgtgtgtgtgtgtgtgtgtgtgtgtctttctgtgtgtgtgaatctgtaagacaaattcttaaaagtgaacttagtgggccaaagattttgatagcgtggccactttaatgccttggatttagatactgctttcaactttccctttttgaatgattattccataggctctgtccttttgaatcagaggcttaggatctgagataacaaaaacaggtctgaatatgtatctgcagaataaaaacaagggacagagagttccaagatccacaacttggaaggctcttcagaagagaataggttttaaggtgcttggaagcctttgggcagctcatgctgtcactgaaggcagtcgttgcttctggaacgcccacttcctgagcctctagaggactggcaactgcagaggatgccctgcagacccaagctggactgtaaaacccttgatctgggttgtctataaatgccaagggagggtataataaaattagtacaaaagcagtaaatatttgttgcatgaacgagtctattcttaggtaccttcctcttagaatcttggaacatcagggctagaagagtccgtggagaccctctagtctaccatttgagagggtgggagtggtgcagctcttacatctagtattggaactattgaactttgcccctaccactctatttatgtggaattgtgtatttggttgtgagtgccacattttaggggggaatgtagttgaaaaggatcctgtccagcatgtggggaataaatgaaagacccatatgtgttaggcttgggaggggagagggaactttagaaaggatatatacgtggcacttgtcttcatagcctcacagtgaagaaaatattctaagcacttcaagaactataactagagccagtggatggaagctataggggtacggatt

SEQ ID NO: 31642 - DNA, 1035 bp, Homo sapiens
gatcagggaccttgcttgggtggtgttcacctctgcattccagtgctctgaacaacatctgagcgtattaggtgagcagcaaatcagtgtggaatgaatcatctctgagcaaagagatctgatcaagtgagtcagggacccattgaagcaatctcttcctttcttcagtttctgctcttctcagctgtccctgaaatgcttggctcaaccggatgaaactaacaccaactgttttatttatgtgaactactcacttttttctccaattcctatgactcaatgtatgcatgtgtcttcactgaagtgtacaataatctttattttaggcttattggacacaacactaaatgctttgtctggatgaaatttgttacttttctagtgtggacatgctctcccaactaacaaattgttacagggaccatcaataaggacctaaactatgggaataattttctgttttcatttaatacttatcttttgtcttatttcttagggcctaaacttaattttgctttggacctttgctttgaacctctgtgtcagatgcacaacatctttaaatcttcatttgaagatgactaagagactcagtaattaaaagctatcactccatcttcctgtgtaccttcaagggttttattaatagctttcctttctgttgaacagattatcctgcatctctgtgtcttattgaaatgctcagcactcacatcccttttctcgggagtttttacaacaagaagagcagaggtttttgttacggatacaaagctctgcttttgtgagcatgttgattcattctcatcagggaacagatgaggggttgtgtgaaggattggggcaaattgttatcacgaaaaaaaaaagaagcctgaaatattgttttacctttcttgacctaaagttcaagatgtcataaaatcaaccttaaagcttacctagtccaatgttattattatatagatgaggacacttagttcagggaggaaaaggggttctcccaaggccacacaattgaaacacaaaagtcag

SEQ ID NO: 31643 - DNA, 1007 bp, Homo sapiens
ccatattatccagttcagattccatggtccctcacaaccattcccttgcctctcccctccaccacttttgcctggtgctcttggttttcctgccacctgtctagttacccttgctcagtctcctctgctcaaacctcattctctgtttgacttctagccatgaatgagaagtgccccagagactagtctctggctgtcttctctagctatgtcttctccctagttggtatcatctggtcacgtggctttaaattctatctctaggctaatgattctcaaaagcattcctctctgtctttgacctctcactttcctgtaaagcctgcttcccacttcctagtcattcattctccctaatgctttactgctctgcaaaataattgtctacattcctcatcttcccctccactcttctatgaaaatgagtatttttttaaaaaagtattcctctcccctgagtttcagactgatttacctgacatgtccacttggcttagaggcaccccaacctaacatgtccaaaggagaactcctgagctccttccctaccccaagcctgcttttcccaaatcttcctatttcagtccatcacaccctcattcacatagttgctcaggccaaaaactaagtaatgagttgttgaacaaacatttggggtttaattaggaagtaactatttttatctcctcatagcccttcaaaatgtattcagagggttgtctaccccaggatggaaattcctgtggtcccatgacttttgtgatcactcttaggtaataataaacaacaacaacaacaacaaaaacctatagtccaaagttaaaatacctggtctcatgtagtgataaaagtctgaccttgatttatagttacgtcttctccctaccctagccggagcttgctgtaatctggcttcttgcagtggatgtggctggccagtggtcaggggcttgtgcacttctctccctaccctaccctacgtcatgctttcacctaccctccagcat

SEQ ID NO: 31644 - DNA, 2361 bp, Homo sapiens
atgaaaaaaaagtaaaaatgataagagtgatagcaaaaatggtggaaattctctgctccataaaagcaataacaaaactgcaaaaattgtcagaatcaacttttaggaaaactctgaaaattaaccaaaagcagcagcaatttaggtaggggtcatttattcaagaaaaatgtctgaatctcagtgagaacagtgagctttgtggtgattcgactggctttgttctcatccttctctctccagttcctctatggccttgggagccaacagtctgcagtcatggtgaggaccagcaggctgacagtccccagagaaggcagagcggggttggagcccctttaaagccacattcccagagaatttttacttagcctgtctaatggttccctggaagactctacttgcaagactatctttactttatttttacttagcctgtctaatggttccctggaagactctacttgcaagactatctttactttacctgacttggagcttgctgaattcaaaaagccttttatctaagggtgtttgttgaaagcaattagaggcatttgactagctttgcagctgtctgaggtggtagataacagttggggtaaatgatatgctaaccaaaaagcctaatggtaaaagctgaagaataagatttccatgggggttttgaacagctataaaatattcctgggaatctagagggtcactctcattcatagagcttccgtgcatgcttaggaaagacctaaggaagcgctaaactttcacctctggttaaccatgaggctgtgtgcaagcaggaagtaaaggctaaggcagagttgtccactgagtgttgagtgaatgttgattgcatgccccagcacagacacagaacccaccagcaaagactggttttgctgagtttctgtatgatattggttccagatgtctaaggaactgttcaatcattagtggactacaaagctaatcaagcagacacttttagttgccatatacaacaaagaatacatatttataggattggtttagaaaagtcactaaacaataatagcaaacagcaacaacaacaaatcctggagagatcttgtttgttggttgtttatttttggtatttctcatgactggggttctttgaccaactttgatcttgatttgaagtgtttcaacgtttttagaaaatccacagccatatatatttacatatttattatccatagttctttctctcctttcttccaggtattacagttatacacatgttatgccatttttattgtcccacagctcttggctgctctattctatgtgcaccccctcacatactcctttttctctttgtatcttaatctggtttttattgacataccttcaagttcactaagtctttttatcaactttgtgtattgcacttaaagcctattgaaggaatttccatctcgaaatgggtttttcccttgcttcattgtgtatcatactttttgaatgcgggccatgcagtgaaggaccatagggactgaggtcgatagtgtttgtgcctagaaatgcacatccttctactgggtcattagtgtggggagttgagctgggtaattcagagttgacctggattggagtttcctagtgactaatgtgaccttcagtgcatccacttcaagttactctagcaggtggctgctttgacttctgcttagtgttggggctggattgccagagggtttttctcattgattttgctcccattttcctttcagccatgcttgctttcctgcaccaaataggggcatatcttcaccatgtctgtgtctctccctcagccatttcctgctcctgcttattgcttgttgctaggctgatggtgggaaacagccggggttcactgttatctcagtctagcctgagtcttaggtaggccctgtgtgcctgagtctcaggggtgggcctttctcagcacttccacctcctcccatggtatctggctacttgaccaaacctctgcgtggtgtcagtgtaaggtcatcagctggagatgatttactgcccctcctgtaaggtagaggttttagtttctaccattccccctgcagcagtgaatctttgcctgcgttcctgcaaatgaggtcatatgcctccccttgaggcagactgatttcacctctgttccttccccagaggccataggtctttgctagagccccagggggagtttcctgtgtttccctcagcaactgaaaagcttatgcttcatgggagagaagcattcaggagagcaggcaggacttgacttcttcctgtcccccgtagccactgaagtggcccctctccattcacctgtcctgctcccagtctttcttgtgagca

SEQ ID NO: 31645 - DNA, 1077 bp, Homo sapiens
aattatacttctatgcagctgattttcaaacaaaattatatttttgctttctggtttaaagaagtagtaatcctcatgcaaggtaaagattttcagtttactacttgtttctatatatttctgctaagaaatggaatcctatgtaataactgtagttatgtatcagatgttatttctgtatggataaattgttcttatgggcaattaatacagtcatgcatcacttaacaatggggatacgtcctgagaaatgtgatttcattgttgtgggaacatcagagtatacttacctagatggtatagcccaccacacagctgggctctagggtatagcatattgctgctaggctacaaacctgtacagcattttacagttaggcatttgtaacacaatggtacctgttagtgtatctaaacctggaaaaggtacagtaaaaacatggtattataatcttacgtaattgccataatgcagctagagcgatcttttcaaaatgcaaatctgatcactgttactcatccctctgctctaaaaatcttgaatggcttcttgttccttttaggttcaagaagggactctttaatatgcgtaaaaggtcctaaatgattggatctctttctccagactcatctcttattatttacttcatattctctctgcttcatcatatagatgtcttaggtcctcctgcatgaaaagctctctcccaccacagagcctttgaacttgtccctctacccagaatgttctttattttttcatctagtttacacccctactcagcagctcaagttcttcctggatccagtcctcctacagtaggcgcttacagcactgtgtccatctctttccagcacatttatatgattatttgtttgtccatcactcccactggcttataagttaggcattttaaccccactgtcaacatgagcctaactcatagtaaatacatgtgtgatctcatttaaatataacattatgatgttctattatccctgttttacagtgaggaaactgaggctcaaaggggtaagtctccagcccaaggtcatatagcaataagtaataagtga

SEQ ID NO: 31646 - DNA, 1060 bp, Homo sapiens
ataagcctattaatatcttcctggaccaaggttgggaattccatcgaattcaagattcgattttgaatctttgccagtgagtctttctcacgtgtaatctatatattaatatccactgtagcctggaccagtagggacatcagagagggccatttgaatgcccttccataggggagctgtaacgttcatgtaccaaaccttacattcatccagcttcttgaagcgtggtcttccagaatgtttcaagaccaaatagtagacaagctgaaaaagttcctcgttctagactttaaagctgcagttgtgtaggcttgtatatgctctgaccccagaaatatcagaatgagtaattaattttctcctttggaagattttttaaatgtcttgaaagaatgttaaaggaatttttgatcctcaaggcatattaaaatgactaagacttcaaaaatattaattgcttttatccccagggaagcgatctgagtgataattttagtaacactgactgctatacctaagtgtctttttgtaaaatcctatttgtgaaactatgtttaattttaggaatgtggtttttgagcagatatggtaataagcacattacttgaaaaaggaatgagcagttctgtctggtattttaattgtattagcatcaactgtgtttttcagtggtgactagaattggaacagcagatatagcagataatcctgaaacttcattttagataaaattctgaacctcccaaattttgtatcagtccatttagtgatttggttatcattcaggtgagtgcctgaggtggggcagaaggaaagataatgggaattgaagacaccagggagctgtgcagcctggctgggcagtgacattgaagtcacagaggaagaggagattgcaggcaacttctgagatgtgttttttgttaaccacctctaacatctgttttcactgaggtagcatagcaaaaacctcttagatttatgtcattagtgtactgcaaatgttttcctttaacaaatcagtgatttgtgctggtgatttgaaagcccctaggtaaat

SEQ ID NO: 31647 - DNA, 1028 bp, Homo sapiens
ttttggagaatagtagagcaaactttactagagaaaggtgcaagagttttatagcagtattgaatgcccatttgagaattatgatcatgaaattaaagtgtcactagtcagttcagggctagatgaataagcctgtagtgaacattagccataactgttaaactctgttcttcatccacatttagctggttggctatcataggtgatatgatggtgaaagaaatatatgggattttactttggaaaacactgactccaaactcatttcttgatttaaagtagaagaagtatctcagtggcatcactgtagaagggtgtgagtcttttctactcttgagagagcctgtttttagtcttttgtaccactgggttctgggttcttgggcagacccagagacactctgactgtaagggctggtctaaagaagagtagttaaagtgatcagggagtaaagggcttgatttcgttctaaaaaagattacatttaaacttagagaggcacaaaggatggtatgattcaggtattcaaaatctggaagaaaatgagttgattgaacgtgtacttagtcatggacactcccacgactagctgagccacttaaaacttttaagaggaaaatccaggacacatgcccaccagaactgagattttaaactctgcagtattccttgccaaatggcagatcttctaaaatgaagtaaagaagtaagtgggaacaatgttactagtcttgatctgttgacatttttcattttctgagtaggggttattggaattctctggctaaagccagagtagtggctgccatttacttttggtttccagcctagctgtggggtaattagatttaaatctgggattttattacttcagaagataataagtcattaagtctccttaactgttaatgtgattactttagcaaatttcttgactaattcttaaatctccagtctttatgtgtacagtggaatggccttagtaggaaaatagcttagacctggtctaactaaattatgtagatcc

SEQ ID NO: 31648 - DNA, 1031 bp, Homo sapiens
tttggatcacatattgcatttcgtggtaatatcttttcaatctctttcaatctagaataattcctcagcctttctttgtcttttatgacactggccttttaaaagaatacagtctttgttgtgtgtgtgtgtttttcaagtaaaatcttctcattctggcagaaaattcagattatgccttcctggccagaatactatataagtgatgttttgtcttcggaatattacatctagagccatttgacatctgtgtacccctcatttgtgatatcaggcctgatcacctggccagtttctctctggtttatactttacatccgctgccttgctactaataagaagtctgcagagacacttcaacactatgtagctattctatacctcattaagatttcacccctatatttagcatcctttggtaatttttctctaaactattcttttctgtgatagttgcaaaatgatgatttttcaactttagcattggtttcacagttgctaattgatacttggcatgattctgaaaacaagagcccttccctctgccttattattattttctttttcttttttttttttttttttttgagacggagtctcgctctgtcgtccaggctggagtgcagtggcacgatctcggctcactgcaagctccgcctcccaggttcacgccattctcctgcctcagcctcccgagtagctgggactacaggcgcatgccatgcctggctaatgttttgtatttttagtaaagatggcatttcaccgtgttagccaggaaggtctcaatctcctgacctcgtgatctgtctgccttggcctcccaaagtgctgggattacaggcgtgagccactgcgcccggcctgccttgttattttcttatttgtctcttatgaatatggattcacagatttttaactcattacttctcttaattattttcgtgtttgtatttttccacatttggccagcaggagtgtcttcattctaattcctgtcctcatgacatacacccccattattttcatta

SEQ ID NO: 31649 - DNA, 1069 bp, Homo sapiens
atggactcccctttttctagatccatccatcagttcgaatacatttctgatacatcatttctgatgctgtcagtttgtttgaagacatactcgtccatgtgtaattaagttctaatagtggtttaaattcctgcttcaaagaacactatagtcctgccagtgctctgtagtgaacttataagcactacctcctggatccccctcttagtgtgttaaaggctttgagaagtcctacattaagggttactgttaggttttgtttaatttagtaatcctaaatttatttgaccgccaagcctttctgttctcatcacttccatcttacaaaactggtgtttgtggagattctgaagacaacactgggccatgttcttctttagttgtatcttggccacggagtcaggtcatagagaaaaggccctgtgagttttcctgtctcctccacaatattctgacaggccatctgctgaatgtgagtggcagcccttaacccttctatataaaaccatgtcagaactgcctcagattctgaggccccttaaatgtattactcagttccactaaatcatggaagaaaaatcaatgtcattttcgtgtttggggaaacatttatcaggtttcatgttttaaaattcctgatagaaattgttgatctctggtggtgctttttattgtaaatgccagtgaacagtacagttcttcactggaatttcacagtcacagtttaatcatctgtccttgataaaacaaatattttagatacagacgtaatgaatcatctctccctgtgtgcttctgtaaacacaaaatgattcagctgttgctacctactgagatttcattttgccataattttatcaaccttgtagagtcagatgggttgtcattgtaagaagagcaattttcagaaaaatataatctattgagagtttgcaggtcttttcacagttaattagttatttctggcttttagactttgttaatacagcataaaagacataatttatttggggaatggctctgttggttaatagagaaatttttgattgttttcagtctatacctgact

SEQ ID NO: 31650 - DNA, 1641 bp, Homo sapiens
tttcttcccctcattcaacatatcagttcccatttaatcttgaaaagctctttttatcttattttaccaccacttgaatgcctcctcactgttctgcctgccatataaagcctgtgacaatttgaggcctaacctagtcatcccgccttattgctcacctctctgtctcagaagtcctgctctagcctccccactgttcctccagtacactgaggaattggcaaactacaactggcagatctaatctggcttgccacctgtttttgtaaataaaagttcacatacccaccctattctctgtgactgctttcattctacagtggcagagttgcatggttgtgacagaggccataggatccgtaaagtctaaattctacctggcccttcactaagaatgtttgccggcccctgttctatacctttccagactctatccagatcctcactattcatttgttatgttagaaaacactgtctcacatcacaaaagtgctatagcacttgttttctggactgttttgtatcccatttgcttaactgtttgatgaatatgtcagcttgtttaactttttgtttctgtatcttctttccagtgaagtttagagcaccttttaggcagaaactcttagacatctttggtatacccataccacacgtagtgcagagatgtgagtgtgtattaaacttagattgaaattagtttattagtacttaacgtgtttacatcttttaaagatatataaatttcacttatattttctactatgtctatccttagtctttttaccaattgacagttcttattgtagtattttttagcttgatggttaactgtttttcccctagcggaaccttttttcccaaatgaaattttacgataaaccataacgtataaaatagataaaacagattgttctgttccacctgacctccttctgcctattatccatggtggtctgtaggccccgagatacccccacagatccctgcaactttatgaaatagtttgagaatgactgtgttccttaattttaacattatatatggaatcatcagtgagagctaaattaacaaatttgtaaccattgacaaaattgaactcaataaattattaaactacctttccttcactcggcccttgggccaggtgtgtcttacttaagtcgttactattgcttctgggctaaacatggatagctcctaagggttgggaaaatttaagatgagttctatagtttggtcataccttggtagaaaagatgtaaccgaaacatttttaataaatgaactttcaagcttatttgcagtctctttctctgggaccaggacttcaattttgtgacttcccacaatttagccattacccagtaaccagtctgtcccactcctgttgtcccgatgggccattctttttcttttctgcttttctaagtgcatgttaagttgggattcttttttactttacttgctgaaaagatgccagtttacatacttttgccccttctacaattaataaagtctctctttttctttttaaaaaatacagtggattgtcctgtttgcggggttaacattccagaaagtcacattaataagcatttagacagctgtttatcacgcgaagagaagaaggaaagcctc

SEQ ID NO: 31651 - DNA, 1027 bp, Homo sapiens
ctttctttctgttccttctgggcttttaattatgcccaatatctcatacttttttgtgtttgtctttttcattcatttttctctctgtgcttggtttggatattttctattgacctgccttcaagtttgtattgtgtgttgttatactcatccaatttagatatggtattttgcagttgtagaatgttcattttattcttttttatggattttatttctcataatacactatctttttatcccttttctttttttttctttaacatgtttatcatagtttgaagtccttacctagagatgctattctttggattacctctgggtctgcttctattgaatattttatctcttgattagtggctactttttcttgcttctttgcatgttcaataattttaaaatatgtgctgaacattgtggttgaaacgttgtagaagctgtgaattgtcttcttttgaaagatgtcacattttgttctaagaggcagttaaattatcagctcttcatctttgttctgtcaaggcctggtataatgttttcttaggttaggtctgtttgagctttgtttatatttcttcagtgtggtccatttttctaaggtgtggtctttgtggggtgtcacttgaatgtccatgatcttaccaagatttctcagctttggctgggctccaatgcgaacaactaactttccagcactgacgtttgggattttaatttaccagtatcagcttcctagtgggtctcctgtgtttttgtctaatcatgtgcagccctggaaatgagcaggaatggatgtgaatttctaagcagactggtggggttccctttcagtagctaccacgtgtcaaagcactctgacccctcaatcctggccagttttgttcagaactctgatctcttattttctctaacaagtaagatcaatgtttcctgtttagacttcactttagtacccattcctagaaaatgctcccagggtaaagtaagtcttgggggaaatgttggactacttcatgttttcttcttt

SEQ ID NO: 31652 - DNA, 1026 bp, Homo sapiens
gcagatttgaggacttccttacttttgggtgctctgaagatactccttttcctgcccaagccctagaatcagccatttctccaaggagctcctcttcttggagaatagtatttagagaccaggatctggtgctgggtatgcttgttgctactggggtgtcattgcttctaggccctctcaatggacagagctaagtaatatatgtatgttatatatatgtatgtactaactcatgtatatacacatatctataattgattctgtctgctatatattaatctgttaattcttaatcggatttattcagcatgtattaaatggtatggcatttgaaatatgtaattgcttgtactttataaagctcagatatgcaactttacttcctgtcaaatgcatgaatgtgtgaaagtgagtttggtcacccaaagggatatgaaaaggcatgtttcaatatcttggattacttttagttttaatcatgcaagtcaaacaagaatttttatgaaggacgtactggtttagatagtggtcaggtgcccctgtagttaagtgtaatcatgtgttgcttaacagggatgtgttctgagaaatgtgtcattaggcaatttggttgctgtgtgaacatcatacggtgtacttacacaaaccaacatggtatagcctactacactcctattctatatggcagggcctattgctccttggtaacaaaacctgtacagcatgttactatagctaatacggtaggcagttgcaacacaatggtacctattagtgtatctaaacatagaaaaagtacagggaaaatatggtataaaagataaaaaatggtacatctttatagggcatttactatgaatggagctttcaggactgaaagttactcttgatgagtcaatgagtgagtgataagtgaatgtgaaggcctaaggcccttaccatacactactgtagactttataaacactgtacacttagactacacactaaatttataaaaaagtttcttcaataattaaccttact

SEQ ID NO: 31653 - DNA, 1040 bp, Homo sapiens
ttaaatattcacattttagagtaacattatgtataataccactctcttaaaactgtatcaaaatgttgtggggagggatgggtggggtggcttacctctttagtcccagctacttagaaggccaaggcaggaggattgcttgagcccaagagttgaagaccagcctgggtaacataaagaggcctgtctctacaaaaaatttttaaaaatgtgtcaaatagaaactaacatagcaattttaaattttgtctttttattgaagcctcactttgatgtagtagaatgcacagatcttaagtgagcagctcagttaatttttatcagtgtcccttccaccctcaccaaggtgtggaacatctccagtattcagaagccatgcttgttccctctctccatcaatacccgtcaaacgtgaccacttttccgacctctatcaccataaactagttttgcacaacctcattcgttctggcttctttcaataaacacaagatctgtggatttcaaacatgttgctgttgggagcagtagcattcctttttcattattgtatatcattccactcaatgaatatctcacattcaaaaaatccattctattcttactagacattttgggttatttctaatatttggctataaagatactaaaagtattcttgtatatattttttggtgatcataagcactgatttcttttgtgtatgtatccatcagtgaaattgcccggtcataggataaataccataatacattggtttctacaatcatccatcaaagttacctgaacaagtcaaatgttttacactgctcctttctttaccttcttgaactcctaattccctttcacttgcttcataaaatttaatcttaacatattttatgcttgaaagttttttaagattatcatcttttttaaaactctacttatgtaagctgaaatggacattttaattttttcctttgaactctaaggatcttccttttatattgatttatgtatcattgcagtgatcagtaatacacaatttatcaaaataa

SEQ ID NO: 31654 - DNA, 1064 bp, Homo sapiens
tcattctgcccgcagtctcctgctctccttccctactccctccaccttgctttctccctccgtttcctttcttccttcctcccatcttcacttcctcatttactcatttgttaaacacttccaccctttaaaaattattttaattgtgataaaaaacacatagcagaaaatgtaccatcttaaccattttacaacgtacagttcagtggcattagatatatcacattgctgtgcagccatcaccaccatctgtctccagaactcttttcaacctgaaaaactgaaactgtacaaactaaacaataactcctcattccctccttcctctagtccctgtctgtgaatctgactcctctaggtacctcatataagtggattcttacacgatttgtccttttgtgactggcttatttcacttagcatactgtccccaaggtccatccattctcttccttttgaaggctgagttgtgccccactgtgtgcctagaccgcatctggttgacccatccatccgtcgatggacacattatgaatggtgctcctgtgaacactgtgtaccaataagtgctttttgagcatgatcacgtgcctggcattgtgctgggctgcagtgggaaatgaacttggttcccatgctctgggggtaatgttaagaagcaaacaccaatagatgtttactaagagactgcaatatgtcccgtgatgggaaagagcagtgttcggggagagaattatggcaggggtggaggtgggtggctgggacaatggtcaggtctcaggaagtggcctgaagaatggggaggagaggtgggcaggggtggggagggtccaggcagaagtaacaacatgtgtgaagccactggattgcgacagagttgcccgttggagggattgatgcttagatttctgcttcagtgtcttctccagcaagcatcctatcagcctccaggcccacctctccccatcatcttctcctctctgctcttattctagttcattcaaactgcctctttgctcagctatttctcccactgtccagtgagcggcttgagtgcaggaact

SEQ ID NO: 31655 - DNA, 1054 bp, Homo sapiens
cgtcttgttctgaaggatgaacaaaagcttgaggtgtacgtatcagaacgtaaactgcagcacgaagaccaccaacgttcacccagactgtatccacctttcgccatacgtgtcgcattccagataacgcctgtgtacacacaaaaaaaataacaattaggttgacaatctacttttacatcaactaggattcttaactgccaagataggaaacctcaggggaagagaaaacaaatcttatccaaacaaacatccccaaatctcaaaaagatcccaaagttgccacaggctgcgattttgagctaatgtgtatagcaccttggtaaagcattttgtgtcttgagtaagtagtacagctcggcctgtggtaggtgtgcagacacggctcatctcccgtaggcaagctggataaaggttccagtttctcttcttggatcccatcctataatagaaggtctcatgagtcaaacacttgcaaaagatacaaaatagaaggactatatgaaacaaaaacagtttcatgcatcctgaggcatgaaaaatagctgtagttttagaaaccagacctttgccattacatgtctatgaaataagttgagttagtaaactgcttagaattctgaatcaaaaaaattttttttagacaactgtgttagttatatgacttgtcctcttagtataataagcagtcaaactgtataaaccaaacaagtgattagaaatcatttaggccaggtgttttggtggctcatgcctgtaatcccagcagtttgggaggctgaggcgggcagatcacctgaagtcaggagtttgagaccagcctggccaatatggtgaaaccctgtcttttaaaaatacaaaaataagctgggcatgatggcatgtgcctgaaatccgagctactcaggagggtgaggcaggagaatcgcttgaacccgggaggcagaggttacagtgagccgagatcataccactgcactccagcctgggcaacagagcagggctctgtctccaaaaaaaaaaaaagaatcatttatgctgagaaacagaatga

SEQ ID NO: 31656 - DNA, 1882 bp, Homo sapiens
aaaaaaaggaaaaggaaaaaaaagttctactgtgggtaaaatgctatcatgctatcaaacagcatcacatgctacagagaagtcttgtgaaaggatgtcagtgtggcaaacttcattgtcttttaagaaattgccacagctatcgtaatcttcaaccaccaccaccctgatgagtcagtagccatcgttaacgttggcgtaagaccctccaccagcaaaaagattgttagcatttttttagcagtgatgtatttatcaattatacataatgctattgtacacttcttaatagactatggtatagtgtaaccataatttatgcactgggaaaccaacaaattcatgagattcgctttattgtagtgctctggaattgagcctgccgtgtttctgaggtatacctgtgtatttagtatgttccttgtatataaaaccccattttatagggtaggaaactaaggcttagagtttgagcaattttcccatagataacaccaataaattgagggctgcagagaccacttaagtggttctcttaacagtagtctagacatgacgtaatgagatttggcttaggagtgacaatggtaaggaagttaaaggattcaggaaccaaataccagttattgagaagaaagaatggcctcaaaacatcacttctcaaggaagccttgataccctcacccttactacactgtatcctccatttgaatgttgtcaagagctcttctcacaattgtaaataataattgtgtaattttgttttttttttcctactttaggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgtaatggttactttaaaatactgtagttttctttgtgcctaagtataaacataagtacattttgttgttttgtttgcaatagtggtttaaatattttcccaaaatatccaaatttaaaaattctacaactttagaatttaataaatttattctaaaatatttatatattttttcatttaagaatggatcggcttaaaaagactgcttctcatttacttactggctataccatctgtatactaataaaaaacaagatttgatttggaaggactgactcaaactaacgaaaatatgaaacctgtctttctgctttggagatatttacctaatcatgttctgcagtagaataatttagttcttttgtctttttttggagatgaggtcttgctgtgttgcccaggctattcacagctgccatcatagtgaactacagcctgaaactcctgggttcaagagatccttctgcctcagcctcctgagtagctggaactataggcatgcgccaccaagcctgggcttttaaaaaaattttaaaaagaattttgagacaggatcttgccatgttgctcaggctagtcttcaactcctagccctgagtgatcttgctttgggcctctcaaaatgttgagttaataggcgtgagccaccatacccagccaaaaatttttttagagatgggaatggaatgatcttgaatagtgttggtgccacctatgttgtggcatcattttgaaaccaatcattcagagtgctttttttggtaaggcattatttt

SEQ ID NO: 31657 - DNA, 1031 bp, Homo sapiens
gaatgttgaaatatattctttcgaacaagagaagttcaccttatttgtgtttctcctgcttaattgcaatccttaaggaaagtgatttttcagtgcctaagcacagagctggaagctcaataaatgttagttttgttggtttatacgtgaaattgattctcaagtaatagttaagctcagaaaacatataaacaaggctttttgggagagacttcagggtcccatttaacctacatctcctaatattctattcatagaggaaactgatgcctcatggtctctgagtacatctatcccaccattcagttcttctttgggtttcctgtactaatcattgcagttatccttttcctgcaccttacttccttgggctttttgtttaaattaaccagctacctatctccttttcaagtagttacatactatttcttacccttataagacaaatttattaagtatattacacgcttgtacttggatgagaaagctggtgaaacttttgtcagggctagtgtgtgtgtgagatttgcaaaatgtaaacttaggttacttccatatattttttgtgagtggaggtttggcataattacataattctcttttacaacactctggtttgactgttaggttaattgtagagcaccttgttaggtcacaaatccagaagtctggtactggactttgcaggttgctttcttagtggcatattagtttatattagagcacatacttctcaagaagccttttttttcttatctgtgactctctcttcttgagatgggataatgtattggattattagagaagtgtgagtattgaatcagatagttttattttatctagagcagggttaaacctgatgaattgtttctgctctctcatggagtatatcttcttggtgacaaagacttttctgtctctgatttttatcttagtcgtggttacatttaataatcctgctttccagcttttcctagagatcagtcatcagtgaccttttgtcttgatactttgtcaccttttgttttctg

SEQ ID NO: 31658 - DNA, 1093 bp, Homo sapiens
cctggatagactttcctcaatttaacagctttttcatttttcactattttccacatactacacacacaaatatgacctctctcctgaagtcacatggaatgaattgcagttacccaaatcatagagacgtcatatatctttgtggggtggttctttttggaatgctacccttgctgcttttaatcctgcagattcaaatgtcatctcccctttggtcatgccttccatggtctgttgttctatgacccaaactgcccttttaaaaaagcagttttcttctgactcctgagcagtttgtactgcgtgggtcatagtaattctggggttgttgtcattgctgatttaaattaccttaactattctgagctttttgaaggaatagtgtcttgtactcctgagctcctagtatactctgatgtctagccaactttaagtaaatggagtgagcgacatgtaaatgtctttatggtttgacattttattaatcttgagcattggaaaagtggctggtatgactaaagaactgaatttttattttttatctaatttgaattgcaactgtggacagtatagctgtagccccggacttgttctgtggattacagaatacgtggacattgatggttttctctttttactgagcagtaaggaaataaaagctgaagctctctggcccattacatttcatttaactgcttgttttgttttatttattatatatttagctgaaagctaagtccaacaaaccatttttaaagatgtgcctgccttggacaacagtgaaagcaagcgttaatgagtttggatttcaaaaaaaaatgcataatgaattttagggaggtgagattccattaaactgttacaggagctacatagttaaatatatcagaacttgaatgaagaataggtctgtgtgatacaaatgaacccagcctaaatttctgtcctacaagttttcacttcctggaaacacttgattggaggagctctaagcatcatatcttgagttatagaaaacaatcacaaagtaagttttatcctgaggaattataataccaacattttaacaccaaatgctttttatattgctaat

SEQ ID NO: 31659 - DNA, 1032 bp, Homo sapiens
gtgacaagtggagaaaatattagttgtagcccagtatggatggtataatactatttttacttaaaatatatttctttttttctttttctttttttttttttgagatggagtctcgctcttgtcgtttaggttggagcgcaatggcgcaatcttggctcactgcaacctccgcctcccaggttcaagcgattctcctgcctcagccaccaagtagctgtgattacaggcgcctgccaccatgtatggctcatttttgtatttttagtagagacggggtttcaccatcttggccgggctggtcttgaactcctgacctcaggtgatcctcccacctcggccttccaaagtgctgggattacaggtgtgagccaccatgcctggcttacttacaatatatttaaatatgtgcacataagggaaaaaacctggactaatatgtagcaaaagattaggaataatatataacaaaatctggaatatatataataatatataacaaaataatagtaattctctctgggttgttggcattatgggtttttccatattttttgaatagtagatacatacgttgcttgttttaaaaaccagaccagatgtgtctgtccctccctttgtatctggatagatacagagggggtgcccaaagggaaaggcaggttttcactgaccttgggaagccctgggaacctccaaggtgggcccttctccaagctggctcttgagtctgacgggcctgcctcccgctgcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggtgagcgttagcaggatgcacagtcccgggggtggccttggaggctgtggccacggctagtcacctttcaggggttttacaacaggctttccaa

SEQ ID NO: 31660 - DNA, 1067 bp, Homo sapiens
ctgtcacgatcccatatcaaggcaggtaacctgacgcatgccacagcccccattgtcctaaggcctgtcacttacctgaggcccagcacgaacctagatagatcccctactgccctgggatgtgtcacttagctgaggctttgctctaaattcactgcaactctagcacttgcccttggctcccactgtcccaggacctgtcactcgaggctctgccctaaatgtccccaaggcctctgacagcacctatagcctctctgcccctgggacctctaacacacctgaggctctgcctaaaatgcacctgggagtcttggcctatgtgaacccagttatacatgaacgcccctcccccaagtctgacacagcttcttaagtccacacaccagaaatccagacccactcccagaatcctgatacagagctacaacccttagcccacagaaacactaacttctgtgtgcactgttactgcacaaggccctgacacacctgaaagtgattacagaaactgacccttcagaagaccccgtgcacatctacagacctgactcacccctgaacatcgcagtgctctgaagattctgatatacaactgaggccctcaaacccctgcagcctgacctataccataaaagcttaagcatggggtctctggccacacccgaggcccttgtgccccttatcctggcacacaaccaagccttccttgtgcatgacacacacaagagacagcaatgggggagtctctctggaagaggcagggattttcctccttcctggagagctgcctctgcttccctgaatccctcgctgatgggtccctggattacaggactaggagcctggagacacgagctaaatccagaagggaaagggcaggcagtggttgggttggcatgcatgatagtgagggttcctctgtgtcccctccactccaagctgttccttatgttcaggcctaagctgttctcaggccatgtgtaaagcccagtttcactgcttcctcctcctcagagacctgaactcctcacaggcagggacggaccatgtcttcttagtctgcc

SEQ ID NO: 31661 - DNA, 1026 bp, Homo sapiens
aaggcaaggaggaacaagtcacagcttacgtggatggcagcaggcaaaagagagagcttgtgcagaaaaactcccatttttaaaatcgtcagatctagcgagacttattcactatcatgagaacagcatgggaaagacttgcccctgtgatacaattacctcctaccaggtccctcccacaacacgtgggaattcaagatgagatttgagtagggacacagccaaaccatatcagacctctatccctgggtaactgaatagttaatgagaagaagtgtccctatctggagcattccatggaataaatgacaaagaaaggatggaattagagtatcaccattttacaagccccagtgaattaagagaggcctgagttattgacagctgttaatataagagacaatctaacgtgcctcctgatgagagaacgcaccagctctagtcttgccaaagggatcacacctgagtctgtccagtcttggctccagctgacagttttcaggaattcagaggaacatattgaactgcatatgaagcagcaaaacccagaccgagagactaggctctcttcagcagaaaaattgtaaggaaaaaaatcagaggaggaatctgcaaagtaggagatgtaaaaaacatccaaaaaaatgtttaatggacaagactaaactatagtatctaggggtgcacatttgggtgataaaatggggggaaaatgggttagaagttagggcagtggttacttatagtggaagagggagctgtgattaggaagggcataatgacagggcttttcaggcaggtggcagaattcttgtttcttgatctattactttataataaaagatttttcttaaaaaaaagctccaatgtaccattctttcatgtgtttagaaaatgtcctgtttcttaaacttgtgggagttcttaatttctacttttagcgcacactgcagaaaaatgcacacactgttgggatccttgagggagaattctgagcagtggaccccatgatgagtgcttcatgtc

SEQ ID NO: 31662 - DNA, 1069 bp, Homo sapiens
atgttgtagcctgtgttcaagtttctttctctttaaggctgaataatattccattgagtgtatagaccatatttctcccctctcttcagcttatcctccctctgaagcccttgcttgctgttggacaagttgctctctgagcctgcatggtggagaggctgcctgcaagcagcaacaaggctctctcatgaaacaatagctgacactgaagccccaaagataaaacaaataaaagtagagccatcctgaccaaaggcctccttcacccaccatagctacacttccagcccctggaaagaatgtcagggtcctttggaacccagtttgagaaatctaaagttctaggaaagtggttcttaacctttcttgcagcatagacccctggagtagtctggtatcatcatgtgccacacctattccaaataaagccttgaaatgcataaaatgaaatgcatgaggtcccacaagatcccactgaggtcacaaaggaaaccaattatattggcataaagtagaaaaaaaatatgtggtatagtaatgagtgtactttattagaacactgaataacaagatctagcaagcagttgcataaccactttatttataaaatagagatgagcaccaacaatgctgcaatagctgtaaagtgatatgaaaaaatctgtgatttttgtaatgtgtgtagtggcatcatggacactgataacactcctggagtttgatgtctacatctgtaagggtggtagaggagtggggagaaggagacagaaggaggaagtgaccctccagggcaggtagtaggtggtgggcctggagatgtttggggtacctgagaactgataggtagcagtgtttccaccccagcactgtcctgaggtgaaagcatcttgaaagagcccaccacacacacagtgtgaatcttaaccataggtgatgccccatgacctctgcaggcaaagagccaggagctgactgagaccacattttttcactcctttggggagacggcttcaaccatgcaatggtaacttggcttttgtcccctttcccaggaacccacgtgatggag

SEQ ID NO: 31663 - DNA, 1025 bp, Homo sapiens
ccctaaataagacaccgtgcttttcttatgtgtaccaggagctcagatgtttgtcaaatgattgaactataatagcagacagcctaggcagtctactttgactgagcaatgtggccctgactgaagtccctggagttggaggcagtgtgaaaaggacaactggagcccaccaaaccagccacacaaggaaacaacaaagagaggtgaaggaatgtttttgaggaagcttgatccaatacttgaagagtactgtcacacagaaatggaattaggtatgctctgtcaaagccccagaaatcaacttttggctgaatttaaggaagaacttattcctagcaaaatgtttcccagactgcatttagtggaatgctagcattcagggggtggagtacactggggcaggggcagagagagggaagggattctaatttattccataggaaaataagtttggaaatttgggttcagcaaaggtaaatggatattctcactgaaggacatagctttcatccattctcaaacttatgtggctcaaaagcttttcataggatgatatgaacatctcacacaatctctatattctaatctcagctcaggggcaaagaggaattagaggtgtctgacaaaagtataactgtatgaaggggtgcgtgtcccactagtatttgagtacttttaggatacaggattcaacaccacatggatgatacagacagagatgcaatctgaatagaaaactagaaccatgggttcatttgcccatgaactttcatcttgagtaaccaagtagctggcaggatggtctataccgatgaggatgcacacaaactgcccttgcctgcccttggtgttcaaatgaatggataatatggatattgcaaagggatcctggaattaatcaatgctgttgggtgagaggcttaatgacagcaggtgttcttgccagagcccactttgactcttctcatataatattttctaggacatattgcctgcctgtctgccttcttcatccatccatctag

SEQ ID NO: 31664 - DNA, 1050 bp, Homo sapiens
tgggaggtgatggggcaagatggagaatgaaaagggtgagcattgtgggccgtgtcctccgggacctcctgcccagcctccttggagggctgccagcctgggcagggcagggtcagtaccaaacagcagtgccctctgcaaatgggtggttggggttgttctgttcataagaggactcgggcctgggccggggctgggctttataggaaagtagaaactttcagggaggtgttacccattttatcatccattttactgggtttttagctatggggaagaggcataggtgctcagccacactgggactgggtggcctgggactggccctggaaggtgcctggctgaccccttgctcctggacagattgagccactcgaggggatgcggctgctggcagtgcctgagctgtgcaggggatcctgcgagacacccagaagacttattgtgcggggattattattttgtaaaatgcattttacaaaaccactcagggattttccagagcgaatctctggggcagggacgggctctccactggcttcgtcccattggctgggctcagagggcagcagccatcttcatttgaaacctcaagaaataaccagaacagggactcctggggatagggacagggactggagtgggactgggggctgggatctgcaggctctactgtgtcctcaccgcagctgtgtccttggcagtgcaactggtgtggagaaggggcacagtgaatgtcctcttagtgaagatcatagtaaactggcacattttaaaaaatatcaatactcagtgccgacaagggtatggcaaaacactgccacaagagaagtataaattggtaccatattttttaaaagatttggcaatatgtaatacaaacctttaaaaacattcaaccctaaggaaaaatgatctctttgtaggtaatatcaaagcacacctggaaaccccaataaaataagtgctaagatatccttagaatacaaatgaaaaagtatttagtaagagcaagatataaaattgacaacaaccaattataacccacca

SEQ ID NO: 31665 - DNA, 1070 bp, Homo sapiens
acacgacctgagcttcagggtaaaaaattaaataagcaacacggagtgcctggcgcacagtcactgtcccctttgcctttgagaaaacgccccctgaatgcccattcctctttttcaggaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcaggtgggcctctgtctgggagggtggcgtggggagtccaggggctgggggactgggctggatggagagccccgagcagaggactccgagggcggtggtgagggagggaggtggtgagggagggaggtggtgagggatgccacccttcgcctctgttgtgcacttgggacaagggacagcagaacaggagtcctcttctgcttttacttcctgcccagacctgcccgggccttgcctcttagcactcacggccttgggcaaggtgaatgtcactggggcttcatctctttcctctcccagtacaggggtggtgtactgaggtgtttcctccagcagtcttctgtggcaggcctgattctcttaggatgaatgtagtcatcctcgggtgggggggtcctacgtttctcctttagacggtcacgcggatgaagggaaatgtcaggttgctttgccttgggctggggtcctgcacagttgatggtcacagggttgtgagcccatgctggtcagaagcctatgattggtacatagggatttttttctatgaaaggaaaataggaaattaaatgattgcttaataaacacagcttgcttggtagaaacaaatctttttaaaaatggggttcctggggaaatatatgggagaaggcagcagcattgaggaggctcaaaattactgcttgagctctccgaatctccagggactgcgacctaataggtccttagtcagta

SEQ ID NO: 31666 - DNA, 1047 bp, Homo sapiens
cgagagtgggattgcagcccactccttcccgggttgtcttctttttttgtcctctttttctcacctggtcccctccaggatatttttcactgtcacattgagcttttagagtatttgatagtctcttgttgagtaccattagtaagctctgaaatcagaaaagtttaaattctgcttttatttaaccattttaccagatgtttcctgtggcttgacagatgtaccatttactagaaagttacactcctgagatttggaatgttatggacactgttgctatagacagtgattctgtcagggcaggatttggaagacaattttcacatcattttggggttgaagatgtgtttttcaccagaacagaaatgctattttcataatctgcttttatcttgtcttttataattagaacctctggtttataaaatactatatctggttgatcagagtttactctgataaataccgtggtgcttcaattggtgttactttctgaaagcagctgggcttgggtatatcagggtcttgtttgcaaaactgacctgggtgtaaaagaactcaggtagtgggcaggtggaaatttaaattgggctgaaaatcttctgcttcacttctccgggctacttgatgctggcgtatggctaagacatctgcagacttagcaacttcttgcacccacctgtaagttcaccaagacaaacctaggatggctgtggcacctttgcttctccagtgcctggagtcaccatctgtggcagcctgagtcctaagagaaaagcctctcacctagggttctgctggtggaagggaggcagaaggaagttgcttcctacagtgcaggagtgagactgtagttgcggctgcagcagagaataggggatttctggcattccttctctgaggggccggctgcagccctgctgtggagttgcatgcatcgtgccttcggagcgtctccacttctgcagcaaccttcctctcctgtgttttctttagccttattttgaagttttataaaagccttatgttatggaagatggagaaaca

SEQ ID NO: 31667 - DNA, 1065 bp, Homo sapiens
gcagcccaactgggggcctgcacactcacttcatcctccagtgtggttctgaaagccacctcctctggcaagtggcacttcctcctgcttcaaggtgaatactactttgtgtaaaacgatgacactctgctacagttgggtgtccagctgtctgtccccttccctggtctacaagttccaccagaccaggggctgaatttgctcaggtctgtagcactataccctcccagtgcctgacaccaaccaggtgctgagtaaatgtgtgaatgaaaaaggagccacgaggagagctctgtggaaacactcttccctttgggacagatgttaagaatcacttttaagcccacataaaccctgagtggcaccacttagtatacttccattttctcccttagagccttgatgtttacttccacatgtgccagaacagagcgccaccgctctcctttccctgctaagctcttgaaaacagaaaacgaaaacgcacacatgcgcgaggttcagtcggtagcaccagccctgcccgtgatgcttctttcacggcacgtgatctcatcccggtgttgactctcagtaagaagccccccaggtttcttgtgtggatgaaatgatttttttcactcctctgtatttcttgcttatgcatctggctccagtccaagtgtgaacataaagtgaggtatatgaaagtgaggaattcagtgcatttgggttgagtctcacagggcagagagatgaccagacatttcttttgggtggaaattgacccaaagtgcagatttgctcatactctgctagaaaagcaaacacatctcggcccaagtatgtaccagttctggtatttttcaaatttttccaaaaagtcctcaaagccaaagtgtttttcggctgttttctagtagattgttgttgcgtttattttatttttgtgtgacagatttgtgcttgtatcactaatagctgtcatcctctgtgtgttggttttgaatgacaccacatcattttgtcttaggccgttggcttttgagcaagttacgtccagtgatagaaacacagacactccat

SEQ ID NO: 31668 - DNA, 1046 bp, Homo sapiens
accacaaggcctcggatgaagttgactttatcctcgtattactctcaaattgtgaccaaatggaaagaaaattggtcaggtccgagagaccaaaatgtacagcacaacaaaagggttattatttgtgaaaaatttaggtgctccccccatgtgacttagaaagtttgaagttttctcttaaagtaatcattcgtctttataaagtttagaaggtacacaagctttattactatgaaaggctatgcttattttaattcacagcgaggcacaaagtgattgcctagtacaaaaccttttaaaataataatgaaaaacgccaagatgtcaaatcaaatggaaatgtggaccctaatttgattgcctaacttcgaaacatgtttcagaactgcacctacccacgtattatgcttgcgataagttatatgccgaagctttgtgctgataatattttaatgtgcaatatttagcgtactgtaagaattaaacatttatttcccattaaacgatgtatttatatttcttttaactttcggtacaaatgtgtgaactgttagcccacacactttcctcattcttttaaaagaaattaaataccaagactatattagaaaaaaaaaacagaacaagcaggaaaagtgagttgggcatagtggtttcatgaatgcagtgaggtcattctcctatctgtatcgagtggaatacccacacgtgaaaagacctttggtgttttaaattaacttttgaaattgtttacagaaaatgctttttgcctcccccctgctattttattgcaactttttattttaaactctaccctaaagagtgactgtgctagaaaaccacgttgatgtaaaatgtctcatggttggcagctaaccacactcaaaccatgttcagaggatggcaggcggccccgtcccattgccaaaaactttccactgggagtagttttgtaaggggctggctgggcgggcggggagcctgggggactgagatgggggcctttctcctgcttagtgactacatcatctctctctgcgtaggcg

SEQ ID NO: 31669 - DNA, 1044 bp, Homo sapiens
ttggaccactgttctaataggcagatgccagtccttagcctgcacgagcacagccacagcggagctcgcactctaagcggggactgcactttcctagtttactcagaggcctctgaggctacctgagagccagagtctagggaatggaggaccaagaatagaaggtaggtgtcgttactaaatctgcatcgggaaaccagggaagtggatgagtgttcattcttttttgtttgttttgtgtttgatctttttgaatcttatgatttacaaagctaaaacccaacctcaaacctagatctgatgatcttcaggctgtttgtgttgtgttacatacctgagttttcttcaagccaaaatgatatgtatagtaagacattagtttgaccccacttactcaattccacggaggttgcagtgttacatagtctatcaagatacagttcagttgtaaactaaatccaacagggtaaatgagacagcagggacttctattagccctgaagataataaaatgattttaagcagtatagaacttcctaattaaatgaataacaatgtgtggatgtgataacaagttttaatttaaagtatttttagtgctttttggtattcagagtaactgcagttcattaaaaaactagtgtatattcacaatagatgttgagaattatagacataatttctttggcattcttttatctttttcccttcagcccctgtaaaattatagctattaatacttaaaaccagaggcgccagcagacaccatccctcctgcaccagtatcatcagtacgacatgtctgggagcaggtcccacctcagacccactgcctccccatccaaaggaggccccagcctggtttgtgaacacaaacctagtcctcctctcttacaggcaagcagaagaattcctgggaggtcgaggttcctctggctagtgcagggcagatgatcaccaagtcagaggggcaggccgcagctgtccacttgcccagtgcccagccaggaaacccattctcctcccttgccagtccatgtgttt

SEQ ID NO: 31670 - DNA, 1030 bp, Homo sapiens
gattcggagcacccactcacccaggctcttgggtactgtgtctcctgaccccttccatcggctagtggctgactgtattcgaggcgggggcctgtcatgagtagcgagaaggacagttagaggttccctttgttcagccatcttatccttcaaatgggaattgcaccaacagatggaatccaacaaacagtgtaataaataaattgcctgttctgggctgggacctttatatgaattctcattgattcgcatagaaatccctcacggtagttggatagaggctcaagagagatgaagagactgctaagatcatacatttttctgactccacagcccactttctactatgtttctctgtcactggtagagtggccagggatacagaaatgaatgagctgctccgtgcctcccagaacagtacccgggaccacgtgcgaggtattacagagaagagcagcacgtggtgaattcttccattaggcagcctgtgggcagggccattctagaggctcggagtgttacgggagatcagaagagggaaagtttagttttctgttctctctctgcacttgcaagactgtgtctcttttttccccctctagtgatcagtgcctgattccaggactcaaccatctcagggcctgtggcagtcgtaccctctggaactccctccaattaaagaatgtcttgaaaatgcagatggtagcatatgaccttcggtgcttaacctgtcacatggtacagggcttgcagacagaagttttttgagtatttttaccaaaacacttacattttgaagagatcataccattaccagcttaatccctctgtttcgtggcaaccagggtccctccggaggcttggctcaactgctgaagaggtttgaacaagcctctttttttttttgcttaccctcatccagctactccttctaaacatttataagctctaccagggaggaaattgagcccccagcaaagtgcctgattccaataccatctgctaacaatttactttcataactctcctc

SEQ ID NO: 31671 - DNA, 1052 bp, Homo sapiens
gtttttttattggataatacagacatcttgtaataatagcttacataaactataattattgagtaaaatttatctgtaaaagcactccagaatataccatatactgtgaaaaacccaacatatctgtatattagcctgacaccaatctaatgaaggatgatgattttttagaattggtttattttaatataggtagatttcattggagtcagtttttaaacatcggtattcagatttttccctctataagtatgcattattatttgatttgtttgatgttcttcacaactcagattttaggaaatgtctgttgaataaatgttgattaatcatggataaatggaagctcttagcacaacccctgccatcaaacagtggacatctaaattgtttaaagaaaatgagtatactgacagttttcttcaagaataaaaatggaatcttattagtacataaaaacgtcacctgacagtgattgaaatgtaaatatgagaggttaattagactttgttagatcaacctgtggaacttaaaatatggagttctagcactaactcactcttccttgttacatattgataagctagggaacaagtgtagcttcctggcttgttcatctcatagtttctcaatttatacgaaggaagggtcaacattgagagagttattaggaagaagctgagggtggcctgtttcggaaagatcaggtcaatgtataatactagctggaataccagctctctgatctttccttaaaatgtgtcttcaacctgcctcttctccatcctcactgataggaacattgttgaagcttcctcacgtaacgcttgcgtccctgccctgttccctgactcaggtgtgtgcacccatctggcatggtgtgttggagcacccctcacggaagcctccctgtagctgtgtcagtgcttacagtggctccctgtcagtgacccgcctcgtcaggtctcagccgttcacctgtgttcagagccctttattatctgacccacctctctgtatccagccttaagtctaaggaaacaaacccgttg

SEQ ID NO: 31672 - DNA, 1027 bp, Homo sapiens
caggtttaatttactatctaattttcagaaatacatttgtcacctgcagacagttagacctagacagttgtagaaattttcagcattcccaacttacagaaaaccctgacagaaagaatacacagctgacccttgaacaataccatctgaacttcgagggtccacttcgactcaggattttttttcaaccaattgcagacagaaaatattgcaggatgtgaaacccatgtgtgtagaggcccagcttctcctataagcgggctctgcagagtggactttgagacttgggtatgtgtggattttgccattggtgggattcctggaaccaatcccctgagtatatataccaaaggatgactaatttctctttagtatacaacacctaattttcactctgctgaaaataaaatcctttgctgcttctgttccatgggctcttccttctgttccttccagccagtcgacagagccttgatgtgatcccagtggatgacctgttaacttagtgaggggctttgattctgtgtgggttcctgtggatgctaggatttggatatgtatgaggtgacatcactttctcctctgtcaccagcattggaatccataactaaaaggtggatggtgagtagccatccacctttggcaagaaaggttgctacctcagctatttaagatatttgctcaaataccaagtatgtaagtaaatgggtaattccaagctggaacagcccaaggaagcgtaagaaaggaaatacaagagcctttccaggtttcagttctcagtccaacagatggaagcctctcagttacatgagctcacatctgtctctctgatttgacagagctcgtgccatcaaaactggaattgctaattctataatccctcgaaagcataattgaagtgagactgacaaagagctacaccctaaaggttaatggcgcagagagaataaggggcctagagaactaatcgtgaaatataaatgtcagtggctgcaaaccactcatccatttaatttgctagaag

SEQ ID NO: 31673 - DNA, 1076 bp, Homo sapiens
ttttaaatgttctttgaataccaagaacatttatccttcactgtaatatatgacacaaatatattcttcagttttgtattttgcctttacttggttttggtgtttttagatgtataaaagcataaaatctgtattctcaatcaaattctacatcttccttggtggcttctgtctttgattaaaaattttatttctggcttagcaaatgttttcctattccacatcagatagtctgaacatatccttatagttttgtaagtttttgcagcaaaaaccttactttaaaagcatctaaataatctttaaaacatttgggatttattttgatgtacagtataaggcaaagtgctatctggattcttttctcagtaatgtttgttttgtaatccacttcttccccattggcctggatttctgattcctatatccacagtatctgtctggtcctacctagtctctacccagtaacactccaaaatatattctttgctttatgttttaaatatttgatagatcaaacttattcattcgtagaaaaagaactagcttttcccatctcatttgtgtgtgtggataaaatttagacccatctttccaattccctacaaaactatcctgttgctactttaattatgaatatattatcctatgaatgaatctgagaaggattgatattttctagtatttttttttttttatggatgagctgattgtaccctgaagtacaatcagaatctacatggtgtttcttaaaggcaaggacctgtggtctccaagagatgttgacagccacctaatgacatcgagtaagataatccagagtgtgctggaagtagggatggggaaatgaagaatctgccgtttagatgtttactgattttattcagctggtatttattgatggcctaccatgcgccaggcttctgccagacttctgccagactgacctcgaaaaggtgaggaaggcatagtccttgctccgaagatctaggctaggaaagaagcacatataaggtatgggttgagcgtcctaatccaaaaatctgaaatgaaaaatgctccaaaatctgaacagt

SEQ ID NO: 31674 - DNA, 1028 bp, Homo sapiens
agtgttcagttttgtaaagaattttggctatcataatcctacaattcagccccacagccaccctgatgacactgaaatgcatcatgggctgcttttgttgctgtttggtattcaatctttttctcaatctattggaaacaaggccgaaatgaaagttcagttaacataaagtttaagagtctttcctttggatcccaacgttatttaattttttaatttttaaagctaaatttaaatgatttttccactcagattccacatgcttccagtacttggaagcatgagaagtatatatgttgagtttatgcccaagttcccaaatagataatctttgaaacctataacatttacaatattaaaaacaaaacaaaacaaaaacaacaacaacaagaaaccccaccatactgggatagagatatgctgaaacttacaaagtaaaactaaaattttgaaactgggttacttcatgatttgaagaacagtgtactttgtagaacaaaggaaaggattttcatagcaagtgggaatccaacagaaagggtagaagctggcattgacaatgtgtctgctagcacagctagcactgggctgcgtttcagagtaaataagcaaaggcctttgccctcaggagctcttggtttggtctacaggggagataaagccatgtgtaattatagtaggccatattaaatgccatgagaaaagtggtatgatcaaaggagaatggtcaggctgtatcattatccaaatttttcaaagatgcagaagtagatcagagagattctgtaacacgcctaaactcacgcagccagtctgtggccgaaccaagatcagaacctgcttctagctaactgctggctggcaggatgggaaattttttttttttttttgagatggagtctcgctctgtcgcccaggctggagtgcagtggcgcgatctccactcactgcaagctccgcctcccgggttcacaccattctcctgcctcagcctcctgagtagctgggactacaggtgcccaccacca

SEQ ID NO: 31675 - DNA, 1030 bp, Homo sapiens
actccatctcctttctctctgttctccacgctggtgctggagtgggcctttaaaatgggaactcagattctggccatgctctgttcggaagccctccaggagcttcccatctcatgcagagataagaactgtggctcttccatgacctgtaagtcacgctggcctcctcctgcctcggggcctttgcatgtgctttcccgcagcacagaatgaactttctttttttttttttttttgaggcgcagtctcgctctcacccaggctggagtgcagcggcacatctcggctcactgcaagctccgcctcccgggttcacgccactctcctgcctcagcctcccaagtagctgggactacaggcgcccactaccatgcctggctaattttttttgtatttttagtagagacggggtttcactgtgttagccaggatggtctcgatctcctgacctcgtgatccgcccgcctcggcctcccaaagtgttgggattacaggcgtgagccaccgcgcccggcccagaatgaactttctaatcctcggggattgtgtcctcccttcctgtcgtcactcagaggcaccttctcagagcagccttccttgtctcttgcccctacctgtgccttgcttgcactttcctgctttattttgatttctctcatttgtctttcacatacactagaatgtgcagctcacgaaaagagggagttttgtctcattttgttgactgtggaatctccagtgcctagcacagtgcctggcacctgggaggtgatcagtaaatatatgctgaatgaatgagtgctgtcacagcctctcctggccgtggtgttctgtggagactttgtcaggcgccttcaggcatggtcaggacttggcttcctttgcagggagcaatgctggatgccctcttcccccacagctgctcagcaggctctttctgccactccggagtcactcagcctcaggctgtggctggcagcacagtgtgaagttgctttggtgaagctgcaggtgtatgaaggcatgttgg

SEQ ID NO: 31676 - DNA, 1025 bp, Homo sapiens
ctcttttttttttgagatggagtctcactcagtccccaggctagagtgtagtgtcacgatactggctcactgcaacctccctccagctcccgggttcaagcgattctcttgtcatagcctcccgagtagctgggattacaggcacccaccatcatgcccggctaatttttgtatttttgtagagacggggtttcaccatgttgaccagggtggtcttgaactcctgacctcaggtgatccacccgcctcggcctcccaaagtgctgggattacaggcatgagccaccacgcccagtctacttttatctttataaatgaagataagccaataaacctaaaaaatacaaccaaaaactgacaaccaaaaactgttttctaaaatagatcaataaattaaacaaacctttggtgaattcattaagaaaaagaacaaaatgtataattatagaacatatatgaaacaagaaaagggatattactatgtatatagatgagaatactatacaaatatatgcacatgtaaccaaaaaatggaaaatgtagatgaaatagatgattctgtttgaatcagaaagaggttaaaaacctaaattggtcaataatcatggtaaaaatttaacaagtagtcagagatgtgaggcccatatggttttataggtgaattttaccaaatcctaaagaaacagatttccctatgttataagactattttatagtatagagcactttgtaattctttctgtgaggctaatataacatgatactaaagccaaataaaacacaaagttgtatgtatataaaatcaagtacatagatatgagagtacaaagttaaataaaattcaggctagcaattatattgaaagagtaacatatcccatgtcgaagtaagccatttgcatcacaagaatgcaaggatgtttcaataatagtaacttttgtaatgtaataaattatattactttaacagattaaaggaaaaattaatatatttatgacagaagtctaaaaaagtatttcatgaaa

SEQ ID NO: 31677 - DNA, 1064 bp, Homo sapiens
gatgggaaaaaaaatcatcgaacgtcatttatgtcgttggaaatgtacagtatgtgtcataatggaaaacagtcatgaaaattatgtttgcattgctgagaaagagcaaatactgggagaaaaaaaatgttcattagtgtagtttgagggatgggtgaaaggaacaatattggaagattattctacaacattttaaagtgattttcctgctcacccaacaatatatttatttttaaacgttcttgttcaaagttaagattacttgctaaacaatattgtaagaattactgtttcatgtaggaacagttctttttctaagcactaaaatattaataacaacaaaaaaatttaggttgacgttttatacattataagttctcgaagatgagctctttccagtttagtccttcctggattggcagacagcaagtgtatgttcttaaaatctgaggtctacctctctactggctgttagacttttatttttctaagcctcagttttctcattagtaacatggagcaacaatacctacctacaaagtgttgatgaggattaacgggctgtcgtgtgtactgagcttactgattagcttttgactcctggttgggactgccttgccctctctcctggcacattgttggcttctgatagggcttctcccagtcttctgtattaacatgtgtcttagtccatttacattgttgtaaaggaatacctgagactgggtgatttattaagaaaagaagtttaattggctcacggtgctgtaggctgtacaagcatggcatgagtgtctgcttggcttctggagaggcctcagagagcttttactcctggcagaaggtgacggagagcaggcatgtcacatgtgagaggaagggcaagaaagaggaagaggtgccaggctctgttaaacaaccagctcttgagtgaactagtagagtgagaactcactcatcaccgtgccattcatgagggatccacccccatgacccaaacacctcatactaggccttgcttccaacgttggggatcacattcttacatgagatctggaggagac

SEQ ID NO: 31678 - DNA, 1078 bp, Homo sapiens
gccagtaactgtgtgtgtgtttaaataacccagaaaagggaaactgggtaaaaagcattctggttttccagggctttcctcgagctttaaatcttttgctgttttagcttttatagtatgctgtaatttaaggaaacaacaataaaaatccagtcttattaaaaaacatgatgctagataaattgatgataggtggtgattatataatataccattatacaaaacatgacgttttaacataaagattcttattggacttaaaatatcaattaacctaccagtgggtttctcacacagctttccatgagtacgtggcgtgtgttaagctgcaccacctcactggtagtgatgctgtgttcatagagcagccgttgttctgaaaacctttcttttattgggcatgtttatacaggcatgttatgcatgcacataaacataagcaccaaataacatgggcatgaatattcacaatatcccttcttttagttcctacatcagctgcttcctgtagttggcaaagtttagcttagtagactaaatggagtttaacccttttctctctccctgaaccaagcccattctgtttcctcatgtgggaagaatttcatccttagaagaatgatttgcatttggttgaggactcattctgttaatgactaggattctaagagtcttttgaattctgtttaaattattttttccccttttattttttcctcttaggctccaaccaggaatggagacgccattggatgttttgtccagggcagcatctctggtgcatgctgatgacgaaaaacgtaagtgaggagtctattataaaatagcttaagtgctttaatgatcccttgtcttctgctccataacaaaattacatgcttctctacatggttttctggctatttgctgttaattttggtggttttccttagagataacagcttcacatcctcatttgtattttcaagaacatgtaagtcttttaactggcacttaactatggatactggtttgtttttttttttgtttttttttttttgagatgggatcatgctgtgttgcccaggctggtttcaaa

SEQ ID NO: 31679 - DNA, 1053 bp, Homo sapiens
gaggaatcggcacattgtcttccacagtggttgaactaatttacacccctgccagcagtgtataaatgttcctttttctccacaacctcaccagcttctgttgtttcttgacttaatgacaaccattctgactgctgtgagatggaatctcattgtgattttgatttgcattcctctaattatcagtcagtcatgttgagctttttttcctttgattgttggctgcatgtatgtcttcctttgaaaagtgtctgttcatgtcctttgcccactttgtaatggggctgtttgttttttttcttgtaaatttgtttaggttctttatagatgctggacataaagcctttgtcagatgcctagtttgcaaaattttctcccatttcctaggttgtctgttcactctgttcttcactgtcttgttcttttgctgcgcagaagctctttagtttaattagatcccatttaaaatttttgcttttgttgtaattgcttttggcatctttgtcaggaaatgtttgcccattcttatgtccagaatggtattgcctaagttgtcttccagggtttttatagctttgcaattaagtctttaatccatcttgacttaatttttgtatatggtatgaggaagggtccagtttcgatcttcagcatatggctaaccagttttcccagcaccatttattgaatagggagttctttccccattgcttgtttctgcctactttgtcaaagatcagatagttgtaggtgtgcagccttatttccgggttctctgttctgttccattggtctatgtgtctgtttttgtaccagcaccatgctgttttggttactgtagccctgtatttatagtttgaagtcgggtagcatgaggcctccagctttgttctttttgcttagtgttgccttggctattcgggctcttttggttccatatgaattttaaaatagtttttttctagttctgtgaagaatgtcattggtagtttaataggaatagccttgaatatataaattgctttaggcactatgaccattttaacagtattg

SEQ ID NO: 31680 - DNA, 1050 bp, Homo sapiens
gggaggagggggtgttattgaatcaagtggcttacctaccatatatgatgtttgtatgttacaaatactcccttagaaaaaagtagggaaaaaaggtaaaagaattcagattctgaagcctgatttataaaataatagttatatgttttataatactgttttttacaattagaagagaagaagctatgccttggaatactgcagcattctcctctttccttgctttctaatatttattttggagtttctcatagtgtgtcttttatgtgctatcttaattttgtcagaaattatctgtatttgacaaataaaaggcaacttatgccctgttttctagaataggtagaaaatgtgtcgatagtaccaaaagatttagagatggtagatatattttagacatatgagagtccttattaagggacttctagaccctttactttgtatagaaagtcaatcagaaacagtatgatgtttttaaaagatcatggtacgagtgtaaattggcataaccactctgaagagcaatttgacagtgctaagtatgcaccttagagcagtaattctcaaaatgtggtccctgggcattgcttaagaacttgttagaaatgtacatttttcagccctcaccgaggcctcctgaaacagaactctgggagttgcatccgataatacacattttaacgagttctccaggtgaagctaatgctagctaaagatgagaaccgctggcccagagaagctcttgccttgtgcactgagaagcacacacaaggaagctcatttcactgaagggtttgtgtgcagtaactcacttgatctttctagcagccttatgagcttgattctgttatttactccattttactgataaggaattatgcccatagtcacagagctagtaagagatggagttggcatttgaacacatctcttaactgcagtgcaatctttaaaagtaagaatctcagaacagactgaagctcttagtatttttttttttttttgagacagggtctcaactgtgtctttcaggctggagtgtagtgtcat

SEQ ID NO: 31681 - DNA, 1063 bp, Homo sapiens
taggcagaaggaaaaactgctgcaggggcaaatggaagaaaggaaaagaaatcgttatcaggttctttcagtgttttagtcggctggacatcggaattttctggggagcttttaagaaaatcctaatgctcggcttccgccgatggagattctgatttaattggtttgggatgaggcctgggcttcaggaatttaagaaacgtcccaggtgattctaatgcgcagccaagtttgttgagagtcacctctataaatgtaggagaaaatgcaaaatgatcttctgacttcaggaagttggcggactggttgtagggccagggcaggtgcagtgaaagtaactaacatcaaaagttagtgcgtgaccagtgtatttaccctcgctcagcacttttaacaacggtctgtttgagactaggcattgttacttttcagagttggctcagcacagcctcagtaagggtacagttttccttgtaatttgcagaattcagtgtgcaggttttaatggggccccctgcgtctggatacctgactgtagtctgtcttctgattaacatcctgcctgttcacttcctggtgaggccatctatgctgttgcttggatttcctctgtttcccacttacactactatttaatatttttctttaaattggcagcatatgagaaattataggttattataggctagttatttttcccgaatttaccttaacataattacacatttttaaaaaacatgtttattccatacctgcctcgccaccaaatctcaagtgtccccagtggtctgtagagtcacactctacagagcaggcgttagcctcctgatggccacctcttcattcttccatggaggttttcctttgaatagacctggaattccctgcaagaaaaggtccttccttcccattccctcacttttgattccttacattcaagtgaacaagttgtagattccaacacctacatctttctcacatcagtccccatccttagcgccttagctaatataatttcatttctcccctggaatcttgccatggcttcagatctaattccccc

SEQ ID NO: 31682 - DNA, 1042 bp, Homo sapiens
cctataatcccagcactttgggaggctgaggcaggtggatcacttgaggctaggagtttgagacttgcctggccaatgtggtgaaaccccatctctaaatttaaaaattagctgagtgtggtggcacgtacctataatcccagctactcaggaggctgaggcacgagaattgcttgaacctgggaggcagaggttgcagtgagctgagatcacgccactgcactccagccttggggacagagcaaggctgtgtctcaaaaaaataaataaataaaatggtctttctcaaaggtacataagtgggttcttcagaagtcactattagaagaggagaggggttgtttttatagaagagtaaatgaagaaaggtatttttaatgctgtgaggcgtgaaatttaacaattttgaatctgccaccctccacgagcctttccttgtgaaagaaagatggcattacaacccacgttttgcctcttgagcagtgagaggcatgatagttgtgttggattatgggacatggcctattttaggtacatgtctgaggtgtggaacacctttcagtggtggggtttttagcagccaaacattataccatgaaagcagacaccacagatttaaggaggtgtgaattcctgggcaccaacatcacaagttactttgtgtgtgttttgttttttaattttttgttcttttttaatttttttttcctcacaagtttgacttaaactgtatgacttctttacccagaagcgagccgacttcagttctcattttgaagtcactgagtggtaccgattctagtgaggaatttcttactacaacattgaacactcagtaagggatttgctattttgttaaccactcaagtttcagatggtgatttgagggcagaatacaggcagaaacgactgtaagctgtcaggccatccttggccctctggggagcactggagtgtggcctctgctcatcctgttagggtttcaagtacctgtattatgtggaaaggtcacaaggccagagacccagcacctagatgtgca

SEQ ID NO: 31683 - DNA, 1050 bp, Homo sapiens
tcactcgttactgcagggaggccaccgagccgtttgtgaggaatccatccccatgacccaaacacctgccacttaggtcccacctccaacactggggatcacatttcaacttgagatttggagtggacagatatccaaacaatatacccattagaggttacccaatacctcccacccacttgcagtctactttctgtttctatggattttgcctactttatagttcaatataaatggaatcatgtaagatataatatagtcaggtaacatataatgatgtttcggtcaatgaccacatataggaaggtggtcccacaagattataatactgtatttttactgtgccttttctatgtttggctatgtttagagacacaaatactcaccatgttacaaccagctacagtattcagtacactgagggccatacagttttgtagcctaagtgcaacacgttataccatttagccagggtgtgtagaaggctgtaccttcttggtttgtgtgaatacactttatgatgtgtgcatgatgacaagttggctaacaacacatttctcagaaggtatccctgccgttaagtgatgcttggctgtatataatacataagatatggtattgtgtgcctgggctcttagacctagcatagtattttcaaggttaatgtgtagcatgagtcactacttcattcctttctgtgtctgagtaacattccattgtatggatatgccacattattcattcatcatttatggacattgggttatcagaattactttagagtaaaactgatgcttgaagaagtgtcagcaatggtcaggcgccaggggcccatgcctgtaatccaagcattttggaggccaacatgggaggatcacttgagcccaggagtcaagaccagcttgggcaacagtgcaagaccctgtatctacccaaaaaaaaaaaaaaaaaaaaaaaggcggcatggtggcacatgcctgtggtcccggctactgggaggtgggaggatcacttgagcccaggaggttaaggctgcagtaagctattgac

SEQ ID NO: 31684 - DNA, 1740 bp, Homo sapiens
agtggcttttggccaggcacggtggctcatacctgtaatcccagcactttgggaggccgaggtgggaggcctcacaaggtcaggagatcgagaccatcctggctaacatggtgaaaccccgtctctactaaaaacacacacaaaaaattagccagacgtggtggcgggtgcctgtagtcccagctactcgggaggctgaggcaggagaatggcgtgaacctgggaggtggagcttgcagtgagcccagatcacaccactgcactccagcctgggtgactgagcgagactctgtctcaaaaaaaaaaaaaaaaaaaaaagtggcttttaaatttatagcactctaaagtggaatggatccctggatgtgtctaaagttatatcaagaggctggttttacagtgcttgacaatcagttgtcagtgttataggtagaatagcaattggagtcagactggggttttgatcctggctgcagcgttctttgttttttggctgtatgaccttgggcaagtgactaaacttctcagcttgttgtctgtgaagataaattatttacgtcagagggcagctgtgaggattaacagagataaaagtatacacagtgccaggattcagtattattagaattactttttaatggtattgaaggcagagaagcttaatttcaatatatatctctgaatttttactagggaccatcttaggtctcactgaaatgtggattcagagttcagcctcaatagttgctaaatggcctgcttccttacaccagcaaccagccccagtcattctgtatttgccaggccattcatatgtatgcactgatttcatccccacaggacaaggttttgacctgtcacacatgacctcacctctgtggcttgccagggttggtgtgaatagtttaaccaaggctatcgaaggcctaactgtagcgatagcagttaacctatgtaacttttttgagtcatttgaattatgtagagattggacctataatcccagcactttgggaggccaaggtgggaggattgcttaagccctggaggtcaaggctgcaatgtgccactgcactctagcctagacaacagagtgagaccctgtctcaaaaaaaaaaaaaaaattggaaatttgccgtatctgtgtaggtatgtgattctttggataaatgattcactgtatcttcctcaaaactaggttatttgaaagactgagatcattcaactgattgcactgactgccaactaattttgcaggagatgttgcagtaaagatcctaaaggttgtcgacccaaccccagagcaattccaggccttcaggaatgaggtggctgttctgcggtgagtagaaagctggcggtccagtccctctggagtgctggagtggggagtacaaggactgtagagttagtggactgtgccgcaggttgggacgggcaggcagttaggactcactgtggagtttctgtggttggatgctcctcccttgagagcaaagggatgtttcctttagtttatgtggttgtcaagcctttcgaagagcccctttttaggagaataccctcctctgggcacagtaaactcaatagcccaatttctgtctctgggttttggtttgaggtgggcagaaataggccctatttttacctttatttcccagaacccttttttttatagctgagttgccttattttagacttcagaacagtcagctttccaatctttcagtcactatttag

SEQ ID NO: 31685 - DNA, 1033 bp, Homo sapiens
tttctttataaagagataattcagaaaaataggtattaagaaattgaaattattgcttggacattctcttgaaaagttaaatacacgttaagctgggcctgatgaccaatacctgtaatttttttttctttttgaggtggagtcttgctctgtcgcccaggctggagtgcagtggcgcgatctcggctcaccgcaagctccgcctcccgggttcacgccattttcctgcctcagcctccggagtagctgggactacaggcgcccaccaccgcgcccggctaattttttgtatttttagtagagacggggtttcaccgtgttagccaggatggtaatacccgtaattttaacactgggaaactgaggcaagagggttgcttgaggccaagagttcaagaccagcctgggcacatagcgaaggcccatctctacaaaagatttttaaaaattagccaggcatggtggtgcggccctgtagtcctagctgttcgaaaggctgacgtgagaatattgcatgaccccaggggcttgaggctgcagtgagtcatgattgtgctactggactccagcctgggctggagcaagatcctgtctattaaaaaaagccaaaaaacaaaaaaacaaaaacaaacacatgttaggtattgataatgtttccatggatggaaacagtgatgttagatgctgtgtttttttgagacaaagatttttctttgtgtttactctaatgcattatatagactgggcactcagaaagtgcattattttatataaagaatgctatcctcgggagattgacttttctcattcactaatttttttttttattcagttaaatgtgtactaatccctgctgtttgatagattgtttaaagatgcagaagcatttctgcttcagggaagattcatggtttatcctattcctaatggtggtggcaagatagaggcatcccctcaaaggctaggagtaatacctcaaagcagcagagctgtccataattatccattatccattattccctccaccccgaaa

SEQ ID NO: 31686 - DNA, 1044 bp, Homo sapiens
tgggattacaggcgtgagccaccgtgccccgcagttgcttgctaaatcttttaactgctggtcccattttcctcatctatgaaatatttaatggaagtgtactattaaagaaacttttctttgctgatgaatgcaggaggtatcattaaaaacccacatagtgctattttcataattactctttatgtattgtgttcttgggttgaatacttttgttctagagttacaattatttgtgtttcttaccaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtatgtgaacattctacttaggaaatttagctatttatctgcctgtggagcacattaaggatcatgttcaacttaaagacaggcaaaatattcattgtcatttagggtctttatttttttttttctaactgcagatttatttttttatattgctgttccttccacaccccctattttttcctacctcttggccttccttctgttactcttgcctggaatgtcttcctttgtgccacttcatccaaacaaatagtacattcttatgggtatatttcaaagacttttctttgagaagtctctaggcctttccaactacttattttagaagacattttatttcttctattaaaatattcacctaaagctttttgactattacaatcaagtataaagaagaaagtaaagttacatagaaaagattatttttgtatatttcataggcccaggaccagtctggaggcagcttagaaatcatagaatcttctttttcagggcactgacaccagccacttagttctgcgtagtttattttttcagtgccagtgacaggttcatattggca

SEQ ID NO: 31687 - DNA, 1030 bp, Homo sapiens
ggatttttttcttttttcttttcctttcttttttttttttttaatttccagacagggtctccctctgttgcccaagctggagtgtggtggcacaacacaatcacagctcttggcagcctcgacctcctgagctcaagtgatcctcccacctcagcctatacctgggagtacaggcgttcgccactgtgttggaataatttttataattttttgtagagatgagggtcttactgtgttgtccaggctggtcttgaactcctgggttcaagtgatcctcctgcctcaccctcccaaagtgctggattacaggccattgtgggtttttttctctgtgtgttttggtctttatcatccatattcgagggtttcctaaaaagcctgatattcctttgcaacctctttatttttttaaaagataagattaaaaacaaattggaatctttgggtgcatggatgagatttgttgtctttgagctttattgtaaggtaagggaaactaaagattttagtttctttgagtttggttgccccactggggaaaaggggtttctgcagtcaaggattcagtaagtgtagtttgcagaacagtattcatactctcaactgggtctggaatcctccagtcaagagatcctctaatttaccttctccaggaatataagcctgggactacttttttttgttttttcctcttcacgtcagatgggtaatgtgtccatgtcattacaaggtttgaagaaggcacatctcacacatgagtgtgaaaactcaatcatgcttataaactacaaaaggatcagcctgggactgagttttagagagtttcaagaatttcagaagagtttcagagagctcttcgggaactaggttgttgaattctactttttgtcaaaggggtataaaaaatagaaaatagtctctttcttttaagttgctgatggaaagctgactaatgtggaattcttagaaagattatacccactgttgttggttgcctttatcaatctgtatctttaccttctctaaactt

SEQ ID NO: 31688 - DNA, 1049 bp, Homo sapiens
agcttgatccagcagcacatcaaaagcttatccaccgtgatcaagttggcttcatccctgggatgcaaggctggttcaacatatgcaaatcaataaacgtaatccatcatgttcctgtacattcttttgcattctacatgaccttatgtatgtttaaaaacacatttttacatttctttttttgtatttttaggccgtgttggccaggttggtctcgaactcctgacttcaggtgatccgcccatctcagcctcccaaagtgttgggattacaggcatgagccaccatgcccatttttacatttcttgagcaggagccctgtagtttaaaagtcccctttattttcagcagtgtacatttaagacaaatcggatgtgtgagtaggtagaaaatatttaccgtttactgtgacagaacagatgaacaagaatgtatttggttttatttgtaatataaaacaactgtgaagggaatgccaaacaatagtagtgaatcaaactttggaaatacctctgacgtagaattctatagtagctttaattgggtattattatcagctggtctgtttgggacttgtttgatgaactgttagatgactgactgccagccaatcattatcctggctgctccttagctgactgccagtcaacaattactccatgctgattctacagtttttccacagttgtcagtgttctagttctgagtatagtctcttggcataatgtggttcataaacgactgcactgataacttttgttagaactcaccacttgccagatagcccagatgccatatgttactcattcagtaaataactcttaagagcctgccaaatgctagatacttaaaggcagtgggttataagggtgaactgaacttagcttcttagagcatactacctagtggtataggcagtcaataatcattgagtaggcaaatacctaatattatttcaaatggtgataaattattatgaaaaccaaaaagctgagtaaagagaagaatgatggggaagggtaggatacacttgaaccagggtggtcagg

SEQ ID NO: 31689 - DNA, 1115 bp, Homo sapiens
tgcccaggctggagtgcagtggtgcgattttggctcactgcaacctctgccttccgggttcaagcgattctcctgcctcagcatccctagtagctgggattacaggcgcctgccaccacgcctaattttgtatttttagtagagatggggtttcactatgttggccaggctggttttgaactactgacctcaggtgatccacccaccccagcctctcaaagtgctgggattacaggtgtgagccactgcacccggcttctttttaatttttaaacaagtcactttttggcaaatatagtatggcccctatagttactcttttcttactttgatccttaacatgtttgcatacccaagagtgttgtgcctgctatataatctgtttcttagcctgatggtgctttgtgtagattgagatatgaggattatgggattagtgctcagaactctgcaagctctctggaaatacagtacacctttttgccttagccagcagaatgtttgtgagttctgtgctgaagcctgggggttgagtggtagatattgtgcttttatctgacatttgatttgttgcctgaggacagagatgcagtgttatgggtgggagttgtgtcttgccttaccagtgtttagactttttaaaagataatggatcttacttcttgaaagaataggagatgaaaaccaatgtcctcctgcttctgttcttctctttcttcatagctttccacttggcatatagcagaaaactctttggctatatttggtgcattttgttggtggaattcctcaagaatgcattcttgacttttttcttttttttttttctgagacagagtcttgctgtatcacccaggctggagtacagtgacgtgatcatggctctctgcagcctcaacctccctgttaaggcatcctctcccctcagcctcccaccccctggccctgccccaatagctgggactacaggcccatgccaccatacgcagctattttgtgtgtgtgtgtgtgtgtgtgtgtgtgtgtgtgtgtgtgtgtgtgtgtagagatggtgtctccctgtgttgtctggactgtctataaaacttgacattcaacagtctcttgtttttatt

SEQ ID NO: 31690 - DNA, 1521 bp, Homo sapiens
gaacagctggtacaaaggcttagagccatgtgggagttgggatgagtttggggagcagcaaattgcctggggtgcaggaaggaaatggtgagagatgagagtaaaataaaagttgctagaattgtgagggggctgtctttgttgtagatagtgaactagttgaatttggattattgtacatgggttgccgagtcttcattcttgctgataattttctccctttgttgatgttgaagctgatagtgattgaacatatttagtttaacttagttaatgacttttaaatttttttttattttttcagaacaatgcaaacttttttttttttttttttttttttttttttttttaaaggaacaggatctcactctgtcgcccaggctagagtgcagtggcatgatcatagctcggttgcagcctctaactcctgggcttaagcagttctcctgcctttgcctcctgagtagctgggactacagacaggtgccaccacacatggctaattaaaaaaaaaatagtagagatggagtctggcagtgttgcctaggctggtctcaaactcctgggctcaggcgatcctcctgcttccacctctccctcccaacgtgcttgctgggattacaggggtgagccactggccaggcagaactttttttttttttaaataatagagagggggtcacactatgttggccaggctggtcttgaactcttgggctcaagtgatcctccagcttcagcctcttaaagtgctgaaattacaggtgtgatccactgtgcctggctagcagaacatttttgataagtgttttatatcaaatgttttgacttacacagtggtgaatgaattgaactcatatattcctggggattcttgcaaaaaattctcttaaagttatacttgctcacaaaaatgttaactttataaatgtagaacactctcctactaatttttattttattattctattgttttttatttttttgcgacggagtctcactctgttgcccaggctggcgtgcaatgatgcgatctcggctcactgcaacctctgcctccttggttcaagcagttctcctgcctcaccctcctgagtagctgggtaggcacactccaccacgcccggctgatttttgtatttttagtagagatggggttttgtcgtgttggccaggctggtctcgaactcctgaccgcaagagatctgcccacctcggcctcccacggcctcgctgggattacaggcatgagccactgtgcctggcctaaattttaaatataagtaatgtactccccagtcttacagaaattggacgactatagaaaacaaacatcaaaaaaagtgtagaatgtgagtatttttagtttaataagtgtattttataaactatttatttgtattgacttctcggataacaacctgttataaaatctttatccccataaacataattttcctaaaatagctataatattgtgattaatgtttatgctaaagtgactattatggaattaacaga

SEQ ID NO: 31691 - DNA, 1023 bp, Homo sapiens
ggcctgccacttgtatttctttgtcctcaatactgaacactagacacatttgaaaccttcctcagaaggaaacaaaccaactggttatgcctgggtggtggcatggaagatgcccattgttgcccaatttgctaataagtattttgaaattagaaatgaaacatgaggtccaagcctgtccagttccctacccaacccattcctcctccctggaaaaaagaaacccgtatcatcttccaaatttctgattcatcactgccacttaaaaatgaaccgttttgaattttaaaatgtgaataactcaagtatcttttcttttgagatgcccggcctgagcactaacttcaggcattgctgaatgcagtgaagaaaccagagtggtgtctgctgcctcctgatcttttacagctgacagcacagcctatttctaaatactactagtttgtgaggcagagacaccctctgaaggaaccagacagactatggaggggtacagtgtgaagtcactggaaaacttcctcaccctatttctttggatgactgtcctgagttaaggaaggggcccaactgttggcagcctcacagcttgggctgggggcctttgagttgggtccctggagaaggcactgtaagccctgaccaggagcgacagggcccccagtgagatggtggaagggcaaaagtagagacctgcgatggtgggatggggaggcctcggacttgggtgggctcctttctcttaagcgagggcccaccttggtgctgaggggactagctgagctccattgagtctgtgctgggggctgaagcggaatccttctggatgctttcaaagagggcagcaagttcagggttggatctgatttgggaagagaagtcggccatgatggggcttttccccacctcggggatggtcagcagggcagccactgccctcattgcagagcgcttcagttcatcttgcttttcaaactcctgcttcacagaaccagctttgacctaaagtaggaaacagcagaagca

SEQ ID NO: 31692 - DNA, 2070 bp, Homo sapiens
tgatggctgcgaagagagcagaaggggtgctgctgtaggaaatcaatggctcggaagaccacactgaggaaggtgtgagttgatactggaagatctccaggtttgaggcatcttcagaggtatatggtggttttgtgtgtgttgagggtgtggtagcgcagcagctccctagggaattagaaggttttattgaacatttaccctgtgacaggcactgcaggcattcagcgcgcagtgtcatcttcattttacaggtgaggaaaagactcaggttcaagtagatggtcaaggccagtactaccggaaggaccatctgggggttcggacactggtggggtgggatttgctgccccttgcaaattgagagtgtcttggggtcagttttgatttgctcagctgttggcattctttgggctctgagtgggtgaggtgacccttgacctcctgggatcgcatctggagagtgcctagtattctgccagcttcggaaagggagggaaagcaagcctggcagaggcacccattccattcccagcttgctccgtagctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaaggtatgtggtcctgggatggaaatgggtgtggggtgaagaaaagagtttccaacagtttctgacatcacctagtcaggattatctttgaccgatgaactggcttgtggaagagctttctgtagaaatacaggtctcccccagtgtgccctagtgctggtacttatgtctcttgatgtgtgaagcgaaactttaatgaaaagggacatttggccgttttgatgtgttcagagggctttgcatttgtgtcctgtattttgggttgccttgtgacagcaggatccctattttatagacaagaaaactcaggtgctgagagcagtgtctgcagctgtgcttgccatctcagtatctacacagtcccctcgcatcccattggtgcctcctccattgcttgggagtggcaatggtgggggtgccttcatccctagtggctaaagccacgagctcctggtttttcccaccaaaaaagtaaggaaatagtgaagtcctgttaccaaaggcaactactgtgtggcatacttccttttcatttggtcctttttttccctccccaaaaggaagagttcgcactctgcacagacgctaacccacctgtgtattatttccttcagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaagtgagttgggtcccacctctagttttcagtgatcagaagtttgcatctgtgtgagcacttctggcaggaactctacaaactcttgggatgcattttggcggggggtgttgtacattctctgagggaatcagaagttgttccttgcaggattttagagaatgcttgttggggaattcaaggtgtttcctttgctgaaggaggtgacttggtcttctaagtgtagagacccaagaccaggaaaagactgctttgtgaacactgcaataatagccactttccactactacaatatcctttggctgttgtttccaaaatgttgctttctttatgaaggtgtcaagcaaaagagttgaactctgaaatattcgaagagatttattctgagccaaatatgagttgaccatggcccgtgacacagcccttgggagaccctaagaatatgtgtccaaggtgggcggggagcagcttggttttacatattttagggagacatgagacatcaatcaaatacacataaggcatacattggt

SEQ ID NO: 31693 - DNA, 1048 bp, Homo sapiens
aaaccccaaaacttgctgcattattgctcttttattgacaatgggcaaaaaaataagtagacctgatatggttgatgaaaatacgtaagtaaactttatataaatatataaatatataaatatatatatatatatactgtataggtagtacttgtgtgtgaaaggcaggcgtttcagtccacattagcaatacccaccttacaaggagctccacttacctaataggaagacagtaccttagctgggtgtgtgagacaatagaccaaaccctaaatgctaggaacaaattcagatacttcatattttcatacaaagaagtccctctaggactggctaaaatctttacacaatcattactaactgtgccaagtaacatagcatctaactgtttaaaaagtccagtattgctttgtataaatccttattttattaacagaatactatcataaatagtattataatgctgttatttcaggtaagcaaatagctaaactgcagtacactctacagtagcaactcaggacagctggttacaagctggttgtcttaggacattggttacacggattcttagacactttaatggctgcgataactgtgactctccatgatccatgtttcttttatgcgcatatgatttgacgcacactcattcagagtcctccgagaggggcacccatacacggcagaagtgttcatctccaacatgaaagtgaccagctctcatcctcgtctccccaacaccataacgtcctcatcccgcctccaacccacaccaggccgaagccctcagagagtgttttcatcaggaaccactctcgaacctgaaggttgactttagcgtttagcaacccagggcggtgtgtgtgtttcccgttttgttttctgagtggtagcagtgatcaccgtaattccatgtagccatgtgctagcagaacccctgtgtcctcaccgtggcccgtgtgaccccagccgacgagtgcccggcggagcccccgctgccttcccatggtccagtgagctgccagggcatcacatgactctcagc

SEQ ID NO: 31694 - DNA, 1044 bp, Homo sapiens
tggaagtccctggatgtggcacatccacatcagagggtggatgggggcaaaaaaagagcagcggcagaaggcgggacccggctgggcctggacctggtcactgcagcggtggcctggagggaccagacagcctgggtggagttagagcatgcacctatgtggggaagggaccagacagcctgggtggagttagagcatgcacctgtgtggggaagggaccaggcagcaggggtcggggagcctagcccggctcccccactcactgccgtggaggccagggagcataggcccagggacgccagaaggtctgatttttcagaagccagaaatccagattttttgtgcactcttccagtttttaaatactggcaacgaactagaattctttttgttaacagtgtgtgggccaaagaaaacccaactgtaggtgagccatggcgacccctcacctggaagctgagggagggagagaagggtgtgggctggtgctggcatggagcaggatggtgaggacccagaatctgctctggccttggctgtagaggcctggggcattggagcagttcttgtttggagacccccgaatcatagcgaggcatgtgatcttgtgaatagtgaaaccctggtccttccatcctgggtccctgggacaggtagggaccggggccactccattaccacttctgtgccaggaccaagctggctggtgtctgctccctgccacactcctggggacaagcttacgggtgtggccatcctgggataaaaatagcagggtcaccttgcagccaggaggcttcctttcacttgcacatggaaatgcggtgtctgcagggcactgctgtcagccaggaactgtgcaggttatggggcaggtggacaccggtttcatctccatcccccccaccccggggacagaagaatgctgacttctacctgctggggcaaggggtcaggcccggccccctaattagtggatgacctggccgattacaccctagcacaggttctaggtgtgccatgaggcaagggggcccaagccac

SEQ ID NO: 31695 - DNA, 1071 bp, Homo sapiens
caagttgctcccctttttgtcctttaaggagtagagttctgggcctggtgtgccccaacttcctaagggagtggtgcagatactgcctggggttgggggtcgtccactctcttgacagggaagcccccatcagccccttcctcacctggctgtcggtgctgccttgcaacttaggccggaccgacacagggcagagcaacctctgttcctttatccgtgatgcccagatccaaagtggaccacggtttatagtaagagatgtctgcaacagagccatttaaacagaaaggagaaaggttgggacttaatagaggcctttgaagagaattatatgcttactgtgggcctaataggactgcagctattcattttcattccatgcatattatctgaacgcccactatgcaccagacactgtgttgggtgcccatgaccaaggcgaggcccctgctcttgagctccactgtggcacaggagctggacaggagcaagttagcaatgcagaggcagttgacttccagaaagtaatgcaaactctagggattctaaacattggggaaagaaatagggcagctacgggaggcaatagcattgggtaaggctggttgggaagacctctctaaggaggcattagagctggctgtcccaggaagaggcaacagctgatgtaaaggctgccgagtgtgtgaaatggaaaggaaggcctggaagaggttccaaagaggtaagagggaggaggcgacatcaagggccactgagcatttgatggtccactgagcttcctggaaagctcagcaaaagtgggaatgggacagattgcatgggaatcaccagatgaaaaagtagggtgcccgattccacgaggagttttaagtctggataacacagagtccattttagtgaaaggagcccaagggctagtctcctgtgctcttctggcccctgacccactgtgccctccagtggctttctgtccctgaagcaggaaacttgagtgggtttcaggtactgtccctgtgtcatcaagaagtgacagttctgctttgctgaagggcattcttccgggttcct

SEQ ID NO: 31696 - DNA, 1050 bp, Homo sapiens
ctgaggggaacccctctcccccatgtttgccacgcagcccccatcagacgccctgtgctgccatccacatgccccagggcctctcccagccctgggctccacactgccattgatccacagccaccaaggccctcgggctctttcccatgcgagcccctgaagctgtgaggggggagggagatctgattccaggttctaggggctgccctctcatccccagcctgtctcctggaacctgcattctcatctccaaaacccactcaggttcctgggctctttgagtgagagagggtctcacagcagccgtggagggtgtggcctggcccctgcaggctgacggtactctttatgtttgggagcgaggcctgggctggggaggctggagccatcacctccctggggccggaaagactgcctttgacaggacaagggctgccttggctgtgtggccctgggttcacaggacacggagacctttctttctgtcccccacccgactacgcgctgatgagaaccagccatgtctgaggaccagaggtctctcctgaaataattaccctctaattaggcatggcattagctgttggtggggcttcctggaacactctcactgactccactgtgatgctgtgaaggggcggccttgcccccactgtgcaggtaggaaaccaaggctcagagaagttggggttccaactcaagtgttggactctagcccataatgttactgtcactcctgtcatgacaacattagggtggtagatgcctgacggagctgtacagagcattcgggaccagagggcaggggcagtgcgaaaaactgcatcttccttcatgtggttgggtggcctgagaagccccctgtacgctgactgctgcccgactcctcgtgccgtctgcccatctctccagcagctgctgacacatagggagatgctcaatgttggatcagtcagcaaagctctaaaaatagcctcccgctttgaaaagttcattgttcgagtcctatatttttctatatatataaaagccacttctggaggtctgggt

SEQ ID NO: 31697 - DNA, 1032 bp, Homo sapiens
agagcaaagaaaacatgggaagctgagaagaggaatgtggagatgggcagtgaaggggcactgggttcctgctcagcctcttgcctcggaacccaggtgctctaaactggcataaggggcactgggctcctgctcagcttcttgcctgggaacccaggtgctctaaactggctttaggggctgccctcctctgctgcaagctgggccacctcagcccccttccttcactgtccccctccaaatgaaagattcagaagggcacaagacaatgcccctgccttgatggcttcttgcagcttcctgactcccgtaggcctgccagctgcctggccctccaggagatggacttgtaggtgggtggcccaggacaggtggggttttgattgttccatatctgcttgctgtctcccaaccacgtctaggcattccacaggtgtgggcgctgggcactgtatctgccttcatggagcccaaggacagataataaacaagtaaacatacaaatggaggactgcaagccatgagcgctcatagtaggaagagcctgggagaggaggaaagagtgagggaagccgtctcttagttggcccagttaagctgagcctcagtttactcattggtaaaatgaggccaggggtaactccacctacttcacaatgttgccttgaaggccaactatcactaaagaactctaaagtgctaattagtattactttaagcttgtcataggtgcttgaagggtgtctctgggtggagaaagggtagggggctgggtgggcttagggagaaagaagcaactttccattagatcttcccccaaaaagccgccaaaagggtggtaccaacctcaggatagggcccattcccttctctggggcgcatcagagccccagaaccacacggttcggtccaggcaggcaaaggccaggttttataaactgaaggcaaaatcgggataggcagatgttgagtaggcatcagcggagtaggctctggttgggggtttggcgctgtgcatttgttgtggttaca

SEQ ID NO: 31698 - DNA, 1047 bp, Homo sapiens
ggagtgcattggcgcaatctcagctcacagcaacctgcacttcccgggttcaagcaattctcctgccgcagcctccccagtagctgggattacaggctcctaccaccacgcctggctaattttttgtatttttagtagagatggggttttgccatgttagccaagctagtctcaaactcctgacctcaagtgatccacctgcctcggcctcccaaagtgctgggattacaggcgtgagccaccgcgcccagctgtccttttaaataaatagtatttcattgtatcgacaggccacagcttatgtatgcagtctactgtgatggaccacatgggttgttttcagtttggggctgttgctcttgaacctgtgtcccagcacacatggcatgagctgtctctggggcacatactggctgtaaagcaagcatacagccttgccccaaccccacactgggcattgtcggtctttgtcgttttcactcacctggtgggtgggtaatggtttcttgctgtggtttgaatttgcatctccccgatgaggttggggatcttttgtttgtccattggctgtttggatttcatcattggtggagtgcctgttcatgcctttcacccatcttgggctgtctttttatttctttacgatttggaggcttctttgggtgctacagattctaatccttcgtcagttatccacattgtagacctcttctccctccctcctgcctgcctttttcactctttacagggtgttgggataaacttctcaatttcagaattcttaattcaagtagtcaactttctcactttattaacatttttcgtgttttgagaaactcattcctaccctgtaatcatgaagattctcgttattcacctttcacattaggtctttaatccacctggaatagattttcatctacggtctctctctctctctctgacacatgcacatgtgtgcacatgcacggccccaggtgcacacatatacccattcccaggtggcccggcaccatttggtgagaaccgtgttcttttccctacctg

SEQ ID NO: 31699 - DNA, 1066 bp, Homo sapiens
tagtagagacggtgttttgccatgttgcctaggctgatcttgaactcctagcctcaagtgatccacctgccttggcctcccaaagtgctggaattacaggtatgagccactgtgcctggccgtagagctgccacattctttttgatggctgcataggcttccatcatatggatgtgtcttaattataatctgtttaacaaatccctcactggtggactttaaggaacaagaatacttcaataatttttattcactttaaaaacatttatagtaatgtgcattatgacatttcggtcaatgacacaccacatatatgatggtggtcccataagatgataataccatatttttaccgtaccttttctatgttatgtttagatacacaaatatctactacctggtcaaattaattggacatttttattttgagttgttcatgtttttttcttattgatttggaataactgtatatggaggaaaccaagggaataattgtgattaagtgcctgcagtgttcagtacagtcatatgctgaacaggtttgtagcctaggaggactaggccataccatatagcctaggtgtgtagtaggctgtgccatctaggttgtgtaagaacactctatgaggtttcacaatgatgaaatcacctaaggacacatttctcagaatgtatccccatcattaagcactgcaaacctgattgtttaaatataaagacatgtcaagaagagacttcaattggcccatcagcttgtgcccagataacccctgttgaccttttaaaaatcaattattacaaaaaagtataaaatgaaaagtaaaagcgcctcacatatccattccatgcacccctcagtcctcccaaaaggtatccatcaataagagtttttttgtttcggcatatttgtgtcctttgggaaaattaggaaattcccacacacatctacatagagccttttaacttgtacacaaaaggatcatgatatacagtcttctgttccttgaatttttcagtagaaatatgacctggagatctgtccatcctaggacaaagtcccagtaat

SEQ ID NO: 31700 - DNA, 1030 bp, Homo sapiens
tctgcaggagggccagtgggcgttcctcttgggacagagtgctcaccacctcccagcctgggccatgcctaggcagctctgacgcgaggacatttgttcccacttggaactggcaccatccttcctgcggtgctcgctgccacccacccacacactgaagtggcctggccctgtcctctgagcctcacaacccatctgctccccagctctggacagcctgcagagaccaggactccctgaggctgaggaaggggtcaccagcctcctccccacccacgccttctggacacaccctggctcgtgctgtctatctccgggaagagcccagagctgagtttgggatgggcaggaggtcctgggcagagcagagcagagccgccacttctctggctctgggcactgcctggagcacacataaattcccttatggctgctttcccctttcacccgtgggcctcaccattgcctcagccctgccagcctcacctccctctcctcggttcccatctctgctagtgactgccgccccctctccctgcatcgagtcttcgttcaggggatgaagacctactctgtgcctgacactgtgccaggtgctaactatccattcccacatccagccagctagcgcccaccctgtgaggagcactgtcccacagcacagaggaggacctgagtccaaggctttgcgttactggtttcctcaccggagttgtgggtgaggctcttcttggcaagcaccacagggcagcacttgtcgccgagagctcagagcccagcagcaaggcggcatgggcatgagccactctgacacatgggaagaggctttcttccgctgatcagcaagtagtttgctgagcacctattgtttgctgccccgggctagaccctggggatacagcagtgagtgaggtggacactcaggcctcctggagcagatagatgttcaggtgagagagaaatgataaagagaaaataaacaaatgaagatgccttcaggcaaagatcggtgccaagaaaataaaacagg

SEQ ID NO: 31701 - DNA, 1067 bp, Homo sapiens
cctccctctctctgagctcgcctctcccatcccaggccagcctctggacgcagggccagcccctgggctccggcagctgagcttttcctcaccggcggacgcccctcacccatcccgccctgagtgactcactgctcccctggcctgcagccactgctgtctcctggcaggaggcaggcgcaaggttgtgcagaagccacagggtctagtgtgtgagggccgcttggccaggagggtctggagcagctagacaggaccagggcacagaggctggccggtggatagtggggcctgtggctcagccctgcagtggcctgtggcagccagtgcctcctcttttccctaactttgggggcttttctttcttcttcctaccatgaagaaggaagggacctgaaaatccgtgaagagagccgttccctggccaggaggagactctgggtggtggggcagtggtggtgggccccttggccactcgctcctccaccgagccaggcatgaaggggtatggcagtgccgtgtggagccttatgtggaagtactgcatctctgtgaggacactcaggtaccgggacgcgtgcatggctgctctgcctggctgtcgactgttgggccggatggtttgcatggctgtacagggtccaggaaggagctgggatggagggagctggagcaactttcagtctctggtggagcgggaggaggagagtggaacaatgaccagggggtgtgctgcgattggctgggatccagagcacacgttcggctgggatccagagcacacgttcaggaaaggaacgccaggggcaggtgcagcatgtgttacataacatgctggcacagggcacagctgtgtgaccctggccctgccccacagcatctctgagcctgttacccaccagcgaaatggggctcacacgcgtcccttcagcgcttggtgtagtgattccttcgtgtgaccgtaaacgtcagtcactgagtggctgagggctcagcccggactcagacaccaggctgcccaggtttaatgctggctttggcattgttagtggtgtgaagcggcttca

SEQ ID NO: 31702 - DNA, 1052 bp, Homo sapiens
atctctcctctcccacccacacttctcccaaaacacctgttctctgcatccccactctcatgcctcagtgcaggcctccacctcttccctccagactcaccatcccaacctctcctctggtatcccagcctctaatctctccccactaatccttcccccatgaggggatctatttaatcacaaacctcaccatgtccctcctctactcagaaacctcctggaatgccattacccgcataatgaagcccaaacccctggcaggttgtctcatgactttctgctgcttttcacctccaagcctctgcacatgttgttccatctgcaagcaatacctttccatgcactgtctgcctaacaagcttctggccacccttcaagactctgtttcaacatcttgtcctccaggaaacttctgtttttccttgctatatctctttttctcaaaaaccttgcccctccttccctcatcttacatagtattatttgatctacatttccatcgaaacagtcagttctaccatattataactgtgatcatgttcgctcagtattgtgactattacaaggtacttgcattagaacgtttggttctgtgtgacagtgagcccgcttcaaactggctcatgtaaaatggacatatgggcggcataacctccaggtttcaggtgtggctggcccagggctccggtgatgagaacctgcagcctctcatgcaggctcctccccatgggggccccagtaaagaaggggcctctatctctcaggggtaagctcaggtccaaggtgggatgttctctgtctccacgacactggcaaacctctgggcctgcctctcacagccctgcttgagtcatgccctggtcctggctcccccagagtcccagagattaaagaagcggcaaccagaaggaggcaagtggctgggcaggaaatttgctgggtgtccaccaccgcccaaggcatgctgctcccttcctccaggcaggaaatggggccttggctcaccttgtttcccatgcctggcctgggtctgacccaaagcaagcattggt

SEQ ID NO: 31703 - DNA, 2033 bp, Homo sapiens
ctcccaaagtgctgggattataggcgtgagccaccacgcccagctggaaccaagaacaaatttggatttttgacttgaagaactgggaggacagcagtgctttttactgagatagagcagatgaggaagagagacttgagaggaaaaaacaagtgccctttgagactcatgaagtttcatgtctcagagagctccatggtttctacagctattatttgaaaatagtgtattaatatttctaaacattcatttaaagcaatatgatatttattctttactgttttcccattgatagatcattaaagttgctttcaatttcagtaatgctgcagtgaacatttggcatgtaaatccttgtcagcctccctgattattttcttcattatgttcccagaagtagaattactaggtcaaaggctaaaaagatttcacagtttcttaatccatattgccgcatacgttttccaagagaagcatctaagatgcagcctccctgcatcctctccactctgactattgcaattgttctgatccttgctaattagatatttgggaaatattattttactttcaaatctgatgcagtatctgtggggagtctgacttatgaggaatagaactctctctttttttgtttttgtttttgttgttgttgttttgtttttttgagatggagtttcgcttctgtcacccagcctggagtacagtgactcgatcttgggtcgctgcaacctccgctttctgggttcaagtgattctcctgcctcagcctcccaagcagctgggattacaggcacctgccaccatacccagctaatttttctatttttagtagagacagggtttcaccatgttggtcaggctggtcttgaactcctgacctcaggtgatcctcccgcctcggcctcccaaagtgctgggattacaggcatgagccactgtgtccggctgaagagaactctttctagtgatgtagacatgatggtacttcctccctccaacatgaccttgtgggtagaattcagatgttcaggccaccgagcctgcccctgtttcgacccttgtcctttggtgtggggcctccccgaccccatcgtgctcccattctgaactttgctactgttcccctacttccctgacctgtcacctttgcatgccagagagactcagggctaggaatggacatccaccaaccattttccagcaaatctaataaacagcccctgttgggccatgattttcagctggtccctgaatgatgaatcactcagggaccagcacacacaatgcaatctgtctgactgacactctgctacaacatgcactagggttgggagtgactgggggcagaaggggctgtgacaggggctcccgatagcatcgtccacctctctcttagagaagcccaatacctgacgttaggtgggcatgtggctgctgagacatagaatttcccagcctcctttgcaacgaggttgctggtacaaccaagctgtccttccagcgtgggaagggaagtgatttgtgtcgacttctgagatatttcctcacagagacccttctttctgaccctgtgcctgtcctgctgctggggacttcatctctgaggctgcagctccatcctggcccaggaggatgagggcagcccccctgggatgacagggccatgagggagaagagctccctggccctgccccaccaggccagccctggaccatctgctttcacactgaaatgccagagacacaaatttctatttaccactctcaggtggggctctttgtctcagcagctgagccctgtcttacgcagtacagcagtcttggagggcactttcccacgtacttgcctggggtcaggctgtgccagggaccacaactgtgtgattttcagccctcccgccgtgggtgagagccacactcagctcccacccactgtcctctccaggtgcttgtgaggagatcgaatgcatgaaggtggagactcccactaaaaacatcaggagccaatatcttccagggcaccccttgttc

SEQ ID NO: 31704 - DNA, 1012 bp, Homo sapiens
ctactaatggggaattagactaaatcccaaaatacatttggtaagccttgtctaaacatctgcttctattgcaaccaaatcttaaaggtacttagaaggtggtgacacaatgtgtatgtgtgcatctgacccaggtccagtgtttgggacagtgaggactttgaaaccagggtctaagctgaatgaccttggtcaaatgactcaaattccctgagcctcagtgtccttatctcaaatggaaatgaaaacatcaagagttttcttgatcttgtccacatctgactctccattctctcctccatcactgtggtcatcacactctggccttctggtacctccattcttccaagctcattagtgtcccagggcctttgcctgtgctgttccctcagcctagaacatgctcccccaggtctcacccaagatgagttctcctcagtccaatcccccttcagatgtcagctcctcttcccttatcatctcacctgaagtaacctagccaatctctgcacatcagccagtttacttctgtcccttatctgcctgtccccactggaatgtcagcaggaactttgtcttatgcagtgctgtgcctcagtgctctgccatgtgccctggcacagcatgctattttggtctctgtacttgccacttcccacatccaaggggagcacctctggaaggaggccagagctaaatgtgctaagcttgtctgtccacatgcctgaatgctcccacttctgtccctccatcatgcacttctttctctttcctaattgcctatctaggacttccaatactatgttgagcccaaatgacaaaaatgacatccttgtcttgttcctgatcttagctaaaaagctttcagtctttcactgctgagtatgatgttagctgtggattttttgtatatggtcttcattatgttgaggtagtttctttccattcctattttgtttagtgtttttattttatttattttatttttaatttttatttttttgggacggag

SEQ ID NO: 31705 - DNA, 1050 bp, Homo sapiens
gaataaacaagtagacaaaggaacaagacagcttcggagagcattaggtacagaaggggcaataggacaggtgtgaccagggagggcaggggaggttgcaaagacttctcagaggaggcagcctctgagtggagacctgacggaatagtgggtgctggccttctaaacagcctggggaagaacgaggtgacaactcccattgacagatgaggtgtcttaggtcaagccacttgcgtaaggtcaggccgcaggtcacagcaggaccaggatttgttcctagtttccctgcccaaaagccactcacagaacctttacaactgccccagtctgcgtgggtgggagtgggaaaccctcagatcccccgaatctgaaacccctggcatctgtggtctccgactcttgctctctggttttccctgcttgtctgtttgtctgtgtggaggtaggaactgctttagacccatggccctactcgggaactggagctttaccaaggaaggtccatctatctgcctcactccttttccccatcctgtcccctgacgccccacacccagacactcccgaactagcgtctgtgtttatcgctcccttgctttttcacttcaattcccaactggccatggctggcagatagaaaacgatggaattgtgttcactcagcttgcatcctgtgacctcgctaagcacacttaacagttccagcagcttttctggagatccttagggatgtttactgagagaatcctgtcgcttgtgcatggagacagttctggttcttcttttccaatctgtatggcttttattccttggccttgctctagtacacttgttaggacctgtggggtgacgttagataggggtgggaaaatgcaggtcctggcccggttctcgatcttaggggaaaacacccattctttctccataaaggtagctggaagtctgtgcagatccctttatcaggctgaggacatttccttctattcctgatgggcagagaattctcatcatgaatcagtgttgaatactgtcaaggctttttctgcatct

SEQ ID NO: 31706 - DNA, 1032 bp, Homo sapiens
tcagcacaaaggcaggagggaaggctggtcagtgtatggggaccacacaaggctggccggaccacgtggccgggtggcagggatggttggtttagatgcgatggtgagagagagcctcccgggagagctggcgatggcgtggccggctgatggcagggataagcccctgcaggaatctgaggggcgaaggagccctgggtgcagaggctctggggtggggacaagtgaggagcctcagggaggccagggcagaggctggggcaggagacagacccagatgatgccaaatcctcttgactgggctgcgaatgggaactggcgtggagtacgaagggaacccactggcacgttggcagtgggtggtgacattgccagagtgctctggcgggttgtgtcatggggagagttagaatggcagcagggggtctgggggtggccagagggaagccgtcccagggacctggcagagaagacggggcttgggtcagggaggtggccgtggagggggagaagtaggcagattggcgatgggtgttggagcggaagctgttaggacctgccgacatggctggatgttgtgggagggaaacaagccaggaggaatctggtgggaaggtttgagcggaggtggggaaggtcagggtcaagagcttggtctgggtgtgttcagccagagacgcttgttagacatcaggtgacaaggataggtgggtggtgagggcacaagttgggtggtcccacgatgcagtagtagaaattgtcagggccagcaactcccaacagccctgcccaggtctacgaagctcagatgctgtcctggctaatatgctagagatgggaaatgaccagtccaggtgtggctaaccaggaggcgggaggtgccgggagctggggatcaggttgtgactggccctgacctgaggctgcttcggggcccaccttctccctcctactcacccacccaggacctcaggtacacggaatgcagccatcataactcttggttcatgcctccctcccatcattggtcca

SEQ ID NO: 31707 - DNA, 1112 bp, Homo sapiens
ggactctgctgggtgtgcggagaagcttttccagtccttgggggtggaggctgtgcctggaggtgaggaagcagagacctgggggtctccctgagatctggagggtctccatcctcgtgggagggtttgggcctttgggatcccttctaaacctgagtttgtatatttccatgatttcctcccagagctcaggcctctaactgggaaaaagccaattatgcaggaagcgttgacttttccatgaagatctgacatgctggggcattattgaaggagtgtggagaatcaggcacagcagctgccacgtgcccacttactgggttgatgaggcaaatttttaaccatttttttttttttttggtagagatggggtctcactatgctgcctaggctggtcttgaactcctgacctcaagcaatcctcctgccttggcctcccaaaatcactgggattacaccttgcccagcctggggggtcaagaatttttattttgttcccggatgtgtcctcagtgcttagaacaattcctggcatacagtatgtgctcagtaattatttgttgagtgaatgaacaatgatctgaggtggatattattattatcatttaaaaatgagtaaactgaggtacagagagattaggtaactaacacagggccaggcaagtactaaatggcaaacttgggattcaaatccaggcagacactggtttcagaatctgtgttcttagtccctaagctatattgtcactttaattaaaatttgatgaattggctgggcgcggttgctcacgcctgtaatcccagcactttgggaggccgaggcgggtggatcacctgaggtcgggagttcgagaccagcttggccaacatggtgaaaccctgtctctactaaaaacaaaaattagccaggcgtggtggtgggtgcctgtaatccgagctactcgggaggctaaggcaggagaattgacttgaacccaggaggcggaggttgcagtgagcagagatggcacaattgcactccagcctgggagacagagtgggactccttctcaaaaaaagaaaaaaaaaaattgatgaattaacaaatcaaatagcctttctagctgcttctt

SEQ ID NO: 31708 - DNA, 1023 bp, Homo sapiens
gctcagtgaccccgttctgggggactcttgctcaggcgtcatcccatccacacagaaagggctcttccatggccacggttttcagaccctttacatttgtaaattgttggcagcagaatcctatttctgaaagaaacctctatggaagcagctatggaaatcagaggaaagtggagaggttctgggaggcggagggagaccttccagtgcagccctgccttgggatccgtgtccagcagagcacagtcacatcccctccacaccaggaagcccctcctcgggcaggtgttgtgagccaggtgtggggccacccagtgcgcccgggccgggccctcggcctcagacaagcagagcagccttcaaaacctggctggaggggggcattttgttgtttccccaaaaacaccccttcccaaagtaccctgggtgggggtggggcatcatcagctgcatggggtgaccagaggcctcaagtgcagacagccagctggaggctgatggcagcgtagatgatgcgtagactgatggcagcgagcccacccttccctctgtgtcccagccctagcacaggggcccgggtggagctggcgccttctcacgtctgtggacccagctggctgctatctccacctctgcagggggtgtcacaggcagagaaggtggaggggatggttggctcagtgagagggggtctgtgactccgaagcacctgaggatggggtgaaggcccttgacaggtagtgagcctctcgtcactgcaccatgtgttagcaggacaagtttggagcacccttaggaccatctggaaccaccgtgtccccactaacgaaagcagggcagaggacctggcccatggaaacatcacatgcgcagaaaagatggccagtttcatgtcgaaaactggaagatctggggttgtcagaacagtttccagtccagcacagcctggctgtgtgcttcaccccagttggccttaagtatgtgaaggatgcagccttgggggacctgtgagggggctgacat

SEQ ID NO: 31709 - DNA, 1097 bp, Homo sapiens
agatcgagaccatcctggctaacacggtgaaaccccatctctactaaaaatacaaaaaaattagccgggcgtgctggcgggtgcctgtagtcccagctactcaggaggctaaggcaggagaatggcaagaacctaggaggcagagcttgcagtgagccgagatcgcgccactgcactccagcctgggtgacagagcaagactccgtctcaaaaaaaaaaaaaaaaaaaaaagaaattccttcccccaaaggaagtttccttcttttctataattgcgcatcaaagtcccaccctttgagaggtagagctgagacccaacaaggaattccagtgatgagagacagactctgcccacagtctgagtcaggaggtagagcctctcataagaggggaattgaagtcaggagcacggactggggcgagagtgtctgggtccaatccagctctgcactgattaattctgtgacattaggcaagtgacttaacctgtctgtgcagctacgtgacctcgggcaagttactcaatctctctgtgcagctgtgtgacctctggcaggtgacttagcctctctgtgcagctctgtgacctcaggcaagttactcaacctctctgcactccagtttcctcatctataacatggatataataaaaatagcctggtctgtacgacgtgattagtaactgtcagccacaccaggtgctatcccaagatttatacttacagcactttatttaaccttcacatgacctgtaagggggctacttttattctgagagtcacaaagggtactgagggagcaggactgcatgagtggtttggagctgccaggaatggcctcctggagaaggggatggtgtggacaggccttggagtggggagaggaccagagccaaggaaggggttggcattccacgttctctcaggggagactgggagtaggttttgagggtgagcccgattggaaaccagagggactctagttttcccaggacctgggcacaggtgggagtcaggtgggaggtggggatgaggccaggaagtccagagctcggggatcctcaagcaccagctgagagattccttctttgttgagag

SEQ ID NO: 31710 - DNA, 1096 bp, Homo sapiens
caggggaaagatgataggtcttgggccagggaaggggatggaggtggcagagcccagacttgggggccgttgtgaggcaacacctgccagaatcccagatggagtgggtgatgctgtggaatcctggggttccctaggttcctggaggttactggtgccagcccctgtggggtggggaggggggcgagggtgcgattcgcagcgtgagaggctgctttttcccagctggttgtgctcctcactggctgcattccattatcttctctgggttctagatttatttttatttttacttatttatttatttaatctttattttcaggatctcatgctgttgcccaggctggattgcagtggcacaatcatagctcactgcagcctcgatttcctgcgctcaagtgatcctcccacctcagcctcctgagtggctgggactacaggcacataccaccatgtccggctaatttttttaaaataattttctagagatgggatctcactatgttgcccaggctggtctggaactcctaggctccagtgatcctcccatctcggccttccaaagtgggaggattacaagtgtgagccatcacacctggccctgagttctagattttttaaaaggttttttgttgttgttgttgctgtttgttaatagtctttacttttagagcactttaggtttacagaaaaattgagcagtaagtacagtgagttcccatgctcctgccgtccctgttccctccattattatcttgcattagtgtggcacatctgccgcaatggatgaacccactttgacacatcattattacccatagttcatggttcaccacgggcttgttctgccattgtggcatcacacagagcagtgtttctgcccccgccccccgcaaaatcctctgtgctctgcctgttcatccctctctccctccaggtcaccttctttcacttagtcatatgcattgaagcttcctccatggctttttatggttgatagcacatttctttttagcactgaataatattccattgtctggatgtagcacagtttatccattcacctgctgagggacatcttggttgtgtctaagtt

SEQ ID NO: 31711 - DNA, 1034 bp, Homo sapiens
tagaaaaaatgtctcataattttttttataagaaaaaagttttgggcccagtgcggtggctcacgcctgtaatcccagcactctgggaggccgaggtgggtggatcacgaggtcaggagagcaagaccatcctggctagcacagtgaaaccctgtctttactaaaaatacaaaaacttagccaggcatggtggtgggtgcctgtagtaccagctacgcgggaggctgaggcatgagaatggcatgaatccaggaggctgagcttgcagtgagccgagatcgcgccaccacgctccagcctgggcgacagagcgagactcaatctcaaaaaaaaaaaaaaaaaaaaaaaaaaaaagttttggccgggcgcagtggctcacaccgtaatcccagcacttttggaggctgaggtgggcaggtcatctgtggtcaggagttcgagaccagcttggccaacttggtgagaccctgtctctactaaacacaaaaattagctgggcgtgctggcatgcgcctgtaatcccagctacttgggaggctgagacaggagaatcgattgaacccgggaggtggaggttgcagtgagtccagtgagactccatctaaaaaaaaaagaaagaaaaaaaaggaaaagaaaaaacttttaacagaaaagtacaacaaataatttaacaaacccccatgcctactactcaatgtaggctcttgttagcatgatctcataggcttccaaggtgtgttttgttttgttttgtttttcaaaaaatagacagaaaaaaactactattataacttgtctcatttaacctctacgttctagcccttcgtcttttttttttttttcttgagatggagttttgctcttgttgcccaggctggagtgcaatggcacgatctcaactcgctgcaacctccgcctcccagattcaagcaattctcctgcctcagcctctcgagtaattgggattacaggtgcccgcgaccacgcctggctaattttgtatttttttagtagagacggtgttctccatgttg

SEQ ID NO: 31712 - DNA, 1058 bp, Homo sapiens
gacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaagagggtgtgatcgttgctgagatttctgtctgatggtgatgatttcttccctttacccatctatgatactctggggcctggcagagctggaggtctgagctttattctccccaaagggtgagcatcattttcaagcacattcaggttggcaaatgcaagtgcatctggacgcagccagatcttgccagcaagtgagtgtgcccaagaaggcacattgacaaaaccaggtgatgccacacagttcagctttctgctcccaagctaaccaagcaactctctgtctctaatggttgccagaaaaggcttttagcaccatttagcactaaaaatatagtacatcatatagattgttttttctctagaattcttaagtctggccaaaagtgaactctcgttctctgtttctctgtgtgtctttgtgcatgcttacatgtgcattcctgcatcctggaaatgtttttttgttttgttttgttttgtttttg

SEQ ID NO: 31713 - DNA, 1026 bp, Homo sapiens
ggtgctaggggccacagccctgtagagggcgggtgcagcagggtaggagagctgatggctccaggtggctggagtcaggagcatgaccggcactggggcaggcagcgtggctgtctcctgaggctgctgagtgagcccccatgggggtagcggcagccagcgaggaagctggcctgtcatccaggtgagctgggctttgactggagtgtccagctatggaaagggggctgacacctgtgcttcctctccaggcctctcaggaacctggagctcctcggccaacagcatcctccacatcgaccccaagacgggtgtggctgtggcccgggccgtgggatccgtgacggtttactatgaggtcgctgggcacctgaggacctacaaggaggtgggctctaagcagccggaggcacatgtggctcagtggcctgtgaggcgggcctgaccttctgggaggattatgaagacttttccttttagggaaaagccgtctgaggggttgggtctgggagtcatgagtctgggactggccacttgctgactctgacatggggacaagctcccttttttttccaggcttcagtctccccatgttcaagagggtgtgatgaggacaggcagccttgtagggtggattccagctcccatgggcttgggtctggcaaccccggagtgggcacttcctgggagccggtgcttccctgtcacctgcaaggctaagactccctgtgcaagtcaccctttgagtctggaggcgacaaaacctgctgtctcttccattcatctccagttgagaatgaatcagtggggcaagtctggctgagatccaaatgcatctcatttttagaggcagcatgtgctttatggaacctagcagtttaacctaattgtttgcatatttagtgctgcggctctgcagtttgggcgagccagttgcagacagaggcatcctgtgacaatacagctgtgctctcctggaaagagcctctggtcaggggatggggtggcatggacaaaggtgtgtag

SEQ ID NO: 31714 - DNA, 1038 bp, Homo sapiens
gggcgagactccatctcaaaaaaaaaaaaaaaaaaagaatttctattttttttcctgtaacttttcccctttattgatattcgctgtttgatatgagattgttatcaaatcttcctttactcccttcatcgttgtttggttggaaggctttgcctggtgaatctgatctctggtggccctcacagacagtttctgtcatctgccttttttctggagtacgggtcatgttttcctgttttgttttgttttttgttttgttttgttttgttttgttttgttttgttttgttttttcatgtcctataattgttggaaactggacattttaggtaatgtattgtagaaactctgggtactgattccccatccccatgctggagcttgttattattatttgcttgtttacttctttagtgactggccttgttattttgctgaagacacaaaaacacacgcgcacacacacacaaacacacaggctgtgttattttgctgaacacacacacacacaggctgtgttattttgctgaacacacacgcacccacacacacacacttttccccagtaagaagtctctgatactgctcttaggggataacaccttggtatgtcctttgtcactctgggatgactgtggcctttgcagggctttttttggctgtctttcactgaccactcaactgttgagctgcactaattgaggctgattgctccactgtcttcagtaattccctggggcacacattcctacacaactcagtccaatcctattcaggatcctttgaagggaccctttccctagaagatgtttaaggtttgttctgaccccaggagagctcttcctacctctctctttttccgtttgtctctggcaaacttgccggcctccagtgtagcccacacctcccaggctctccgtcacctcccagttgcctttcagcacaacttgcagtgttttggagagtgtgcttaggcttggacttctccgagctctgttgcgcatgaagtcagttccttcaggagcaactcacacctgtt

SEQ ID NO: 31715 - DNA, 1121 bp, Homo sapiens
aagcacttcacaaagccatccccgtggagaaagagagggcagcagggtgtctggcaccttcctctccactcttcccccaaatccacctttgtgacccgatccccagggaggggtgggggtccggtgactgggaaagactgatgatgacatggttgtcatggttacgtgtggcaccctcaccccttgtaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggtacgtgagacccctcacctctgcgtgcattcctttggtgttttcatgggattgtggctttttgtccattctattacttttagtattactctctagtggttgtggagaattttaaatcacagtctttatgtttcctgaggtttccatcatagcaatgcattctggtaattaggaaaaaaaacaacaaaaaccaacaatgaaaaaattgagaataaggcagggtgcggtggctaacacctgcagtcccagcactttcggaggctgaagtgagaggattgcttaaacccaggagtttgataccaggctgagcaacatagggagacctccatctctactcaaaaaaaggaaaaaaaaaaaaaaagagaaaaaatagaataaagaaaacctggaatacagttttgaatttcattaatgtttatttttctaaaaatcttttttgaaagcattatatatatacacacacccttagagaaaacattaaaatttaagggataagtatctccaacctcatcacatgggatggatcactgctctgaccttaatacttccacctggcattagccagcaggactcgccttagacagggctcgagtcctcgtggtcagtgcagggcacatcagtcctgctgtcccatggagtggtgacaggtgtcctgtctgtgcactggcaccggctctctgctcaggtgcgtcaccatcctggccccttgggttttggggttgtttcctctggtctgggagcagaggtgcagtcgctgacctcccagcagacaatgaggaatgggcaggggtgtg

SEQ ID NO: 31716 - DNA, 1036 bp, Homo sapiens
agctccaagctcaaggctcgcatccaggaggctgtctacaaggtgggcctggggcgctggggtgtcagtgggcttcctggggtggaatcaggctgacggtacctgcttataggtaccatcacacctataggcacgttgaatagtggaagtgagatgctgtcccgtgatttcaggatgtgggttcatatttttatgtgtttggtttggtttgtttgagcctcagcttacaaagaaaggtggttgaggccccagaaagcatctctaggggtgcatagcatttgctcattcttagtttctagggaggtccaagagcaggaggtttccagtaactcacctgtttccaactggtgcccccaccgtgctggtatagggacactcccaagcacttggggctttgacaaaacctggggctcctgggtgtcttctatgctgtctctccttgggcccccattggagccctgagactggtggcccagggatcctatgtgtagatcacctcaaccccctgccccagccgatcccatgtcttcctggcctcaccagcatcccattcttagggtagtgggggtatgccagaggaaaggagagtgaggagtgggtctatccaacgtcctggttccttctctgtccctgtggactaatgtccacccaaccagtgcctcgttttgagctgcaaccctgagatatttttgtttgcctagtgtctggagcacaggcaggaacactgtggtacttggcctgccatttaattttgtaaagtggcagacggagaaatcctcttctgattcactctctgtagtgggtttgctgcatctgggagtcctggaaagttatggaaacatggggacatgccctgttataggggctaatcccgtaggactctgcaggtagtacttagagacagtttgctcctgtgtagggcccaggctgggatggggtacagccacactgctaagctggaaaggcagacttgctgtcctgcccatagacattcagtggccctccctgcctgcgtgctggaaagcagccgccacag

SEQ ID NO: 31717 - DNA, 1043 bp, Homo sapiens
ctcctgtcttgcagccgatgtgcttcgctggtgtggattttcatatccaccatcctcacctaatgccctggatgttaggaagacagattaattttcaggaaaccatagagttttcatttgctcaaaatcctgctctggacctctaagaaaaaatcttcccgcatatatgtacatcatagatgggggttgtcttcctctgatcagttgctcacattgacggaaagacacccagggaactgtaagaagatgcctctcttcattaaagatgccctgagaagtaaggcgaaggagcagagttttctggagcttctgctaggcactatttcatgcagtctttgagaccttgcagggccagggatcggggtgaagagaagcaggaccccaggcccgtcagactctaaataccttgccctttgcactgtagaaaacagcttttcttggcccccagatcccttgtactgggagctggtcagaaggggagtgtggatgagggatgtggaacaggcgtggaacatcaggggctggtgaggagtgtggcatggccccttctagagagggcgagcagcttctggctctcagagggaatgaggcccaggtgggtggatcttcatcctttcaagaggaggtgagaactagacttgcatgtggcatctgtttcttgattggaaaggacagatcagaaggctcccaggcagcaagccaggacataagagccaaggctggctgggcctggctctccttgccccctacctaccccacgacctcaggagtctcacagtcaaggtgaagagacaagagtcatgtgacactagacagtttgggtaatgcccctccaccctgggtcccctcccctgcacagggagggagaggagtttactcccaggaagtggtgagcaggaatgaatggcccaggtttccgagcagactcctaaattgtaaaccgctcacagacgtgcggggcagcagtgttatgcactgcactgagctggtcctgcagtcaagggcagggagtcacagcaggaagagcacaagctttcatcgga

SEQ ID NO: 31718 - DNA, 1050 bp, Homo sapiens
cccaagtagagcctgggcaggggtcagaggtgtccacagagaccccaggacatgagagccctgcgcctgcacggccctccaccaggaggccaggcctcagagccaggccagcattggaaccactcaccacgtgaacgaatgtctgtgtcccctcagactcatgtgttgacacctcatccccaaggcgatggcatttgaggatccccaaggcgatggcatttgaggtagcacctttgggaggtgatggggtcatgagggtggggccctcatggttgggattagtgcccttatacaaaaggccccagagagctccctcgccccttctgccatgtgacaacagtgggaagacagcaggcatgacccagaaagtgggccctcactagacacctagtatgccagctgatcttggactgccagcctccagaactgtgagcaatacatttctgttgttggaaaaaccctgtttgtgatgttttgtcatggcagccccaaaagactaagacgtgtgactgtgagctctgaaaatgcagccagtactacatgtcagaagcatgatatttaggatatgttggggtaaatcacgtattttcttaaaaatatgactttttaatagggatttaaaaatggaggaataggcagagtgcaggggacttttagggcagtggtgctgttccgaaggatactgccatggcaggtgtgggctgttatccatctgtccaaacttacaggacatgggatgccgactgtgcaccctcatgtcagctgcgagtgttctgagtgattgtgaggtcaccacagcctcctccattgtaaccaattcaccactctggtggggatgttgagggaagtgttgtgtatgcatggggcagggcatgtatgggaaatctatactttctattcagttttgctgtgcacctcaaactgctttaaaaaacaaggtttattaaaaattaatctcacctgttacttttttttttgacggaaaatgaaaacgtggcctgtgttacacgtctgttgtgcagggctatctcaggcttgtatgagtcctta

SEQ ID NO: 31719 - DNA, 1031 bp, Homo sapiens
tacagtggcaagatcttggctcacagcaacctctgctgcccaggttcaagcgattctcctgcctcagcctcctgagtagctgagattacaggcatccaccaccatgcccggctaatttttgtgtttttagtagaaacgggatttcgccatgttggccaggctggtctcgaactcccgacctcaggtgatcagccctcctctgcctcccaaagtgctgggattacaggtgtgagccaccacacctggccaaggtttccttttaaagtaattttttagtaaagaagaatccatttaatacaataataagaaaagggccgagcatggtggctcatgcctataatcccagcactttgggaggttgaggcaggaggatcgcttaagctcaggagtttaagaccagcctgggcaacatagcgaaaccctgtctctactaaaaaaaaaaaaaaaagaaaaggaaaataaagctgggtgtggcacaggcacctgtggtcccagctactcctgaggctgaggcaggaggattgcttaaacccagaaggtcaaggctgcagtgatccatgattgtaccactctactccagcctgggcaacagagtgagagcctgtctattaaaaaaactaggccgggtgcagtggctggccagatgcagtggctcatgcctgtaatcccagcactttgggaggccgaggagggcggatcacctgaggtcaggagttcgagcccagcctggccaatatggtgaaaccccatctctactaaaaatacaaaaaaaatagctgggcgtggtgctgggcgcttataatgccagctacctgggaggctgaggcaggagaattgcttgaacccgggaggcggaggtggcagtgagctgagattgcatcactgcactccagcctgggtgataagagtgaaactgtctcaaataaataaataagtaaataaacgaatacaagtcatacctgtatgtgactgggctagggcaggtgtccaaccaagaggagcctgatggtggggaggggccgtcggcaggt

SEQ ID NO: 31720 - DNA, 1091 bp, Homo sapiens
tgtgactcttactatgagccaggcactacttgaggtcctgggatgtgacagtgaagcagcaggagatgccctgctctcagggactcacagttgattgccggagttaaacggttaattaagatgagatctgtggatgcatgtgaggcaggagtaagtcctgaaggaaacagaactgcaaggcatggaatgtgttttggggagggcgctcagcataagcctcctgggagtcgaactaggagtggagtggggttgagttggaggggacagcaagtgcaaagggccggaggagagatagagcttgtcagaagtgcgcaaaggcagcacgtttggccagggcagcagggctgggagggagggtggagaggttggcagggcggggccatgtgggaccttgtgggctgtggttaggagacaggaaggagaatgccaggtcagatgtgggcagggttagactgggcctggtttttgggcctcgttctccctggcccctgagggctgtctgtagctgtggcccctgcagggctggaccgggccttgctcaactcccttcaccaggcccgcagcagggaagtgccaggaagtgtctgtggacctgggttgacttgggccttgggtgattttcttcctgcttcctttgtgggtcccccactctgcctgagctctgtcagccccacgaggtggcttccgctctgtagacactgcctttgggcaccgttaggggctggaccccgcgggtggatgggaggtggcgtgtgtcatccaccaccctcacccatccttgttctttgtgcaactctcacttctcttttcttttcactgttgctttctggcctgacccaggtccctgagttcccctatggcctgcctgcctcctgttcctgtgttgtgaagagtggggagcaccccctcaaaagcagtgcctgccagacgccagcacattctgtgtgccagtggggcctcatgcgacagtgggaatgagaaaaattcactctttcaaaactcactgtcagtcctttaattttcctcaaaataaaagttttcttctggtgtctgtatgtggtttacatatttttttattttaaattgtggta

SEQ ID NO: 31721 - DNA, 1030 bp, Homo sapiens
tgagaattgaaagcactcacttataggccttccttagtatttatcttgtgcataccactgtccccgtaagaagtccctaacttccccccctccgccccccactgatcctttatgcttcccataggatttttaaaaaatgatcccaaactgcttactgtatcagagcttatgtgatctggccctgtctgcctttccagcctggtctcttcccacccttttgctgcccagcctctagcctcttggctattcccttggtttggtatatcctgccttcagctcttccgtggctgactcctcatcctttaacatttagctccaatatcacctcctgaccctttgtgtctttcacatcctgaactgtctgaaatgaccttttttattttttgccatcttacttcctgcctgtcttctcgcactaagctgagagcatcagatgggctgtggaatccccagcatctagcacagggcttggtgtacaatgggtgcccacatctttattgaatcatgcatttacctgccctctgttctgagtgaatcacttgcctgtacaagtttatttcaggggtccacctgctacccagccttcaggttaaactcgttggtttggcattcaagggctctcagcctcgcacctgggccttgggctagccacacttctcctgtgtcagcaccatagtgtttctttcttagtttcctctttctaatgcagagcctgccaactcctgttcagtcaacaattatagagcacacgtgatgtgccagccattgggcatatagtggtgagcaaggtgacacattctctgccctcctggcatggtggaacagattgccattaaaacatcaccagacaaatgcatgattacagactgtcataggtgacatgaaggaaaagcccagcatgctatgatcgtttagtgaaaggctctatggggtctgagaaggcttcctgaggcttcagacatccttttaaatgccactttcttaagaaaaccttttgcaatcctaaacacgtgtgagcgaacactactta

SEQ ID NO: 31722 - DNA, 1066 bp, Homo sapiens
gtgtgagcagacataggttatatgttgagacacaggctctactgatggacagttacctgaattgtaaatcctggttcttgtcacttaccagccatcagctcttaagtgactttgtctctcagtctcagtcactgctatcagtgatgacagcacagaatataggctagtggatgaaagtgtgggctctggcccttacgagctgtgtgactttaggcaaatcatttaccccgtctgtggtgttcatctgtaaaatggaaacaataataagacctaccttgtgggtttgttgaaaaaattaaataataacatataaagcactgaagataggctgggcgcagtggctcatgcctgtaattccagcactttcggaggccaaggcaggtggatcatttgaggtcagaagtttgagaccagccaggccaatatggtgacaccccatctctaccaaaaatataaaaattagctgggcatggtggcgggtacctgtagtcccagctactcaggagacaggcacgagaatcacttgaatccgggaggtggaggttgtagtgagctgagatcacaccagggcactccagcctgggcaacagagtgagactccgtctcagggggataaaaaaacaaaaaacaccgagaatagtgtctgggacagagaatgttccataaatgttagctagtgcttgtagtaagaaaaggggagcagccgggcacggtggctcacgcctgtaatcccagccctttgggaggttgaggcgagtgcatcacctgaggtcaggagttcgagaccagcctggccaacatggtgaaacccccgtctctactaaaaatacaaaaattagccgggcgtggtggcaggcacctgtaatcccagctactcaggaggctgaggcaggagaattgcttaaacccaggaggcagaggttgcagcgagccaagattgcaccactgtactccagcctgggcgacagagcgagactctgtctcaaaaaaaaaaaagggagaaaaagcaccccagctggtaggtgtgttctgagggttcaccaggtaccaggcatgcggcactgag

SEQ ID NO: 31723 - DNA, 1063 bp, Homo sapiens
gaaggcagaccgggaggcagagacttctagaacatgacagctatgtcacttgatcctagaaccagcactgacaccaggaatagtgcccgagccgcctgtgtgtatggcagtggtggtggtgggtggagcttgccatttctacacaggaacatgcccagatttgtcgcaggtttatttccaatccctcaggataggtaaattgcagatttattaatcatttcctataggagtgcaatgcatcccatattgagtgtttgctccaggggtgcattttacttagtaatgctaagtaaaatgggtgcattactaagttcattttacttagtaatgacaggttaagtggaaagtatgcagatggtatcgtaactaacctacctaaagcgcagtggaagctgaacgtgcagcgtcctctcccactctcagcaactccacattgccagtcctttctagtctgttggggtttttgaagagatgccaagggcaagccttagagagcctagtgaacagggtgacttacagcagtgaattgcctactgagaaatgagcaatctcagagaagggcagagagaacactgtcatagtggacgaagagaaaagtcgcagggtgagaaccgctgctctcagtttcctgtgagagcagacaggtaagctcacgctctagaagaggattgtccctttgaaataagaccttcttactgaagagcactgtgtgtttttcttccttgcagacctttaacacatctgctggggctgggttaggtgtctaagcattcaaataggttagacaactttttgaagttgccacaagccacagatttatttgattctttaaagcttttgattgatctgtaactgacttactggccggaggtacagatgcgatgttacaaaaccattagtgttcatgaaaccttggctccaccatctgttgtcagaacaagttagtctaaggatcatctccctcaaacttcatttcctcttctaaataacatgctcaaccttgtctgtctggcctttgcagtttcaggctaaacacatggaccagcctttgcccactgccatt

SEQ ID NO: 31724 - DNA, 1046 bp, Homo sapiens
ggtccacgaggtcatgccaaatgctggaaggggagccatgaatgttcattgccccaggtcctgtgtgtgtttgtgtgtgcgtgtgtttgtgtttgtgtttgtgtgtggtttccagtgcgtgggtgcatacacacttcctgaacaaagcggcatctggagctaatgcacttcctgctgtgaaacatctgctcattgccttaaatcaggtagtgggggcccagataaatttacagaggaccagttagactttggaaggaatcttttgtttgggtttaataattgcagtgtcaacaccggagctgattttaaatgtctccttgtacctccaaaaaatgcaaataaagctttgaatggtggaagtcatttcccatgccatggatcatgatgtcagcatgcagaattgccccccgcaacccccaccccagccacaaatggtgatatagattgtagacttgtttttcttaccctctcctttaaaatcatctcttttgcttttgctttgtgggtaaaaggacaaggaatctacactctaatttggcttagaaaggtggtggagaaacacaaaacccatcaaagtgatttctttgcagttggctttctaaggcagcagcctgggtaggcttggaaaataatttttttttaaaaaaaccaaaacacataaaaaaagcctcagggctgcagaagatttagcattctcggtctctcttccacctgccctgcctccactttgcaggggttggcagatgatgcagttggtgaggaaggaaacgagaattccccctcgcattcttggcttctctgtccttggctcaggttttagcatgccatgcatgagccttctctgcctcttccctgccatcctaatggggattttttttccccactggaaaaaattatcatatgccttccacccagttccctatttctcatgtctcttccaccactgatcagagatgttttatctgaaacacatattggaaggtggttttcacctgtttacacattgcttattatgctccattacttacagtaaggtctcaggcttt

SEQ ID NO: 31725 - DNA, 1107 bp, Homo sapiens
gtattcccagctactcaggaggctgaggcagaagaatcgcttgaacctgggaggtggaggttgcagtgagtcgagatcaaaaaaaaaaaaaacaaagaacacgtgaactcgaaagctgactttctgggttggaatcgctcttcacggcttactgcttgtgtgaccttgggcaagttacttaacttccgtgtgcctcagtttccaaagggggatataattttatttacctaatgggtcttagtgaggattagatgagttaaatgagctagtcttgataaaaatgttaatgattatggtagacagaccaatcaccctcaccccgactcccagatgtctaccttctaatccccagaatctgggtatatggtgacctttatatagcaaaagagaattggcagagatgatgaaattaaagcgattgagatggggagctagcctggattgtgcaggtgggtcccctatcatcaaaaccatccttataaggggtagacaggatggccagagtcagacagagatcagagatgctttgaagagggagagtgggaccacatgcctaggtatgcaggaggccgctagaaaaagcaaagaaatgagccctcctccagagtctccagaaggaatgcagcattgctgacacggtgattttagtcttgtaacactcatctcaaacttctgacttccagaactctaccagaatacgtttgtgttgttttaagccaccaaacttgtggcaatttgttacagcagcaagacgaaagtgatcataatgattgtaacagtggcatttagtatatgtggggcatgtgtatgactctttgcatagattatattatataatccttgcaagaatcctagaagcggacctattatccaccatattagagagaagaaaaatgagactcatcacatcctcatctcatctgtctttatggagaaaatgggaaaagggaaaaggagaggggaattgaggcagttgactgtgttcagtcttatttatttattttcatttgtttatttctccaagtccgccagtctctgaaattagaacagtaagcaatatgagataatcgggcctaataatgttgtgattctcttttcttaatggag

SEQ ID NO: 31726 - DNA, 1027 bp, Homo sapiens
ggcagatgccaccaggcctggctaatttcttgtactttttgtaaagacaaggtctcgttatgttgcccagactggtctcaaactcctgggctcaagtgatcctcctgcctggcctaacaaagtgttaggattacaggcgtgagccaccatgcccagcccaaaggctccataccttaacagtcaaacttctctcagcctatggatgctgtgggaaactgaggctatccaatttgctatgttgccagcctgggtcaacaaaggtgtctttgacatgagcctccaaccagggggctgggctctgctccatggccaccaggctgaaccaagacacaccccagccccaagtccctgtgccctaccttcctggatgctgttctgcaggtggttgacaatggcagccaggatggtggagagactcatgacctgggcacactgggccaggccgagggtgaagagctcattccagcaggcccgcacaaggctggtgttgcagtcctgcctaggaatatagaaaggagtctgagtgtggtgtgtgttggcatttctccaaggttgtggggcatccaggcactaagtcccagcatttcccaaacaggtgaattcagcaagtgtttattgaagtgctatccaggatcattcttcaagaaaaggatgaagtctatgaataagtctatgaatgttttaactaaaatccttctaatgatcaactattctcttaaaaaacattctttaaataataaaaaaatgttaataggtatggccaaaccatcattacctacagccttcaaaagcctcagcatcctggactgactgtcccaagagatggtatcagttacttaggtcctgcagccaaggtcatgagaggctacggggaccaaaagacggagatgagtacagattctgaagggcagaaacatgccctgcaaccctgcagggcaggaggcaggctttgtgctggatccgagactgaagcagggaggatgagggtccagctaaggccgcttccagccttgccctggctaacttc

SEQ ID NO: 31727 - DNA, 1390 bp, Homo sapiens
tatgtattgaggctgaagttattctagattcatgatgaagtcttcaatgattccagtagaaaatggatcttgcttttgtaaaagccacatctgggcaacagaagtgcgccaaaaggagaagcaggctcttgtctaccagcaggaccagccagccataagacacccccagtcacaccagagaaatgactgggactgtcctggttttagtgctgaaagactaagagctggttaccctgctggggggcaaaatcatttgagaagcactgggccagaaggggtagcccccaggggcatctgtgttccatggggctcctggagactgaggtctgtgcagaggacacatgtcgggaaggtgggcctgtgtgtcttcccaggctgtcaattttgttccaatgtttattttagggggacatggtggggagggaaacaggaaatactttacttgaaagggtctcagaaattcatgtagcttctggtaggtcagaagttgtcataggaaagcagcactcttccatccttggctggaaagcctgccaatgcattctgacctttggcagatctgaacaattttcctgcctaaagctgcacgagaaagggtttttttttgttgtttttttttttgttttttgagaaggagtctcactctgtcacccaggctggagtgcagtggcgtgatctcagctcactgcaacctctgcccaccctaccaggttcaagagattctcctgcctcagcctccccagtagctgggattacaggcgcctaccaccgtgcctggctaatttttttttaaatatttttagtagagacggggtttcaccatcttggccaggctggtcttgaactcgtgacctcctgatccacccgcctcagcctcccaaagtgctgggattacaggcgtgagccaccgtgcccggtcctaatttttatacacatatttttactgcacattaattacaaataataccactaatttgcacccaaacaaacttttttccattagtttatctgagggtaaaatgactttatataactcatccactcctttataggggtcagatttgatttctgtcaataagaattttctgtcaataagcacttttctgtcaagtactctagcactgcctcttcaatggatgctgaccagaggagcagacctttcaaactattctggacaaaggaatctccatgagaactcaagcctcatgtacagtgttagccccagaacaggccacacagcatctgttccaactcctccaattaaagagtagcaatctgaggcctcgctcacagtcacacagcaaaactggaatcagccacagtcctggccctcctgctggcactgtctacactctacaccacctctagcattcaagaattatctctagct

SEQ ID NO: 31728 - DNA, 1634 bp, Homo sapiens
cttatgagagtattccttccctctagggcccaaagaggctgctaaccagcaggaatgtcctgaaccaaaaggagtggtgaccattctctagacagaataaatgtctggtccctaatgggacagataactagggtttgagttcaggcttgacacaggagcaatgggcagtgaggtggacagcccagaccctgaaaggacgtgtggagacagcagcagtcctgtggtgcagttactgcctgtgtggccagcttcacaggcagcagataatttgtggaaataaacattattttctttttttgttccctgtaggctacttgatcctggatagtttctctttaaacctttgtctttccctattttgtttagtagtgatgaaagatgggtttaaaatatacagaaatgggagaaaattaattagagaaaatgtgaggattttataattgataacatgttcttaattttacttgcacaagcagtgttcacagccttattctgaagtgaccacttttcttctctttgaggcactacctggcagcaccatctaaacctgtatcatctgctgtggtcccagttactcaggaggctgaggcaggaggatcacttgagcccaggaggttgaggctggagtgagccatgactgtaccactgcattccagcctgggtgacggagtgaggccctatctgcctgccagtgagttctgtcatgcatcagactttggacctcagaattttcacctggaacatgagaggtcagatgacataatgaatatgttctaacttctgaaacttttggagcttgtttttgcccttgatagcacgtatccttagagaataagcttgccaatttaaggcctgtctgtaatggcatctgaatgttccagcagcctaactgtgctctgctccagaaacatgtgtgtggcttccctacctccacaccaaggagctgccttgctgggtggatgtaaagactgtcctgccagggtttcccactaaaggtattaataagtccagtggaccacagagggcccaatccctcttggccgctaaggctaaggtaggagccagagagctgtagagacaggaccaccaggatgcttcatgtccataacacaagagagcgctgcattgtttgggggccaggcattactactatcatgaagaaaaatgaagagcaggatgcatgttagtctttaattcacttttaatagtataaacctcatttaggtagtagtattaagccacaacaataatgccacattgaaacagcatttaataaaatgcataaagctaattcatgcactgcaatactctatatacaaacacaacaatgcaaattcttcttcaagactgaagacattgattagatataaaattcagtttaaaaagaacatgctattttttaaatgccatcacataaacaaagtgatttcacagggagaagaaagctgtataaagctgcagctttcaacaggttttaaacctggcattaaaatgtaatggcaaaaccaatattttctatattgtgaagggcaaaggttacagaaacggtcccaagaaaatctaacacccaaattttcctttgatagatagatgcctttaaaagggctggtaatgcagttacattctaacagaga

SEQ ID NO: 31729 - DNA, 1033 bp, Homo sapiens
tcagttataattcccaatattgaggtagggtgtgatgggcctgctccatgggagtacgagtcctagtcaccgtgggggcggtttctcatgaatggtttagcaccatccgctttggtactgtggtctgtggtagtgagttctcttgcgatctggctgtttaaaagtgtgtggcacctcccccttctctttcttgctcctgcttccaccatgtgagactccttgctccccctttgccttctgccatgattggaagcttcctgaggcctccccagaagcagaagctgctgtgcttcctgtacatcctgcagaactatgagccaattaagcctcttttctctataaattactcagtctcaggtatttctttatagcaatgtgagagaatgaactaatatattcagatattttgcccattttattagttggattgtcttattgagttgtgagttttttatatattctggatataagtcctttatcagatatatgcattataaatattttctcccagactgtgggttatggtgactcctgaactgtaaaagtttttaattttgatttttcaatttatagagttttttttcttttatggattatgttttttaatgtcatctccaaaatatacttgcctaggtaaggtcatgacaattttctcctgtgttctcctctagaagttttaagtttgagtgcttacatttaggtctcaaatccattttgagttttaattttttttttgaggttgagtctcgctctgttgcccaggctagagtgcagtagcacgatctcagctcactgcaacctctgcctccagggttcaagctgttctcctgcctcagcctcctggagttttaatttttaaaattttaatgttgtgggtaaaagtctaaattcacctatttagcatatagatagccagttatcccagcgccatttgttgaaacgattatctttcttcattgaattatcttggtatctttgctgaaaagcaattgaccttacaaataagggtttatttctggactcagttttgttc

SEQ ID NO: 31730 - DNA, 1032 bp, Homo sapiens
ggaatatttcaccagggtctattttctcagtttaagttcttttttgtctctttcaggaagttaagctcccagtgcagggtatcaatgtgaatctggtcctgagctttttagaaaataagagtggtggccgggcgcgctggctcacgcctgtaatcgcaacactttgggaggccgaggcaggcagatcacaaggtcaggagatcgagaccaccctggctaacacagtgaaatcccgtctctactaaaaatacaaaaaattagccaggcgtggtggtgggtgcctgtagtcccagctactttggaggctgaggcaggagaatgctgtgaacccgggaggcagagcttgcagtgagccgagatcgcaccactgcactccagcctgggcagtgagagtgagactccgtctcaaaaaaaaataagagtggttaactttttggttgatattagtattatttgtgagaagagtttccccacccttcttctgatagaacaattgtctgtcactggagaaatctccctccagagctttggcaaagttactctgatctgggtctgtttaaaaggccgggtctctaatttaggaatcggtgatttggaagcttttgcagaacatcaccagaagaagggaagcttcccagagtcagaagctaaattaaaataatttccaaggctatttgatcagccttcttcctttttggttcattgtgtcctgacttggggcactgatgagattttttattttttttgagacagagtttcactttgttgcccaggctggagtgtagtggcatgatctcagctcactgcaacctccacctccctggttcaagtgatatttgtgcctcagccccctgaatagctaggattacaggcgtgggccaccacgcctggttaatctctgtatttttagtagaggtagagtttcaccattttggccaggctggtttcgaactcctggcctcaagtgatctgccaccttggcctcccaaagtgctgggaatacaggcgtgagccactgtgcccgccctgatg

SEQ ID NO: 31731 - DNA, 1018 bp, Homo sapiens
gttctgttattatctgtgttttgcaggtgaggtaactgaggcacagagaagtaagaaagtactcagggtcacacagctaatgagtctagaagcctgagtcttgatctgtgttcccaacctctaaaccatgggtcaagaagcctgccctggaaccgtgagctccttgagagcagaaattgcatcttatcctttccgcatcttcatgttgcgtggtgcaaagtaaagatgaaaaatgagtacttgctttaaagaggaatgcttgcagcccggcatggtggctcatgcctgtgatctcagcactttgggaagctgaggcgggtggatcgcttgagcctaggagttcaagaccagcctgggcaacgtggcaaaaccccatctatacaaaaaattaactgggcatgttggtgtgctcctgtagtcccagctacctaggaggctaaggtggtgggatctctggagcccaggaggttgaggctgcactgagccgtgattgtgccactgccactgcactgtagcctgggcgacagagtgagaccttgtctcaaaaacaaaagaaataaaaaaggagtgtttggaattgacagaattacaaaggcttaaggtgtagtcatttcaaccctgagacatttggatttctctgtgtggatatcttatcctttttcattctcagttccattggctgaagtttgttcccagccatttagagctgggagaaggcccctgagttcctcagacctgctttgcttggcaataccaggtggaaatgagatctgccaggaacccgggctcacatggagagcccctgccacaccagtttgtgccgattctgcctccccaggcaggggcggagctgctaccctggccctgtcactaggccattcccatccttccacaggcccacaggtggcctgaagtggtatggcctccggcagccagaggggccactagctgtgtatgcccttgtgctctgatgctgtttctgatagcctgctctggccagggcccgccggctgcagcc

SEQ ID NO: 31732 - DNA, 1049 bp, Homo sapiens
agcagcccttcatgctaaaaactctcaataaattaggtactgatgggacgtatctcaaaataataagagctatttatgacaaacccacagccaatatcatactgaatgagcaaaaactggaagcattccctttgaaaagtggcacaagacagggatgccctctctcaccactcctattcaacatagtgttggaagttctggccagggaaatcaggcaggagaaagaaataaagggtattcaatcatgaaaagaggaagtcaaattgtcgctgtctgcagatgacatgattgtatatctagaaaaccccatcatctcagctcaaaatctccttaagctcataagcaacttcagcaaagtctcaggatacaaaatcgatgtgcaaaaatcacaagcattcttatacaccaataacagacaaacagagagccaaatcatgagtgaactcccattcacaattgcttcaaagagaatgaaatacctaggaatccaacttacaagggacgtgaaggacctcttcaaggagaactacaaccactgctcaatgtaatagaagaggatacaaacaaatggaagaacattccatgttcatgggtaggaagaatcaatatcgtgaaaatggccatactgcccaaggtaatttatagattcaatgccatccctctcaagctaccaatgactttcttcacagaattggaaaaaaatactttaaagttcatatggaactaaaaaagagcccgcattgccaagtcaatcctaagccaaaagaacaaagctggaggcatcacgctacctgacttcaaactatactacaaggctacagtaagcaaaacagcatggtactggtaccaaaacagagatatagaccaatggaacagaacagagccctcagaaataatgccacatatctacaactatctgatctttgacaaacctgacaaaaacaagaaatgggataaggattccctatttaataaatggtgctgggaaaactggctagccatatgtagaaagctgaaactggatcccttccttattccttatactaaaa

SEQ ID NO: 31733 - DNA, 1032 bp, Homo sapiens
atattttggggtggtgttctgagccccaacattccagtcccctggtccctgaatgtcatggtgaggtaccttggatggggatattttcaccttttgggctgcactctccatggctgctatgattttggaaatgtttattctttagtttggggaaatttacttacttgaactatttatttaatgattccctaacatctaacacttctaggactaccccccaaccgccccccgccccagcctccaacacacacacacacacacacacacacacacacacacaatttctcctggaactctctctctctctttttctttctgtgagacaccatctcactcccgtcacccaggctggagtgcagtggcacaattgttaccggaaagggatcccaatccagaccccaagaggattcttggaccttgagtaagaaagaattcaggtaaagaaagaatttgagtaaagggaaagcaagctaagaaagtaaaggaataaaagaatggctactctgtaggcatagtggccctgagggctgctagttggctatttttatagttatttcttgagtatatgctaaacaaggggtggattattcatgagttttttgggggcgaggggttgggggggcaggggaaggaaaggataggcaattcctggaactgagggttcctcccccttttagaccatatagggtaacttcctaacattgccatggcatttgtaaactgtcatggcactggtgggcatgtctttttgcatgctaatatatttaattatcatgtaatgcgcagtaggaccaccagaggtcactttcctcaccttcttggttttggtgggttttggccagcttctttaccacatccttttatcagcaaggtctttgtgacctgtacattgtgctgacctatctcatcctgtgacttagaatacctaacctcctgggaatgcagcccagtaggtcttggccttattttacccagcgcctattcaagatggagtcgctgtggttcaaacacctctgacatgatcatggctcc

SEQ ID NO: 31734 - DNA, 1029 bp, Homo sapiens
ttttggttatatagttattttataattttggttatgttttttaatctggaaaaattagggtcattatttctttgaattctttctttagctcttgttctctcttctccctctgggattccagttatgtgtgtaacattttctattgccccacagcccttagatgctgttgttatagggtttattcccccacttttttcctttttgcattttcagtttgtgtaatttctattatcctatcatcaagttcactgactgtttcctaggcagtacctgttttgttgagaaacctattgaaagtgttcatttcttttaccatatttttggtttttagcatttctcttagagtctttttatagtttccatccctgaaattatgtatctgattttgcatgttgtctgtcttttccattagagtctttagcattttaatcataattattttaaatgcccaagcttttggatccagcatctgtcatatttgagtctggctctggtgatggcttattctcttcacactatgttttttgccttctgggatgttttctactttttggttaaagctagacatattataagggccagtagatactgagggatagggatttgtaacaatctagtcaggaattgggctgttgtttgaagtctgttgttgctgtctgtgaggtttgttgttgctgtgggcaccagagacttcaaacccctctagcaacttgtttttgtctcctctcttggatttgggtcttccctttgtaccgtttcccaaagagtctatctgttgtggctctcccagctgcaatttcctgttattcttggagattcgatggtggggtgtgggagagggggtcgttctctaatgttctgcttctccaaatttgaactggtaccgtgggcctgtgtctcaagggtagtcatttgtctcaagggtagccagttcttctaaacacagtaaattgaatgagaaattttttcctcactcataattgtcatctttattatctacctttttgtctaattgtcacctttgtctat

SEQ ID NO: 31735 - DNA, 1050 bp, Homo sapiens
ggtggcacacacccgtaatcccagctacacaggaggctgaggcaggagactcacttgaacctgggaggcaaaggttgtagtgagccaagatcgtgccactgcactccagcctgggcaacagagcaagactccatctcaaaaaaaaaaaaaaattctatatataagaaaaacaaaagttttttaaaacaataaaagttaacagtcaataatgtgtttgtcggcaagaagccctctgttaataatggtctaaacaaataagacattgtttttctccaataaagaaatccagaggcaggcagtagctggctttgattcagcctctgactgtcactgtcagggccccaggccccatgagcctttcgtctttcctgcatgttggcttatcttctcatgcttgtgacttcctggttgcaacacggctgctgcaacaccagacatcttgcctgtcttcaaggcaggaaggagggggaaactatcgcctaccagctatttttcttaccttagctcctccatgtcttggatcaaaagcatctctttgaacctctccctcaggcataccctgaaatgctgtggactttaaccttttttctgttgcaaaggtcgctcacatctccctggttgtttggtcttctcttccttggctctagtaacacagcagtctgttgcttcctaggacaacttataatgggacccaaaggggaaagaggatttcccgggcctccaggaagatgtctttgtggacccactatgaatgtgaataacccttcctacggggaatctgtgtatgggcccagttccccgcgagttcctgtggtaaggctttctgggagaagtctggggtggttatccgtgaggacctctcacctgatccttatggggctttgtaaaatcctttcagtaaaactaactttttttcacgactctgagtacaccctcattataggaaattggaaaatatgagaaaatcaagaggaaaaccaaattgtccatttgattgtgagtccattttggggtattttctttgtcttattaaaatctaacttttatatg

SEQ ID NO: 31736 - DNA, 1050 bp, Homo sapiens
ggatttatgagaggaaaaaaagtgcaggctactcagtgcacaccacgcagccccacctgcctgccccactccacctgagctgcctccggaatcttttctgagagcctcaaccctccactgtcacccagaagttgagccccggaatggacattttgcagttcctggggtgtgtccattctccaaatatcttaaataaatgatggagggagattcttcttagcaggaattggatttggcaaagtttctcatcttctcaaaaaccatgaggtgaatttataatataacttcctgggttcccatcagctgctcaaacatggaatttccccttctgtttttcttctccccaagtgtttatgaaattcccttctgcagcccgtgtctaacacagaccgtttccatgaggtgactcaggaaatagttctcccgtagccacactgaggtgtgagagggagcagaatttggaaagaaaggaccaggtgaggaaaagagcaagattagggaaactggcctagaagacaacagccagggcattctggggacttgggattctcagctctttcccaacgctctgtctcctgagctgtccaattcaggagccactagccatatgtagctatctggcacttgcaatgtggctagttcaagttgaggtgtgctgtaagtgtaaaatacatactggatttcgaaagaagtagtatgagaaaagaatgtaaactatctcattagttaactttccaatactgaatatatgttaaaatgataatatttgagttttgttgggttaaagaaagtatattattaaaattaatttgacttttttctttttaccttcttgaaaggtaaaaaagtgactactagacaatttaaaattacagtgttgctcttattggtgcctcacgttagttatgtttccattggacagtgctaacctacacattggatagaggcccctgaaatgagcttccaaactctatccaaagtggctacgaggtgtctgtaatccatacaagccaggttcgtctcaagagcagatgagagaacagaaactgg

SEQ ID NO: 31737 - DNA, 1064 bp, Homo sapiens
ccaggacaactgtggccccttggtactcctccatgtggtctctctccagaagggtacctggtttttctcatgagggcaaaagtaaaagctgccaggcctggaactggcacagtatcacttctgctgcattctaatggttacagcaaatgacaggaccaagtgaggttcagtgtgggaggggactacacaggaatgtgacccctgggaggtgtggttgactgggggccatctttggagaccagctactataattgtcccctctcctcatggagttcccatcctgaggctccacttctaatttgctaatggatctactctttgcaaacaggacttttccagtttgccatctgctcagccccttcccatggggacatgggaagtttctggcatcattcctcatgctatgctgggatgtacagatctctgcaggtctctcaggcccatctgcctggacttctccctcagacgctggaatgctgccactggatgccatgttgggcatgggcttctccttggggtccacactctggaaagtcaggcaatggtctcttctgttcagggattccccagacttggctgacccatccactccctgagatgacccaaggaatggaggacttcaggaaaataataagaaaacatggaagagaaaatggctaatgttctgttttaggtaactgtcaatgttgcttactggtattgttttgatctagatttgagggaataatgataatcaagtttacataactcttaggagggttcatacacataattttatttcattcttcacagaaaccttttggagggagtggtattattccccaggtaaggaaagaggctcagggaaattaagtggctttttcagggtcgcatatggtgtggttttatcttgaagagtgcaattttaaaagagaaaagattcaaaagagaataaatggggctgtgtttttaagttgagaacttttgaattttttccattttgatcttcttgcaaaattctgggcttaatatttaggtgacaaaactgaggattacctaaagaacaagcaatgtcaaagtacaag

SEQ ID NO: 31738 - DNA, 1066 bp, Homo sapiens
ttcaccctcaagtgggccctagtgtctgttcccctctttgtgtccatgtgttttcattgaaaaaaatagtaatttaatcttatatttctttctctttacccttctttaagaaaaattaaattttcatcttttttttaaatcccttcatggaagccaacataaattttcatctttaaagcccaaatggtcaaaaagcttttgctaaatgatgtcagtgaaaatggcaagaggaatgacctccgaaaactagctgcttcataagagccgtgataaaactggcaaaatttctcagaatcgactgtttagaagtctgaaaattaaaggctgtcagcaatctcaggagcatttagttcaagaaaaactactgaatctacctaagaccaacagccttggtcatgttttaacttggattagttgcctttttcactgttcagctgtagaagccctgaaaactaacagcccacattcctgttgcagcctagcagccaccagaaggaacaaaacaaagctagagctctttcaaaacctcattctccattatttgaccaatgcacttaacaacagagtatcaaagtatgtgaggcaaaaaccggtagaactgcaatgagaaatagatgaatccactatcatagttggagacttcaacacccctctatcactaatggacagaaccagcaggcagaaaatcagtaaggacatagttgtgcttaacaccatcaaccagctggatctagtgaacatcgagaccagcctggccaacatggcaaaaccccgtttctactaaaaatacaaaaattagccaggcatggtggcaggcacctgtaattccagctacttgggaggctgaagcaggagaattgcttgaacctgggaggtggaggttgccgtgagctgagatcgcgccattgcactccagcctgggcaacaagagtgaaactctgtctcaaaagaaatgttctaaaatcagtcatgtatgtgttcaccttaggaaactagagaaagaaaagcaaaataaatccaaagtaagcagaagacaagaattaagagtagaaatcaatgaaattga

SEQ ID NO: 31739 - DNA, 1457 bp, Homo sapiens
ttttgtaatccatctgtgagagtctgccccccagcttaaccacttcctttggtctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaataaatcaagtgtctgtctcttttacatgcaaacttcttttcccttaaactgtctagcattgaattgacaagttttttttccttttctaataaaaaaatgactttttagcaaagttgttttagacttaaatgaacctatctatatgggattttcaaatatatttattcaacaaatactgcttgcctgctgtatacttgggagtgggaatgggcagaaaaccaagaaattgtgatcttgtcctttaggagcttacaattaatttcattgtggaaaggtataagtagaaagtaataaaagtgtaattgaggtagagattaattgataaaaggtacagaataagatcacattgggagggaagatcagaacaggcgtcatggaagactaggtgcggacattgagaatcagatttgaacagatggagaagggtgcaaaccctatgtgaaaagaacaaaatcagcagctctttaaatggttggtggagttggtggaggggcgctctgggatagagtagatatattggcacttagcaatcctgagcatggaaagatgatgaaaatatacaagagagctaattggaaacacgtacaagattagataatagaagtgagaacaagtagatataaataggcgatgggaggaacaggtgaagagggctttaataacctttctcaaagtggtctttatgcaggtaataataatagaaaatgcctatgcagcatttatcatgtaccaggcaaggttgtaagtacttgaaataaattatctcttaacccacacaactgttctacgtggtaggtactatttatagcaccatttaacagatgaggaaagggggagatgaagtagtgtttgcccaaggtcacctggctggtaatttgtgaagcctagattcaaatccaggcagtcatgtccattgtcggtgctcttaaccccctaatgactgctgacgtgcaatc

SEQ ID NO: 31740 - DNA, 1009 bp, Homo sapiens
tgttacagcaaagttagtatttactgtttatacttgccactttctgttgttttagtagccaaagattttgttctttcagcaaatatgtatcaagatcctagttaagtactaatattcttatttaaagccagtgtttctactcatgcactagatcctgtccccttttgcctacttcataatgtcagtttgacagttctcttttgtgtcctggagtaacatttttcgctctcttcctgtattattcctctcagtatataaacattagttccctcatccttaaaaaataatttataaatctcactgctcctgccagctactgccatatttctctgtccccttttgcagcaaaactactctcttgctgtccgcagttattcctctcattcttccattcttttgttgttgttgttgttgtttgtttttgagacggagtctagctctgttgcccaggctggagtgcagtgccatgatctcggcttactgcaacctccgcctcctgggttcaagcgattctcatgcctcagcctgcccaggtagctgggattactgacacctgccacgacgcctggctaaattttgtatttttagtagagacggagtttcaccatattggccaggctggtctcaaacccctgacctcaggtgatctgcctgccttggcctcccaaattgctgggattacaggtgtgagccacagcgtccagcctcattcttccattctctcttaatttccgtatagtcaggccttctccccctcacccctacacatagcaaaactgttcccatcaaaaccaccaatgacttctactgtgttaactactacttagctctcattttacttgatagatcagcttttggcacaactgatcgtttcctttgataaatttttttactctgctttttgaaccccactcttccttggttttccttctacattactagttattccttcttaatttcttttacaaaatttctccctcttcttctaggactcaattcttcgttcttt

SEQ ID NO: 31741 - DNA, 1004 bp, Homo sapiens
ttattgattcaatgatttgttccatgggagcctagtggaaaatataagccacagtaattattctgggataccagaggcatccttttaataagtgattgttttggaggcttaaacagtggcattaaaggatttatttttcttaaattgtaaaaaatatttttcttaaattgggtacaattgtacccaattgtaattgtattcccaggaatagcttgagtaataagagaatcaggcataactcattctgccaaagcaacaatgaaatattttctaaaagaagagacaaattcctcagagcttccaattgctattattcagtaatgtacatttgcttatttgttttttaaatggttttttaaaaatcccctgtcagcatcacagtttctacctttaaagctccccaggaaaagttgttgtttatactttggaatttttaacaatctgacattggttttcttttgtttaggaccaacatacagtaattataattctgctctgccttttatcccttcatcctcactttgagtaaataattggaaaaatacatgaaatcttccgtgactcattctagtcattctgcttgttacccccattgtcctgatgcctgcgttcttggtagacagtcattcagcaagtcctctgaagtgtctttattttacatcatgtaagaatccagcaaacaaatatatggctgctatcgcaatgaacatattaaatatgtgaaatattaataaataaaattatatttgcctgttgcagatacgtatagggctgtctttgagcaggatgtcatgtgggtcttctccacacctgtgtgtagtatgtatataagagaaggaaaggttgagggctgtttttcctgattataaggaagaaattcccctcataccagctctcctgagataaccatcatcaacagttatattgctctgtgtgtatgtagattattttatgtccctcacagccttaatcaaagttgaagtcctggtatatgttataaagcc

SEQ ID NO: 31742 - DNA, 1025 bp, Homo sapiens
attaactaaagatacatatatgtaaacagtcatagtataggagaagataagggaaagctgacaggactcatgcagtggctcacagctgtaagcttaactactcaggaggctgagacttggaggatcgcttatatccaggagttggaggctgccgttagctatggttgcatcactggactctagcctaaactatagagtgaggctctgtttcaagaaaaaaaaaaaaacctataagcaagttgtttcctaaagcctcctcagaatctcttttgcaaatgtgatcttccttttaaacaatgacaacatgaatcgtgtgttatttcctcagtgtgccaatatgtaagtatataactttctaaattctagataagatgaatttcaatgttttattcttcatagaatgtaaatcatcatttttgtcacatttatcttcatataaaaacatgctttcatgcttctttaaacctaccaatttcattataaaatcactgtcaattaagttttctaactgtattttctctcaataggaatttggagtgcctaaaccttctgctgaatactggtgcagactttaataaaaaggacaaatttgggaggtagggtatgatacagtttctttatggagcctatttttacttaataacttgattgaccttctaactggcttctgaaaattaactgaacaatttagcatcttgtacactgatcatgattcattgagagtcccagctgaagtcagtaacttccaaatattcgttctcacccacagttttcttcttgagtccctaccacagccctagcctaccaaccacagccttggccttataaatgcctctatacttgctatcacttccccccctccaaaaattatgactatggaaatgtaaagccccatagaacctatgttttttcaagaaactcacaatacctagaaaataatgatacagttctcctttctccaagtcatttcttggtgagggattctactgcccatatcttgttccagagcagtagtaagagggagg

SEQ ID NO: 31743 - DNA, 1028 bp, Homo sapiens
ggctgacagaccaagacccccatctctttaagggaaaaaaaaaaaaaaaaaaagtccaggtgcggtggctcatgcctgtaatcctagcactttgggaggccgaggcgggtggattacttgaggtcttgagttcaagacaagcctggccaacatggtgaaaccccatctctactaaaatacaaaaattagctgggcatggtggtgcatgcctgtaatcccagctactcaggaggctgaggcaggagaatcacttgaacccgggaggcggaggttgctgagagctgagatcacaccactgtactccagcctgggcaacaaagcaagtctcaaaaaaaaaaaagagagaaaaaaaaggccatagctaaaatattaacattaaaaattaggatatatcctatctggaacattttggaaagacagaatccttttgccaagatgcttttttgccctttttttttctggttgaacaaataacaactggtacatgaaaaataatggtaaaacaaatatatcctgagaagcactgatgtgttatctgagtgttttacaaaggattattgtatttactctgtacaacagaccagtaagatgtagatggtattatcctcattttcagttgaggaactgaaggcacaaagaagttaggcaacttgtccaaaaatcttgcttgtggtaagtaggagatctgagattcatgcttaggttattctgactccagagcctgtgcatgcatgcatcctctctcctcctccccttcctttctcgtactgcctccaaaagattagaacttctgtaaaattacttgtcaattggatggcttgtttacttgaaaaattcatattatggaatcaaacacttaagtagatacttatgatgttctaattattattataaagacatgaggatttttaaagaatatctgcgttgtacagtgttagcataaacttagaatacttgtgacatttccattttagtacctatgcagaaggcatgctgaatgttgctgtgagattaggaagctgctaagt

SEQ ID NO: 31744 - DNA, 1111 bp, Homo sapiens
agtgtggtggcatgcatctgtagtcctagctactcagaaggctgaggtgggaggatcacctgaatctaggagtttgaggttacagtgagattgatcacaccactgcatttcagccagggtgacagagcaagaccccgtttctaaaaataattaattaattacaaaatatgtttatgctatactatagtctattaagtgtgcaatagcaatacatctaaaacaatatacatgtctttgttttttcttttttattaattttcagtgttcttaattaaaaaatatgttattgctaaaaaaaaatgctaactatcgtatgagcctttagcaagtcacaatctctgataatggagagttttgcctcaatgtgaatggttgctgaaggtttggatggctgtggcaattccttgaaatgagacaaagatgtgctgcatcgatggactcttcccttcacaaaagatttctctgtagcatgtgaagctgtttgatagcattttacccacagtagaatttccttcaaaattggagtcatttctctaaaagctttgttgtcatttcaacaacattcacagcatctttgggagtagattccatctcacaaaaccactgtctttactcatccataagaagcaacccctcatctgttcacattttatcatgagattatagcaattcaggcacatcttcagactccacttcttattctagttctcttgctatttctaccacatctgtagttatttccttcgctgaagtcttgaatccctcagtcatccatgagggttggaatcaacttcttccaaactcctgttaataataatactttgacctcctcccatgaatcagaaatgttctttctttctttcttttttttttttttttttttttttttgacagagtttcgctttgttgcccaggctggagtgcagtggtgtgatcttggctcactgcagcctctgcctcctgtgttcaagtgattctcctgcctcagcctcccaagtagctgggattacaggcacccgccaccacacctggctaatttttgtacttttagtagagacagggtttcaccatgttggccaggctggtctcgaactgctgacctcaggtgatt

SEQ ID NO: 31745 - DNA, 1053 bp, Homo sapiens
ctaggctagagttatagaagtaataagttgatagttaataatggtttggtggggggaggggttgttgttgtggttattaaaactattattaaaattaatcttattttaaaacttatttcccacctttccttattatcacaggacaatgaaaagcgaaccccattgcacgccgcagcttaccttggagatgcagaaatcattgaacttcttattttatctggtatggtaacctctgagtaataagaacacattatgtatatttttgttattcttaatgtttctcaatcataattgactatttactgcatggcctgttgttcatatttgttttatcagctgaaacttatttttatattcattccataaatactgatcacatatctttttctgggtgcttagagtacattaaagaacaaaacaaagattgctgccctcttgtagcttatactctgataaggaaaaacaagcaataaatacaagtgaattttatagtatattaaatgatgatgagtgctttgaaaaaattgaaaggtagatcaggataatcggggtgggataagcattatatgtagcgggtttttttggttggtttttttttttttttttggtttttggtttttgagatggagtctcgctctgttgccagggtatagtggcacgatctcagctcactgcaacctccagctccctggttcaagtgattatcctgcctcagcctcccgagtagctgggattacaggcacatgcctccatacccagctaatttttgtatttttagtagagacggggtttcaccatgttggccaggatgatctcgatctcctgaccttgtgatctgcctgtcttggcctcccaaagtgctgggattacaggagtgagccaccatgcccgcctacatagggtattatatggaacagttatagtaggcctcattgagcacagaattataggagatggttgcagttctcctaggtggaggtaacggtggtttatagcaaatacaacagtggagacagtaagaaatagtctgatagtagatatattttgaaggca

SEQ ID NO: 31746 - DNA, 1046 bp, Homo sapiens
aggagtcagtccatattagtctatagagactttcctcattctttataatttatttcatagcataatttatttaactagcagaactagttccctcttagagggcatttgggttattattaaccctcttcattggtaataaatgagatcttttcatcaagttaacaaaaattctacttaaatggacaagcaaaaaattttaaatgtatttattatctgttattaaatatattattaacttcatagactacctttcctctaggttcagtatttaaagcaattttagtgcatatgtttatatgaattggtggacggtaaatactggcattttctataaagctcaagtatcaatacttgcatactcagaagtaatgctgatggttacttatacagatgttgatagttatatggtatagcaaaaatatgataaattatgtcctaaatttcatactgaaatgaagtaactttggtctgaaagttctcagctagtgcctcagactatttttttaaacttttattgagatacaatcgatgtataataaactgcatatatataaagtgtaaaatttcataagttttgatacatgcatacacctatgaaaccatcaccacagtcaagatagttaacatttctatggctcccaaaggactccatttgccccttggaaatcccttcctccctcctctccctggtaattactaacctggtttgtacattttgttttttcctagagtgttatataaatggaattacacaatatgtcatttttttggtctggctttttttttgtaatagattttatgttgtagagcagttttaaattcacaacagtgttgagaggaagatacagacatttctcatacactttactgccaccacaaatgaatagccttcccattatcaacatttcccattagagtggtacatttgttaaaattgatgtacctacattaatacatatcattatggctcaaaaaccagagtttacattagggttcactcctggtattatacattgaatgagtttggacaagtatataatgacatg

SEQ ID NO: 31747 - DNA, 1084 bp, Homo sapiens
ccaggagacagaggttgcagtgacctgagattgtgccactgcactccagcctgggcaacagagcaagactctatctcaaaataaagaaaaattgtccctggtaattattttgtcttttctcctatccagtagctgttcagactcctttcactgaagcccttttatttcacaaatactattttcaaattctgcttttttagctaccaaatgactttttgttagctaccctacttaaatgagttgagtacttaagtctatagagtctatttgtgattgtaacagattatggagatcttaattcagggaaataatttcttctaataaagcattctcttattcttttaaagatcaaaataaaacagactctagaataacagtgtcccttaacaacttactctgaggccttgtttctccagtctggtgtgctgttatttccttttctgttctttgtagggttatttagataaaaaataaagtcataaaaacaagcatcttaaactaccctgttctgtagtctgctcttcatttgctattttatagcttttgagttatgaatttataggggattgtaggtcagcaagtttaaagtcactcacagtaggcttggtttgcctttgagtctcaggcttacaggagttatgggttaaatgactggctttgcaggtttgcttcttggcagtgagtcttcacataggcagtgttcaagttgtggtcttaactcttagaatgtgaactttgtcatgtaaccactctaggccttatttttcttacctataaagttgtgattttgtttagcaaataaggatcatggctaaggacaatgttacttaggggaaaaaaaaaaaaaaggagagaacaaattactcataatcctgccactgacctaactcatgtagtgttgatgctaaaaatgaaaaagaaaaaaagtcttctatttaacgtaattaagattattttgtttatactgcagtgttgtattccatataatattttttagtatatcccatgttttagaaattctttaaagattttatttttaaatattagatatagtttcactgtgtgatatatactgtattttaaa

SEQ ID NO: 31748 - DNA, 1031 bp, Homo sapiens
gattgttcattgctggtatatagaaaagcaacagattttgtgactttatcttatattctgcaactttgctgaatttgttcattagctctgatagtttgttttttttaattcttggccaagcatagtagctcacacctataatcccagcactatgggaggccgaggcaggcagatcacttaagctcaggagttcaagaccagcctgggcaacgtggtgaaatgccgtcactatcaaaaatacaaaaaactagccggctgtggtggcacatgcctatggtcccagctactcaggaggctgaagtgggaggatcgcttgagcccaggaggcggaggttgcagtgagctgagatggcgcctgcatgacagaatgagacccaatctcaaagaaaacaaaacaaaacattctttaggattttctatgtataacatcatatctgcaaatagagatgattttttggtttgttttatgactttccaatttgaatggcttttatttcttacctagttgatctagttaaaacttgtagaacagtgttgaataaaagtggtgaaaagtggcatctttatctctctcctgatctttgaaagaaagcattgagtttttcacccttaactgtgatattagctgtgggtttttaaataaacgatctttatcatggtaaagaagttcccttctatgatgttgagtgttttttatcatgaaaacgtagtggattttataaatgctttttctttgcatcagttgagattataatgtttttattcctttcattttattaatgtgatatattaaatattttaaagtgtacaaccacccttacattcctggtataagtcccacttggacatggtctacaattctttcaatatgctgctgaatttggtttgctagtattttattgaaaatttttacataatcataagggatgttagtttattgtttcctcatgatgtctttttctagttttggtatgaagtgtctagttttggcctcaagaaatgtggatatccagttgtcctagcgctatttg

SEQ ID NO: 31749 - DNA, 1172 bp, Homo sapiens
ttttttatagctgaacagtatgtgtgtatggaccatatattctttgttaatggacatttaagttgcttccaaatcttggttgttgtgaataataaccaaggtttttatatataatgtgcatattatatatcaattattataaaataatataaaaattataaaataaaattatatataaattatgttatatataaaaattatacacaatatataacattatacatataaattatgcctatataataacatgggagtgcagatatctcttcaatatactgatttcctttctttgggttataccaagcagatggattactggatcatatggtagtgctagtgccatttttagttttttgaggaacctccaaactgttctccctagtggttgtactagtttgcattcctaccaacagtgtacaagggttcccttttctccacatcctctccagcacttgttattgtctgacttttggataaaagccattttaactgcggtgagatgattgtagttttgatttgcatttctctgatgctcagtgatgccgagacccttttcatgtacctgtttgccatttacatgttttcttttgagaaatgcctattcagatcttttgcccatttttttttattgggttattaggttttttttctgtacatttgtttgagctccttatattctctggttatgaatcccttgtcagagaattagtttgcagatattttctcccattctatgggttgtctcttcactttgttgattatttcctttgctgtgcagaagctttttaacttgatgtgaaaatattttctcccattctgtgggttgtctcttcactttgttgattatttcctttgctgtgcagaagctttttaacttgatgtgaccccatttgtccatatttgctttgattgcctgtgcttgtggagtattagccaagaaatctttgcccagtcagtgtcctgaagagtgtcccagatgttttctttcagtagtttcatagtttgaggtcttggatttaagtctttaatccatcttgatttgatttttgcatatggcaagaggtaggggtcttcattctttttttctttttttgagacacagtcttgctctgttgcctaggctggagtgcagtggcgcggatctcggcttactgcaacctctgcctcccagg

SEQ ID NO: 31750 - DNA, 1035 bp, Homo sapiens
ctgacttatatcttggaatgacagatccttcactccttcagtagtaagtttgaaattgggaagtgcaagtcttccaatttttgtttttgttttttaagattttggcttttatgggtcacttgcattcccatattttagcatccatgggtcaatttcttccagaaagacagttgtaatttcgataggtattgtattgaatcaatagatcaatttgggaaatactgccatcttaatgataatagtctttccatgaacatgggatgctttccatttattaaggttctttaatctcatcgtatcttgtagtttcaagagtacaagttttggactttcttaaatttctaaggttttaaaatgctattgtgtatggaattttcttatttttagattgtttattggtaatatatagaaatacaagtgattttatatattgcttttgaatcctacaactttgttgaactttcttattagcactaatacttttttagtggctagagataattttccgtgactagagataattttgcttttttctttccagtctggatgctttttatttcttgcttacttgcccagactagaacctccagtacggtgttcagtagaagtggtgagagtagacatccttgtcttgttcatgatctttcatcattaagtatgatgtagctgttggtttttcatagatggtttttattaggttgaggaagttccttcctatttctaatttattgattgttagctgctgctatatttttttttttttaagttaaggtctcactttgtcacccaggctgtagtgcagtggtgtgatcatggcttacttgcagcctagacctcctgggctcaagcgattctcccacctcagcctcctgagtaggtgggaccacaggcatgcaccactatgcctggctaattttttaatttttttgtagagatgggtctccctctgttgcccaggctggtcttcagcttttgggctcaagtgatcctcctaccttggcttcccaaagcactgggattacaggtgtgagccac

SEQ ID NO: 31751 - DNA, 1051 bp, Homo sapiens
tttgcctattctggatatctcagataaatggaatcatacaatatatggccttttgtgtctcattcacttagcatatttttaaggttcttccatgttgtgcacgaatctgttggtcataaatttttgtatcatgtttaggaattcctaaaagaagttcctgtactcaggtcatctcactgccttccgtggtatgcatatgtgtaatctgggatagtatttatttctgtttttggaatttgttttatgaactttgtttgcagcagtactaaagggtaatagcttttacatttggatcatttttgtgtaggagccatctttgtgtgctcccttatgggttaatggtgaggactgatatgtttaaggtgttgggtttttttttgttttgttttgtttttttaaacagggttggcatatatcagtgagaaaggtgttggatggatgtgagtaacttaaccactattttggatagttaataagttcttatttgatcaagtacacactaagagtggaacattgtttgaggggaaaaaacacacacaaaaaatgacggttcttgggaaatcttacaataggggatacagaatgcatgaaatacttgaagaagaacactgatgcccagatattcaggtactctatgtaggaggtgtcttcctgttttgtttttgtttttgtttttgttttttgagacggagtcttgctctgtcaccaggctggagtgcagcggcacgatcttggcgcattgcaacctctgcctccctagttcaagcaattctcctgcctcagcctccctagtagctgggactacaggcgcccaccaccacacccagctaatttttgtaattttagtagagacggggtttcaccatgttggccaggatagtctcaatctcgtgaccttgtgatccacccaccttggcctcccaaagtgctgggattacaggcgtgagccaccatgcctggcgtgtcttcctgttttgtgctggagatgacaggggacacaagggtgaagtagctaccatctctacccttacagatcttagaagaggggaaa

SEQ ID NO: 31752 - DNA, 1011 bp, Homo sapiens
cggggtccgcgggcgacccgcctgtcagagctgccggggcctgggtgaagcccacgtgccgacgggggtctagccgctgcagcaagaggggcgggttccacgctcaccgccctcgcgtcgggcgagctgccgggcaatcgcttcctctttcctgccaggtgaggctcgggcctaacaggtggcttccccgctgccgggcgggagcggtactggcggccgtgacccagggtcacgaccttgttctgtttgcttggctgggtagtgcgagggactctctctccgggttaaaggcaattgattcctcttagcgactagttactcaatgcaagtttccagacttgttttcttttgacattttgtgcaccatcttgttacttttcttgacttatgaagagctggtcaaagaatacaagtcaaaatgacttgtaattctctggaactgaaaaactactttgtatctaggaacgaaatcgcaactgtatctgaatgttttgtacacctaaacatttggaaagatgggtaataaggcttttgaaggatccggacgctgccaaacattttccccctcttttaaggaaaaggaaaattaatgtgtgacatttacacattaatttgtcgcaggacacttactagtgttgacaacttatttttgccattgttttcctgaacagaagatgttgaacagatttgaagggaaaataacttggatgttttggaaaactattttgaaagtgagcaccccgtttgcgaaaacaatggggaagaacctgagactattttttatattacttaataaagattgcaccttaaattctgaatctaatatcaagaattctcatttcataagtgaattttatgtttaggctgatcgcagaccttgtgtatcattaggtatcagaatggtcttgcctggtgttaacatcaggtcatgatactttgaaaaactacggtttagtcaatacagtttataccttgtatttcaaattatacaactgttctgtcctataagag

SEQ ID NO: 31753 - DNA, 1049 bp, Homo sapiens
ggaggctacaggtgggtccaggacacactgccgctggggtcctcggaaaagaacaggagggagctggtcgcggagtccaggtttccggggtgcgcgcggcctgggtggggcagggtggaggcggtgcctgactgcccctctgcgtgtgccctgggaggtgggtttgctctggggacagaggtgctggacgtgtaggagcagacatgccgcgcgctccgaggaagcgccggaaccaccagaagcacagggacgcgggtgccgagagtccccagcactgaaaacggggatctcctcttctgtaagggattttcttcccttgtcttaacccacttctctagactcaagggacgccaggatggatatgggtctgggcgaggaggaggtggttgtgtatttcgggaagccccgttgtcaggcacgcgcaccccagtcctaggccagggctggtgcccttcacctccggtgtcgctgcctttggcagcaagaaccgcgtggaggccaaggttgtagaaccaggcacgctccctgctgtctgtctgtgactctgtgcttgccctcagctgccctgtgtggttatgggtgatccctagggacgctgggtggtgtcagtgagtttcttcgggggcttaaaacaaacaaacaagaagtacttttttaaaaaaaaagtctggctcaatctctgtcagtggtcaccccagtttccagcaactcatgtgctggaacccttgtagtcggtacagctgtttcaggagctgggcgctcaactagactaggcatcttccaacccctgccatcgtgtgtcatctcaggataagttaaggccttgccaggaaggaagccgggtgtaatgtgagcgacctctgggcctgtgggtagggcctctctgctgccgggattcctaatttgtatctctgaacagctgaatcccaacgaagttcaagtgaccccagatgtcaccaaaccccagagaggggttacgaagcaagctgtttgggactctttggtgcgtgtgtgctaacctcagtgaaatcactctaacctcagactga

SEQ ID NO: 31754 - DNA, 1035 bp, Homo sapiens
acttccaccatccagcagtttccatacatcctctgaaatctaggtggaggttcccaagcctcaactcttgtcctctcaacacccacaggcttaacactatgtgaaagctgccaaggtttatgggttgcaccctctggagcaacagcctgcgatatcttaggcccttttagccatggatggaacagaagcaactgggatacaaggagcagtgtcccaggtttgtgcagggtagcagggccctgggcccagcccacaaaaccattcttccctcctaggcctctaggcctgtgatggaagcagctgccacaaaggtctctgagatgcctttgagacatttttcacattgtctcggctattaacattcacccctctttactttgcaaatttctgcagccagcttgaatccctcccaggaacatggatttttcttttctaccacagggacaggctgcaaattttccaaacttttatgctctgcttccctgttgtataagttccagtttcagatcatctctttgctcatgcctatgaccatatgctgttagaagcagccaggctgcatttgaacactttgcttcttagaaatttcttccaccagataccctaaattgtcattctcaatttcaaagtttcacagatccctagagcaggggcacaatgccaccagtctctttactaatgcataacaaaagtgacctttactctaattcccaataagtttctcatctttatctgagactatctcagcctggacttcattgcctatatcactatcagcattttggtcacaacagtttaacaagtttccaggaagttccaaactttccctcatcttcctgtcttcttctgagctctccaaactgttccaacctctgcctgttaccaagttccaaagtcacttctacattttcaagtatctttgtagcaatgctgccacactcctagtaccaattttctgtattagtccattctcatattactataaataactacctgagactgggtaaagtataaagaaaagatttaattggctca

SEQ ID NO: 31755 - DNA, 1024 bp, Homo sapiens
tttcagtgccacattgccttggggacagttatttgtaccctaaagtgcagatgtgcatgacagggaaggaaaagagggctttgacttgtctgggcaattggaggtcagccaaggccagagaccagattgcggagtctgcatggttgtcctcttctttccccctcagtggcatcaccaccctctcctacacagtgtctccctgctcttaaacctcttgtccctggcatctcatcatttatcctttgaacacctgtgtaaacttttccaggaagttatatttttaatccactgggctttcattgcagaaagaatggctttagttctgtcatagaaattctaggcctgttgataaaggggggatctgtatcaggcaggtggccttcactttgcccctgaaaacttagggctaaggaactcccttttggttgttcctcatagctagagcttctatacccagacagtcagttgaaggctagggcactgtattagtccattctcttattgctatcaggaactacctgagactgggtaatttataaagaaaagaggcttaattgactcacagttcttcaggctgtacaggaagcatggctggggaggcctcaggaaatttacaatcttggcggaaggcaaagaagaggctggagaaggagaaagagagattgaagggggaggtggtacacacttttaaacaaccaaatcttgtgagaactcactataacgagaatagcaagggggaaatccacctcatgatccagtcacctcccaccaggccctcctccaactcagaggattacaattcaagatgagatttgggtggagacagaaatccaaaccatattatcctgtacctggctcctcccaaatctcatgtccttctcatattgcaaaagataatcctcccttctcaacagtcctgtcttaactcatttcatcattaactcgaaagtccacagtccagagtctcatctgaaacaaggcaagtcccttccacctatgagcctgtaaaattaaaaactagtta

SEQ ID NO: 31756 - DNA, 1052 bp, Homo sapiens
caaaggaacacatcccccaaaaatagataagattcactgcatctagtccaaaattctgattttgtaggtacagataataaggcccattatgggctgaattgtatcccccccctcaacaaaagatatattgaagtcctaacttctagtacctgagaacgtgacctaatttgggaatagattgttgcaaatgtaattagttaagatgaggtcatactaatccaatatgactggtgtcctcataagaagaaggaaatttggcaagagacatgcacagagggaagacaatgtgaaggtatatacagggagaagaaagccgtgtgaagacagccagaagcagaggttggagtgatattatctacaaggcaaggaatgacaaggattttcagccattaccagaagctaggagagaaataggaaacaaatttttcctcttcagaagaaacatgctgctaacaccagaagcaggagaggcaaggaggattctcccctacaagtttcagagggaacatggtcctaccaaaactttgattttggacttctagctttcagaattgtgaaacagtaaatttctgttattttaagccacccagtgtttgttactttgctgaattatatggattaaaattatatacagaaagaaacattgagcaataaagaaataatgtgagagtaatcgtaaaccattactcctgtaatagtttatgaatggtgatacccccaccacactattttttaactgacttatttcatattgtaagtcactcttgtgattccttgcttcccctggctccacctacctaaatcttactcctattttcaggcctagggcaaggtagcctttttcccaaatcttttcctattattctagctctcattgatttcacactttgcaatcctataagatcatcatcaataccactaactaagtgctacattagtcatactctattttacatttttccgtagttattgtgggtgttggtcctatctcctcaactagattgtgagcttccttggtaccagaaccacattacaattctttcatatctcta

SEQ ID NO: 31757 - DNA, 1048 bp, Homo sapiens
cagtgcaaaattcctggctattaataagactcataataagaagcagcaatgagaagaataacaaaagaaagtaacaagattatttacaaaggaagcataatagatgatgacaaagctatcaaacgttagttatggtactatacataaatgctttaaacttacctagtaaaaggcaaaaattattgactggctttatagacaatatccaactatatgcttcttagaagaggcagctaaaataaatgatgtagcttggtaaaaggattacagggacagcaactgtaatatcaagataatatacttcaaagaaaagcattgaaagaaacagagaatagccttgtatagtcataaaacattcagtttttcatagacatacaatagccttgaattttggcatgtaaaatctgtgacagcaaggagtttgtctgtcttattcattaatatatctcaaatgcctccctaaactgaacctggcatgtggtaaacactcagcaaataatttttgagtacatgagaagatggatgaatgggaaggaaagaaaaacaaaagaaggaaagatcacaaaccagtaatacaaggatctgattattcaaaatatgatatggtgaaaattttgttgctattttaaggaacatcaagtaataagaatgaaacaattacaactctaaataattagtagaaaacatacatgaatagcctatcttccaatgacgatagattttgtaagaatatcagtgaagacattctagatggtaagctggaaatttgactacttcaaaatttcagtccggggagggggtggtggtgctgcctgattcttgtgttgttctttgctcgattaaactctgttaaattaaaaaaaaaaattagtccaataaaattcaatgtaaatttttccttatgatttttaaattggtttaaaaaatttaacatacataaagaaataatatgaagaataaaatactaatttttattttttatatatagagtcctaaatttggtaagaaatcactaatccattaagtagaacagtaaaatgaaacaaca

SEQ ID NO: 31758 - DNA, 1035 bp, Homo sapiens
atattgagtttattaggggatttgcacatctgggatatgcaggccttgggaaccataggcatatccaaagaggttgagggaaggggaagcttttaaagacaagagaggaaagtacacacaatttattttgtaacagagaactttggttacaggggcttattgcaggagctaacaccagttcattaatggagacagtttgtctggcaagtgttcttgtacatcagctagctatccttgtacttatgtagcaaactgcagtttagaaagttattggcaaaagtttttgttacagacgtatgtgtataagagcccttcagagagtctttgtaatatttcttcagcgtatgtgcatgagggctcttctttctaaacctgtctttatttatggttatctgtcagtattcttggggatggatttcaggacccccatggataccaaagtccagcagtcagctctagggaattggaaaggataggaaaaatcagcccctctgtatccatgagtttgacatccttagaatactgtagtctcagtccgtggttggtataaaccatgaatgcggaatctcatgtatggagggccaactgtacttttgttagggtttgacacaagtgacttcattttgattttgacaactttcccatttgaacttagtcatcagtgacaaaattatgcccttacctatgaagacagctaatgtgacccatacaacatcagtatttacatatgtatctatttcattgtggtgacagtgttactttacatgaactgctattttatagtacttgctatttgatagtactaaagtttaaaaattcagtatatcatagtttttttttttttattagatggggtcttactctgttgcttaggctagagggccatctcagcccactgcaaccttcacttcctgggttcaagtgattctcatgcctcatcttcctgtgtagctgggattacaggtgtgcaccactgtgctcatctaatttttgtatttttagtagagtgggggtttcaccatgttggccaggctg

SEQ ID NO: 31759 - DNA, 1027 bp, Homo sapiens
aacagtctacgttcctgagtaagtactctgttgataccctagaatttcatgccacgcaagatggcagggatccctgtaacaggaaaatgtggaaagtgccaccagttgtccatatcaattctaaggtgactgaattcttcacaatagttgagttgaaataatatcatgtcctattgggcctagcagaaggaattgggtaaaaatatgttcctccaggaattgccctgctgaactgactttgtttggtatttaccttgtgtaaactagaaaatagctgccaaaaaattttgaatttggatatatttgatgatgagcttttccttctcttactagttagacaacaggatccattgcttcttgaaatatttctcaggttgtgataataaaaccatttgaactatttggagaacagcacatataccctgtttgcaacagcaggaagtatcactttattcacatttataaagtgtataaataagttgaaaagaagtgtgtatgtgtttgtggaagttgaaggagtcagttttctttctgaggatgaggtgtgatttcttatttttttatgtttatttttggtgattttataactttatttgatgtatttgatgatcagcagttagttctcatccacaatgactgtctgtagatttttgaaagtggtaacaggtgcataggtaaccaaagtgtagaactcatttggtagatcttcatccttattatgttttctcgacagccacacatggatatggtatggcacattccttattcctttggcccagacagctttgttgagcctgctatcagtgcacagttctggagttcccctctccctcatgacagatttccagatctctttgagtgcctgatgggcatgcttcttgaagcccactccatggatgcacttgtgaatgttgattgtatgctcaggtcaccacctcattgatgggagaatgacccttcttctttgtgggagccattctagtgggcccacgttgggggtgtgatttttaaaagtgaacaatcaggt

SEQ ID NO: 31760 - DNA, 1053 bp, Homo sapiens
tgtgaaggagtaaggtggatcaaaatgagatgattaactaaattctttatgtaaaacatttattcttttattttagtgtgtactgcttttcctgtacagtaagttatatatcctaataaaaattaaagagcaaattgtgtttggaagatcgggtcatcgtaattcattgacattaggccacataactgaataatgtcttccttcagcaaaatacatcaaatgagatcaacaattatgactcataaacatgccttgcaggcataaaacagcagggaattagcatgtgaggctgataaatatgcatgtaaataagctcccaaaggaataacatgggtttgattgataggtttagaattggaacatatgtaaacccctttattcctcattctggtgtagctaagtaaagatgcgttttacttgttaaaaagtttcaataactttgtaaatcttaatgccacatctgtttttttttttttcttgtgcatgtcacttgtaagattaattgaattgtctacaggctggacggccctcataaagtaaatggtggaacatgtgaatgagtggctatacattcgttgctagaaacagagtaagaatctttgggaaatctctgtttttacattgtaaaatgatgtatggtcataagaaatttcttttggaaataaagatgtgactcgatagattattctggctccctcagtaatacttcataccatctttttctacattttagctcctaacaatgcagtttctatttatttgctgatttcttactattgatttgatagtctataattaacatgtatctttttaataatttttttttcagttcttggtacttaattctagtccttctaaatcagtattcaggaactattgtgggagtgtattagaaagtgcatgttcaaatgctaatcacatatccagggagactccagttctgtgttcatgcctctcagccatcaaatgacttcgggaaatattaattcccttctccaggttcaaagtcacttcaggtaaatgaaagaagaaatgtggtttttgatatcctgg

SEQ ID NO: 31761 - DNA, 1821 bp, Homo sapiens
taaatggaaaaacattttatgctcatggataggaagaaacaatattgtgaaaatggccatactgctgaaagtaatttatagatctaatgttattaccattaaattaccattgacattcttcacaatattagaaaaaacttttaaaattcatttggaaccaaaaagcccaaatatccaagacaatcctaagcaaaaagaacaatgctagaggcatcatgctacccgacttcaaactatactacaaagctacagtaaccaacacagcatggtactggtacaaaaccagatacatagaccaatggaacagaatagagaactcagatataagactgcacaactacaaacattattgttgaaaaaaacaaggggaaaggattccctatttaataaatggtgctgggagaactggctaggcatttgcagaaaattgaaactagaccccttccttacaccttatacaaaaattaactcaagatggattaaagacttaaactatgaaactgtgaaaactctggaagaaaatctagctaatagcattcagaacataggcatgggcaaagattttatgatgaaatccccaaaagcaattgcaacaaaagcaaaaattgacaaatgggatctaattaaaataaagagcttctgcacagcagaagaaactatcatcagcgcagcctacagtatgggagaaaatttttgcaatatctccatctgacaaaggtctaaaatctagagtctataaggaacttatacaaatttacaagaaaaaaacaaccccactaaacagtggggaaaggacatgaacagacccttctcaatagaagacatacatgtggccaaaaagatatactaaaaaaactcaacatcattgatcattagagaaatgcagatcaaaaccacagtgagataccatctcatgccagtaagaatggtgattattaagaagccaagaaacaacagatgctgatgaggctgtggagaagtaggaatggttttccactgttggtgggaatgtaaattccaccattgtggaagacagtgtcctcaaagacctaaaggcagaaataccatttgattcagctatcccgttactgtatatgtacctgaaggaatataaatcaatctattacaacgatacatgcacacatatgttcattgcagcactattcacaatagcaaagaagtggaatctacccagatgcccattagtgatagacttgataaagaaaatgtggtacatattcaccatggaatactgtgtagccataaaaagggaacaccatcatgtcctttgcagtatcatagatggaacatacttgaaccctggacatggcggttgtggtgagccattatcctcagcaaattaatgcaggaacagaaaaccaaacagtagatgttcttatcagtgggagttgaacaatgagaacacatggacacagggaggggaatgacaaacacttgtggaggcttgggggtagtgacagcaaaacaaaaatacaagaaaattgaagaatatacagatttcaaggaaagaggttcataggagtgtatttagtttttcaacccttctaagtgtttatggaacaatccctcactgcattgcattgtttattttaaattctgaggtcaggctaccagattattcatagatgagatgagtcaaggatagagtgatttactgaggaacaatctacttagcagtagtagaaaattaggtattttaaaaatagcattgtgacttttacataggcaaactactacttgcttagttgctacatatactacagcaaacattcttgtttgacccttatttgatactcattg

SEQ ID NO: 31762 - DNA, 1051 bp, Homo sapiens
aaatccacatggaccggtgcagttcaaacccatgttgttcaagggtcagctgtagtctcagaactgtttaagaatagtcttatactctgtttctactcagcagctcttgtattcttgtcagaatatttgatttttctgccatatggtagctgatggtttccactaagaagtttgttcatttgtctattatatttctttgtagctccttttttcagggtaattgaaaaacaagattctgtggagctgggtcagtacatttgaatcacacattttagttttttccagtaacaatcagatggcagctctggcaaaaacatgtctttcctgcctttggatgagttcttttggggtcttgtcctttgagatctcttttaatcctggagctcctacagtgtctccttgtctgtctactggtagggttgtcagataaaatacagaactccttgttaaatttgattttcaataaataatgaatactttttagtataagtgtcttaaatattatgtttgttgtttttctgaaatttaaatttaattgggcatctgtattttatttcattatttacttatatttatttatttggcaacccatttcctggactttttcttaactaaattttgggccccttgagagaaggagattgattgtaccctaattctataacttgttttcctgttcccatggtagatggataattttttactgactgaaaaaataagctaataaactgaaatgtttctttatctgagtatttataaagaaactttcttctactgagtttgcccttttctgtgaataaattcattgaaaaaaatcatgtttcaatgaataattgcagatcttaaccttaatttaaaaatttcatctccctttctcttcctttctcttcgtcatttctcttcctcttatctttccagctcttactataattagctagcattaacagcaaatgtttgctttagttaaattattcagaacatttattttacttgtcaaaggttagatcaggttgttgtttgaactggtaattaaatgcaggctaataggctt

SEQ ID NO: 31763 - DNA, 1112 bp, Homo sapiens
gaggaagggtaggcattaaatgagatactccatataaatatcaatatcatagtaagcactcaatagatgttctttttactaaagtccattttcaaggaacttttactatctttggccttttattccctagcacggtcatgatgtaagtcatagggtaaaagcaaacaaataaacttgagtgggtatctttgtttttagaagaatacaaggaaatactacgcaataatttaaaaactacagctgcctacatataacttcacagataagccttgaaagaatcatatcatcttaaaatttcaaaattaaaaaataagttctgttaaccttgggtgaaagtttagagttttataatttattagaatctgtaagtcaccagaacattattgccagacctgacttagtgtgccaatagatcaggttaatgggagctgtcgggtcatcagtgttccatagtgacagttgtagttcatgcagaagggaaagtggacatccttttaatattttgagtgattggcagtgttggggagtatggtagacattttctgtcctgaatactgctttggtaccagtgtatgttagtgcccattggtgtcaccaagcagggctatatgtaagcttttattctttttttttttttttttttttgagatggagtctctcattgttgcctggtctggagggcaaatctgctcactgcaacctccgcctcctgggttcaagccattatccacctggtgtggtggctcatgcttgtaatcccaacactttgggaggccaaggtgggcggatcacgaggtcaggagttcaagaccagcctagccaacatggtgaaaccctgtctctactaaaaatacaaaaaattacctgggtgtggtggtgggcatctgtaatcccagctacttgggagactgaggcaggagaattgcttgaacccgggaggcagaggttgcagtgagcccaaattgcgcgactgcactccagcctgggcgactgcgagactgtgtctccggaaaaaaaaaaaaaaaaaaaaggaaagctggaaaaatattatcttccactaacgcatcagaatatttgggagaatctgattgtgaatctccattttaataagc

SEQ ID NO: 31764 - DNA, 1042 bp, Homo sapiens
acagagcaagaccctgtctcaaaaaaaaaaaaaaaaaaccaaaaaacttaaagaatctttttggaactcttcctgtttacacctattttctttggagagaggatggagatagtccacagatctgaattttctagggaagtttgctattatttaatgttagtatgctaatttggtacttgaagacttacttaggcatttgtctgtgttcattccacatttatactagtgaggctcaggatgtattttggttccgtctggccaacctgcacactggctttaaggatttaagtgaggaatgccattaaaaaatctgattgtcggccgggcacggtggctcatgcctgtaatcccagcactttgggaggccaaggtgggtggatcacgaggtcaggagatcgagaccatcctgtggctaacaaggtgaaaccctgtccctactaaaaatacaaaaaaattagctgggtgtggtggcgggcgcctgtagtctcggctacttgggaggctgagacaggagaatggcacgaacccaggaggtggagcttgcagtgagccgagattgcgccactgcactccagcctgggcaacagaaagagactccgtctcaaaaaaaaaaaaaaaaaaaaaaaaaaaaatctgattctctcgtattatggcataatcaagagtaacattttgaaaaaagtctaggagttgtcatttagaatgtttaatcttaatgctcatcacattgactgaagcacagagcttagctatctacattttcagagagagctttcttttagtactgagcaccagggatcgtgtatttcggagtgaagataagtcagaggaaatcaatgtctgagctccatgaatcacacatttcaatgttatgagcgcatgggtatagaagacacgaacttcaggtttccaaggtattccattgagacagataagggagtcactttaattcaccacatgggttttgatacacattactgataggtatacttaaaggcattgtcgtgttgtataaaggttatgggttgtggaatatcacaaa

SEQ ID NO: 31765 - DNA, 1029 bp, Homo sapiens
taattgtggggtgctcatagtggagttggttatccgtagttcaagaattgggagaggaagtggaaactcacaccagaattttattgggggcccaggagtagacagacagttaatttagagctcataggcttttggtctttaagcaattgcaatttgaatcagtagctactttgtgtattatgtagaaagcttcatgtcaccctggtagtattaatcaggtgttttcttttggccatggcagtatcttcttatgttcacaggtacttaagatgttttctgccagtcatagtgtagtaaacatttccaaagtgtgttctatggtatattttttccaggagatgcttggagtgtaaagatcccatggtcacataaatccggaaagcactgaatactttgtttcccataagagaatcccattatatgttgatgtattaaaagacctgagaacctggtgtaagtaacttagttcaattcagtatttcccaaatttactagactatagcatcctttttttttttaagaaaaaaaaaatcttaatttttttcctttaacatgtgcacaaactgacttctttccacatttatttatcttactcaaaataagagatatggacaacttctgaaattgtgatgttataccacataaaacatactttccaatattgctacgcataaatggtactgataagactcttgtgtactgaaggggctacacatgcagacatttttgaggattggagtaactgagaagtcatttagaacaggggtccccaatcccctggtcatggactgggaccggtccacagcctgttaggaatggggccacacagcaagaggtgaatggtgagtagatcagcagcagcattagattctcatgggtgtgcaaaccctgttacgaattgtgtatgcgagggatccacattgctcattccttatgagaatctgatgcctgatgatctgaggtgtaacagtttgatttcgaaaccatctctccccagctcccttcccattcatggaaaaactgtctttc

SEQ ID NO: 31766 - DNA, 1038 bp, Homo sapiens
tagaaccagccacaaataaaatattccagcaaactgtgtaagaaaaaaaatgctctgggaagcaaatgccgagaaatgttacataggtggccttattacattggaaagaaaagaatgtagaagattagtagcagtagtagtaggaggaggaataggaggaggaaggtgcgtagcaaatgatagtgaataagctctaagtgttagttacttttctaagcactttatgcaaatcatattaatcatattatttaatcctcccaataccttatgagttaggtccccactttatatatgacatagctgaggctcagagaggttaagtaattttttttcccaaaatcttgcagccaagattcaaaggcaggatgtttggctctagaactcatgctggtaaccactatgcacactccctccatgaaaccaatagccaccatctattgatgtacagaatgtagtttgtgtattttttgtgtgtgaataattttgttaatggtaccatgggattttcctggatcaagggcatgatttaagtaagcaatggactaattcataggacccctggtgtcctaataaatcaaaacccactcaagaatacctcagcagtaagcacattaactgtcttcctagatggattgttttaaaaattttccatatctgcataaagtatattacgtacgataatttcacttaattgttctaacttttaataactgtcaagtagtagatgaaaggaaagcagaaaaatggtaaagtgtgggtgtggaattacttcactttttttttttttaaggctgagattgatttagaatttttgtatttcctggaagaatatcctgtggctagtaggaatatttgatttctttaatagattctcacatagtagggcctaatatctagctgattgaattagtattattctaggtatagaaataatgaaactccatagtttgttctttatgaaaatattttatttcaagttatttcttttctgcttgacaaaagggcattgcatttttgctttaaagagaggcttgtgat

SEQ ID NO: 31767 - DNA, 1079 bp, Homo sapiens
agaaagaccatgggcatgaggctaagacctgccactgagatgcttcctcctggccttaaccgtttttttttcctttcttcttccttttttttttttttttttttaaatagcggggctttccggtaaaaaccagaaagcctggtagacaaattctaaaagagcctgtaacctttgattcagtaacataagttccagtcttcattcaaggctgtggaggcaaacattcttctgtgatttgccttccttgattcctgtccaagctggattttccaaccttgtcttagtgttgtgaactatctagtacctagccaataaattcctttttgacttagattcactagaatatatgtctgttgtttatattcaggagccttaactggtacagtggtagtgttctgttcttctagccttgtttcttgaattgttttcttttgtcctataatgtgtttgctttgttttgagtggtgtcttatactaaatcatttttgggatgagaagaaagctgaaatgcaaattgtcctcttcgtctcgctctgcctctctttttgtctgtccctctctccctccccatcagaatgcaaaagaagtgaaaagaatttgtatccataccatcagcatctgtaattcttttgtaaaatttaactttatccatgcaattgaatattcagtgttactgttgaaaaatggcctttggtatcgagatctgttttaagaatgtttgcattttttaatacattatattaggtatctctaaaaatcattttctggccaggcacggtggctcacacctgtaatcccagcactttgggaggctgaggtgggtggattacgaggtcatgagattgagaccatcctggccaatatgatgaaaccccgtctctattaaaaatacaaaaagattagctgggcctggtggtgtgtgcctgtaatcccagctactgaggaggctgaggcaggagaattgcttgaacccgggaggtggtggttgcagcaagctgagatcatgccacggcactccagcctgggccacagagtgagactccatctcaggaaaacaaacaaacaaacaaacagaaaac

SEQ ID NO: 31768 - DNA, 1033 bp, Homo sapiens
ttatacatttatcttttattacattttgttatgaattcccctccctcccttttttctctttttcttttcttttttttttttttttttgagacagggtctcactctgtcgcccaggcagggcccactgcagccttgaccttcccaactcaagcgatcctccagcttcagcctcctggctagctggggccataggcacacagcaccatgcctagctaattttttgtatttttagaatagacggggtttcgccatgttgtccactgatctcaaattcctggactgaagcaatctgcccactttggcctcccaaagtgctgggattacagtcgtgagccattgtgcccggactttgttgtgagtgtctaacgcattttctagaggactgggtccatctatttcacttttttgtttgtttgctattttggccaactccatgcacttgttagtagctttgaatgtcttttcctttgtttttccatttcttttatggtgataatggggattttggaaagtaaatcactctagaaaatatggaaaattttgaagcattctaaattatgagactctattaatggtaattatggagtttcagccaatggaattaatgccaatataacaattctctgtgtacccagtagtaactctggaaaattcgggacaattcaagatagttttaaaaatataagaaagatataatttatgttagatgtgttcattatacaagtaaccagaaaaatgtacagtagggtagaaattttaaaaataggctgagaaatatagaaagtggaaggatttgtagaagcatgaaggacaaatgattagttccacagaatgagatgagcaaagtaatcaatatgtcggggtacattgttaggaatgatggatgtagcatctggttaggagtgacttgtgcaaagctgacaaacgtgatatgtgaatgctagtaagttgaatacaagttgggcacagagaagttggcttcttagtactgcctaaagagaaacatctatgttttgccccggttggtaaagat

SEQ ID NO: 31769 - DNA, 1020 bp, Homo sapiens
ttttaggctgggtgtggtgactcatacctgtaatcccagcactttgggaggctgaggcgggtggatcacctgagattaggagtttgggagcatcctggccaacatggcgaaatcccgtctctactaaaaatacaaaaattagctgggcatggtggcagatgcttgtaaacccaccgtcttgggaggctgaggcaggaggccatttgaacctgagaggtggaggctgcagtgatccgagattgctccactgcacttcagcctgcgtgacagaacgaggcctcatctcaaaaaaaagaaaaaaagtacttatgttttttatttcttgaagttttatgttttatatagatattattgcttaaaacattcttactgtatgctctttccaacagtggaataatctgtatgttaattttgccatgtcttttttgtgatggctctcttttgttgtgtgtggaatccttgaattttttttttttgtttctacttcggtagtatatcttggaaaggtgttggattgattaaggcttgggttgaagtcattttctttttttctttcttttttttttttttgttgagacggagtctcactctgttgccaggctgcctggctggagtgcagtggctcgatctcggctcactgcaacctccgcctcacgggttcaagtgattctcctgcctcaggctcctgaatagctgggactacaggcatgcgccaccatgcccaactaatttttgtatttttagtagaggcgaggtttcaccatgttggccaggatggtctccatctcttgacctcatgatccacccgctttggcctcccaaagtgctgggattacaagtatgagccacggcgcccggcctgaagtcattttctttcgtggagcatttgcctgtgctttctccagttgcctgcctagcagattaagaatgctttaaatatggaatttattggatctcctatgaaatttattggatcatacaagtagtgtgaatttagtgtgagaacctttgtgaaggcca

SEQ ID NO: 31770 - DNA, 1001 bp, Homo sapiens
tcgcgccactgcactccagcctggatgacagagcgagactccatctcaaaaaaaaaaaaaaagaaaagaaaagaaaaacacaataatttaaaattttgatgatacccagtttatctattttttctgttgttatttatacttttggtgtcatatctaagaagtacctatatttaaaacttaaacagagaaaaatacgcgagtaaagaaaactgacaggtcagaaaagaaccaggagacgacctcgtcagataaatcaagtaaagagagaggtttaagtcaggggtagttaattgcatcatatgctgcagggagtttgatgaagaatgggagggataggagaaacataaaaagtaggctgtcagaaagggtcataaatggcttttgacactgggatggagagtggtatgtatagccagtgataagctggtatctgctctcagaattactgactatttaatttatttatttcaccttaaaatgctgattccagggctctgagttgtgtggaattacagttaggcgtctcagagtggctctcctttatgctttatactgtttttcactggttattgttctagatgctttcttggttgcctgctcagcttgagcccttcttgtctgagaagtgatacttctgctccaatggtgggcctttgcagctatgtaagtgggactctcgtattcccgatacatagctgttaggaccatgagtaggactgtatgttaaactgggctaagtagttttcaacaatttaaaaatgatggatggcagagatgcaagtttgattctgtaaggcttttcttctagaaatacatgtaaaactgaggctgagacagccatagctagcctgtggtcattataaaaacagaggggactggcatgtgggaaacaaaatgatgcccactgccagggaggtctgaagtccctgagagatgcaatagccttaattcctggcagctttgcggttctgatttccagactcttgtaaagatctatggta

SEQ ID NO: 31771 - DNA, 1034 bp, Homo sapiens
aaataatactggacaaaatgggcttttctagttatgattgcttatgggaaataaataatatgctaacaggttttactgggtgatttttgtggtgctctgctgagaaacctttcatttttcagatactaaataacgttctagatttgtagtggaaaaatacataacactgcagcttctccttagtggtttgtcagtgtgtatggtgaccagtgttattagttgatggtaagctttcatttgaaacattgtagttttttttgtcttaaatagccattatcctttataaaaaagtttatttaagaaactataaattattgcagtattgagaggatcaatgaaaactttggtggaagcaaatcttttttgtaatttagttgattttatttttaaaatttcaatacttgatgataccaaggaattattgatattgttgagataatgacattgggattatgtaagaagaatttgtactttttgtgtgttttcggtatgtagtggtgaaataggtctgggacagttgaataactatagcaaaatttgattatttttgagtctgggtcatctgtctatagggttttttaattctatttttacttattttgtatatatttattaaatggtattataaaaatcaattagagattaccatgggctggaggaggagcattggggaatgattgtttaattggtgcagagtttctgtttggaatgatgaaagttctgaaaatagacagtggtaatgatggtacagcattgtgaatatacttaacattgatttgtacagttaaaaatggttacaatggtaaattattttattttatttttttgagttggagtctccctctgtcacccaggctggagtgcagtggcgcgatctcggcttactgcaagctctgcctccagggttcatgccattttcctgcctcagcctcccgagtagctgggactacaggtgcccgccaccatgcctgctaatttttttgtatttttggtagagacggggtttcaccatgttagctaggatggtctcgatc

SEQ ID NO: 31772 - DNA, 1049 bp, Homo sapiens
aaattattgtgaatacaattgctgggtcaaaagatctgcccatctttacttttcatttttttttgaggcagggtcttgcactgttgcccaggctggaacccattttctttctttaatgctgtatatattttcttaacctgactattgctggtaaatagaagagtttttaacttcttttgtgtatttattgtgtaaccagtcgctttttgaatctgttatttattataatggcttttcagttaattctcttagattttccaggtacataatcataccatctggagccagccattttttttaagggttttttcatgattaattttgacttacggaagttgtgctagaatgatttttcttaatttcattgacttgaaatacaatgttttgatatggtacctgtgttttatctactcagctctcaaaagggttttaaaatatctggaaaatcactctaccaaatgatctctaaggacccttctagctcagaaattttgtgattctacttttatgtcaaaagattcctggtaatgtacgtagctctcttcctttataattattgctgtctagctccaccccccccaagtgattactctgcacttttatttccttagaacttgaagattttttctgtgtggtttagcgtaaattaaaagagaaaactgacagactacagagctcagactgtgcaaaatcacatttcatgattttcttccggtaagatccttatggtgagtttactcatcaagctatgttcctgccatggactacttaaagttccccaagccacattttgtaattgtcagaactgaggttaatagaagtcattgggaagtgataaatagacctggatgcagtgaagataggacagaacgggagaggtaggaatggggaagcacctagtatgaactcttctttctctggccccctttctgcttcatgattctctctctggactccattgattctgccctcttactgattttctggcttcctgtttattttctagatataccttgtctcctttctttcagaaaattgctccttacctc

SEQ ID NO: 31773 - DNA, 1034 bp, Homo sapiens
ccatattaatctctttgaaaaaggtaatcatctctgtggttaatatcaaaaacagtgacttttttttctgtgagaggagaatgaaaactttaccttgtatagcttgattgcagatacctccttattaataatagccaatttaggaaaaaaagtcattaccaaaaaaatatttagtgccctggattatgaagggtgttttaaagctttatattgataattgatactcttcagtcaaagtagatatagggccatatttgaagatgtttgacttaagaggaaatttgtatatatatttcaatattaattccttgagaactaacttttgcacatgcaggcatgaatttattttcattggtcattcttaaaaaccacacacacatacatacacagctgcatttattttttaatgattatgcattggtatgactggatgtagtgtgttgatttcaaagtgtatgcatttcaataaaagcaggtgcagagggtatggtgtgagtgtggagtatgaaaatacacatgctaatgcgtatgtatagacaaggagctctgcagagttaaatcacacatcacacatttgtgtgcacctagtacaatgtgcagttccaactccaacttttaaaacattaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgacttagtgggtgcagcgcaccagcacggcacatgtatacatatgtaactaacctgcacaatgtgcacatgtaccctaaaacttaaagtataataaaaaaaaaattaatgtaaaatatgtacatacaaatacaaagttacatgatagggtcagatgaagatactgtttcttataaacggcattaagaccttaatatgatagaaaacacttgtatgaattgagggttattttagtcattgaagctctgtataact

SEQ ID NO: 31774 - DNA, 1073 bp, Homo sapiens
gcaatacaccatacacattttactgtacagtaagggttttattttgttgaatatgataaagtactccagtagcaagtatggctacaggggccctaaatattatagttagtagaaagttcaccctgtgggcaggtaaattccttttatagagcaggggccaggaggagtggaactggggagccaccaggattttgcctggggtgttgaataagccctgcctccaatgctcttaggacgattgtctaatacttgctaagcaaatgtccatttggacttggattcttagaaccagaagggattatccttcctaggctcctccttttgataattgaaggagccagtgtccctggagattaaagtcacggtgcaatgactaacaagaaagtcctgacttgctaagcctatgtccttgcctgacaataaattttaaagtgctgatttagctacttgggaggctgaggcaggagaattgcttgaacccaggaggcggaggttgcagttagccgagatagcaccactgcactctagtttggtgacagaacgagactccgtttcaaaaaaaaaaaggaatacttacatttgggtacaataatgttttctttgatgatattcataaggttttcttcagctgcagaaattccataagtgggcttagtttgatttacaactcatacctttatttctgttatcactttcctatcataaatctgcccaaatcgattgacactaatttattaaattctttgtaccatgtgtttttttatttttgtaaaatgttctaagacataagaaacacttagctcattataggtctgaggttagatgttttgttgttacttttgtttttttcggtggatgtggttagataagttggatggtgcattctgaactgcagctaaggagagaataaacactgatttggggacaagagagcctgtagtcatgaaacttttgaggatatggatttgggaggaaaattgggaatttaaaaagtaaacatttttatttataataaaacattaacattttgatgcttattttccctggagttttagaaattgcatttaaaaact

SEQ ID NO: 31775 - DNA, 1069 bp, Homo sapiens
ggatgtattctaaaaatgcagtttaattgtaggagggtctcagatactccaaataacaaaattactaaagtctttttgtgggtttttattaacattttcatcttatttttcatgtgcatggtttctgtctgataggtgctaaatgaaaattatggctgagatgagaaaacactactaagaaaaagggattgaatggttttatttgtttaggcgattttgccagaataccttcaagccaaggaaggaatcgccagtttgcatattgctatttttgctgtggtctccccaagttgtcttctgatccccgacgggttctttctctggtataaaacagctgaatgaatgacaaaaatattggcaagctctgcggcttgtttttcatgcctagcctattggtacctccgaatgagtttgtgagtttttctaagtaaacctaaagggttttgtcagacctagaatctcttgtgaacagttcactaaagctttggtgaagactcacatgtagaaagatgtagctgttttattgccggcttttgttcagcagaaacaagcaaatagagaatctttgaagggcctctctggtgtcagtaggaaatcctgatttttagctacggttggtgtgcactaagtcatcttcagaagttggtaggattctgtgagtccagaggacagagcttatagaggcattagtattgtaggactaattgtggatcctgggtgccctgttaaagtaacccttgtcatcatttatgctaaagatgatacccttctggcagtttgccacagtacaattcagatgcatctgcttttaacccttttccgttatcattggaagtctgacagtgcgctgcataaacaccttgagtaccacagcattccgtaatatcaatttctagaagaagcctctttctaatagtagtgtggccggtgcttattaatcatctagctactgagttactgtattggattaaaatatataaagagagagcacaccaaatctatgcagattcctttatcctagtatgtcagtttccttttctatctctcatttttaccttatttactgtaa

SEQ ID NO: 31776 - DNA, 1021 bp, Homo sapiens
aaaggtgggaaatgtagcctggatcgggattgttaggtgagttcacatacacctgcatgatcacactcgagtgattttgatctttagcatcttgcaaattggtatccagcatcataatggaaagtttcatcctctccctcatcctgttcaatatttttttcaataacatgaatatgagaaaacatataattgacaaattcgtaatttataaatgtaaatcttagaaggaataggtaacagtaaatattggaactggaataaaaaatgcctcacaggttaatacaagggtagggggaacgtcctataaaattaagcccacatctacttcttgacctaacaatttcactatttggtattcacataagagaaatgaaagcatatgtttacaaaaagacctacaaaaaaaatgtttatagcaggcttattgtaagacccaaacgtagaaactacccaaatgtccactaaacttgagaagataaacaaatcgtggaatattacaatagtatactcttcagcaataaaaaggaatgaacttctgatacatattacaatgtggatgagccagaccccaggaagtacaaactgtgaccccatttatatgaaatcaagtaacacaaaacgaatctatggtgacaaaaatcagaagtggttttctggagacagggaaggagaattgacctgaaaggggcacgagggaacttttcttaggtgataagaatgtcctgtctttagggtcgtgattatactggtgtagacaattgccaaaagtcatcaaacttagcacctaagacctatgctttttaatagagacagggtctcacaatgtttggccaggctggtctcaaactcctgggctcaagcgatcctcctgccttggcctcccaaagtactgggattataggcatgacccaccacacctggcctgactggtgcattttcttgtatgttaactatacctcaatttttaaaaatgtttttcgttttgagatggtgtttcgctcttgttgcccaggctggagtg

SEQ ID NO: 31777 - DNA, 1044 bp, Homo sapiens
aatcccagcactttgggaggccaaggcgggcagatcacgagaggtcaaggagatcgagaccatcctggctaatacggtgaaaccccgtctctactaaaaatagaaaaaattagccaggcgcctgtagtcccagctacttgggaggctgaggcaggagaacggcgtgaacccgggaggcggagcttgcagtgagccgagatggtgccactgcactccagcctgggtgacagagcgagactccatctcaaaaaaaaaaaaaaaacagtttctcagtccatgtaaccacctttcaaatgatcagtagccatatgtggctagtggttaccatattagacaattgaggaaatattgaacatttccatcatcacagaaagtacagttggactatgggccaaatctagcacaccacctgcttctggatggtcttcaacctaagaatagtttttacgtttttaaatagttgaaaaaaaaaaaaaaaagcaaacatttgaaatcaattttaatgatagaagcactaactttgaactccagtaaagtacctacattatattcttgagtttgcctcttggcctacaatcctaaaatatttactttctggtctttaccaaaaaagtttgccaactcctgctctagaccattgagtactttacttttgccttaaagatcattctggtctgacactctgatctagctttgatccttaccttcccttcatccccaaagtcaatcattatcctaaaatcagtgttgaattgtttgtatttttagtgttcctatagtcttgctgtcatatttgttcataggcttttaagtattgttttatatcttaacattttataggaatattgtacacatcattttacaactgacttttaactcaatattgtttttgagatttatccgtgttggcagatgtagattattttcatcattgtacagtttattatataaatcagacttattcatttcttcttttgagacacaattcatttccactttattatttacaaattagtgctgcagtgaatattctgcatctttgta

SEQ ID NO: 31778 - DNA, 1020 bp, Homo sapiens
tttggatggactcctaacaagtgtcatatcaatagggtttctctagaaattttgtcttgggagaaattgaacagtttcaatattcagtgtggcatgaaagggtagagacataagcccaataactagctttattaggtgtgagtatgagaagggtttgttggtctccccattcagttagaaagaccttcactcattcctctcaatatggcaggctcccttaactcctgttgtgtttgatgtcctgaatttagagcatctctggtacaatatattctcagaataagcttctaatgtctagtgctgttccgggacaggtggcatccaagattcacaagaggaaaggagggatggaaacataccagcacattgtgcagacttttaaaacaccacctttattttcagcagcagtccccagtttaacttctgaggtacagtaagtattttgtttgttttatcagcagcttagatcagaatatttggcatcccttctgccagcacttgaaaagcactttgaaaagagataggagagctgatgacatttgtgttctagcttccaaaagtttgttgatattagtccacagttgtctgctttcccattttgtttattcctgtttcttgacaacattcagaaaacttcactatgtttaatttttttcttattaaaaaatattttttcttagaaaatttagacagttcatttgctttcatcttttactctagttgaaaatttaccaaactccactcacagcttcaagttatgtagggatagattattcatatatctattactgttaaaataatattcttatgtccattgacaactagactttcctagtcctcaaaggatacaatttcagagagacaactacatgcaaggtaaataatcacagatcaatagcatccttatatttcagcaataaatgcatagaaaatagtatttatttgtttttgtttttgttgttgttattgttttgttttgttttgttttgagacagagtctggctttgtcacctgtcgccc

SEQ ID NO: 31779 - DNA, 1052 bp, Homo sapiens
agtatgtgattcccctagaaaactggagctctggcccactttcatcctgccagcaaggcatggccttactggagcacagggagctcaagctcaatgtacagacaggaaggaagacagtagtggttccaagatctgatgagttcactgctgctcctcagagaggcctttgacagttcttgctgcccattgtctactgtcacatcgtcttgtgtaatctttacgggcactatctgaaaatctggtttggggtctcttctcctccccgagctttgactgctgtattctgtcacgcgcagtgtctggtgtatagtaagcattcgtgtaaaatgttcctattggcacatactttttttgtttttggcccatacatttaacagacacttagcagtcacctttttagtattgtgaataatgtgaacacaacaattcctgttctcatggatacagaactcccacagctccagctgtcttgttttgaagtactatgttgcaaatctctcatacatcaagtgtagccaaactgaaatgcagactcattgaaaccagtctgtatcctagatgccaatttcccaagtccatcttccattcatacctgagctaatttttttttttttacagttagcaaactacagagcatctgcattttttttttttttttttttttttgagatggagtcttgcacagtcacccaggctggagtgcagtggcgccatctcggcttactgcaccctctctgcctcccgggttccagcgattctcctgccgcagcctcccaagtacaggcgcacaccactacgcctggctaatttttttattttcagtagagatggggtttcaccgtgttggccagggtggtcttgaactcctgacctcaagagatccacgagcctcggcctcccaaagtgctgggaatataggcatgagccagcacgcccggccgagcatctccatttttaacaaaaatgcattaaggagtaaggtgaaatcctaatatccagtcacacttgagaatcagtttaatgaagcaggtttgttaagtggaacaattttc

SEQ ID NO: 31780 - DNA, 1028 bp, Homo sapiens
attcagctctttgtttgcctagttctggaaataacttcttataataagactaagatataaaactaaaggtcaaaactaaaggtcaaaactgtgtaagtaaaagaagctactgccctttaagggaaaaataatacatgttaatttttgcagcaatttcaattgaatgggtttccagggaaacaggtatctgcaatgggttcatcccacttaatatttaagacaaaacatagggaatttctttcttgttaccttttccttgttatcttacacacgacatgctcattcttaaatttcctttgaagcgatcattctatgcttgagtcttatttgttctcccaaaaaaagaaatgaatgcccgttctatgatttttttaagactttttgatatcaggaatataagcctggtgatcactactaaaaaataaaattatgcaaatcaatctgacccccttttttaatgaatcaaaagctatttgttattacttgttttattgaaaatctgcttactttctgagttggattctgtttctaagagttgaagtggaaaaataaaattggtggcaaaggaccactaagtcttcaaggttgagtaaattgtacgttttcttggaagagctcctcaggcagacctataaattcctttttatattttgttctaaattaatctcaggtttaccaaaaagttgtaatagtgcaaataattcccatacccctcacctggattcaccaattgttaacattttaccatatttcttttctcattctctgtatgtgtttgtttgcatatatacatattattattatgtcatttgcaaaccatatgagagtaagttataaacatcatgcccttttaactctaaatacctgctaaaactaaggaaattatcttaggacaccatagcacaattatcagaattgggaagtttaacgttgatgcctactattttctaatctacagactttatttacattttacaaattatccttcctgccacccccttggagggggagttgaggtgaggaccaga

SEQ ID NO: 31781 - DNA, 1048 bp, Homo sapiens
ctttttttagaaccagatatgatagactaattaattggctcctaataaatagtgtgcctacctaagtgattattaaactctatcagttaattgtaggaaagtaaagagacaactgtttacatccagatagattttagctctcttgagaagtttcatcaaactccaaccgtacgtggttacagggttgtgtatcacattctgcaaggtacagtaatgtgccaattcaaagactttgagcaatgggctggaggcagagggtgtaagcctaacactttgtttcttgacccagtagccaaagtatgctatgccttagaaaaaaaaaacctgagatcagctgttctgatcaccttgcaaattttgtgatgcagccaccaccattcctagagtcgattttagccagatacatgcaggaaaatacaaagaatatttatgctatttttctttgggataatttttcccttgttccccagcccatttataattcctgctttcagggaatctatatttatgacaacccaatcatcttggcctgtgcactgcatctcactgtgaggaaccagagccctctgtggaaggcagctttatagaggagaccacactgttgacagattcctgcctcctccctgtgggtggtctgaagcaaggaaatctgagctttccagcgcaggcctggcatgtgccaggaaatttagattcgggggagctgctatctattacagttatgaaccttctgaaaaccagaattgcaggtaaccagtattccttctgcatgccaaagcaaaccccgggcccttaatcttcaaatgactggactattaatattaaaatggtttctattatatagcctgggtaaagatttgttagtttctgaggtaaagcaacaacaacaacaacaaaaattgaaggacttttactttgaaacatgtctaaattagcaagaggaggaagtatgtttgttatctattggaagaaacacttttagaagcccattgggggaggagatagactcagatttcttgggagtcagcccagtcttggaaaaaaagtt

SEQ ID NO: 31782 - DNA, 1063 bp, Homo sapiens
acaccagacctgtaattatgccaaaaatctatccaagccagataatattttgttttttcttattactacttacagagcatgaagttgtggaaagtgttggacttgcaaagctaattttagtcccccagtgaaagttctgaggggcaactcaataaggtaaaattaaaggtatatgaatcacggatttcagagtttacagagacatttagtaagcatctgatctagccatttagctttaggatcaaccccattttgctggtgaattagccatggcttacaacaatgaaatatatatagacctacgattcaacctggagatctgtctggccctacagctagtagcactgtgcctcgtttgaaggagttggacgcctgtcttttgccttcctgcaaggtgtttttttcattgcatcatgctattgccagtctaccttgaactctttttgagtgtttttcataagcttttgctgtttcatttatgtttaatttgtgtggtatcattcaatgactgtgtccttgcaacagatattttgatgtactaaatttgtacacatacctgagttgggaaaggagatgcattttgttttgcataaaaaaaatctaggtctcatgtttacatttaaaatatcaggctttgtttccactaaagtggtaatctttctaaaaatgtccctcacattgaaggacatccaaaaggcagtaactcattagaaccttgggttcagattacaaatgtgtttggctagctcagtattgaagttcaaattatcttggaattattttaaatatttgtacaggaacactgattagtttactaacgtgttgcctatccactaataaccaccttggcctatggtcattaactcctagggctcaagcaaactctcagcaaagagaatttgcttcagtgtttgaagccgtcatttggtgtcttcaccccaggacttggaagtgttgactcagaaaaggaatttgaaaacagtttttataactgcattttattctttgagcagaagagttgagagaaaaaagttctggtgaggtaacgtcctcccctaccttc

SEQ ID NO: 31783 - DNA, 1073 bp, Homo sapiens
tactcgggaggctgaggcaggagaatcgcttgaatctgggagacagaggttgcagtgagctgagatcgcgccactgcactccagcctgggtgacacagcgagactctgtctcaaaaaaaaaaaaaaaaaaaaaagtacatgtagtggcttgtagctttcagctgtttcccaggaaaatcagaaaatcttcaactgaaatatttggtaatttagacgtcattagtaagtggataataaataattaaggttagacttgtcatagctcatatgtatcacaaggaaatatttatggagttttgagcctgtgggtcacttttcctataacaaaacctgggtgtgggaaaccaaatttttaaaagttatattatttacatatttttatttcaatttgaagaaaaatttgtctaatttttagaatgttttcctgcaaatataacagacttcataatgcacatttatgaaggattctgaaacaatagcaaggaaggagaaagagctgcatggattaatcctgagctgctgcagcacactgactgcatgtcagtggcactttaagattgcaacattttgtttggtgaccttcacaccagttgactgtatgcaccttaatctctctctcaaaaaaaagctgagcctactatagattggcatctttttctttttaaccccagtttttcatttacctacactggtttacctacacctggtttaatttgtacagcagaatgaagttctttattacaaagctcagaaactcgtctttgagtttttaggaacagtaagtacaaaggttgtcatgaattgagactgaaagacctcatagataaattgggtagtacatttttaaagtaaagaataaataacacttcagaaaaatgtagaatacgttcataaatgcacaaatggagataaaatgtcactttttgtaatgaggtttctttcagactttgacactcgtaagtaaatgttcagaggaaataaacgtcagggcatatcagcttttgtgagggttgccaatgtgtaaatgtgaggtctactgtaaatcgtgctgtccatttacctgcctctctgca

SEQ ID NO: 31784 - DNA, 1031 bp, Homo sapiens
gcataaaacatgtatacagttttgaattaaattttagagatacatagcctctagcctgcaaacccctacaattgaccagtgaggctcttatacttctggggggctttacaactttccaggcttttggaatcttctgctaaaatgcaaatcttctgctaaaatacaaataaccctgtaagagttagatgaagttacataaccttatgagagaacacatgaagtgcttatcaactaaaattgtgacgttttgtctggagcagaatcttagtaaatagaaactaagattcctggaagcacttcttacaaattttaccttttccccatcttttctatgaccaggcagttctggatgaatcctctaaaagttttagtacctgacactcagtcataactacagcataactctggagctacaatctcatagacaaataattctcaagatagccaatcattacttagtgaattataaagttaagctttatgttctcttccctttaattacagtagattaaaggaatgaaagaaaattgtttaaatattagtctgtacaaacatgttaaggaaatacaaagaaatctggttcaaaaataataatcatgaatattacaaacccaacacagtggtttgaatgtatcctgtcacttttcccattgctgataaagataattgagggtaaactttttcagtgcaatttgtctgatcatctctgaactctgtgatgttcctgatgatgtttgctttataatttaaacccatagattcatttacccagtatggtatgaaacaagaaaaaaaataataaccttctcgtatttttagaaagatacatctcggatagataagcctgtcactttaacctttccattttggtgtttaaagacagagttcaccagataatacattctcaaaagccatttagaaaatgtgctaaataaaatgtccttaatgagcatagaataataatcttttagaggaagtggaagcaaagaaaagaggacagcaggtaaaacattaggcactgcctaacccat

SEQ ID NO: 31785 - DNA, 1033 bp, Homo sapiens
taatttcagaaataaaggtgttacatttttcaggctagaacttggtaaatatgaaaccaccaaggtggtgaattactgtatgtaatctttttcctccaaaaaataagataactggtcttacacttaggttagcattatgattctaattttaaaagcaccattatttgtaatacttcctaaacataagcgaagtttaaggagtgatagttcttaatactagtctttacttcctttcataacttttaaatctattgaaaaaaaatctagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaactgtgttctctgtctctttactgaagataaaggtgtagtaaaagctcccacacacctttaaaataaatatattttattctttgccaggagactccatggaaaaaggtaaacagtatatgaacatagaaagcattgttaaacaaacaatctcaatgtacaaacagagccagtgaaagtacatcacagacttgctaatatatcaaaaaaaaaaaattccactagtgcttaaatgagaactaagaaactgacacttgtatctgttaaccactctaccaca

SEQ ID NO: 31786 - DNA, 1135 bp, Homo sapiens
ttgcctttacattgccgccaagcagagagaaaccatttcattatttaaggcgactcaatttttttttttgaagatagagttttgctcttgttgctcaactggagtgcagtggcgcaatctcagctcactgcgacctcccgggttcaagcgattgtcctgcctcagcctcccaagtagctgggattacaggcatctgccaccacacctggctaatttttttatttttagtagagatggggttttaccgtattggccaggctggtcttgaactgctgacctcaggtgatccaccccgccttggcctcccagagtgctggcattacaggtgtgagccaccacgcccagccaggcaactcagtttctaatcagctataagaaattccatttatataggactctcttcagtttggtttgttggtaagtatattgacctgtgaaatggaaatttgcttactaggaaaaccgtcttcagatacagtccctaagcccaagagagccccaaaacagaagaaagtagtagaggctgtaaactctgactcggattcagaatttggcattccaaagaagactacaacaccaaaaggtgaggattatcttcttataaccctttaaacatatgctgtgtggaaaagattgaattttttctacctcattgaatttagagaggctaggtatctattttgttttaaattgctttactcctcagtaagcagtgtgtctaggaatcagtgctgaatatagtccaaaggaggcatagcaatttagttcagtcactttgttttacaaattaaaaaattgaggctcaaagaggttaaataagaatccctaagaatggtccaaattctcccctgcagccaactcactgaaagttgttattaaaaagtcagatcagtactccacactaactgtgacacttatagtaatgggctagatccaggactcttaggctagaactttttttctcacctaagaaataactgtattcagggccacacaaggaacagcaccagttctccatggcatcccctctttaactccagaatctggaaagcccttgaagatgttttgtaaaatatgtttgtaagacatgatatgagggtagctcatgctgtgagggtagctgctctacctttta

SEQ ID NO: 31787 - DNA, 1032 bp, Homo sapiens
ttgagacagagtttcgcttttgtttcccaggccagaggctcaccgcaatctccgcctctcagattcaagcaattctcctgcctcagcctcctgagtagctggggttacaggattttttaatggtatataaaggcctgcctgagctatagaaacttattttgcaggtaccttttagctagtggtctggaaatccctctgataatcaaaagctgccttcttattttttatggttgcttctaagtagctgtcatttcactgaatgtactggaaaattaagagttacatgcaatattatttactatagataagtgaagtaaaacatggtctgatcaaagtcagctgttaggacctcatcagaatcactgtttttaaatttacctgatttgaaggcgctatctgttgattgaaactatctctaaaatatgtgatgtttttatttttactcgtggcttgattttctttttattatgtagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtgagaaatgattatagttttgcatgtgtgtgagagaaaaaatatttgtatagagtattactagattcttttgattgtgctctttttctggtagttgaaataatgccttcaattttcataaacgtttattttgtaatgaacttttcattataacaattttatttttactaatgacatttctataaatatggatacataccttattgctattcttttgctttaggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcaggtattgtaacacatttaatattactgtat

SEQ ID NO: 31788 - DNA, 1928 bp, Homo sapiens
gttatctaggtacttattaatcatctatcaactcaacaatagcattccgtatttggctaatgtggcttaatcaaatttatagtttttgtttatataatgaagcatcttgctttgcagttttaatttttatcttacttctgaagtacacgtaaactgtactttgtgtatatacattgttttgcttacaaattttaattataaagctttttttttttttttcctcttttggttaccaaaagtaaactttttgctttatggagtgtcatggttaactcagtcattttaaattaaacaacttagataaaattttatttaatggctattgttattttaaaaaatttaaaggtgatatcacctaaaataacttttattaaattcattgtattttgaaatttaatattagcacaaaataatttttttgttgcagctgtttctatagacaagggcctgatgaataaaatttcagcaaaaccctgacgaaattcttactctaactcaccaactcttaaattcttaagtggactttctctgagtcctgacatgaatattctggctttagagaagtttttattaagaattcaccctcagcgagtgaatgtaccttaacatatttattataactgtaaaataattttcataactggtatttattttgtatttcagattgttcattcactcaccagtataaaaatctgacaagatgcagtgataaaacattaattctactctcttaactttaaaatgtggtatcctctcattttgttactgagtacctgaggaaatcagttaatttttcatcagattcctggataaatagggatagtgtataccattccttctgaagatcttattgtgcgtctttagaaaattttaaactttttataaggaaatatatttttataggtaatccaaaataaccccaccatcctgaagatgtagcatttatagtgtagcacttgtagaattttaaactaattattcaataaaattcaacattaatttgatactatacaagactttaatatacagtttgttattttttacaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagtatgaacttttgtgggttaaatagtttgaaactatttcagtgttatctgtatctttttctttttccaaaaataagtattttgatttatccttcatatgttttaaaactattgaatgtttaaactgtacttttttattataggggcgagaggtcaatgatcttaaaagaaaatctccttcagatctttggaaagaggatttagcggcatttgttgaagaactggatgtaggttaagtctctattaaaatttatttggaaaagtcatgtttatgaacaagaatgaaattcttttaagtgatcttaaagttttctttaactctgtgaaggttaatatgtttataagttgagttaggcttaagcttctagttatgtgaagttataaagaacttcttgtatggaggaatttaaatgctatgaaattgaaatttagaataaattaaatctgctttcaattagttaaaaatttttaactgagttttagattaaataattgattcagtttaatgttttcctggaaagaggtaaggctaatatgtgtgtataattgaatgtaagtactttgattttaggagtagaatgatagtctctacatttataacagacatttcaatatttgattgttataacatagttttttccaagtagaattctaatttaaaaaataaaaaaaatgtagagatataaaaagcacaccttttctaaaattgcccaattaaaatattgga

SEQ ID NO: 31789 - DNA, 1031 bp, Homo sapiens
tgtgattcaagttccattccaaattagcttttagatctaaaaaagtaaaaaaagttcagcagtagtacagtggctgagaaaaagtgccataatccgctgagaaaggctgatggaagaaagaaaaaggatagagaggagtttgggtgactggattatagcacaagtaaatgtgaaagcgagagaaaggggacaaatgcgtatacacagaatatatgggggaggaaaaacttgaacatttttaaacttagcaatagaatatgtatgttttcagtttggggaaaaatcatttttgtaggtggttttatggttactttaagagccctttttttaaggcctatttttgtctttcaatattattcctaaatacttttgttgtgagaattgaatttattggcttgcagtcaccaaagaaatatttacagaaatgtgcttaatagtcttagttctgtttaatggtttttaggggtagtctgtgttcacacacatgcattatggttatatattatggttattttaagtattgtagatgttatataagttaaaataccagtacagatctatatgatctgcaaagtatatgtgttttgcttaggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactataggtaagatacaacctttaaaaatttgaacattagttaaaatggaaaaaaaactttattaatagaagacatttttatcagtagaatataagcaaatacaaattgaatctcttatcttgatcctaactttatttttccctcacatagagaataggtcaaagaaagatttgattcaaatgttagtccagagaggttatgaatctgacccagtgaaagcctggaaagaagcacaagaaaaggtaatca

SEQ ID NO: 31790 - DNA, 1048 bp, Homo sapiens
ttggttgataagtttattaatatagcatttctctttttatattttttccttgtaatttatttgttaaagaagttgggttgtttgttctgtgtaatattccacattctggattttgttaattatattcctctagttacatttaatatatagtattttcctttgcccttattttctgttaactgatggttaaatcagaggcgtgatcagatttgggttacatttgtttggcaaaaacatttcataggtagcgttgtgtgctttcatcaggaagcatctaatgtctactttgtctttagttgcttattaagattgatcacttagtataggtgttgccagcttgatccatctattacaacttttccaccagctttttacttgatggttttaaacagacattgatattcatgactcacttttatttttaaaattgtgcaggattgggtactagtacagctaaagaagcaaaggaatattttgctgatatggaaaggcatcgcatcttgtttagatatgctggtcctgaagatgatgctgccattaccttggtaattaagttaattttttaaaagcttttgttagccatccccctaccttctattcctttcctcccagtcctggttccctatgataagtctcttttgaatgctcaagctagttaattttaatttttcccccagatgatgctgtgcttgtataaacttctttaattgaaagaccttagtttaaatgtgtttttgattaaaatattgtaaaataacctaattttccagaaattaagaattagttattggccacttatacattttaattttgtaataaaatttattttatttttaatgtgcaaaatcgttacctggaatctttcaggcatttagtaagaagaagattgatgacagaaaagaatggttaacaaattttatggaagaccggagacagcgtaggctacatggcttaccagaggttagtcttaaagagtggtgacctggggaaagaaggagagagagactagaattcatgcagtaataatgataatattgctatataactt

SEQ ID NO: 31791 - DNA, 1072 bp, Homo sapiens
tgcatagaatgaagatgtataaaaaatagtagcattaaatcagaaacatagctgttaaatttatcctgtttttaccagcatgccttttgtaaaatattacattcatcctttgtaatttcattagtaatttagcatgattttaagatttttctctagtaaacataaaaatctaataattcaggtatagtcttactagtaataatctaatttcagttaagattagtagtataataaaactataatttgtatttggttataccatgaagttaactatattttatatgaaaatgttaccatataactgtgctgtcgagattatttatttttttctccatttttttttaaatttggattatttctataatgaatgcattcttgagaagttatataaggcatacaagacataagttacaacttatacagaagtttaagatggtttcaaggacattttggctgttaagattccttttccttatttaggcaattgtcagttaaaaaccatatctcccttcatttattatgttttaggagagtaaggagtaatagacactgaatgtttgatatctttgaatttttttcaaaattgaacaactctaattaaaactaagaaagaaaggaccttccttaaatacactcttgatgaacatagttgcaattgtttagttcttttatgtggttctggccatattagtccaaagattttagccacattaatgcaataagattgaatttaagaaatagtgtatagcatgccatcataacaaagtgataaagaagtgagctaagccaggtgcggcagctcacgcctgtattcctggcactttgggaggctgagtcaggcagatcccttgagcccaggagctcgagaccagtctgggcaacatggtgaaaacctgtctctacaaaaaacaaacaaacaaacaaacaaaaacaccaaaattatctgggcatggtggcggcatgtgcttgtagtcccagctactcaggaggctgaggcgggaggattgcttgagcctgggaggtcaggctgcagtgagccatgattgtgccactgtactctagcctgggcgac

SEQ ID NO: 31792 - DNA, 1117 bp, Homo sapiens
caagtggattcatgtttgattttcaacataaaatggaataaccaaaaacaagactcattgcaagtaccggtttaccagcaacaatttgagattccttgaaatacagctgctttgctgggtatctgtgggaatgacggacttcagggtgcttgctgtatggtgaactgaacttgagtgaatcttagcagcctcagtagaacaataattttaagagtgtattaaagaagagcttcaaacaatatagtccaaactgaacctctagggagccatagcagcctgacatgtagtaatcaaaaaatctttgagcaaaatcttctgtagaatattagttacataaagccaacatgcaaattgttctcagtcctgaaaatagtggttacagccacaacctaaagacaagttctatttttatatattgtgaatagtatggcttatgcctaaaccgtagacacacaggtcttgttctcacgcaaagggtgtatatgctcatatgtgcttacaacaaggagcaaggatgggtcactggtgggaggaggggttgggtggtatatatagaatacaggagaaaacctccatgatttctgactttactagcactcctgctaaagtaggatagcaacactcaccttttagagacctacacattacaaaaccgagcttacagaatgcacacaataaatttaaaaaaaattttttaaagccaacaggcaaaaatatgtctatcaaataactcacgatgttaggaacaatcaacagttgtaaaaaaaattttttttctctacactaaacaagtgaatgtttgcttttttttttccttttaaataaattatagttactgattgtgttcatattatacatagtgggatcagagttggaggttttttataaattctattgttgtggtacattttaatttactaaactgagtatacatattcttggtaactttctaccacctctaaaaatgagtctttgacagaatatattgtgcaaaaaaagatgataggaattttctgtataaatagggtgttttatctccatatactgttctttaacataagagaccttttttattttgctcatagtatgtttgaatgtttaaacatttaagtattaa

SEQ ID NO: 31793 - DNA, 1021 bp, Homo sapiens
gaaggcgtgcttcagacactgccgctcttctcgtcgtttaacggcctcagatatcgggacacaacggtaaccgcaccgcgcgtgtcattccccctgcgtgcatttttcgagcggagtggcttacatttccacatacttatcagaagttactcactgacaaagtgatgttttcttcccatgttgagactatccgagtactaaagcataatgcttctgaagtggtgggttttaaaatttttaattttttttctgcccacttttgttgattgaaacattatagtattttgaagttacagtttttatattaatacctggattctactatgtaacataaccctttaagaattcgtggaggtaatcgccttggatgagagtaatttccttcattctcctgtcagcaaaattgcacttctagaggtctaagggaccttgcagattttgggaattgggaggcaagtttgattattcattttgaataagtacccacctcaactcttcagatcaaatgatctgaagggacatggtgtgggggggtagggaaatggaactgaggttaaaggagagccacttgctttaggggtgttacctcatttatcaggtcaccgtgattaattaggttctctgttcccctcagcccctggtgcattaagtgtttggtatattgtcatgaagtctaaaaggaaattctcagtttcaaggttataggtttcacgtgacccaattttagacattagttacatgtgcagtttttaaaatccatgtcagtaatatttcatttaggcaatggtaatgatttttaaagtaaattgaagggaaaatatattgagcccttattttgtggcagatgctatgaaagatgcaacatgtggcctgttcacagctacataattgtgacctgtgtggggaccaccttcgtgctctgtgacaccttctcaactcaccttttttactctttgaggccttacagctcttcacagtacaaggatgccaagggactccataaatgaactgataggctggg

SEQ ID NO: 31794 - DNA, 1046 bp, Homo sapiens
tcatgatgctgtgattctcaccccaccctctgtacccctttcagactaacagcggagttgctgcgcctactttgtgcagagccccaggtgaaagagcaggtgaagctctatgaggggataccggtcctcctcagtctgctccactctgaccacttgaagctcctctggagcattgtctggattctggtacaggtttgtgaggaccctgagaccagcgtggaaattcgcatttggggaggcatcaaacagcttcttcatattttacaagggtgagtaaaagtgggctttggcctactttgccctgtttgttgaagtctggggactctgtgacaagatggcagattggtgtgtgtcacctcattccctcctgctttgggatttctttggtaattcatgctttccaaagtcatctagacttgtcacaagcatgttctaaatcaatgtcaggggcattcatcttttaaattccttggggacccagatatatttatctttgcatcaccaacctccagtacagtgctgggaatgtagaaggccatcaatctgcaaatataatgaaggctgaatggaaatccagtaacctaaaaaaaacctttgtcttgccaccttttccttgaattagtatatgcattttgtcattccaagtataatgattactaatattttcctaaaatgtttgtgtgtgcacatatgttattatctataaagagaaaacaaagcctatatgaaaggagcaggtgtacaatccttgtttttgaaagatgatatcattaatcaagtggttgccatgttactaactctagtccagttctctacttttctctctaatcttcattacggtcctctaaggtgggcattatctctcttttaaaagtagaattccagtgacattctaagtcaggagcacggagaatggatagttttgttcccaattgaaattctctagaagtacgttgcaaactaacttctgtattttctgaattaaatagattgaagtatttaataataatatcttgtggtaccatccatgggaagattctattacc

SEQ ID NO: 31795 - DNA, 1059 bp, Homo sapiens
tcacttgcaaaatactttgcactcaaaatgtttttacaatgcttctaaatgttactggtttctgctttcttttgactacttgactgacaaaatgatctgactactccatttaagagcaaaggtaactcatgtttaggtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataa

SEQ ID NO: 31796 - DNA, 1046 bp, Homo sapiens
gcttatctaggcttactcgacagcgtaataatctcagggttcaaagcaggttagagaagaagctgcaaggttctttaaggttaagacttagaaatcacatagtgtcactttggccttattctgtgggttaaagtaagtcacagggtcatcctggtttcaggggggaaggaggcagactccacctctaggtggaaagattgactgagtcaaatgacaggaggtatagttatagggataggaagaattactgtggccatctttgaaaataattcaccatgtagttcaagatttaagttatttcccattcgttgggtatttcttggaacagatcaagtctatgttatggaaatttagtgcaatacagcaaggagactttttgaaaattatatttaattttttaacagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaaggtaattttagaattttgccttaagcattgtgattcttcaagggtttgagctgtttttgtaatgattagaacattaaaagatgtaagatgaaaattagcttcttccctctttataattcgtgtagaattttaaattgagggaaccatttagacttacagatatttatgttcatttcacttttcagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaaggtaaaatttctttattgccgtgttttacaatcttattataacat

SEQ ID NO: 31797 - DNA, 1059 bp, Homo sapiens
aaattgtggacaagcaagaatgcagaagaaacatttcacaaataatactcactacaaggctttcagtatagggaatatggaattgaaagaaaggagtatttgaagtgacttggcaaaatactgtattttagtgatttgagatgcacgtatttttcaaattataatatcttgaactcaggatatgtattacaattagttgttagtgtgttatagttggctggacaatgttttttctttataaggaatacaaagtaatggtgcctcttacaatcagttgcatcttacgagtcaatgaagctcataataatttattgaatacgtaagaatcccccattctgctttttctttctccttttttccaggaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtaactgtgatataattttggaattctggtaatattcatatttttggtttttatttccttggtttatttcaaaacagtaatatattttttgaggttaatactccatgccaactggttaataaagaaattattcgtagtgaaaaatgtatattacgtgcctgagctcacagtaggaagatgatggtaccataagagttgctaggttagttgcgaaatgtgtttcttatatttttggaaagaattaaatataaatgtgtttcactgttaacattgtcactagttaaaagctccatttgtacgttgtagtgacaattttatcaataaaagatgtgaattatttagaaagaacacatagtatttctgtgtttatattaacataatccctttaacataggtgcgatcgacaatcagtgattttgctgtatttctcacaatagtaataatggttacaattgactaccttgtaggagttccatctcctaaacttcatgttcctgaaaaatttgaggtaaggattaaaacaagtggctatttg

SEQ ID NO: 31798 - DNA, 1049 bp, Homo sapiens
tttctcactaaaggtgatagttcctaactatataatttgaaggatattatctgaaattttatcccactgataatttaagactgtattgtccaatacagtagccattagccacgtgtgtctatttaaacttaagattaattaaaagtttagtttttcagttaactagccacatttcaggtgttcagtcaattcatgtgactgctggctcctgtatttccattatttctgtgatggaaatgttacattatctgcatcatctaatatatctattgggcagtgctgatttaaagcagtaaaaattgccaagcatggtggttcacaccatagcactctgggaggacaaggcaggagtattgctagaggccaggagttagagaccagcctgggcaacatagcaaggcaccatctctacaaaaattaaaaaattaccctggtatggtgactcgcgcctgtagctaacttactgggaggctaaggagggagaatcacttgagcccaggagttggagattacagtgagctgtgatagcatcactgctcaccagcctgggcgacagaatgagaccctgtctctaaaaacaaataaaagaaaaaacatagattcatgctttactattttatatttaaaaagtcatttttgttaaggaagaggtgtagttaatagaggtgttcaaatgaaagtgatttgttacaaataattcatttcatgatgggtcagatgtcttgatatatagatataagtgttttcatgttatcccaaagggccatgcagggtgggtttttttgtttttctggtaatggtatagcttttattttcatgatccatggaatggattaggtttactaatctcagcacatggcatgtgaaaataatggaacatttaactatttttctttgggtacaactgacttgttttgttaaaatgagcttcattagattataagtaagaaaaaggagaactttagtggcatgtgcttctattaatctctgattgcctttcagttttttttttttttccctaaaggaaaatgaagtcagtagtttctata

SEQ ID NO: 31799 - DNA, 1032 bp, Homo sapiens
aatggtgggagaggagggtagtggtagtgatggtaatgatgttggagctggttactgtattgatacatatgatgtctggatctttagagggagtaagatgcaattgttttttcatatagacaccatacctgtcatttactcataactgatttataaagtgagctgtaatgattttgaaatatttatcgcctggtagattttcactgtaaatcttttatataagtgtaataaactattaataattaatactaattaatttattaataataaatctactaataagctagtcttcagccgaagcagaaaaagatatagagttatttctagatgttattttgtcattctgtaattcattctcttttaggaatcgtgttttcttgctgttcccattgcttgcaatgaaaaattttaggtacaaatactattccacatatgtttatcatattcatatttttctttctaaacagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcgtaagtatttctcttttctcctaatattaaaatgtgtttttacagagatgtcagagcctcagaaaatgaattttttttgcagtgtgatagtgtaactagctataactacttaactagccatgtgatagtgacatggttgtttcagatgagattttgtcacagcattcaatgaacaaaaatatagttgatcaaattcagtattttttgttcactgagatagcttattcacatgtgtatgttttggtcttctgtttgaattggattggccagtttaaatttgattggcaactgatccactatatatttgaatcaggcaatt

SEQ ID NO: 31800 - DNA, 1050 bp, Homo sapiens
caccatgttggcaaggctggtctcaaactcctgacatcaggcgatccgcctgcctcggcctcccaaagtgcgggaattacaggcatgagccaccgtgcctggtcagttacctcctttaagagaattttcctggctcctttgttctttcccatcagtttccctttctgtaccctactttctttttatcagagcgtctatcaatacctataattatttatttatttaataacgcgtttcactgtttttcctcctagaaaaaaaggttcttgagtatagggaccttgccttacctgtcaccattgcattatccacaatgcttagaattgtattttagcagttagtaggtagccagtaaatattggtcattaaataaattatttaagtaaagttgtttgcatatccatgattattttcttaggataaatgacatttaaatgtcatagaagtagaatgacacgctacagtgttttattttctaatcaattactatttcccaggcaaaattttatttttaaaaaattgttctgtcttaacatgtaactgttctctttcattgtttgttattgttaattcatctgataatactgagtggattaccttttatagttgttacccaggctgggctgaatacctgcctgagataagagtttaggggttatctttattgtgaagctatttatgatatccagagtggatttactatgtgtagaaatttttttcaactttaaaatcttttactcaatatttttttcacttagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggtaagaatccagagctattcttctgtgacttactttattttaataaaattttttttgattaggtgtgattcaaaaaccaaaacagagaagttttatccccacctcgtcctgtttaccttcttacccccatacttacctcctgtgg

SEQ ID NO: 31801 - DNA, 1025 bp, Homo sapiens
ttctccaaagaatgtagtacattttaggctttttttttttgcttgggcgggtggggtggagagacaggttcttactctgttgcctagactggagcgcagtggcgccatcttggttcactgcagcctcgcctcctgggttcaagtgattctcctgcctcagcctcctgagtagctgggattacggcgcgtgccactaccacccagataatttttgtatttttagtagagacggggtttcaccatgttggccaggctagtcttgaactcctgacctcaaatgatccacccaccttggcctcccaaagtgctgggattacaggcatgagccaccatgcccagccacattttagtcttttaaataaagataggatcaagtgttctttttctcattttgcctttgagaagattgaagttctctaatgactgactgcctggaatcatatacagactcggatttatgttttggaatagattttagttgtccattgtttcatgctgttatttatctttaatccaaatttaccttgaaattttcaggaccagagttcctgtagttagggaaaaaaaaattgtatgtgcaaaattagcaaaaaattattattttttagtggagaaaaggtttataactcttttttttttgtggagatggagagtctcgctttgtcgccaggctggagtgcagtggtgtgatctcggcttactgcaacctccgcctcccgggttcaagtgattctcctgcctcagcctgccaagtagctgggactacaggcatgcaccaccacgcctggctaatttttgtatttttagtagcaacggggtttcaccatgttggccaggatggtctcgatctcttgacctcgtgatctgcctgcctgggcctcccaaagtgctgggattacaggtgtgagccaccatgcccagcctataactcatcttaagggctataaagtatgaaaatttggtttatccttatgttgactacatgtacatttgtacatatatctttttgcctaatataaaataaa

SEQ ID NO: 31802 - DNA, 1032 bp, Homo sapiens
ccttactattgacacacatttttgtttcatttttttaaatattggaaacaatgcctcagtgaaaatgaaagttcagagaagttgaactttctcttgcccaagacttcacagacagtatatagtgggagcagcctgtgtagaccatgagaggatgtgctctttttttttttttaacatgtcatgtttggtacatgtgggagcatttatctatgatagatatttagaggtcaaagggtatgtgtattttaaataagtatagtaaataatatatttataagtattgtgagattatataacttaagctgtttttgagtcctttttgttgttatttgaaggtgagggttaattgttttgcttcatatcctggcaattgtgcgacctaaatgaaagtttggaatgggagcagttaatcccttttagaataggcagtatgctacctctcaggatacaacttctgtgccttttacttaggagagcttatcttttgtacctgtgcatgttcagagactaaatgacatgaagtcattggaacacgtagctcaagattttagaatatgacttggttgatggatggaaattattattcattcttgcacttttggggtttggtttggtttcctactttggcttttccttgttactgaggaagtgaatgctgtaaggcggcttgattaatttgtctgtcttgttttttattaaaaaatttttttctttcttgagacggagtctcgctttgtctcccaggctggggtaaagtgacgtgatctcggctcactgcaacctctgcctcctgggttcaagcgattctgctgcctcagcctcctgagtagctgggattacaggcgcccgctaccacgcccagctaattttttcgtttttagtagagatggggttttgccacgttggccaggctggtgtcaaactcctgacctcaggtgatccaccaacctcggcctcccaaagtgttgggattacagatgtgagccaccgtgcctagccttaagtttctttttaattaaaaattttattaaa

SEQ ID NO: 31803 - DNA, 1043 bp, Homo sapiens
tttaattcctgtacagttttctttctttctttctttctttttttttttttgagacggactcttgctctgtcgcccaggctggagtgcagtggggcgatctcagctcactgcaacctccgcctcccgggttcatgccattctcctgcctcagcctcccgagtagctgggactacaggtgccagccaccacgcctggctaattttttgtatttttagtagagaaaaccccgtgttagccagggtggtttcgatctcctgatctcgtgattcgtccgcctcggcctctcaaagtgctgggattacaggcgtgagccacggtgccggcctaattcctgtacagttttctacctaatttaaaatttctcggtttccccctgctttggctgattgaaattcacaattagaattttaagctgtgtagtatttctttttcctgaatttaagatttcaaaaaatcagttaatttgattatataatgtaatgattgtaaagcagtaaaaatgttagtacttttttttttttttttttttactgtgcctaccagttcagttttagaacatgggaaaatggttaggaaaattttgaaccatcttctgtaggtagctgaccttgtgaaatgctttttcaaaaatgttacttgcttttttattaaagttgtatctacttaaaacaagaattgattgtaggtttgtgggttttttttttttttttttttgagacggagtcttgctctgttgcccaggcttggagtgcagtggtgccatctcggtttactgcaaactccgcctcctgggttcaagcgattctcgtggctcagcctcccgggtggctgggattacaggcacgcctggataattttcgtgtttttggtagaaaccagggtttcaccatgttgtcctggctggtctcaaaccccagagctcaggcaatccgcccaccttggcctcccaaagtgctggtgttgtagaaaaaaccgggttcttgtcacacggccgggaaagattaggcacgcagatactttgaaaggtgaggggttacgaattt

SEQ ID NO: 31804 - DNA, 1031 bp, Homo sapiens
ctcagtagagtcctttcagtaatattttgtctttatttttgttttgttcataattattcccaaatgaccttaattataaaatgtccaagaggaacttccttatccatttttgcatatgccattagcagtatcctcgggataagattttgttataagcctgtttgtatctggggaagttggtcatttgttaggaataagggattcattcagtctaaaattggccttcatttggcctttcattttatcttattgagctattttattcagtaataggaaattcagtaaataatcatacactctaatcctcattttcaaaacaaggtaaaatttggaggtggcttaacctagatgtaacaagtacatgtttgggtttcagatatacctgggttccctatttctaatatgccacttaggtggctttgggcaactgacagctttgaatctcatttttctcatgtgcaaattggaattactctattaaacttatctcgtagggctcgtcttaggatcaggtagaatactgtgtataaaatgctaaatgtgcctcttggaaacttgctattaataatcagcctgtgttcttatggagtatcctacataataaaattgtagaagagtttgtgtacagaatgaggacagagaaaaaaatcttgactgtccttaaacccctggtgtttagatattctagataactctgtgggcagggatttgatactggttttttttctttttgagacgcaatctcgctctgtcacccagagtgcagtggtgcaatctcggctcactgcaacctccacctcccaggttcaagcgattgtcctgccttggcctcccaagtagctaggatcacaggcgtgcgccatcatgcctggctaatttttttgtgtttgtagtagagatggggtttcaccatgttggccaggcaggtctcgaactcctgacctcaagtgatctggcaaagttctgggattatatgtgtgagccaccgcgcctggcctgatactggtttgttgcctaaagcttcacatttt

SEQ ID NO: 31805 - DNA, 1049 bp, Homo sapiens
cggcctcacagagtgctgggattacaggtgtaagccatggcaccctacccaactctatcctaatagaagtgatatttgagttgggagacagatgacaaaggaattattaaacactgctgttaatgacgtggtaggggagcactttagaagggtaaacctcctaagtctttgagaagataaggcttggctactgttaacatatataaatcaataatagaaatcaaatacagtaaactagcatatagtctacgaatagaatgggagaatagtaaagctgtaggttgaactgatttgaaaacaggaaagaggaactattggcgttgataaaattaaatcttcgctcacccagttttggtaaataaaagtcgtaaaagtgagagatcatgatattcatcagtcataactctaactcgcagcagactgctcagcatagccaaaaaagtagaacaaattaatattcataaaatcccatcttagatttgtaattatgcaaaaaaatgttgaatagattggtggcagtttatattactctgaaattggagcccatctgtttcatagtttagcctctatggttgcttctgctcctaaaattctctaattttcactgatcagggtgttgggatagaggaaagtcattaatcttgaaaaaatgtaacttgtcttttgcttttgctataaagcctcataattgtaagcctcacttggaattgatttgtgagtctttttttgttgttgttgtcagtcttattttccagtataggttaaatccttttataaatagcatggtttagaaggtttctaagttttagcaggtaatctactttcttttaagcagtgcatgatataacacaattctgataccactgacattttgggaccatgatatttttccatgattttgttatgattttattcattttgcacatatttattaaatatcctataggtgccaggtaatggggatatagtcaaacaaggtagacagcatactgccttcgctgagtttattttggcgtatggtgtgaacacagtgatggcatttacatttc

SEQ ID NO: 31806 - DNA, 1010 bp, Homo sapiens
agtcgctgtacttcttttgctcatcatctgtaaacttacattgtggaactgtgttacagatgacttcctaaaatgtaaattccaggtttagaaaaaaaaagattaggttagtgtttatcaggctcttctgtgtttccttagtgctgtgaaattttattagttataataagcattataaaaatatggaataagtcagaaagaacacaccaataccagagtgcattacacacaataagggtaagtatggtttcttagaacttgttttctttgggttgcagtgtaaaatgattcttgctgtgccttgcaataaaaaatgagagccacttgtttggggggaaccgcagttgtcaaaatacacacttttaagtctataactcttggctaagaatatcccatagtttaattctactgtgatgatggaggatgtaatagttcagtaaattttcaaatgctaaagaaaaatatgtatggctgaagtagaaactcaagtaagtggatttttcttatacaaggaatagttatttgtgtattaaagagttccatatatagtgtcaattaagaaagctgggcttttagctgttacactttgtaagcaggacatgtactccctccttcagttgtggacatgcaggtttcacttaaaagtcagagatgtgaagttttatactgagaagtataaaacttataagattgtgttggcagtcagcatattgtaggtgcttggtaattgatgatgatatcaaaaatgttactccaaaagggcagtgatcagtcattagaccgggttaagtgaaagacagctttgaacagcaacatggcagactggagtagacttctcaacccatttcctcgtgtgtaaaatgaggttactcactttaccaagttggtgtgacaatgtaggtgaagtgcctagtatataataagtgctcagccatcattatttgtgctttatctgtttttagagttctcatttgagaagtttcagtgtaacatttcaatattttaagtag

SEQ ID NO: 31807 - DNA, 1065 bp, Homo sapiens
gtccaagaccagactggccaacatggtgaaaccctgtctctactaaaaatacaaaaattagcagggcgtggtggtgcacctatattcccagctcctcggaagctgaggcaggacaatcacttaaacctgggaggcggaggttgcagtgagctgagatcgccccattgcactccagcctgggtgatgagagcgaaactcagtctcgaaaaaaaaaaaaagtcaagtatgccctaaggtgctgctttttctgattatagaaattagatacttttaatttaaaaaacatctaagcagtgtgtatcacatctatactctgttgtgattatgatgatttaatgttataaaacagacaccatgaattataaaatactgattatgtaaaagcatagaaggcttcaaaaaatattctacacatttttgctttctatgtaaagattaatttgtggaaatgaaatactcacctaatgaatccaggctttatccccttattacgattgaagtaagatatggagccatcagaacactgacttattttttatctatagaatactctcttaagctttctcttctaatttcataccgttagctaatagctcgatttgaagaagaaacaagttccgtgggacgagaacaagtaaataaggcctatcatgcatatcgagaggtttgcattgatagagataatttgaagagcaaactggacaaaatggtaagttgatttgaagcgaatgacatctgcattttggaaatgaattttctccttcaagaggtttaaaattagaagtaagttaaatatttacatttagtaattaaaattttgtatacatgttcaaggcaaaatggaaattttagtaatattttaacttatttttatgtaaaatatttagtatgtaatgatgtttaggacttaaatacatctaacaccaccgacttattttgaaaaactatgacatggtagatttagtctttttttttttttaagccagtgaataatgatgtcctaaattaggaaaagaaaaaaagacatttctgagaaactgagttcattttgtcaccttgctttta

SEQ ID NO: 31808 - DNA, 1050 bp, Homo sapiens
gaattcactcacgttgaccccagagactgcacccctttctcccaccctctcgtttctattgctctaacagtgagagccgacactgttcagtcaacctaagacctctgtccacgggaaagtgtgggctgctcacccctcccaacctcgcaccgctgtggagctgaggggcgttcagctgctctttgcagcccacttccctcaaaatgcctgaatcaatgcctggtaaatggtgcaggctcttaattgagtctgtggggaaaaacagttagttctaatgagaggaagcaacatgattgccactgggcttgtgagtgccaatgctgccgggtctgcaaacacacttcccagagttccttctgtgactctactttccaggatgaatgtcccagctgaatattttggttcctcagattgagattggacacaaaattattttaagtttatcagtttgaaaatcttaatgctttgcctttattggcgaatcaatttgtggaatttcaaatgaagatctcccagcctgaggaagatgcatggaaggattgattatttgatgttttttttttttttggcttctcttagctgttaggccaaatgaagaagtaacttatatttgtgatcccatttgtaagtctaattttaatatgtcttttattcatattaaggagatttttttttaaatgcaaccctgaaaaaaaagagtatgtactaagaaggcataattgcaggtgatttgatgaatgaacacacatttatggattttcagaaacaagccaaaggcatgtggtcttgccagtgccttcaaatcagtttagctctgaggctcactgacctcccccaggacttgggggaaattttaccttgatttggaagagatttttctgaagaaaaatgggaggaggatgctatctcttatgcagtattacattagagaaagtctgccctgtgtctcttccatccctcacaggtatagcctattggaagacgttgtagtttcctcttttttttttttttttttttgagatggagtctcgctctgtcgcccaggctgca

SEQ ID NO: 31809 - DNA, 1035 bp, Homo sapiens
acaattctgcaggctgggaagtttaagagcatagtgtcacatctggctggcttctggtgagggccatgtgctgggtcaaaacgtggcagaaaagggagcgggtgtgtgtgcagagatcatgtgggaagcacaagggtctaggaagccaaagtcgcttctagaacagcatgctcttgcggtccctaattcagtcctgagagagtgagaactcgctcctgaaggaaggcattaatctcttcataagggatctgctcccattacctacacaccttctactagtccccacttcctaacactgccacatcggggatcaaattgcaacacacatttgggagaggacaaactcagaccacagcagcatctcttctcccttccatcacatccaagtcatttgcagggaagggtgttggaatcctgaagtagagtcagggttacagatctgtgagcctgtgtgatatttgtggtccgtgatcatacaccctcccaaatgttttcatgggagtgagggactgcagaaaggaaggacagaattagttatgtaaagagagattgtaaaccagccccatggtattggtcaactcgctggaacccggtgtgttccctgcgtggcccagcaggtctgggctagctttccagtttcaaaatcctgtgagtccacgttaggaggaacagaatgagatgctctgggttaaggctggctgtgttttgcagctaagtgggtggattattaatacccgataactgtttgggaggccaagacgggtggattgcttgagctcaggagtttgtaatgagcctgggcaacatggtgagaccttgtctctactaaaataaagaaaattagctgggtatggtggcatgtgcctgtagtcccagctactcaggagactgaggcaggagaatcacttgaacccaagaggtggaggttgcagtgagctgagattgtgccaccgcactccagcctgggtgacagaaggtgactctgtctcaaaacaaacaaaaaatacccgatatttgtttcaagttaatttaaga

SEQ ID NO: 31810 - DNA, 1049 bp, Homo sapiens
gtacagaccagtttgctttcctcttagagaaagtggcagggctcttcctccgtgtcacacagaatgagactcctcgactagggtcttgccgctgcttgagttagcatgcgtctggctttagtttttaaatgtcacaagccaggtagtgctctgttagctgactatcttggttctgaatctggcccaggaaggacagtctgaaatccgaatcaaatctgtagatgcatatgaaagacaatttttttttcttgaaagattttacatgtatatactgtgtcttgcctaataaagaaaaagtagagagtcagaattctattggaattttcaggtagaatgcttactttgaaatagtcaccctgatgtgttaaaaaggaaaaactgggccgggcctggtggcccatgcctgtaatcccagcactttgggaggccaaggtgggtggatcacttgaggtcaggagttcgagagcagcctggccaacatggtgaaactccatctctactaataacacaaaaattagctgggcatggtggcgcgtgactgtagtcccagctacttaggaggctaaggcaggataatcgcttgatcctaggagcgggaggctgcattgagccaagatagccccagtgcactccagcctgggcagcagagtgagactgtgtctcagaaaaaagaaaaagaaaaagtagctattagcttaattgtgttacgttagttgatatgatgaatgattgtgcacaggtttatatttcttttcattttcttagcaccttttcaaaacattgtataatggaaaattttcaaatatatgcaaaatagaatagtaatgcaaccctatatccatcaccttactttaacaattccaactttccattgttcttgttttatctgtttttatttcccccaccactttatttttcctgctagagtattttaaagaatagttaagttttataaaaagttcctgttagataaataccattacattaactggcagtgataaaatgacacaacacttaactatgataccatcatttcacttttatgtaga

SEQ ID NO: 31811 - DNA, 1013 bp, Homo sapiens
agtctaagtagccagggatttattagagggttttgcagtgtttctgggagaaccaagatcaatgctacatgtttaggaacaacacagcctgtctctaaccaattcccatctatagcatggatataacccacttctgccttagggctggtgacactagaggccaaacttcataacatctgctataactgctccaaggaatcaaatacacttgtcaccatctgaccagaagttctgaccttctggtttgtggctactgcctcctgttgttcccctctcactctcagatcttgcatgagtgtgtctgcttagaagaatctagctgcaagggagtcagtgaaatgtagcttatagttttctagcttctgtagactagaagctgggctggaaagctgctagatggcactgaatgagctgctttgcattatttgttattaagagcatgtgcatggagatgatggctaaatccctggtgggtaaattctccttgtggcaaaaagaaaagagggaagaggattgagtgtaggagaccccacagggcttttgggagaatgaagcgacagggagtcagtgcaagtgccaatgctgttaccaagagggtggcttcctactgcatgataggtggcattgctgggtagctgtggctgcagtgccatgcctgagcctttggcacagtcctgacctttgcaagagggaagcagtgttgggctcatatggttctttttctattgaggttggtagagctggtttcaaattctagcctcggataagttcctgcaccattctgagtttcagtttgcttatctataaaatgatgatatgcctaccttgcagggaagttgtgatggtaagaccagatggcatatgagtgtctagcatatacctctggtgtatagtagtggttcaacaaattattactgtattactgttatcttcaattttgtcatctttccttttttcttttgtctgagcagctcacgctgcattaaaccccagtggatgcctggatgccagta

SEQ ID NO: 31812 - DNA, 1089 bp, Homo sapiens
atggctctggcaagttaaaaaaaaaaaaaaaaaaaaaaaggctgtagcttcttggttaaacattgacagaaggaggtcccttggggaatttgtgagctgctaggtggtttacaccattttttgggcagctttgaggttcaagcagtttggttttaaccctttgtaggtcaggtttttagaccttgtaatctattttcccttttaaaggaggaataaggattaaagaggataaagaggatggtttttctgtaagagagagtgctggtaattctctcctggtggtgagcatttgtagggtggggtaggggcacagatggcacatggctgatggccttgagggagaagtgggttgcacagtctcttgcaacagtttccagagtggggaaggttcagagatgctcttctggtttctgagcttgtgaagagagagacgtagaggagaaagggttaacttccatttttacttggaaatggatagtttaagctggggagggcctgtgttatgtaaactagcttgcaaccttctggtgtccattttagccttgctttctcatttaggtcaattggatctgaataaggaatttggccagacaacaaaatatttaaactggttcccctattgcatctcatttccacagtctgtttataatcctaattgatgcaaatgcccttgttattgtgaatgtgaataccctgaatgcagggttctggtttgtttcatttcacattgtattactgaacgtggtgagggaagctgagggtctgagtgacaagcggagtgtggctggatccagccttattttgaaggattcctttggcacccaggggcccagggatgaggtgctgttttgggaggctggtaaaagttcagaagcgatctctgagactccctatctgccagattcccagactgtgagctgcttcaagatcagggaagtttttcggtacgtaatttcttaagcactcagcaaagtgctaagatagtcttccctgcctcagggagtttggaaggacatttttccatggagtacatcagacctaagagggagagttttgtttttcttcactgataggcaactttcattttct

SEQ ID NO: 31813 - DNA, 1051 bp, Homo sapiens
ctcacatctgtaatcccagcactttgggaggccgaggtgggaggattgcttgagcccaggagttccagaccagcgtgggaaccatggtgaaaccctgtctccacaaaataaaaatataaaaattagccagtggtggtggcttaggcctgtagtcactgctgctcaggggtctgagttgggaggattgcttgagcacaagaggtcaaggctgcagtgagctatgatcacaccactggactccagcctgagcaacagagcaagactctgtctctaaagtagacatttatttggggaggaagagtagtgtgaactttggattcaaatcttgacaccaacacttagcacacatgtgaccgtgggctagctctttaattgcactgggcttctgtttttctcttctgctaaatgtgggaaatgatgttactcttttcattagttcaatgtgaagattaaatgagattattggtgtataagggactgagaatagtacatagcaagataccaagaagtggtagctattattagatcttcaatttgtctgtttttaagtaggcactttctggtccataaaattcttggtttttattctgagtgctgtggttaccctgggaccacattaacataattatcatagagttctttggggagaagatgattacttcattttgaagggatccttttaaaacttggcaccaaacatttacagctccccttcccagcctctaaatcctatcttcctttcctattttatttctctccatataccttgctattatctgacatgctttatattttactttttttggtctctccacactagagtataagctccctgaggacagataattttgtttgtctttgttgctgctgttatctccagtgttgagaacagggtctggtatacagtaagggtagagtaagtattgtcaaatggataaaaaaatgaataaatgtcagagagggaaaccagggcttagttctatttgagccagtgttagctattattagtatcagaagtcttggttctgtacctgcttgtaaccttgtcctt

SEQ ID NO: 31814 - DNA, 1038 bp, Homo sapiens
aataaaaagaaagaaaaaataccctcccccttttaatattagtagcaatttacattattatcattatttcctcttcaggtcccatttgaagtttcctgctcacttcccccttgcagttgagaagcctagttatggacacgtggaaggatggggctgtcgaggaaaggggctcaggaggcacttggaatggtggtagtgtgtgtgatctgccatcgtgaggaagacaagaacagatgtggcactactgtttactttttgtttttgttttttttttcaatttgttttccaaaaacaagccagagggaaatacaagtgtcagtgcgaggagaacaatgctttttggagaggtggttggtgggatattttgtcctgcctatttaacagtctccagatcttaatagacttggggctcttaaggatgtttgtgagatttgaattataccctggaaagttgcttatctctgctgcatggactatattacttggttatctcttcctgtagattgtttggaaatgttcagatttgcttccatctgaaacatatcagccagttatctgcacgaaactcaacttggaggaagaggtcttttgaagtatggaaactgagttgtttctatattgatattctacatataggactttctgagtcacctgggcttcctgggagatgtgttactatgttagtggaagttgcacttaacttttgaatccttttatttctcaaaatagtcctagtgtctgctgttgcctctcccttcccctttcaattcgtgaaagctgaaaaagaataggtagaatgcgtaggtagagggagatatgagatgactaaatctgatttcagttcttggtaattatgtctcgttaatggcaactcaaggtgccttgtcagtaacagcattttgttggtgtgttgagcaatcacttaatgctttttcttcaagtagattatgaggccagcaaagcttttaccctggattacagttattttattatttacttgctggggaacaatattttaccttgcagtctgtattaaag

SEQ ID NO: 31815 - DNA, 1034 bp, Homo sapiens
cctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtgtcttagatgggttttaattgcatgaatgtggctaatgtggttctcagaaattggtcagtatggcccaacatagcttctgctctgtcttactgactcaatacctttaggatttgtatcagagtttggatactagtgttagtggtggtgtcaccactacttaattgggagataatgaaaccaatcatggatgctgtttttattgggcatgtcatctaagagaggagaaatagctgggttttgggtctaattatgaataaggactgattcagaaaacgagtttatggtaggtagactaaagtttcacatcagactgtaccattgtgatttagacctatctaaaattcagagcatatcatctgggctacctcagggtcaccacccatgtattgggcttagtcaggattgacagatacattctcagctggcctgtcatataaaacatactgtcattgagcttaagctccgcttgttctgaggtttcacctccatgtgtttcattggtgcaaaagtggatctcttagttggtcacttaattctttctttttcagaaagatagtatgttcactggtatatttggtcactcttagaaccttccttcacattgttttttatgggacccatgaatggttagcctttcttttctattgtagaaggaaataaataggagtaaaaagaccattgtagtaaataagttcaaggggaacttgggaccagaaaccactgttatgtacaaaaaaatggcaaattcaataaactcaaatttaaaataatttttaaattaacagttatgataaattttatattttatacaaatagattgcttagaatggttctcaagaattataagagaaatga

SEQ ID NO: 31816 - DNA, 1036 bp, Homo sapiens
cggttgataaatgattctgtcattctgttacaggtcattcttttactaggcttagcttccaaattatgctttatagctgtataaacatcgtgattatattcatctacttagaaattgttttatttttaaattaatttgcttagctgtttgttttgatgcttagattatgttctgttaatgggaatttaacatatttaagaaaccaatatttaaaatgttggtctaggtttttttccttaacatatattaccaggctttactgtatttcactcagccttaaatgttataatatttttggataacggttattaattctttgagaccttcgtatagcctataaaatgtatgggagatgttggtattttatgtgtataaaagcaacaatatcagcaacttcgtgtttatactgcaccttggttgttgatgtcaagtaaaaaaaagattgttttgtaacacataaaaaaatggaagaaactgataccacacctaaggaccaaagataagaaagactttttgcccaagacagtgaaagtaattataaaaacaagctttgaccacttaccaagtatctgaagagatgagttcatactatgatttagaaagtggttcaattcccctgttggcatatgattatttttactaaaattaatacagctctgtgggtcttccttagtgttttctttgaagccaatctgttttttttaggacaccagcctttggtttttcatctgttcgagatgcctcttctctgtctccttatcagatagaaatggagtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaagtaaatatccagggaaccctgcccagactaatactgttggtggcataagagaatcaagccattctcaagagat

SEQ ID NO: 31817 - DNA, 1035 bp, Homo sapiens
gcatattaatacacttaggttttaaatattttttcatgcaagagaggttttctgttttagaggaatgtgttttgagtgtgtggtactggtggtgcctaaagaagaataactttttttttttttttgagaagtcttgctgtgttacccaggctggagtgcagtggcgcaatagcagctcactgcatcttccacctcccgggttcaaacgattctcctgcttcagcctcccgaatagctgggattacaggcgtgtgccaccacacccagcaaatttttgtacttttagtagagatggggtttcgccatattggccaggctggtctcaaactcctgacctcaggtgatccgcccacctcggcctcccaaaggaataatattttttaagagagaatgtcttctatcccatgctattgcagtcggagtctattaagaacaacagtagccaacatttttgggacgtttacatttattagtggtatagctcagatttgaactcaggtagactggctctagaacccgtttattgaacactacattatggtctaaaaatgattgtcttgtttcaattaacttgaatgtattccaaatattagtaaatagaattttatatttatatgtaataaatttgaaataatcaaaaggattaaaaaataaagtactacagggaaacaccttttagaagcagagaaaacctctttttttttttttcttttttgagacagagtttcgttcttgtcacccaggctggagtgcaatggcacgatctcggctcactgcaaccttgtgcttcctgggtttaagtgattctcctgcctcagcctcccaagtagctgggattacaggtgcctgccaccacacccagctaatttttgtatttttaatagagatagggtttcaccatgttggccatggtgttcttgaactcctgacctcaggtgatccacctgtcttggcctcccaaagtgctgggattacaggtgtgaaccaccgtgcccggcaagaaaacctcttacattttatataaatgttaagtga

SEQ ID NO: 31818 - DNA, 1047 bp, Homo sapiens
atgttaagttttcatttctctgagatagttgcccaagagttctatttctgggtcatatggtagatatatgcttagtttttaaagaaaccgctgaactgttgtttgtccctttttaatgaaaatgttttgtaggataagatatttactattactatgaaatgtatctgttgattttggtagcaatcttgttgccattaacctgtctggttgcttctactggcctgactggagtgagaagggaattccctttagcctctgacttaggtcatcagtcattttgatggtttcggccctcagcaggaaattccctcagcttccacaaaacccacacaaactgcccaagcaaaatactcttcttcactctcttcccttctatttctagagaagagttagccccaaacctgagccctgaatcctatctttagagagccatttttctacctatgtctttagacccacccatcttactggtttctgcctaagtatttaaacatgctcagttctcccatgttgaaattcccttctctttgacctcatccactactgccctatctggccattctttcccagccacacttattgcctatgctgtctctccttcactgccttaccctccccttacttcccaatatacagtattgtaatcgagcttctctccctgactaccctggaacttttcttgctaatgtcactggcaaccttcttatagctcagtctaaggtaggtgtttcagtgttgttcttacttgacctttaagtagcatttagcactcttgattacttgtgtgtttgtgcatgtgtgtgtaaatacttttttcttgtttactacccctttgattgctgctgctagttgtcctttgctggtttcttcccctctgcatatcccgtaaatcttcagattcctcagatttccacataaggctatctttcctcatttgagtcatctcaccctcccactctgccagctcccacatctttatctgcatcttagacctctcctttgagctccagaccttatattcatttgctttccaactacatcttcacc

SEQ ID NO: 31819 - DNA, 1027 bp, Homo sapiens
gtcatagttgttttaaattcatggtctgataattccaacatcgctgctatatcccagtctggttctgatgcttgctctgtcttcaaactgttttttgtatgcttcgtacttttttattaacagctggatatgatgtacagtaaaaggaactctggtaagtagtcatttagcggtatggggggagaggaagctttctgtatttgtatgataaggtctcagttttagcaagcctgtgcccctgggatgtaaacttcacaagtgcttttcagtacccccaccccctttaggtgggacaggatgtctagaaggggctggagttaggtgtttcccttccaccaggttgatttggctctgataaaacctcaacaggtaaggctgtggcagaatcatttttcttgaggacaggccttgttaagaacagaatgctctggcatatttcaaaatggttactttccccctcccttgccagaagcacgagagatcttcatggtgaaatcttcactctgatcttcacggtgagaacctgggagagctcctagaggtaaaactcacaaagtgtggggaccctcttatgactgggtgtttgtagaattattaactcacacacttacccaaactgaacctctgggcaattcatcaattacaattcagattcctctgtcccagtactggttcccatggaggtgtatgcccagtgatttctgctccggtaagttgtgattctgtgtcacctgtctgtctccaatttgggaggcagtggtttgccctgtgaccatttctcccacagctctactgctttttctttttttttttttcagacgaaattttgctcttgttgcccaggctggagcgcaatggcatgatcttagctcactgcaacctccgcctcccgggttcaagcgattctcctgcctcagcctcccgagcagctgggactacaggcacctgccaacatgcccagctaatatttgtatatttagtagagatggggtttcaccatgttgaccaggcttatcttgaactcctg

SEQ ID NO: 31820 - DNA, 1071 bp, Homo sapiens
ctgtttagatgcaacttttttttcaaatattttccttctgtgattggttcaatccatggatatggaacccacggatacagagggctgactaatttaaaattttcgacctaattaataatataattattaagctttctgacctaagagataaacgaatacacacgtgcatgtatatgaggataaaatggtgttcatgggcatacaaaaatttatgaaaacattttatctgataaaatatttgagataaacaatgccagtgataaaatctttagtccagaaagggttctgcaaaaagggtggtgtagattctctctaaatcagtactcgatgaagtaagtggaactaatggaaaaaggaaaactgctgacagtatttggtgtacttggatatatctgctaccttgtttgcatgcataaaccaactcattctgtgtgtgtgagacattgaatgtgtactagaaaatccttgaaattaattgagttgttacttcagtttactgtaattgttcactctgggatttagtttaatcttaagaccttgcatagatcatgtttaaatctgaaagcttcacgcctgtaatcccagcactttgggagaccgaggcgggtaaatcacgaggtcagttcaagaccagcctggccaacatggtgaaaccccgtctctactaaaaatacaaaaaattagctgggcatagtggtgggcgcctgtaatcccagctgcttgggaggctgaggcaggagaatcgcttgaagctgggaggccgaggttgcagtgagccgagatcccaccactgcacttcagccccagtgacagtgagactccatctcaaaaaaaaaaacaaaacctgaaacctatttttgtacaattttttgcaaggaaatttgttttaaaactttgtttttaagcaaactttattgaagtatacaatacagaaaaaatgtacaagtgtatggtttgaagtatcacaaagtgaccacatataaccagcaccaaaataagcaacagaacattacccagcacttacagaagcttcgagtgtgccccctcaatcagtatccccacccaccaagt

SEQ ID NO: 31821 - DNA, 1094 bp, Homo sapiens
cctcctgagtagctgggatcacaggcacctgccaccatgcctggctaatttttgtatttttagtagaaacggtgtttcaccgtgttggccaggctggtctcgaattcctggcctcaagtgatcctcccacctcagcctcccaaagtgctgggattacagacatgagccaccatgcctggccttcattcctttttaattgctgaataatatttcattatatggctataccacatttcatttatctgtttactgggtaatggacatctgagtttcatctactttttgactattattaatatggtgctgctttgaacatccgtttttgtgtggatatttgtttgtaattctcttgggtaaatacctaagtggaattattgggttgtgtagtaactcggtttaaacaaaggttttgaaggactgccaaaatgttttccaaaatgctgtatcattttaaattgtcatcagcaggttaggaaagttcgtttctccatatccttgccacatttttattgtcatctgttgttaccactcattcatcttctctagatgctacatttttgttgctattttctgttttaccgttcttattgtcctatgccttaaaaaaaaaaacctttatgagattaaatgataggtgccagttatacctccatttggtaacagatccacaatttaaaatgagggaatttgttttttcttgaaatttatattatttttattttttagacagagtctcactctgttgtctaggttggagtgcagtggtgtgatctcagctcactgcaacctccacctgccgggttcaagcagttctcctgcctcagcctcccaagtagctgggattacagcagggtttcaccatgttggccgggctggtctcgaactcctgacttgaagtgatcctcccaccttggcctcccaaagtgctgagattacaggcgtgagccaccacacccagcttgaaatttttaaattaagtgttgtttgtataacttagtgtgctaaataaagttaatgaaagtgttaggactttttaaatgaagagatattggtgaaaacgatactttcacttatatctaaatcttgtttttttt

SEQ ID NO: 31822 - DNA, 1034 bp, Homo sapiens
ccgagatcgtgccaccgcactccagcctgggtgaccaagcaagactccatctcaaaaaaaaaaaaaaaaaaagtaagtgaccatggactaacctttttgggccttatttgctttatttgtaaaatcaggacagtggctattagaaagaccccacagattaccattttattctttttttcaccaaacatttattagagacatgtcatgtataaaatgctttgctgaatcatctggggtaaacaggatgactaagactcagctcctgccctccaggagcttataatctcctgtggggaagagactcaaagtagtaaagatcaagtatgtcggtatgaaataattgctaaataggtcacgaaatattttgcggatgaggtggtatctgagtacaattttgctaagaagggtgaggggagaacaacctgtgaaaagggcctaaaacgcagagaaaagggccgaggcagtttagatatggcggaaggagtcctgacgaaagccacaagatcttaagagtcagcctccctatcctttgaagtggtggagttgtggacaaattagaacctcctgacctgtaaactgagattatttcatgcatcatgggattaaaagaaccaaaagaaattatgtctaaaacactttcctctcaaaattggaaatcactattttaaattatgaaagtaatgcatgtttcttgccagagaaatttaaaaaaaggtaagaagataaagtgaaaatagccatgctcagtggctcccgcctgcaatcttagcactttgggaggccaaggtgggggcatggcttgagaccagcctgggtaatacagcaagactctgcctctacaaaaaaaattttttaaatagctggtgtggtggcacatgtcttttgtcccagctacttgggaggctgaggcagaaggttcatatgagcctgggagtccaaggttgtagtgagctgtgatcacaccactgcactacagcctgggtgacagagcgggaccttgtcccaaaagaaggaaagaaagaacatgaaaataa

SEQ ID NO: 31823 - DNA, 1036 bp, Homo sapiens
agcacatctttttttttttttttttcagtgtttgtatatgtgtatgtgtttgatctccagacactgcctcatctttatttttttaaagtttttcccagcattttgttttggaaaattttaaatccaaaaaaagttgcaagaatagtacaataaacacccatatgctttttacctagattcaccaattgttaacagtgctttaattgcctttttctctctgtgtatgtagtcaactgcttttctttttctaaccatttgagttatcagcaccatgtcactccacagcatacatcttttaagaaaaagaacattatcctgcagaaccacaatacaatgatcacacatgagaaatttaatattgatgcaatcctattatctaatataaattctatagtcaagtgtccctggtcattgcaataacgtcctttacagcttaatcttttctcaatccagtttccaatccataatcacacattaattatattctccttagtcttcttccgtctgaaactgttcctaagtctctctctcatgacatggacatttttgaaaaggtcggggtgtttgtagactttgcctcactaattagattcagtaagacattttggacatgaacacaacaaaggtgatatgtccttctcagggaatgatagcaggatgcccgtgagaccagcttgtcccttaactgcaatgttaagcttcatcacttaggatctcagccccatgttttgaaatggaaggttatccacgtcctcctttctgattttctgtggcaaccaccttctggaaggagtctgaacagtaaggcaaaataataacagcatatctaatcttagtttagtgaagtttgctgtcagttcctgtttttacacctgtgattttattccaacaattctattttgcaataaaatgaataattaagtccccccaccacacacacattcactgtttcatgaacgttgtatagggtactctgcagtcctagcacccacatctataaatggaacttacctgcacttagcagagctgttgagca

SEQ ID NO: 31824 - DNA, 1043 bp, Homo sapiens
tgcttgcaggctaagaggattgggtctctggcatcctggagctgaacagctcgtgtcaggaattccccaggcccttgagtctctggggtgagttgtaggggtgtgtagggtgctggggattaagatctgctgagtaggtgcttaccagagttatactgaaggacctgaagacagatcatcttcacataatcagcatgacccataatctgtgatgtcactgagcttcttttatttctgtagtcaaggaatgtgcacaagtaatgcaaatataattacttttagtcctgaggattagggaacttgggggatgttcacattacctgatgatgtcaatattgtgttatgtttaattttttttaaaaaagatgcttatttattactgaaataatctaaactgaataaataactttttaaaaaattacattggccagtattaggttcctgatacgtatttggtgttttgtttgtactgctgggttttttctctccagtattggatgcgttaacggggagccttgagaagttatgaattttggtttgttcggaattgctttttataagttttctgtgacctcatgcactaaatactgatgctaccacactcctgcaagtatgaaataaaagtatgtctcttcagtattgcattcctgcgccaattcatttagaagggtagaatttgcacacaggtcaaatcttgcattatttgcatttggggggaatacactctgaaggcagttttctctctctctgtctcctttttcctcctttcttcctcctattcccacttttttttttttttttttttgagacagagtttcagtcttgttgcccaggctggagtgcagtggcgcgatcttggctcactgcaacctctgcctcccaggttcaagggattcttctgcctcagcctccaagtagctgggattacaggcatgtgccaccacacccagctaatttttgtatttttagtatagatgaggttttgccatgttggtcaggctggtctcgaactcctgacctcaggtgatccacctgcctcggcc

SEQ ID NO: 31825 - DNA, 1035 bp, Homo sapiens
aaatatgaagaaaaattcaaacctcaaatctttttgtccagggatttctgttaatgtttattaaattatatttgtggatataaataatgtattcttacgttttagattggtagttcaagatttcaaggtagtaagatgggggaaagaaatagtttattcccatttaaaatgtttttttacttttttggtactttgaaaggtgtgaccttcgtacagatcctacagatcaggcagaaaacagatcaaagattactgttaaaatgcttttctttttttttttttaatttcagtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcaggtaaatcaaatcatttgtttttccttttcagactggtatttacttttatacatgtaattgtagaactgtagaaaaattctgtgacctcttttgaaaatacttatgagaatcattttcagagagttgggaatcactttggaagaacttataaccaagagtttcaggcatcctagtgataatatggaatacaagccaaggaaaactggcttagcctccccccagccctttaggatgcagccaatcactggggcactctagggatagtggcaggctttggccctttttatgaggtgagtcactggatgtgttttccttttgtctattatttgatgactaatttaaaaaaacatgtaagatatataatttttcccctagtgattggtggcaagtaataatagaagagcactttatgcaatttttgttcgagtcatcatccactggagccggcagggaatgtgcccctgtgggtcacatgggtgactgaccaggtctctcagggaccattatggacaggcatagtgaacacaaggcagtgcagcacgtgtgcatctttgctgcctcacactgccttcatgaattatcgttttggccattgagtcctg

SEQ ID NO: 31826 - DNA, 1279 bp, Homo sapiens
cttctaagctccttcttgatacaggacatggaaaagccagcattttccttggctctgaaggacaggtgtctgtttgtcttcttatattgttcatgtgtatgtgtgtattcaggatatctgattattttgaaggacattggactgcatgaagacagatgcctgtaaagcagttctgttctttttccatttatttgagaaaaatatttttgctcttctctaggtgccgacttattaaaactgacaaaggaggatttagttcaaatttgtggtgcagccgatggaattcggctctataattcactgaagtcaaggtaaaatactgtgaactgttttgcttgaaataagaatgtacctttcttcgcgtggggaatttgggcagaatgtgtttccacgctaggttggcgtgtgtgcctgtgtgcgccatcgagcattggcagcattgtgctcacaagaagactgttttgtgtacaccttcagggcaggcccagatatgatgcaggcactgatgagggcagaggtagactgtaagactggtagaaatgcacatgggcagtactgatttcttgaagacgactgggtttgttgccaagaaaacaaaacttctaatttaggtgagctatacagaatctatggttttcaaggtcatgactattactaaacagttattaaaaatgtaaactaattgtgaattaaaatgacagaaactgtaaattgtgctggcttgtaagaaccatttactatcattgctctttctatacttgtggtgtgagaattccattaaaattgaatcttactgatttttaatttgctgacttaatcttgaaacttaaatttaccagcatctgacagaccatctcaatggtttagagtctggatcatcatattagaccacctgtgatagttggtgtgaggtgtgtggtttttatatttttattagtaaattactttgtataacgaaataacattataaagttctcataaggaaatagaacttagattcctgtagttgtcatatttgtacatgtgtaaggcagctttctctcccaggctcatcagtggcatcttctgattgcaggtcggttagaccccgtttaaccatctatgtctgccgggagcagccaagcagcacagtgctgcaagggcagcagcaagctgcaagcagtgcaagcgagaatggcagtggggcaccctatggtaggtattgagggcatctcaattctgtcacttctgagactgtcagacagaaacggaaaggactcgattgagcaggctttggaga

SEQ ID NO: 31827 - DNA, 1034 bp, Homo sapiens
tctgtatctcaagtctgaagacttgtatttgagattactctggcatgcttagcatgcttttgactgactttttcaacctcctaattgtaatagtgtatctccgtgtctttgttctgtttctggtcagaattttgcctggagctgaaaaatattaaagttcaccataacccttccagaaaatataaaagaaagaaagaaggaaagatagatagatagatagacagacagacagacagacagacagacagacagacagacagatagattagatagacagaccagacagacagacagatagatagatagatagatagatagagatagatgtagtactgtacacagttgatgtattttgatgctgggcctgtctggtctgtcttgaggattattaacctttagaggtatcagagaagcaaatgggtactggtgaggctgctcattagggaagagggcaaaaggagcactagctaggtcagagccatgtttcaggtcaccatgtgatgtcagatgttgcttataaatcctttcttgtcttcgccattcttaaatcttgataggtgcctgttgggaaactgataaagaggatactggtaaagagggaggagaaagctcttcaaagcaattatacttaagcatatattttaaatgcctttataaatttttgctgctgtcatcactttaggtcttctctaagattaatcagtgtctagacgcacacagcaggtaaaacttttctttgccacacagaagtaaatttgacatgtgtctgtgaggttgcttgataaatgtcagctgtctcgcattttataatcttgcatttggttagtgagtgaattacaaaaatatttcttccacatattttaaaagcatatcactaatttatttctgtttctgtccttagtgttctccgtggcccgatgcccccacagcctatgtgaataacagcccttccccagcgcccactttcacctccccacagcagagcacttgcagtgtcccagacaggtatctagtttgtgtgatcgtgtgcctgc

SEQ ID NO: 31828 - DNA, 1057 bp, Homo sapiens
acatatttagcaatgtgctttctctgattgttctgttttcgtctttttttgtcctatttttttcttttagtcttattgttagggccccatcacatgttgctagttctgaaaatgcagtcaatctccttttagggagaactttcagataacgagattttctccctgtttcatataagaagttcctttcctctctcccgccctcctccctctctttctttttctttcccttcctcccttccttttcattcctttcttttttcctttccgttcttttttgggtaggggtttctggtagaaactggaaaacctgctagacaaattctaaaagctatataatgctagaatttttcttatatatcttgtaatttcctaactttggtcctccttttatctttagtattttagtccaaccttctagaatggggcttagtaaagctctgaagtctaatacctgtattctaatactgttttcatctgaatatgtgtagttagtatggttcttactgagtatggaacaattagaactgtgatattttctgtgctgtacttttttctggagacgagctggctagcagatgtgaaccactggcattggtgtcttaggggccaccactagcctatgcaccatcactatgagagctttgctctggtcaggtgatggtgtgaagtgggtgctgggtaattgcttggacaggccctgcaggtgtgggtgcaggtaaggaagatgggaataaagcagccactgagccctataaatgtctcccacatggtactctttatctcaaagaaaaaaattgcttttaattggctgctgggattacaggcatgagccccaccgcacctggcctaagttcactttttcaaggcagcgggcagtgtttcggatttttgttttatgccagttcttttttttcaaaactcaaagtttttttttttttttttttgtgatggagtctcgctctgtcacctaggctggagtgcagtggtgcgaacttggctcactgcaagctctgcctcccgggttcacaccattcttctgcctcagcctcccaagtag

SEQ ID NO: 31829 - DNA, 1024 bp, Homo sapiens
ttaaaccagataaagatatttcatatcgataaaagtcataatccaccatctgtagtagtgatatagtagactgacattaattgatactgtgcatctagcattgtactaaatacatgtgttaaccttattcagttctcacagtaactctaggagagatttattcatttatagattaaacttagagcagttaattaccttgctcagtgtccatttggaaagcttaggttttaacaaaatttttttgaagtattacagtaatgtgcacaaatcttaatgaatttttacatatatattcccttgaaactactacctatttccatcttttccagtactccagcaggctcccttgtgcctctttctcaggtgatacctcacttgaatataatcaatgtaagggcaggtgattttcttgtcctttattctgcttactgcagtattaatgttgagtattttcttggttctggaattgtgttcatttatttcttgattttttctagtcttttcagaaaaaaggtagaaagctgaactgtatatgtagacatgtttaaaacaacatacattttagtaattttaaaaaatatgggccgggcacgatggctcacgcctgtaatcctagcactttgggaggccaaggtgggcggatccatgaggtcaggagatcaagagcatcctggccaacatggtgaaaccccgtctctactagaaatacaaaaattagccaggcatggtggcacacacctgtagtcccagctactcaggaggccaaggcaggagaatcacttgaacccgaggcagaggttgcagtgagccaagatcacaccactgcactccagcctgggtgacagagcgagactctgtctcaaaaaaaaaaaaaacaaacttttttttgagtaattttaaaggaactgtacttttatgtacccttttaaaagaaattataactttcaaaataatacctatatgagtatcatatataatatagtgtgttgtgctttgcacagactgtatcttagcatttatcatc

SEQ ID NO: 31830 - DNA, 1053 bp, Homo sapiens
tgcaccaggatggagtctgtggctaaataaacatcaaattttatcccctatatcttgtttgtagtttatgtcagagtgttacatttcagtgatatgaaagggttggtggggaaggagggaaaatagagatgtgggggtagtttacctttttttttttgagactgagttttgctctatcgcccaggctggagtgcagtggcgcaatctcggcacactgcaacctccgccccccaggttaaagcaattctcgtgcctcagcctcccaagtagctgggattacaggcacacaccatcacacccagctaattttgtgtaattttagtagacagggtttcaccatgttggccaggctagtctcagactcctgaccttaagtgatccgcctgcctcggcatcccaaagtgctgggattacaggcgtgagccattgcacccggccgagtttatctttggaaagaggagagtttgccctttgcagtttgggcacaggctgatgtgacttacccctgtaaacaaaagtattttgaatgcaggaattaatttgttggatacatatactgaaagcaggttgaattctgattttaaacaattttttgaacatttttactgttatatgctcattgtagaaaaactgggaaatatgtgaagggataatgccaaaaattgactaatatttttggtctgtttcttgaatgtatatacattttctttcaaaaaattagaattatacatctgttcacttgagtatatagtgtttatttttctgtcattaaatagaatttttactcgaagttttggaaagagcaatagattttagacttttacatgtgattaatctgaaatgtggaagaataacttatttctaccttttcatttgatatataagtttagaatctataaggttttaccttcaggtagtcctgtctctggcacttgtgacaattccctgtttgtttttatatttagtgtttggataggcaatcacttatttgagagttaagttttatatttgaaagaaccttaataacttatttggtaatctgttgtagacata

SEQ ID NO: 31831 - DNA, 1025 bp, Homo sapiens
aatcacttgaacctaggaggcagaggttgcagtgagctgagattgagccattgcactccagcctgggcaacaagagcgaaactccttctcaaaaaaaaaaaaaaagaatctaatcaacttgaaaaagaacaaaattggagtacttacactctcaattttaaaacgtattacaaagctatgatagtaaagacaacatggtactgtcataaaggtagacttaatagatcaatgaaatagaatccaaaaataaccctcacatttataggcaattgattatcacagttttttgtggggaagaagagtatttttaataaatgtgatgctaggacaactgggtttccacatgaaaaacaatgaagttgaacccctacctcacaccatatacagaaattaactcaaggagtgatgcacagaaaatggcagacagagtaggaagctccaagaattgatccatctacttaagcaaccattgagctggcaaaaaatgaatagaatcaacttttttggaactctaggatctaaccaaaaacttatagtaaccaagagagtacttaatgaaagaaaaaggcttactttcagtactttagaataatactacaatgaattaaaatacatcaaattttatttcaaagcaaattcttttttttttttttttttttttttttttcgagacagagtctcactctgtcacccaggctggagtgcagtggcacaatctcggctcactgaaacctctgcctcctgtgttcaagcaattctcctgtctcagcctcctgagtatctggctgggacgacaggtgcctgccaccgtgcccggctaatttttgtagtttttagtagagacaaggtttcaccatcttggccaggctggtcttgaactcctgacctcatgatccacctgcctcggcctcccaaagtgctgggattacaggcatgagccactgcacctggcctatttcaaagcaaattctaagtatcatgtcatattaaatacttcatgaagtttacactttcaggacatagga

SEQ ID NO: 31832 - DNA, 1098 bp, Homo sapiens
gttatcagaagcagctgtgactaggacttggaaagggtctttggaagaaaaaaaaaagcagcagtcaacagtgcacaggtcctcagtatccgcaggataaggttcttttttcatgccctgattcccacaagctgtgtgcaagctgctccagcaacatgtgcacagctgcctgtcaaggggctggggctggtggaggggggagtgggtagttgctactgtactgagagctgaaattgatagaaattaaccacactttaccatccaagaccttccctagaagttctaagccttcagtagactagagttccaaaatagttacatcagacagattctgttgtctggttgaggagacagagtcctgatgcttcctaatctaccatcttcccagaatctctcaataatatcttacagctaaaggatccatttcagaaccacacattgcatttaatcatcatgtctccatcagtgttcttctcctccagtgttcagtctttccttagctctcatgaccatgacacttttgaagttattttgtagcatttctctgaatgtagttttgtctgatgttttctcatgattagaatcaggttatacattctttgcatcagtattgcagaagtgatggtgcattcttttcattgcaccctatctagtaacacatggtttcactgtgctccatcactggtgatgttaactttgatctcttgattatggtggggcttaccagacttctttactgtgaaattactttttctttttgtaattaagtgttttatcaggagatactaatatttttaaacaggttacatattcttttcatcaaacttgaattcatttatttaggaaattttttattttctattctagaaaatttatttgagaaaattgacatacatttttgtaacagtagggactcatagtttcccattataacaatcattatttatttattttgaagctcaaattgcccttgatttgaccaacaggattccattcaagccggcttttgttgttcttctaacatgtccccatccttgcattctggtactgttgtactatccctgtgcttcagtcctggaatcaatcatttcttcaggg

SEQ ID NO: 31833 - DNA, 1025 bp, Homo sapiens
tagctgcctttaccacaatcctccctctaattttatcaccattcggaatatttcaaatcattccccttgcatttacctatacatttcaaatgagagcttacactgttgtttgatttatcaatttttagacttgtttttaatctattgatgaatgtagacattaggtatatccgtctattttgttaagtgaggacctagctttctcatactttctgtatcctttctaaggtattcataaactacttatgaatcaattactagttatcagtagaaaagatttacatttgactgtgcaggtattcacttttataccaagtgatttgcgactgcttgctttcttatagaaacgttatttttcctggagttgataatttgccttgctttttcatttgcctactttttttttttaagtatcataatattttcaacatctctgctacatgtgtatggctattatttttcatatgctcaaaagcatagattattattttattttctagagagctccttcttagacattctgttgttttctccagttttgacatgtttctccccaggcctgctgcacacacgtctgtctggaatttctcttgagcatcttcctgagacttatcttcatccctgtttacttcttctatctttttttttttttttttttttttgaggcagtctcgctttttcacccaggctggagcacagtggcatgatactggctcactgcaacctccaccttccaattcaagtgattctcatgccttagcctcctgagtagctgggattacaggcacccaccaccacacccagctaatttttatatttttggggtttctccatattggaccaagctggtctcaaactcctgtcctcaagtgatctgcccaccttagcctcccaaaatgctgggattacagatgtgagccactgcacccagcctgtttcttgcatcttatatttacttctatttactttcttttctggtgaattatttccatcaacatttgctgcaaaaggagtacacataggcc

SEQ ID NO: 31834 - DNA, 1050 bp, Homo sapiens
gcctaaattatttataaatatgtatttaatatagataatagatgtattagcaaatccatgagggaaaatcactttttggctgggcacggtggctcacgcctgtgatcccagcactttgggaggccaaggtaggtggatcatctgaggtcagtagtttgtgaccaggctggccagcatggtgaaaccatgtctctactaaaaatacaaaaagttagccaggcgtggtggcaggcatctgtaatcccaactactcgggaggctgaggcaggagaatcgcttgaacccaggaggcagaggatgcagtgagccgagtctgcgccactgccctctagcctggatgacagagtgagactccgtctcaaaaaaaaaaaaaagaaagaaagaaaatcacttttcaactcttacaccagtgtttagaatagcagggaaaagttatattggagccatactttatgccaaaaataaaaccagctttcaagtgagtgacaggattaagtataaaaaatttaacagattatagaaaaccacatgtaacttgagtatcagatctagaaaatttttttattgatctttcagataaatgatggatgtttatataaaattttacatctctttcagagtgtcatgtgattacatgtcaagaggaagcaatgggggaaatggcaatacaaagtgattttatttgaattagtaatactttaaagataaatataatctttgctgacctctttttctgggtttcacaaacaattaaagaatttcacatcctttagcagctagattgtttttccttctctgaaaaagaatgcatgtttgctgtattaaaattataaactaggtataaccttgtaaaatatcctaataaatatacatgttcaaatgattatatatgtattgtggttatgttgcctattagtatagtaaacacatacattctgtgaaacccttgtaaaattttgcatgacgataaattgctaaggcactgcactagttgaatctcacatagtgtaaataaatatattcagttattgatggtggcaaattataaac

SEQ ID NO: 31835 - DNA, 1890 bp, Homo sapiens
agcgagcctctcacctcagcctcccaaaatgctaggattataggcgtgagccaccatgcccaacctaaccttttttttttttttttaaagaaaattatatgtaaagttacttttacatgacttcttgctacagcaagatattaattaaccgctgtattatcttggcagtcgagttgaactgaaaagattatgtgaaattttcacaagaatgtttgctgaccctcatggcaaggtatgttttagtatttaagattatttatttctatagggtatcatttgtatattgtcaaagcagaaaaactgtaggccatttttattttattgtcccaaaatggcagtaatattttcaagcataattaaaattgtttggtatcatacgtaatttagaaattaatctctggtaactatttgagcttctccaatgatagatggtctaagactgaaataaaggggatacagttacaactcaagtaatttagtcaagttggtgtattttgtgttactaagactgttttagtgtttgtaaaagacataattggggtaagttgaaaaggtttttaacattttattttgttttcgtctgtgattaattacagcattgatgtaaatatgtttcaattttgaaataataattttgtagaaaagaattgtcattaacacaaaggcacaaaatgtggttccagccatagtttggtagtaatataagagacatttcttacattgaagtagtccataaaaattttcagaactttgttcatttttaatgttgattaaaatatatttatttaagtacttatatgtaatgtgcatgtgtactgtgaaattttggtttaccttgatgcatagtactgttataaaactgtggtcacatattctgtttccagcaatatgtttgataatggtgaaatcttcccttaggataccaaatgtctacaggagactttctaacctaagtgagcgggagatgtggcaaggaaataagaaaaatattaatgaatttcactttactgtttctttttattgtcttcactttattgttgcacatctcatttcctcctcatttttttctatttttagtattttcattacttacaacactacttaaagataatgaaatcccacattgtacataaactaaaatccagctaaagatttaaatgcagtgggggatatacttaattatttaaataaattgcttatactttaaaacaatattttcaaagattattctatcagaagttatatttatttgagggtaaaatatcccattaaaagacaaagaagaaaatacatttggtaagcagtttactaaaatcttttaaagtttgtaacttataattgaacatgtagataactataccattctagatagatattgctatcactgattacagctgttagtcttactttaatgtaaaaatttctataaatcctgaacagattaactgttgatatttttagttggcaatataagccaaaggacaagacagttatttgggttaatttgttttattaaacatttaaattaacagtctgttcaactttgaaatatatagttattaagcatcttcagtaattcctgctactggaagatataagaccaaagctagattatttcttgaagtcacagtttttgactttttgttaagtcagtaatgcagtttggttggatgccatgatgtatagtgataaagacaaacttttttaaaaaagatcaaataggaaagctgagtttaacactggtataggaacttaactgagcacaaatgtttggcctctcttaatacaggtggagaaccagctactattttccctaggattgcatcagatttctcttcttagggctttatagcaacataaaattcttatctacccatcttgtttgtttga

SEQ ID NO: 31836 - DNA, 1864 bp, Homo sapiens
tttgatgaattaggtccaggttatgggatcagccaatcaagtcgactgtcgtcttctgttagtgccatgcgagtcctgaacacaggttctgatgtggaggaggcggtggcagatgccttggtactcttctccattttcttatcattataaatgttccaattacgaaactgttgaatgagtaggccagtctatccatgtgggaaaggggttggggaaaaatcagtgattaaatctaaagataaaacgtgggcagtgtaaaaagcagaatataattaattcttgatccttattaatcagaattttataccagggccagtattactgatggcctatcagaaatataaatatagatgtctttaatatggtaatgtgttttatacactatagtatacttaagggagataaactatataaatatgtacacttaaaatcatgtaatttcaactctagcttaaactttggtatttaggaattattttactttggggctggattttgtttagtattttatctgtgttttttgaactaaaagaaagtacaacctcaaggcaaattataattaagatatattatatcttatagttagatataattctttatgtctgacacattaaacagtgagatttaaaaacatattctacagatccatgatagcttgtcagaagattgcaatacatatatcgttgtttttgtcacttaaaattatgtaagaagtagcatttttaaaaatgtatgtaattggctttggctaatttcccaagtcaattcagtatcacttcctctttcagattatgatattaatcctatgtttgagaaacatttactcagcttcttacccagaacttgtaagaggcctcatctttgttttgaaattaaaaaaaaatatgcttcctaaaatcatagatcccatcttaactagtgttgatataatacagtgtttgccacatagatttgaaaaggcaggtttttaaaaatattcattggtaatagctataatttattgaatatcacacgtgtagttctgcgctaaccatttcgctgtgctgaatttttcccgttacttcagccacttgattattttttataaattaatataattaagtagggactttgttctcttcaacatgggatatattgatcacatcttgttctgatgatattaaattaatgagatgtttttgatttgctattcctcatccctgtatctcaaatcatgttttctgggttttttaaattggataatttaccagttaaattctgcttacataaatgttacgaattgattgggtttttcttgaactattacttagaacactgagatggtgtgtttgaattatatgaggaatgtttaactaccaaggctaaagtttgactcccagtaatctgattctgaatacttccattatttgcagagcacagaagttccacttacaactaccaatttttaggaaaaaactttccagctagtaagcctaatttgtgctggagaaaatcatagaaatacacttaactttggaaatgacaaaaggatccaaataggaagaacatttaggtttctttgagaaaactggttatgggaatattttttgtagcatcactatttctctttgaactaaagaatattgacaagattaaagacacagcctgctaataagcagttctttgtacctatgtgtgaaaaaaacgtaatgtttctgatcataggcattgttaatgcctatttcactgtgctgattagcaaaatgttcttcattattttcaatttttctctttaaaaatttactgctctcagctcttaggagacatacggactaaggtatagacattgctattttctgacatcttatgataccataactttttt

SEQ ID NO: 31837 - DNA, 1081 bp, Homo sapiens
agatcatatcatattcttccctgatcttgtatatttttagagtaacttaatctttagcagtatatcatagtagttagaagacgtgtgcttccatatgtgctgcccagaccagtattagcatcatctgggagctagttagaaatatacaatctcatatgccattacagctctactgaatccaatctttaacaagatcatcaagtgatttatatcacagttaagtcttgagaagtacatactggtttagatcatagatactggagtctgcccaggtttgaatactggctctttgaggttatttgaagttactgcacttctataatttcatctgtaaaatgaagaggagaatagcatctacataggattgttgtgaggattaaatgatgtagcatatttaatagacataaaatattgcttagccctgaataagcactatatatgttggctaataaaattgtcattattttttaattttttaaaatttaaaaaaattttaaatactgcagatgatccttattatttttaatcaaatgtcaactgaattttagactgcttttgtgtacttctgtaccttgttattcttactgccttcagtaaacagagaaataaacaatgaagttaggaaaattgaagcataaagataaccaaccaggaatttccatgtccattgtctaaggataaaaattaattgtgagatattagttcttttctgaaacaatactgaggctgatcttagggcaaagactcaaagggcttttttttaaaaatacttaagagacctccttttcaggtacattgtaagtaaggatcacttcactggaaaatagaataattttttgcatttggcttttcactttgaaacccattccataatcctccacatcttctcctaaattgtgaaaacacagtaattgactttcttagaccaaataggactttaagattagaagactttccctctgtaaaatcatttgggttttatattggagggacttttgtttgtttgcttgcttatttatttgaatgactatatgttccattccgaattcttttgtaaaaaaggtattatgtaatttgtatg

SEQ ID NO: 31838 - DNA, 1067 bp, Homo sapiens
aataaggtagagaaatattgagaaaattgctgaagacttagttgtgattgaaactgaggcattctgactttaaaatgcttaatagtactgtccatttggccacagcctttttgttgaccatttgtcatcagattagctcatggtggtcaggtttatataattttcatgttttcagtgatttaaatgatataagttatctttgctttgtatttcgtagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactaggtaagagaactgattatggaaaattgtaccatgttctctccctgatctctgtgaagacaagttcatataccttaatcatttctattcattcttgttatttaaggatagtccatatgttttaatataattctatattgcggacacacttctgaggaatctgagctgccttgtttctccttttcccttgttctcatcatcgtcttgatcaaagaaacaattcttgaatccatgattgcctgtagaattttcataactgcacttctaccacatctagccactggtttctaagggggtttgggaagggaattggcttgtatctaactttcctgttttctttctcctacttctcttctcttaccaagaatgtgaagccttttggagatctgggagaactgcaaagctctactctgtctaaccaaaccctaaacatatattccaaaactctattcagtttgatttcttcatgtttttatgtctatcaaattaaaaagttgacgttggtttgcgtatctcttcttcatgcttccatttttttcttttgggtagtactgctggaacactaagcaggcagatcgccagaacacaatacaggttgagcatacctaatctaaaaatctgaaatctgaaatgctccaaaatctgaaactttttgagcaccaacatgacactcaaaggt

SEQ ID NO: 31839 - DNA, 1065 bp, Homo sapiens
atgcatttatctgggtttttttcttctcatgtgaatgtgatgaatatttctcctgtgatttcatttataaaggtcagatacccttgagttaagaatatttgatttggtctaaatcccttaaggaaaatatttgataaaatttaaaataatatttgtgttgacaataagcaatatattttttaaatttgtgaacttattgtttacataaccaaattacatttaccaaatgagtacctcagagttttcaagaagccagagaaaagggctgcatttgaagactgttctgctttgagaggtcccaatctggctgatcatgaaaatccctattttgatgaattaaatcaaatgcagggccttttgacaaatatggcttttatgacactatgaacaaaggaccatttttgtctttgttaggaagtctacatatcttaaaacattgaaatactgtttttaacagagagtattcctccaaatttgttaaatatggctcctattcttcaattctgagatgagtctgatacagaaagattttttgtcacaggtgatctgtagagaaacatgacagattaagtgttattagtataaaatgtgaactttttacttaagggtttttttggttttacttaaaaactacccatttggaaacaacagatggtcttttgattttttttttattagaaaaatgacacaggcttattgtaataagtgaaacaatgcagaaaactacagagaaaaagttaatagtttcctgcctattaaagaaacaaacttttgttgaggctaagatgggaggattgcttgagtccaggagtctgaagttacagtgagctatgattgtaccactgtgctccagcctgggcaacagagtgaaacgctatctctaaaaaaaataaaaaaacaaacttcattttagagtatatccttttctgtgttatatgtatttaaacatatatgacaagatatgcacaattttcccctactctttttgtaaaccaaaaaaaaaaaaagagagagatcatacttgatacattacttagaaacttgcttttttttttttggcttaac

SEQ ID NO: 31840 - DNA, 1037 bp, Homo sapiens
agcatacacagattttctgcatcacactatcatttattgacatttagtgtcattttaagttgctgttcaacttttaaaatgtttgtccttacttatgtttatttgtgtttgctagtgcattgaatagggaggcgggtttcagggctgtgttcttaacagtttgaatattacaacccgcctagcctagtaccttataatgaatcggcattacaaagtacattgacctttctgaaagttggagattttttaaatgctttcttataaaatggaatatcccttaaaattatacttttgttgatatcaaaagagttttatttttcatgttgtcattaatgttaagatgcttaaaaatgaaccttaggaaattaatttccttttaattagcaggtgcttctaaggaaggaggtgctggagcagttgatgaagatgattttataaaagcttttacagatgtcccttctattcaggtaaggctaccagtggcactccccgtgaatattgcctgtgtgcctgttcatataattatttgtctctgtccctttttaagaattcttttttccttatatagctatataaatgaaatatttgacttattaataccaagccattatttgttggtacaattagattttcaagtgatttttcagtgaggctgaaataaaattgaatcatattgttgaatcacattacactgcagtgttcagattcttaaattaatgagttttgagctcagagaattagattagttgatgatagaagtttggaagtcattcatatagatataattgaagtaaagtggacacatgcataaataagagtattatttccatgacttaaaaatacacataaatgttatattgtacataacattctacaacctgactttttactcagtgctttttttttatattttttcgtgatgtaaaatttgtgattctagttcattcatttggattgatggatggtattctattgtatgtacagaccacagtgcatgtatagtttgcttctaatttttggctattccatatcatgct

SEQ ID NO: 31841 - DNA, 1050 bp, Homo sapiens
aactgctaaattatgatttgttttcttccagttacttttccaattatttttacatatacaaatattttcttggtagaagaacaaaagtggcactattcattgtgtagtttttttgtaacttatattttaccctaagcattttctcgttgtcttaaattattaattgaaaattattcatggctaaataatgcctaggttgccatgagccttttctccttctataaaccgtgtcagcattcttttatatatatctttcagcacatctgcaatgatttctttggaataaatttctaaagttcgctggatcgaaagattcagggatttttagtgttctttcagtttggcaaagtattttccagaaacaagcccatttcagttctgaataaacaaattcttttttatgttgcattaaaatctacctccttgtagcatatgcagggaaaatgaattatttgtcaacatgctttcagatacttgaagattgttctatttctctttatgactattctgttttctggactatacattatctttcccatgattttacattgaatggtggtgattcagtctcaatgtattatttgctactccgaggtatataataaatagatagatgtgattagcttctaattaaagggatatagtaggtggaaatgtataatagtggcgtaagccagacacagccactgggtttgacaaatctcttttcaagtaagattaccaaaataaaaaaaaaaaaatacagtgagcttctttggaatcgtgacttaatctgcttttgtagtttgggaatgtattttacttcttctagagatatatatccagattagggctgtatgcaatttttagcaaagtatcctatccagttaattaaagctcataagtcttgtgtttaatctttagtgtatgttaatttgctttgttctttggccttcgtatgccacccttttcttctcatattgtattaataaatgtgtagcctttaagccaaggagacttgaaaaaaaggctatggctaggttcatacagtatatgtatcattgctataaa

SEQ ID NO: 31842 - DNA, 1572 bp, Homo sapiens
acctcatactggaacagcccatgtcttgtcggtagtagaatggatattaataaattgtggtactttcacacagtagaaaactatcagcaatgaaaatgaatcttccaaacattatccttccaacattgagtaaaaagaagctagataccagaatacatattgtatgattcattttatataatgttcaaaaatgaacaaaaccaagtgttagaattcgagactagttagctttggtagtaaatgtagacttttaggagtctcgagggtacttacacgatgctggtaatctgtggatctggatactggttatactggcatgatcattttgtgaaaattaattagctgtgtacttatgatttgtatactttgctgtattttgataaaaactttaaaaattaatttcccagtagtttgagaaaagagttaattttttttttaatggtagggacatatttactcttttcaattcttgtgtgtgtgtaggaacagaatactgtttccatgggaacttctggctgctctgtgttttagtgcttaactttctgtagatttgtatgtctactctttcttagctgcattttttttaacataacagtagcaaagaagtttatttggaattgtattagtgtttttaacaaagccgtctatgtactgcataggttttaagcttattaatttatccaaactgactccctaatagtgttatgctaaaaaaataattttttaagagtagaagataattttttcctgcaagttgtattacttaaaaacactttctgaaatagaatgtgactttagagtgtctatttgattcttttttcttttaataaataagtcttaaaactttcttggcatattttaagatatatttaatagttaaatagttatatattaaaaatagttatttttctttaaaatatttaataatatctctttataggaattatttaattctaggtgattgggtgtttgtttaagtaaagaaagttcattgaaaggaaaagattctggcatattcatctgaagcgtgtggtaaagctgcttctctgcctcgcccatgttgtttgtcatggttgatttgtgcagggtcctagagaaaaccatctcttctcaggagagtaaaatacattgtgtgtgtgtgtgtgtgtgtgtgtgtgtgtgtgtgtgtgtgtgtgtatgctgggagatgtttcatttgcatataagtagatgatactagtgtggtcattcatattccgaaaggagccttgtagaatcatttatgaaaacaaattgttttgtttggtttctatggcttaaataaagagcagattttaagattacagagttaattatgcacagtaatgagcactgtggcagtctatgctttactgatgcaataagcatcccagcagaatgaatattgcataaaaccttattttctatttatataaattttcatgtcaaataagaaaaacagatttctaagcctttagttttgaatgcctttgaaattttgatatagaataaggattatagctaatagagaattttttagatgcatggagaatttttacctttcatctggcagta

SEQ ID NO: 31843 - DNA, 1051 bp, Homo sapiens
agtctcatttaacgggtgcagggggttgggcaccaatagtaacatatcctcaaacctgatgttgctaataaacttgaatcttcaagaaaaggtttacatgttttctttgtacatatagaatagtacaattgatgttcttaaagctgcagtaggctaaactgtcttgaaaatttaagtagttgaaatgactaaattttgtaaaggttctaaataaacctgattctgagcctcatttattatttagtttgctgttatggctattatggcatgtgttatttaatttcattaataccaaataatggtttaaattgtgattgtcccgttacttcattggactgttcaaagtcttgaatttttaagggacccctttaaataaaagggcaaaagtcttcaaatatatttttaactagtcagttatatctacctagaaatttcaagatactttatcaattatcatggcctctattaaactttgtatagaactgactttatttcttataaataaaatagttaactaaggttgtgctgctgagaatactgcatctgcatgtgaatattaaaatatagccagttgtcttatttttgaagtccttgaattttcaatttctaataattttactaaattttttcattttagtttaaattgaagatgttttaaatttttactatttgattcttttacttctgaaagcttgtgattttctttagctctgggaagttttctcctattattttttcgtaagcttttcccctttattagtttagtcttttcttacctaattgttattcagatattgaacttcctgggttgatcctctgtcttttatgttttgtcttcgctttcaagttttatgtctttctcttattctatattctgggagatatccttgactttctcacccaatccttctattaaattttaactttgacaaacaaaagtttaaatgtgtccaagaacttgctttttcctttttccgtggttccatttccacaaaatcctgtgtgtgtgtgcactcatgtgcacatttgtgtgtaaaatgttgtgttccct

SEQ ID NO: 31844 - DNA, 1054 bp, Homo sapiens
attaattatttttaaaaaagtaacaacctctgacaaagatcagagggtaacatttcagctaattctcttcttcaaaaatatatacctttataaaaaatttaaacaataaagatatgtatatagtgataggctgtcttgggatttatatagttcttaacagtttgatatatactcctgcgtattagtctttgtcacatccagtgcacatacactataccagaatcatgtaaacatataaaacatgaacatataaaacaaatggattatactgcccctacctgatgttttttgtttatttacgaacttacaaactttgtttatttacgaatatacaaatgtcatttccctttcaaaattcaaacaatgaaggtaaagcaaaaatcccttcaaaaccaccttcaagccccgagcccaggtgtaaacagaggagaacacttttattaatacgtagcatgtctttttctacctgttactgtgcctttacatacatactaaatatcaaagtatatggttttgctttgactgtgtttacgtaaatgataccattctgaatgtaattttgccatttgctgtgtttactcagtatgggatggagctttttaaaaaaatactatcgtgttatttcgcatcattttttaaaacggttgcatagtattctataatatggacatatcataaccattttgtcttctatagaaatttgtttactatatataatttttctaaatggttctgaaataagcacctttgtacaaactacatgtgtttgtgtatatacacacagatatatttcttaaaatagtctggacgtggaatttctgaatcaaagttttcatttattttagaattgtgttaggtatagctaatttgctccaaaagaggctttaccacatacactcccaccagtagtgtctgctgtcctacattcttttcagttctggttattattaaaatttgtctatcagatggttgaaaaatatctcaccctttataaacatctatgctttctgataagattgatcaccttcatgtgtttggttatttatatttcctt

SEQ ID NO: 31845 - DNA, 1050 bp, Homo sapiens
gtctttgaactgaaatgctttctatatgtaaatagttgtatttgttgaatttattggaagtaggaggtgatgttaaggtttagaaatcctattataatgaattcctaggagatttcaactaaaaaaattttttagttcttactgaaataagccaataatttatttcaaaaagtatctgtatctataatttactggtaagaaatgaccacgatgaggaccaaggcttaagtaaggttttaggaaatgaaatttgacacatgtatatgggtgagtcagagaagaacatttggcaactaaaggcaatatgtcagtgaccctcctctcttcctcaattctctaagtcacaaatttaagaatgaatcatagcacaatatattggaaagagaaagaaaagcaaactaaaaaaaaagtgctgtcagttttatcccatttcactctgaagaaaatttgtatatgaatataaaagtatcagaaaggatacagttaataaatacattctctgaatgatagaaatgtggttttttctttgttcctatttatatttcctaattttcttttataatgaatgtacattacttttgtaataaatacatttttaactaagaaaagtgatagcagaagtgcagaaagtgtaattatcctgaatataaaattagaaggaccagtggaattggtgttgtatgaaaacagtcgtgtgaaacagggatagcatcagattatcagtgatattagccatctctttagtttttgatattttatattttattgtttgtatgtttgccttaagttactttggcatgatttttatatgcctttaaaagatgtcttggtgactgagtagacttattatgaggttgaaactaggatatttttgatggatttggaggaatgattttatgatgaaacatgagaaactgctttgtgtaaaaattgtcttttcacaaacatacctgcaaatatgtagagtcctacctatatgtgacttctttcaactgaagagagatgggttttgtgtcttctttcagtgcgttaattgtgaaagagagttgt

SEQ ID NO: 31846 - DNA, 1032 bp, Homo sapiens
ttatttaggattggtatttagatggtgaaaaagaggcttctagttgttttcatattggactgacagtggcccattgaagagcattatatatgctagatatgtatatctttgattcttcttatatatcccataggccatttttggagattctgagccatcatgcttttcctagagcctctggactcctttttttgctgtcccacacattttttcttatctgtctttggctctttgcttctagcagactagagtaaaaatctcatgctaagtatttaagggtcattactaaaatgaattatctttccatcgtctcaaatatccttcagcatttttaaaaataaagaaaacccttataattagctattttaaccaacttagtttttccctccatcattttagaaggtaatagagttattttagtatgcatagagttgttttcttaatcttgtcctttttttttttttttttttcttttggagacaaggtctcactctgtagcccaggctggagtggagtagcgcaagtatagctcactgcagcctctgtctccaggctcaagtgatcctcccacctcagcctcctgagtagctgggactacaggcacgtaccaccacgcctggctaattaaagacaaatttttttttatagaaacggtttcaccatgttgcccaggctggtctcgaactcctgggctcaagcaatccacccacctcagcttcccacagtgctgagattacagttgtgagccaccgtggcaggtcttgtacttttcaaacctaaaatgtattgttttttttaataccctggaaatttgcttcacgtactgtgatgcagaacactttgtgacagtatctctttctaacatacctttactccgagctctcttgttctaaacaactattgctttataaagtagaatgtttatattcagagatacacaaagaggtcaggcattctggtgtatttcattacagaagcaggtagtgagagtagagaaggaccattccataataattatacagtattaataaa

SEQ ID NO: 31847 - DNA, 1105 bp, Homo sapiens
tcatgcctgtaatcccagcactttgggaggctgaggtgggcggatcacttgaggtcaggagttcgagaccagcctggccaacatgttgaaaccccatctcttctaaaaatacaaaaaaaaattagccgggcgtgatggcgggtgcctgtaatcccagttacttaggaggctgaggcaaggagactagcttgaacctgggaggcagagggtgcagtgagccaagatcgcaccattgcactccagcctgggtgacagagtgagaccctgtctcaaaaaaaagaaaaaaaagaaaaaaaattaaagttaaaaaaagcagcatggcacatgtatacatatgtaacaaacctgcacgttgtacacatgtaccctagaacttaaagtatagtaaaaaaaaaaacatttcaatcgctgtcattacctgctttgaaacatttatatgttgttttaaaaattaaaatgaactaaaattagtttctttttcagagtttttacagcaagaagtaacaaagagttaaatgtctaaaaatagtgtttatattactgatgtaatactatcatcataataaagaatatttataaacataagtgtgggtaataaaaagaacactaaaaactttcagatatgtggaagttagggtgaagtgttctgagtagagccagaaatgatgtttcatgttttaataattaactgagaaggttttcagatctcttctctagattgggtctagaaggtttgtgtaggagttggagttattttcatttagttacatccctatgtgccttttttctcctggtgataattggaataacatatatattcaggtaaacaatatgaacactgaattgaaaatttacaaaactaagggttggattcagctctgcaaccttcagcaaaatctgtcacctctgaatttctttttccttagctataaaactcagggtttggactagacttttaaggtacctcccttcttgaaatactgtctgaaacaaccttaaggcctatctacagaagataggttaatttaattgtggcaagttgagataacaggctactatgaagctgtttaaaataaatgagggaagtctattagtatagatgggg

SEQ ID NO: 31848 - DNA, 1203 bp, Homo sapiens
tgcatttaatatctatagtttaccaacgatgacactgcaagcattgtgtcttctgatcgtgccagtcgtggacgaagggagagtgtggtgagcatgatttgcatgcaaagaaataagatgagttttaaatgacagcaatgcatgatcacatgaagtctgttggaaagtgaagtttgcatttgacaaaaagagcattttcctcaaatttagttatataaatattttgccttataaaacatgttgagaacacatattctctgtgggctgtgcaagctttcattaataatttgcctttttacatctcttaggagtgaatcattatttgaaaagtttttactttttcttctttgttgctgttttatgcacatacatgtgtgtgcagttcaccaaagacaaatttcttcagcaaaattaatgtttccatattgtataaaactcataactatggattacaaatcatgttaccattaattgctttctatattgttgtatttagatttaaccagtgtttatccacctgttaagacctgtaatccagtcagggtggctcatgcctataatcccagctacttgggagactgaggtgggaggattgcttgagcccaggagtttgaggctgcagtgagctatgattgcatcactgcactccagtgtgggtagcaaagtgagactgtgcctctcaaaagaaaaaaaaaaaaagacttgtgaacttaagaattgctaatgacaaaatttaaaaattctagtcttagacattcaattggataataattgtagaggcaacaaatagctatgttagaatacaaataatataatttcaggttattctttaatgaagctttaaattttacagaaaactgatgacatttttgttatatttaagaaattgatttggaaaatacattgttccggatggtatgtcagcttagagctagaataaagagcataagaggctgtaattcctttaagaaaaataggccatttaacatgagttatgtgaaagattataaacccgagttttcatagagaaggggaacattaaatgttggagagatttgttaccatacattcatttatttaattaaagccgttttagttccttagcaaagcaactaatgctcacgctcacaactgaaggagaaataatatgccacaacacctaaaaacaccttggaacgcagtggagtggaaagggcagggact

SEQ ID NO: 31849 - DNA, 1050 bp, Homo sapiens
tggctcacgcctttcatcccagcactttgggaggctgatgcagcagaatcacccaggagtttgagatcagcctgggcaaagtagtgagaccttgtatctactaaaaataaataaatacaaataaaataaattagctgggtgtggtgctgcatgcctgtggtctcagccagttgggaggctgaggtgggagctgtccgggaagtcgaggctgcagtgagcgttgattgtgccacagcataaaaacgaagaaaaagtgatcttgattgaatcagagcagtagggatacattgccttttctcattggtggagatttttactgttgcatgtatttagttactatttatataccagtagccttggtataattttaatgaatttaatttttaaaatatacttacaattttgtgttttattatttactattacactgtttaattctattgaagaacccatcaaaggatataactgggacactttggagtagagccagtacacccaaaaggaaagacactatggtgtgtagcccaggaaaatgtgtggtattagtgttatgcattcacttttgactttcagtgtccttgatatttgagtaataggtacattctaatagagattgacacttgctgaactttgttcactgtatgtactttctttctagtttgtttcctaatgaaaactttcaggcaagtttgacagttaaaatttctttaaaagattacaatagcaaattttggatttttttttaacttttaaagttaaaaaaaattttcttttttctctatggttatagcatcaaaaatttggaaatgagcccttactattttcacttttacctcctttgatgaatctttcttttctttacaacaatataaaggccaacttttacttattggggtgactttttttgtttgcccattgttctagtagaaattggtatgcccaaattatggattttcctaccagatagattcaacatttttttttaaaccagctgaattctacattatattttggaaaaggaaaattgaaacaggttatttccagtttggc

SEQ ID NO: 31850 - DNA, 1030 bp, Homo sapiens
gtagaaccagcaaaatttgaacatttgggggcctttaaaacaaatctgcaaacaaaaaaggaatctgcagttaaaccgataataactatataccagaatgtatataatcaggatgattttatttttatggcatttgtatcattaaacaaatttaagatataactccagtatttaatttcattatgttgattttgaaaatttgttactatgggatagaataaaactcccagtatttaaaaacgtcaatgtataaatgtaaaaattaataaaagttttacatcctagaggagattctagtacattactctctgtgagtgcacatctaacacagtttaaatgtttagactttcctggaaacaagtctgaaggctcactactaatttcatttaaaagaaatataattgagataaaactttttctgttttacccaaataatattgtgagttctaagttttcatcaaattatttgcttttaaaataatttttccattaagctgaattgttagacaacttttgtcctctgtagatggcctaaacactgacctaaatttccttgtggtttgctatataattttggagttatgcatttctcagccagttatttttaaaaacttaaggccgtgtactaagaggtctaatactttttgaacgtagtatttgatgtttgaacattagcagtacctgaatgtgaggtggatatatttatggtcttatgctgcattcttaggactttaggtttctccttttgtccaattaactttcatatactatctttttgaaaggtggcttaccagaagctatatgggctggaaatgttggtgtcagtgctatagacattatgtataaaaataaaaacagcaaaggtagttcaagactgtgaatggtaggattgggggagggaagattaaatcaaagttaggaatttagaattgaaacaatctgtgtctattagttttgtataatgattggattattaatagtgcagaacattagtagctgcttggtcattgctttatacattgaaatacaa

SEQ ID NO: 31851 - DNA, 1031 bp, Homo sapiens
gaatctagggaggcagtaggccttgctgagctgcggtgggctccgcccagttcgagcttccctgccactttgtttacactgtgagcatagaaccacctactcaagcctcagcaatggcggacacccctccccctgccaagctccagcatcccccggtcgatctcagattgctgcgctagcagcgagcaaggctccatgggcgtgggacccaccgagccaggcacgggagggaatctcctggtctgctggttgcaaagaccgtgggaaaggtgcagtatttgggcagaagcgtaccattcctgcaggtacagtcactcacggcttcccttggctaggaaagggaaatcccccaaccccttgtgcttcccgggtgaggcaatgccctgccctgctttggctcaccctccatggctgcacccactgtccaaccattcccaatgagatgaaccaggtacctcagttggaaaggcagaaatcacccatcttttgcatcgatcttgctgggagctgtaaactggagctcttcctattcggccatcttggaagtgactcccatgatccagttttatctttgttccacagctaaccattgttgcagcaccacttaataaaaactcagtatttgtcccaatgttttgaaatgccaccttgaatgtataccacttttccatatgcacttaggttgatttccggcctttttattctgttctgctggtccatctattcatgcaccagtaccgcacagttttaattacagaggctttgtagacgttttaatgaatagtagtgctagtctccaatgcccactatagctttttgcccctcagtattttcctagatattcgcaggaatgtttctttttccatataaactgtagtatcaacttgcttagccccagtaacaaaaactgtcctcaaagtgttcttaaaatttagaatgacttctcagcattaaaggtggggagatatcacatgaaaattgtatttctggtttctcttgaaaattgggaagcgctgtcacatgggcttttt

SEQ ID NO: 31852 - DNA, 2054 bp, Homo sapiens
tgaggctgcactccaccctggaagtatcagtgaacagatgctgggttctgatgggacatctgcagaagtcgtgatcagaggctcaaccatcaaaggcattttgaaggctgagtgcggtggctcacacctgtaattccaacactttgggaggccaaggtgagcagattgcttgagctcaagagttcaagactagcctgggcaacatagcaagaccccatgtttatgaaaaacacaagaattagctgggtgtggtggcacacacctgcagtctcagctacttgggaggatcacttgaacccatgaagtcaaggctgcagtgagctgtgatcacatcactgcactccagcctgggcaacagagcaagactgcctcaaaaaaaagaaaaaagaaaaaggcctttctgaagcagaggacctagtgtgtgcagggctgagcactgcatctcagcaaggagcagagctggtgaggctcataccccctgtccttgcaaaccctcagtttcccgacatgtgaaaggatagtgttgtgtgctgtggtatcagaagctcaattcagctctcactttctaggatgcttggaatccctgaatctacctattgaaggcaggctttaaccccagacatgagcagccctgagctcagccatgctgtcagggagagaggacaaagagggaaactataccctggtgaatggggtatagacggagaacctggtagtgggaaaatgcatcagaatctctgtctctaggtacactatttgtaagccaactctagccctccattttacaagtgggaaaactggctctgagagacaataccacttacttgccccaaacccagtatggatttaggcctgggtggagttaagcgagcaaggaaagagtggtgggagatgaagttgcagagtagtgggatggaagacagatcgtggtaaaagccaggtgtgatgggagtcaccggggtgtaagaacaggcagagctgtgacccgctttacattctgtagagactcccctggctatggtgtggaccacagactggagaaggtagagacagacggagtagttaggaggctatatcttggaagccaggagacagaagatagtgactggaaccaaggaccaagtggagaaggggagcacctggtcagattctggacatactttgcaggtagggctgacaggaggccccccaaggtggtttttggtttgagcagctgctaggtggacggtgttcccattggttgaaatggaaaattggagagagcgacactggctgaagtaggaagaaaatcaaaagtccagtttgggatgtatgacatttgaaagcacccagggtgagatattgagtaggcaactggatattccagtctagggttcaagaaagagctccaaggtggaagtataaatttagaagctatggggatacagatggtatttaaagccaggagaccagatgagatcacctaggcatgagtgtagcctgtagcctgaatgtactgtgggatgccccaacatctcatctggaggccaagagagaaggctggagggcagaggcaaatcaggagagagcagtgtctgggaaggaatgtgattccgctggaaacccgccaccgggaggttggggaaggtgacgactaagaatggactattggatttgacagagggggaaggtcactggtgcccttgacaagagaggttccagtggaggaaaaggacatgcacttggttaaggagggttcaagagagagtgggaagagaggaggtgtggcaagtacagacatctattttgcggggcttgctataaaatgggactgaaaatggtgtagtggtcagtgcggaatgtgggtcaatcaagggagggcttttaaagaaggggggtgtctttgcaggctggtgaaaatgatccagtagagagagaatgctagatgatgtagatgagcaaggggattgcaggagcaaagcccgtgagctggcccaagagggtgggaatgcagtgccaagggggagcatcgacctgaagagtggggaaggctgaatttcaggtggagatggagg

SEQ ID NO: 31853 - DNA, 1031 bp, Homo sapiens
gaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggtctgtaaactagttcaatcattgtggaagtcggtgtggcaattcctcagggatctagaaccagaaataccatttgacccagccatcccattactgggtatatacccaaaggattataaatcatactgctataaagacacatgcacacgtatgtttattgtggcactattcacaatagcaaagacttggaaccaacccaaatgtccaacagtgatagactggattaagaaaatgtggcacatatacaccatggaatactatgcagccataaaaaatgatgagttcatgtcctttgcagggacatggatgaagctggaaaccatcattctcagcaaactatcgcaaggacaaaaaaaaccaaacaccgcatgttctcactcataggtgggaattgaacaataagaacacatggacacaggaaggggaacatcacacaccggggacagttgtggggtggagggaggggggagggatagcattaggagatatacctaatgtaaatgacaagttaatgggtgcagcacaccaacatggcacatgtatacatatgtaacaaacctgcacgttgtgctcatgtatcctaaaacttaaagtataataataattaaaaaaacccgggatatagagacatacagaataaaagaaacaaatagaaaagacagagtaaagtagtatattcaaaaacaaaaatattcataaattacattaaatttaaatggactctgggaaaaagagtgtcagtcaagatttttaaaaattcaaataaattctgtttacagaaagccacacaaaacctaaggttaccaaaagggtacaaatacaagtacatagggcacatttacaaaaatagtccgtatgcctggccatagaa

SEQ ID NO: 31854 - DNA, 1048 bp, Homo sapiens
ttttattattctctgtgtctctccgtgtgtgtgttgcatgacaacgtttcagtcaaccacggactgcatatacaatagtgatcccataagattataataccatatttttactgtacctgttctatgcctgaatgtttagacacacagatacttaattgtgttacagttgcctacagtactcagtatagtaacatgctgtgcaggtttgtagcctaggagcaacaggccatagcatatactccaggtgtctagtaggctatgtgtaggttaagttctatgatgtttgcacaacaatgaagtcaactaacaatgcatttctcagaatatatccctgtcattaagcaatgtgactgtaaatatactgttttttctggtatattcttatatgattaatcgatatcttaacctcagtgaccaagctgtcatagatgttagtctgtccacagacacacatgcacacccaacacctgtgcccattgatggtatctaagttcttgaatgctcagtcctgtagcctggtggaaggagggtgctctgaactagaagttggctgatttgttttctagccacttatttttctcactgacttcttgggagagcctggccaagtttctcaactttcacagcctgccttaatctgcccatgagggaaaggggactgatgatgcaaattgctttgcatttcccagggagactgggagattgggagtggtggaactttccaagggagaagggaatccttatttgtacccagttttgctcattgccctcacctccaacccctaggagtctttagccacatgcctgcagcagaagcagcaatgtagtgggtgctcctgtagccaaggtgtgcttttcttcttttcatatatttatttatttttctcagcaaccctatcattaggtactgtgtatcttacttttaattgtggggaaactgaggctaggagaggttcaataatgtgtttatagtcatatagctgggcagctggagccaggggttgagcccggggtcagattccagagcctggtgctgagccttatcatg

SEQ ID NO: 31855 - DNA, 1068 bp, Homo sapiens
ctccgcctcctgggttcatgcaattctcctgctttagcctcctgagtagctgggattataggcatgcgccaccacgcctggctaattttgcatttagcaaaattagcaaaatgttggtcaggctggtctcaaactcccgacctcaggtgatccgcccactttggcctcccaaagtgctgggattccaggcatgagccaccatgccaggccagcttttctttatcttggacagaatgacttcatttataagcagcatcttgtgtaacagtcagttttatgtgtcaacttggctaggctataatacccagttttcaattaaacactaatccaggtgttgctgtgaaggtattttgtagatgtggttaacctctgtaatcagttgactttaagtaaaggagattatctttcataatctggatgaaagaaaatcaggacacatatttccctgacaaatacaccttgtttcccttccttaaagggtagaggctatctcctgcttttttctgtgtgtctttgagagaccactgaggcagagtaatgctgtaaaaagaaagtggactttggaatcaggcattgattctgtatttgatcctggatttgtcacctgctagctgtgtattcacctcaactttcttgtttgttattttgagataagtcttgtgctattgcccaggctggagtgcaatggtgtaatctcagctcactgcaaccgccgcctcccgggctcaagtgattctcctgcctcagcctcctgagtagctgggattacaggcgcacatcaccacgcccagctaatttttgtttttttagtagagatggagtttcaccatgttggccaggctggtctcaaactccttacctcaggtgattgcctgcctcggcctcccaaattgctgggattacagatgtgagccactgcgcctggccagtttatgggccttaattagaggtcaagagtgaagcctcccatatataaaattaaatacttagggtagattcagtggctccggcttgtaatcccagcattttgggaggacgagacagcaggatctcttgagcccaagagtt

SEQ ID NO: 31856 - DNA, 1041 bp, Homo sapiens
acctgaatgtccttgttttcagtaccaagggcagtgtactgccttggtactggtctcactctagggctgctccgcctgagtttgaattcacttcttactctgtacaacttgagcaaattatttaacaccgttttagagcctcggttctcccattttgtaaatagataagaatatgcggccgggcatggtggctcaggcctgtaatcccagcactttgggaggcagaggtgggtggatcacaagatcaggagttcaagaccagcctgaccaacatgatgaaatcccatctctcctaaaaatacaaaaatcagcggggtgtggtggcacacacctgtaatcccagttactcaggaggctaaggcaggagaatcgcttgaacccgggaagcagaggttgcagtgagctgagatctaccactgcactccagcctgggtgacagagtgagactctgtctcaaaacaaaacaaacaaacaaaaaaaaagaacgtgcttttcccaggattgttgggataaagggagatgatattcctggaaccccacactctattcaatgctattagtaacagtgaagtagaattatcttcaaaacagtctcttcctcccctgccccaccacaggtcctgatttggggttgtgaaaacatgttcccttttctatccatattactttacccaggatgctccctgctgctcagacctatgtgtcaatccactaaaaaatccagtccatcttcaagggtcaaatcaaacacacctctccttcaggaagtcttttccttttcctagccccctcctctaagacagatgtattcccatgagtctgccttaatatctttatttctcattgtctatagcatcctaattattcatataggatttagctcatcttttggactcttcttcaagggctaataaccttactaaatttgtgagtcccctactgccctttcacccctttcatatttgcccagaagggtcctgacattcaaaatatgattttgaagcaaattaataaatacccaacagctttggattaatattg

SEQ ID NO: 31857 - DNA, 1029 bp, Homo sapiens
cagtattttaccttacttggaaatgatctagatttaaattttaacttagaaaaattcgaagggtatggttaccaaagaaatttgggacacttttgaaagcagacattttaaaatataattattgtttaaaactacatttataaacttttatttcagttacatctatttaattcactcattcttaacaattatgcttggaacactcatgaaaattacatgagacatgagacaaagctgccatcacctcaagttattttcctattatccatcttgacagcacatgcatgtcaggcagtcatgacaatgcaagagccctaaagttaagtacatgagtattgttgacaactcagaagacacaaatgttctcattaaactgacaatattaaacgagtcttattacagatttactcaagtcatgtaaacctgaaaagcatttagactagttcctatatttctaggaattttaggtatactcatttatctctaagccaatttgaataaagcctttaatatttgtagaaaagacctttacaatttttcatttgctcaatattcaaatagtcaaaaatcatgccaacaaggaagaaagtggacagaggggcagagcatataaagttagcagggcttttagaaaaggaatttcagttgactaagacgttcccatgggagaagcaagatttaatagaacagaggggccttaaaaaatgtatgcatagcctgaatattagcttccagttgacttctggccatagtgttccttaaaaaaattcctcctcggcctggcgcagtggcttacgcctgtaatcccagcactttgggaggctgaggtgggcggatcacgaggtcaggagatccagaccatcctggctaacacggtgaaaccctgtctctactaaaaatacaaaaaattagccgggcgcagtggcgggcgcctgtagtcccagctactcgggaggctcaggcaggagaatggcatgaacccggggggcagagcttgcagtgagcccagatggcaccactgcactctag

SEQ ID NO: 31858 - DNA, 1035 bp, Homo sapiens
cacctcttaaagccctacctctcagtactgccaacattggggattaagtttcaacataagttttggaggggacaaaaaaatattcaaaccatagaaattgtttaaaggaagctgactcagttgggataagcgcctgttttggtcttctttctttctttttttttttttttttgagacggagtcttcctttttctgccaggctggagtgcagtggcacgatcttggctcactgcaagctccacctcctgggttcacaccattctcctgcatcagccttccaattaggtgggactacaggcgcctgccaccacgccagcgaatttttttgtatttttagtagagacagggtttcaccatgttagccaggatggtctcgatctcctgacctcgtgatctgcccacctcggcctcccaaagtgctgggattacaggcgtgagccaccgcacccagcctggtattctttcttattccttccgcttcctggaatgccaacacgatgctggaagtctgatagctgccttggaccatgaagtaaccgtgctatatggatgtgctgcagctggtggggcagaataatagatggagtctggggctctggactgcctgtttatggacttgctatatatgagagaagaaaccccatgtgtttaacctcttctcttttgaattttcagttaagtgaagttgaacctaaccctagccgaaagagcactgttgtctgaatgcaaccgcaggacactgagaagctggataagcactctcttagtgctctgtgttggatttgtgtatggcttggatcacactccctaccctaaccttgattccagagagttgggccagctcagggtggggtgtaggaggatacactgtatacactctgacagtatatgtgtctcctcaacattcagaggccacatggcagggcagatgtccattaactatcttgggcttatcacatctctttaataaacaacagtggggacagatagtgccctacaggcatattacagggaagacttgatgaaatttagcat

SEQ ID NO: 31859 - DNA, 1051 bp, Homo sapiens
tgtatttttaatagagacagggtttcaccatgttggccaggctggtctcgaactcctgggctcaagtgatctgcctgtctcggtctcccaaagtgctgggattacaggtgtgagccaccacgcccagctaacattagttttaatggagattcaaaaaatctatttttaaaaaattaaaccaggtgatagaatatttcacttaaaaataatctcatagaatatttcatttaaaaataatctcagttaaagaaaaagaaattaggctgggcagatggctgacccctgtaatcccagcactttgggaggccgaagtgggtggatcacttgaggtcaggagttcaagaccagcctggccaatatggtgaaaccatgtctctaccaagaaatacaaaaattagccaggtgtgatcatatgcgcctgtagtcccagctactcgggagactgaggtgggagaattgcttgaagccaggaggtggaggttgcaatgagttgagatcaaactactacacaccagcctgggtgacagaataagaccttgtctcaataaaataaaataaaaataaaaaaattagtactatactatactgaaatgatttcatttatttgaagttcaaaagtaggaaggtaacaggaatcagaatagtgattgccagggggcagaagttggggcagggattcactgagaaggaatatgtgggcactttcttggggtaatggcaatgcgctatacagagtgtggagtatatggatgtgtgcatttgtcaaaactcatcaaacctttcaaagtcctttggagaaaacttgaaaatgaaagcaaatcagtgtcttaggtataatttccttttaaaaaaacattataaacttataaattgcccttactattctaaaaacatacttttagaaggcaagaacacccaacttaggggcacgacttaagatctatccatttcactgaatagaagttatacctaattttttaaaaagataaaaagacattcaatgaaaatactgactaaataataatcttgggctgggtatagtggcttatgc

SEQ ID NO: 31860 - DNA, 1036 bp, Homo sapiens
accaaccccagctatttttttttttttttttttttttttaatggagacagggtttcaccatcttggctaggctgatcttgaactcctgccctcgtgatccaccagcctcggcctcccaaagtgctgggattacaggcgtgagccactgcgcccagccaatttataacctaagagattcttaaatgccttcagaaccacgaaagattcatttatgaacaacatatagctagaataaggttcaggaaactttttctgtaaagcatcagaaagtaaatattttaggttttgtgggccataaactctttgtcacaactactcaactctgctattgcagtgaaaacagccagagaatatgcacacttacataagcatggatggctgtgttccattaaaacttcattcacagaaactgaaatttgaatttcatataattttcacgtcacaaaataattatccttttgatttttttttttagctatccaaaacgattcttagttcataggccataaaaaaacagatggtgggcagtagtttgccaacccctcatttatttattacatactttcactgagaacaaaggcaggtgtatttttacatttgaattaagcacattaagcctaaatgtgaagacctgtaatagaaagggtttttaagtgggttaatatgttactaagagaaatcacaaagtgttcccccccgtaagtatcttcaaaacaagaagctggaccaaatcacacatgaaagctataacaagacaatttatttgggaaaaacatttcaggccattaaaagcagtatgtgctaaaccagaattcagccacaacatatgcatgatttttaaaatctttttttttttttaactataaagacctacaggcttgaaggtccccttaaactggcaatcagatcctcccaatggttcttaaccaagggtgttaatcagactaacctggaacatctaaaaatacagatggccaagaggttctctatcagaggggctggggaagggccctggcattgtatttttaatttacat

SEQ ID NO: 31861 - DNA, 1049 bp, Homo sapiens
aactttaaaatggtaattccttccctattgcttgtatacccagagaaaaacaacaaaaactaaaaaagggatagagagaaaaggaaaagggcttaagatctttgtttctgcttcgtgactctaaggacccagaccccacaaatgtgcaggacaactctagggcccatggggagaagagtggacagttgtggacatacatggagccagtcaggggcttgcttcaaagtcacagctccccagctgggttgggaatgatggattgagtacttagcatgactctccagccccagctctcacactctttcctggttaggggtttgtatcctcccccgcctgactgtgccgcatcaccacctcttttctctggactctgggccttgtgtttgagcaggtagtttttatttcatatgacagatcgctttttttctctgagtaatatcatgacctccaactttagctaacaactttgctcatccttatcttaggctgtatatgtctgtttatgctgtgtgtgtgtgtatgtatcctaatatgatacatatatattccaacttatatagaaaacagtctactttataattttcgcacatgtcagttcatactgataatagtattttcattgcacctttcaactagaggtagagtcatcacaaagtaccaagggtagcaaaaagatgagtccccaaagagttaaggattttccccagcatctctttaattagtcatgtgcaagtactttattgtacactttattaggtaacttaactttataagaaatggtagaaccaaatgtttacatttggataactttaagtttgtactattgagattgtactatttataaggatgctatgaaggtccttctcttatgtagataatctatataataatttgtttttcataaatttgcatctttatacattgtatttcattaaaacaactttagaatccttatgaccttaactcatgtttcattatcatgaaccaaagtatctcataatagtagcatctgactcatggcaccattttgtaatggggtgaaatggact

SEQ ID NO: 31862 - DNA, 1029 bp, Homo sapiens
ttctctgttgctaagtgcttatcccagagatgttctggttattgtcaccgactgttaatcagatgactctatagactgggaaacagttttcttcaaagttactgtttgacctttgtcttaataatgatgtaaaatctacccatgtattgagtgtttgctgtctctgggctggtcactgactgagtcattgatgtggataatattagaacaacctaatgagaggagatactattaaccccattttagagttataaaatctgaggcataagaggatggctgagtaagtggtggagccaggatttgaagctagatattttagcttgacagtttaaccatcatcatcattgtatatactgtatatgatacatgtatactgtatatgataccctagtatatgaagagttggcaaaatcctctagggatctatttttaggaatgtgttgctgattcgaatgttcttaaccaatctctgctttatcaatagcttcaatatgtcagtctctatttcagtcacaaatatgaattctaccttttctgttaaaattgtctttgttctaaaaaaaattccagaataatatagcatcatcatacctagtaactttctgaatactccagtcaacactacactggagaagttgcattttttgtgtctttaagccacaagtctatgcctgtaggttttcacacctgaaataaacttgctagactcaactgtcttatgatagttaaccctgtgctgtctgacacaactgaaaagtgggctcttctggttaattgaggtatttgaccaatgatactctcaggaagcagagggcagtaagataagctttatcagcaaaactcttccctccacaaattaatctttgttcaactgtttagaatgcctttctgaaaatacagtgacccacatgatattataaacagcagaacatcaagtaaagcctcaattatcttgttttacaagcctgctgaagctcttacttcataatgacagatacaaaaacagctgacttccctagaaacaatacc

SEQ ID NO: 31863 - DNA, 1050 bp, Homo sapiens
agagtataagagaaccatatgctctaggtaggagcaaagcgggtataaatgaatgaaaagtttgatgtactatttttgaaaaaatatttttgtaattttttaagcagtatttttttaattacaaaagcaatacagtttatacatgaatttcataacaacattgttcataatagccaaaaagtagggacaactcaaatgtaattcaattgatgaaggaataaataaaatgtggtataccataaaatagaatattattcagtcataaaaaggaatgaagtactgatacatgctacaacatggatggaccttggaaacattatgctaagttaaataagacagacacaaagcaccacatgatgtgtgattacatttatgtaaaatacccaaaatagacacatagattagtgatatgtggaatctacaaatctacagaaagattgtggttgctggaggctatagagagaggggaatgggtgtgactgctaatgagtatgagtttattttgggaatgatgaaggtattctaaaattgattgtggtgatgattgcacgttctgtgaatatactaaaaagcactgagtttgtacactttaaaatggtgaattttatggtatgtgaatttgttattttaaaaaatcacaacacaggccgggcttggtggctcacacctgtaatcacagcactttgggaggccgagttgggtggatcacgaggtcaggagattgagaccatcctggctaacacagtgaaaccccatctctactgaaaaaaacaagaaaattagccgggcgtcgtggtgggcgcctgtagtgccagctactcaggaggctgaggcaggagaatggcgttaaccccagaggcagaggttgcagtgaaccgagatcgcaccactgcactccagtctgggcaacagagtgagactccatctcgaaaaaaaaaaaaattgcgacacaaaatggaatatatagtgatggttgataacttggaatatacacgagcaaaaagaagaaagtaatgtcttccttaaacatataatgcatagattaacgta

SEQ ID NO: 31864 - DNA, 1052 bp, Homo sapiens
tacccagaagtgggatttctggatcatatggtaattctgtttttaattttttaaaggagcctccgtatacttttccataatagtcatactaatttacatttcaccaacagtgtacaggagttccctttcctccacattgttgccaatgtttgttttctttttttttttttaataataatcattctgacagatgtaaggtgatatctccttgtggttttaatttttatttccctggtgatgagcatcttttcatgtatctcgtggccatttgtatgtcttcttttgagaaatgtctattcaagttccttgttcgtttttaaatcagaatgtttttctgtagtgttgttgagttccatatatattttgtatattaaccccttatcatatgtatggcttgcacatattttctctcagtctgtagcttgtctctttactctgttattttgcagagtgtgttgtgcagaaactttatatttggatgtatctgtctgtttttgcttttgttgcctgcacttttgaggtcaaatctaaaaagttactgcccagaatagtgtcttgtgttttttcccctctgtgttttcttctagtggtttttcagtgtcaggtcttatgtctgagtctttaatccattttgaactgatttttgtatgtagggtgaggataagggtccagttttagtcttctacatatggatgtctgatttacctagcaccatttactgaagagacagtcgtttccctattatatgttcttgatacctttgtcaagagtcaattggctacacatgtgtttcatttctgggctctctattcttttctactggtcaatgtgtctatttttatgccagtaccatgctttttaagttactattgctttgtagtatagtttgaaatcaggaagtgtgacgtctctagcttcgttctttttgttcaatattgccttggccatttgagggctccatatgaatttattttgtggttccatttgaattttacaattgttttgcctatttttatgaaaaatgctattgaaattttattagggattgctgc

SEQ ID NO: 31865 - DNA, 1054 bp, Homo sapiens
tttagagtgtataattcagtggtttttagtgtattcatgacacaataaattttagaacatttttgtcacctcagaaagaagctctgctcatagcagtcactcaccaatccccctaaatcacctctgcctagacaaccactaagctactttgtcgttatagatttgcatattctggacatatcatagaaaaagaatcatgcagcatggggttttttggctagcttctttcagtttgcataacattttcaaggttcatccaaattataacatgtattggtacttcatttcatttgattgcataatttttttttattatatggatatactacattttgtttatccattcattagttgatagaatataggttgtttccacttctggctgttgtgaataatgctgtataaacattcatggacaagtttttgtgttgatatgttttcatttgtcttaggtatatacctaggagtggaattgctagatcatatggtaattttatgattaatttttttgaagaactgccagactgttttctgaagtggatgtatcattttacattgccaccagcaatgtgtatggactccagtttctccataccttctcctaaacttattatctgtcttttcaattgtggccattctagtggtgtgaagtaatgtctcatgtggtttttaaaaaaatccataaaaatgtattatacaagtatttattttttattgtaataaaatataaaataaaatttaccattttagccatttttaatgttacaattttgtggcattaagtgcattcacattgttgtgtaaccattatgaccattcatctctagattctagaagaaatgcactctgctcacaatctcagtcccagaatgccctgtaacatatgtgttgtcccacttctgatcttattagtagtgacgtgcttcatgtcttccttctctccatgtatctttattgagaacctaatatgtgtaagacattatgtgctggattcttttagggccaccaaaatgaataaaacttggtctggggctgggcacagtggctcatgcct

SEQ ID NO: 31866 - DNA, 1033 bp, Homo sapiens
tctaaaattgaccacataattggaagtaaagcactcctcagcaaatgtagaagaacagaaatcacagtaaactgtctctcagaccacagtacaatcaaattagaactcaggattaggaaactcactcaaaactgcacgactacatggaaacagaacaagctgctcctgagtgactactcggtaaataaggaaatgaaggcagaaataaagatgttctttgaaaccaatgagaacaaagacacaacgtaccagaatctctgggacacattaaaagcagtgtttagagggaaatttatggcactaaatgcccacaagagaaagcagaaaagatctaaaatctgcaccctaacatcacaattaaaagaactagagaagcaagagcaaacaccttcaaaagctagcagaaggcaagaaataactaagatcagagcagaactgaaggagacagagacgcaaaaaacccttcaaaaaatcagtgaatccaggagctggttttttcaaaagatcaacgacttaatagaccactagcaagagtaatatagaagaaaagagagaagaatcaaatagacacaataaaaaatgataaagaggatatcaccaccaatcccacagaagtacaaactaccatcagagaatactataaacacctctatacaaataaactagaaaatctagaagaaatggataaattcctggacatctacacccttccaagactaaaccaggcggaagttgagtctctgaatagaacaacaccaggctctgaaattgaggcaataattaatagcctgccaaccaaaagtccaggacaagatgaattcacagctgaattctaccagaggtacaaagaggagctgttaccattccttcagaaactattccaataaatagaaagagaaggaatcctccctaactcattgtatgatgctagcatcatcctgataccaaagcctggcagagacacaaccaaaaaagagaattttagaccaatatccttgatgaacattgatgcaaaaatcctcaataaaatact

SEQ ID NO: 31867 - DNA, 1056 bp, Homo sapiens
gtatattttgcattaagtctgtcatatcgatttttctaaagagtgttggatttttttctggtaggcaataaagttacttttagattattttaactttttaggggtttgctttaaagcttttttaaggcatatttagaagtgcctttattttaggagtaaggctgttctgtttctaaggcattgccattctgaattatttttacaaaaggcactatatattcaacatgacctctgtggtctggctggtgagaactccagtgattccctggccttctgtgagctctgggaattgtttctcttactcctacctagtaactcatttcttaggatttttttttttttttttttttggcctggcctttgtggtgttttttcctgtgcatatgcagattgatttcaaaaatccactggaacctttgtacagatttcccatgttatttttctctgtgtaactctcttctctctggaattctaccacctcaaactctgtttgccttctccttaactaatctagattgctggactctgtataggttcccgctcactgtgtctctgtctgaaaactgcctcatagtagaacacctggtcagtggtaggttcacctcacttatttttttctcttttagagatcatagtcctgtgctaagttatttttttttttaatatttgtctaattttctagtgtttgacagaggtagggtaattgcatatcctcttaatccctcatggctggaaggtgaagtccaagaatatccattttatgacatgtctcattctccttccagaatgttaataacaaaaggcagggaccatgtggctgaacatcaacaacactagctggcactggacacatactgctcaatgagaacttgctaaatggaaatagcgattgagtcttaggaccatcttaaaaaatattgacctcagtacttcattgattttgttttctttattaccatggcttaaaatatatgactgtcatacctaaatttatttaaatgactggatgcccaatttgtcaactgtaaccttaagtttttgtgtttttaaagttca

SEQ ID NO: 31868 - DNA, 1042 bp, Homo sapiens
aagttttttatattttttgtagagacagggtttcaccgtgttgcccaggctggtctgagcttctgagctcaagtgatctgcccacctcagccccctcaaagttctgggattacagaagtgagccactgtgcccagccaggctatttttctttttacacgagtggtacatttagatcatcattgtataaaaactaaaatataaagaaaagcctgaagaagaaaatggaaattagctatgactctgtgcccagagatatgcatagttagcatttattttaatgtatatatttctgtgtatctctctctctgtagttactgatgtaaatataactatcaactatagaccggtcatctctttgtgtggttccagcatccgtgaatttcagttaccatggtttggttaaataactccagttcccctgcaacatggttcagatttcagttacagatttcattgtgtttatatgtgtgtgtgtgtgtgcatgcatgtgtgtagggtatatggtgagtaactgtacaatgtagaaacttgcctggtagatcttcaatcaacaaatcactaaagagatgcgcatcatgatcagtgacctatcacatcacttctttgaaagtctttcagtgatttgtcactttgcatcagctcttgtttagacagcaaagtgggtagttgtgttttcttgtctctcagtgataaactcacatgaccttttacaaaaatggatagttgagagactggccaacaaaaataaaagttcagcaaagaaacaaaatatgataatactggaaatgaaatctgaattaaatataaggggagttagggaagaaatagctgattgtggtaatggtgacctgctgctttctagaattcctagctatgcagccagaggaacttggtgaaggtgagcttgttgacattagtgaggaaagtggttgtgacagaaagcatgaggatgtcccagaggaagtgacatcagtttaaaaaaaaatcgacattaagagaacacacacagatatttcacaacattgaaagcacaaaggataa

SEQ ID NO: 31869 - DNA, 1031 bp, Homo sapiens
taattgaagagacagcccagaagagagtagagcttactatgtgcaattatatttaacacttattttgaagtacctacatttcttttacttaaaaaagtgtgtgtatgtatatatatgtatatgtgtatgtatatatatgtatatgtgtatgtatatacatatatacatacgtatatatatgagtgtatatataggttttcccacccaactgtccatttcactattcatttacatatccatttaattattgatgtacttttatctttgtatccatgcaaaacaccagagaatcacacagagctcaatcacataaaaatcacaagactgggaagtcttgaagttaaccattgtttaatttatacccaatttcattttataaagttttggagttgactaaagatgtcatctagttcacattttgaaagagatgtgcagaaaatgccaaaaagaatcagccatctacccctttcttgtagcagtctagaggaatgtctttaaccttctcaaaagttagattttacctcagtgtccttgctgtttggcagcctgctctttacctaaacccagaatatctctttccacacacatctctgtaaactcttcaagcctcagatccatgttgcattctgtcagatttgcattttaacacattaccttcctcaaatccttcccttgcttagaaacattttaacctgaagattgtagaacacattaacagtatttacccaactattcaagactctcaggttttgcttcttgcctgccattttaagttaatatcttcctgctccattctatggtttcttcattcctggtgagatttacttagtactttttgaaattctctgtttggaacctgtctgtccccactattccttgacattgtattgttattgtctatgttattatctatgtctgtgactatatctacatttatataacactatattactggctgtcttatattattattatattatctatacctacatatatagatgtactaaaaatcatttaaacaattcccaatc

SEQ ID NO: 31870 - DNA, 1071 bp, Homo sapiens
agaactggaagacaatggcctctgctagggatagcattggtgctttgaaacgcaatattaaagggtacattaaaccattcagagcaggtggcaaagacatggaaacttgagaggaaacagtaagaaatatggagtggaggtccaggagatctcacatgccaagtgccaagaacattaggaggagtaaagaacagatggaggaggatttccaattgaggaaatcatagcagtaatcttctggttgaatgtgttctcttctgatactgtactcaaatgagaataaaagaattaaaaggcacaaaaccacaagggcagaagcaaagggaaagatggctaaagcagatgaatgttgttaccttgtctttgtattttggaagttgaaaattaccagactccatcattaaaggcagtgcccgtttattaaactgacagtttccatgggtcaggagtctgggcttcgtataactggatcctctgctcacatctcacatacttgatgtcaaggtgttggctggtgctgagattctcagttgaggctcggagtcctcttccaagctcgctggttcttggcagaattcatgttcttgcagtctttggactgacatcctcactttcttgctggtatttggctggggttcatgctcagcttcaggaatctgtccttcttcattgacagtttactgcatacctgtttactttctcttggtggccagcaagattgcttctcatgccttgagaagcaggcactcattcccctcatgcttcagacatctttgacttccctcctctgccatcagtcagagaaaatgagttttaaatgtctcacttgattagcttaggctcactcagattatctatgtgtcttaagattaatggaattgggactttaattatgtcttcaaactcacttcccaatacagatgctccttgatttccaatggggttacatttcaataaacccatcataagttgaaaatatcatgtcaaaaatgcatttaatacatctaacctactgaacatcatagcttagcccgtcctaccttaaatgtgctcagaacacttacattagcc

SEQ ID NO: 31871 - DNA, 1034 bp, Homo sapiens
aagagcttggaatgtgaagatctaggggaagaactttgtggttcagccttcctgaagtgtgagagatcttagggagatgtgggaagagaaagaaggtcatcagagttggagcacagccagcagggaggaagggacatggaagaacctgggcagttggaagaagacccagctcaggtagggtcatgatattggccttcctaaggggttttagtgcaatgatcattgtcttattgttacttaaagaaaagtgagtgtcgtctatacctgtctatacatgtgtgtttgaggtgcagatttaccagccttattgttgataggttagaatgagtggaagaggaagagacccaggagcaaatacaaaattgcttcctgttgaacagggagaaggaattctacgtgttgttttttggcgggattgacgctcatatattatggtcttttacaatggaaacccagtctccaaaagagttccattcccttccttttaaataaaagaaattactgtttgctacagaaaacttagaagactctaaagaagaaaacaaaattagctggaatctcactacccagacataatttttgttaacatgttggtttatctctttctagttttctgtctgcgtctatgcattttatgcacacatttaccaagttaaaataaaattgtgttgatttttcttgctgttttcatgagtattttactatgtcattaaatgttcctcagggatattaaaagaaacttgttatatgatttattttgtgatgcaccaataatttaactcttcctccactattgaactgtttggctcctgttttttggttgctactcatcatgatatgatgaacaccctgttacatacatctttgtgttcacctctaatagattactcaagtgttatacacatttgtaaggtgctgccttaatgttgcttgattgttctttggaaaggtagattatgtgggtaccatttatttgtaatttatccagcagtcgtttaagccacatgctgtatttttcttataataaaacctag

SEQ ID NO: 31872 - DNA, 1030 bp, Homo sapiens
attttttatcccaagaggcctttttgaactttgccaaacctttgtaccacagaatgttcatctgaacatgttccaagagccttttagtgattaaaatagaaattctttaaatggcttctgcctacttgtcccatttcagtaatgttaaactgaaaatgtctcagtccttcctatatgctggcatttcttatgcctcaccaactccagcttccatctctttctcccatggcctttgccttttttagggggaggagtccctttatatttttctgcttgctctgacctatttttattcctttccttgtaatactctgccagttgaaattatagagcccccattctgtttttaacctatcctcttctagtcctttatatgcctttattatatatacagtagagtttgtaagtactaaattcgtatcacagaactgtatagtgataaacagggctctctagtagcctttctcaaagtgtcttctctagtcccttgttaaagagtgatccctggaccagcagcattgacatcacctagaagcttgttggaaatgcagacttttaggccccatgcagaccttctgaatcagaatctacattttagtgagatctctaggtgatttgtttgaactttatgctttgagaagctttgcttgagaatattagtgtttgatgatgtgttaacaggtaaaaaataaagtaggcctggctatatataaatttggaaagcaatgattcaaacttagaaatattttcagttgtacaatttttcccagtttttaatatgctaatgtgtattgtgattgtgaattctcatgaggggaaagtagtatgcagcattatttcaaccagtcattttctttttctttttttcttttttttttgagatggaggctcgctctgtcgcccaggctggagtgcagtggtgtgatctcagctcactgcaagctccgcctcctgggttcacgctgttctcttgcctcagcctcctgagtagctgggactataggtacccgccaccacgcctggctaattt

SEQ ID NO: 31873 - DNA, 1089 bp, Homo sapiens
ctagtgaataaccaaatgattatttgtaatagtttcataatgacctgaaagagttatcattcctcccaagttgcctaacacatccagaggcatgttactgtcttggtatcataacattatttacaatggtcataaagaaataacatgtatttatttctcacactaatattattttaatctcctttctctataggaagagcgtgttgtgaatcacatggcagcaaaaattattgaaaatgtctgtaccaccttttctgctcagtcccagggctttattacaggagaaataggacccattttgtggtacctattcagacactccactgctgattctcttaggataacagcagtatcggtaagatgaagcatcttttgggggatatgtctgggtatctttaaacagcaagtttgaagaaaatattagaataagaataaatttaatttaatagataggaaactgaaatctcagagtaatattgagagaaataatttgattttcttctaaaagagaattttgaaaacttggaactggaaaaccttgagactgtgagagaatttcaataaaaccttgttaggactatggtattatggtttcaaaaactaattaataagtttatttattttgagacagagtgtccctctgtcatccaggctggagtgcagtggtgtgatcttggcttactgcaatctttacttcccaggttcaagtaattctactgcgtcagcctcccaagtagctgggactacaggcatgcaccaccaggcctggcttatttttttgtatttttgtagagatggggtcttgtcatgttgcccaggctggtcttgaactcctggcctcaagcaatctgcctgccctggcctcccaaagtgctggaattacgtggatgagccaccgcgcccagccttaaaaacaatttagaggcgatagtagaaaactgtggcagtatatagggtacagggtttggtttgttatatttttagtgttccctgacttttccctgttagcatccccattcagattttgtgtcaaatgagtttatcatgtggttcagatgaattcattttaatgttcaagcatctgtgatt

SEQ ID NO: 31874 - DNA, 1042 bp, Homo sapiens
actaattctttttttaaaatttcaactttattttagattcagggtgtacatgtgtaggtttgttacatgaatagattggatgatgctgcggtttggggtacaactgatcctacctcccaggtagtgaacatagtagtcaatatgcagtttttcagcccttactcctgtcccaccctccccacttgttgtagtctctagtgtcttttgttcctatcttctgtctgtgtgtattcatgtttagttctcacaagtgagaacacgtggtatttgattttctgttcttgcttcaatttgcttaggataatggcctccagctgcatccgtgttgctgcagtagtatttcgtggtggatatatactacattttctttatccacttcactgttgatgggcacctaagttgattccatgtttttgctcttgtgaatagtgctacgatgaatatatgagtgtgtgtgtgtttttggtagaatgatgtattttcctttgggtatataaccagtaatgggattgctggttcaaatggtagttctgtttttagttctttgagatatctccaaactatttttcatagtagctgaagtaaattaataatgtactaattctgtcatttggacaatcttgagtatgttccgtaagtagaacctaattttttctgctttaaaaaattagtttttttcatctttctgtgtggtacctgatttattttctgattgtatttgataggttgcaggagtgtgcttgtggttattacactaatttggttaatcttctgggagagaattattgctcatgtcattaaaatcagtgtacccgcttatttgctcattttatttagttccttgtcttactaggtaacataataccttttacttgtgcttgtgaattatcctgagatattactcaaacttgtgttttctatgctttcaaatcattccagataatgtaatacttttcagatagttgtatctgtattatcatctacaattatcattagattgatttatctgtcagatcatattggatcatattgtcatttctca

SEQ ID NO: 31875 - DNA, 1030 bp, Homo sapiens
ggacttgggctacaatgccacctgagccgctgtgctagaaattatctattggcattcagcctcttctctagccccttccatgttcccctgctttgttggggttggaaggctcaaggcttcctttccggaattctctcactgctaggaatttgatgcaacttaggctctaccagagggaagcaccaccaagacagttgggaagcagagaaaagtaaaggctgtgtttcctgcagcgtggtggctgatgggtgggatatggcagacctgagttttctgcagcagcaggacactatgttccttctgctttcttgtcactagctttaatggatgtgcaaccgagatattggcagtaatgttcggcaaggtggcagctgcaatggtgtgaccatggatagaggtgcacccaaacttccagccctccaagccttcctatatttaattccctacactcaatctctttctgtacaaaacacccggaacgttttctgtctcttacactgaagcatgactgatttggatctctcccctcccccatatactgcaccactaggctcaggtggaggaatatgaaagatcacacatttatcccaagaaatgtccaaaaagagactgagagtcagactctgttggttacctactcagcagccatccccatttctttctcagtagatcaacttcccttatagaaccctcaccaatctttgcagctgtggtttgggtatgtgacctaatcctggcctgaagagagtgtgcgaaaggtgggtcctgggatagatgactgtccctgataaaaggagacatatagaggaaattctcctccctgccagtggatggggttctgtgggaacatgatgcttgggcagcaacagtcattgtgcagtcatgagggggtaagtctgaggatgaaagtccacatactgagatggcagagtggacagacagaaaatacctacatctgcggtgatattgctgagccactgaatttgccctggagctgcctccttctagtagacatcaccctgacaggatc

SEQ ID NO: 31876 - DNA, 1024 bp, Homo sapiens
atcccagtacttttcaaggccaaggtgggaggatcactttaggcctggagtttgagaccaaccagggcaacatagcaagaccccatctctgaactttttttttcttttttttttttgagacggagtcttgcactgttgcccaggctggagtgcagtggcacaatcttggctcactgcaagctctgcctcccgggttcacgccattctcctgcctcagcctcctaagtagctgggactgtaggtgcccaccaccacacctggctaattttttttgtacttttagtagagacggggtttcaccatgttagccaggatggtctcgatctcctgaccttgtgatccacccgcctcggccgcccaaagtgctgggattacaggcatgagccaccacgcccgacctctgcaaaaaattttttaaaaaatatatacatatataagactaggtcaaagaactgctgatttttttgttgttgttgttgttgttgttttaaatagtaataccttctgactcagacctgttctttaggaactgaagcaaacattagaacattaactagagggttttgattagttattttcatataagctgtgtactaaggggtggcataaagaggcgattttgagtccctcataggcagagttaattctagtgaaagcgtggctctaattctccttccttgtcctccgtatggactaggattttagcactgtctctgaatacatattttttctccctttttttaaaattaaaatttctgttcttaggacgctttccttctcttccacatacatcctagaatggtttattcttaagaattacccaggccaggtgtggtgactcatgcctgtaatcctagcactttgggaggccaagatgtgtggatcacttgaggccaggagttcaagaccagcctagggaaccccatctctattataataaaaatacaaaaatcagctgattatggtggtgcatacctgtagtcccagctacttgggaggcttaggcatgagaattgcttgaacc
